United States Patent 11,078,247 (RNA ENCODING A THERAPEUTIC PROTEIN) - sequence listing, part 17

SEQ ID NO: 31026 - RNA, 1989 nt, Artificial Sequence
  derived and/or modified sequence opt1 from HDC__Homo_sapiens__NP_002103
augauggagcccgaggaguaccgcgagcggggccgcgagaugguggacuacaucugccaguaccugagcaccguccgggagcgccgggugaccccggacgugcagcccggguaccuccgcgcccagcugcccgaguccgcccccgaggacccggacagcugggacuccaucuucggcgacaucgagcggaucaucaugcccggggucgugcacuggcagagcccccacaugcacgcguacuaccccgcccugacguccuggccgagccuccugggcgacaugcuggccgacgccaucaacugccucggguucaccugggccuccagccccgcgugcaccgagcuggagaugaacgugauggacuggcuggccaagaugcucggccugcccgagcacuuccugcaccaccaccccuccagccagggcgggggcguccuccaguccaccgugagcgaguccacgcugaucgcccugcucgccgcgcgcaagaacaagauccuggagaugaagaccagcgagccggacgccgacgaguccugccugaacgcccggcucguggccuacgccagcgaccaggcgcacuccagcgucgagaaggccgggcugaucucccuggugaagaugaaguuccuccccguggacgacaacuucagccugcgcggcgaggcccugcagaaggccaucgaggaggacaagcagcgggggcucguccccguguucgugugcgccacccugggcaccacgggcgucugcgcguucgacugccugagcgagcucgggcccaucugcgcccgcgagggccuguggcugcacaucgacgccgccuacgccgggaccgcguuccucugcccggaguuccggggcuuccugaagggcaucgaguacgccgacuccuucaccuucaaccccagcaaguggaugauggugcacuucgacugcaccggguucugggugaaggacaaguacaagcugcagcagacguucuccgucaaccccaucuaccuccgccacgccaacagcggcguggccaccgacuucaugcacuggcagaucccccugucccggcgcuuccggagcgugaagcugugguucgucauccgcuccuucggggugaagaaccuccaggcccacgugcggcacggcaccgagauggcgaaguacuucgagagccugguccgcaacgacccguccuucgagauccccgccaagcggcaccuggggcucguggucuuccgccugaagggccccaacugccugaccgagaacgugcucaaggagaucgccaaggccggccgccuguuccugauccccgcgacgauccaggacaagcucaucauccgguucaccgugaccagccaguucaccacgcgcgacgacauccugcgggacuggaaccugauccgcgacgccgccacccucauccugucccagcacugcaccagccagccgagcccccgggucgggaaccugaucagccagauccgcggcgcccgggccugggcgugcgggaccucccugcagagcguguccggcgccggggacgaccccgugcaggcccgcaagaucaucaagcagccccagcgggucggcgccggcccgaugaagcgcgagaacgggcuccaccuggagacgcugcucgaccccguggacgacugcuucagcgaggaggcccccgacgcgaccaagcacaagcuguccagcuuccuguucagcuaccucuccgugcagaccaagaagaagaccguccggagccuguccugcaacagcgugccgguguccgcccagaagccccugcccacggaggccagcgucaagaacggcggguccagccgcgugcggaucuucucccgcuuccccgaggacaugaugaugcucaagaaguccgccuucaagaagcugaucaaguucuacuccgugccgagcuuccccgagugcuccagccagugcggccugcagcuccccugcugcccccugcaggccauggucuga

SEQ ID NO: 31027 - RNA, 615 nt, Artificial Sequence
  derived and/or modified sequence opt1 from HDDC2__Homo_sapiens__NP_057147
auggccagcguguccagcgccaccuucuccggccacggggcgcgcagccugcuccaguuccugcggcuggucggccagcucaagcgcgugccccggaccggguggguguaccgcaacguccagcggccggaguccgugagcgaccacauguaccgcauggccgugauggccauggucaucaaggacgaccggcugaacaaggaccgcugcgugcggcuggcccucgugcacgacauggccgagugcaucgucggcgacaucgcgcccgccgacaacauccccaaggaggagaagcaccgccgggaggaggaggccaugaagcagaucacgcagcugcugcccgaggaccuccgcaaggagcuguacgagcugugggaggaguacgagacccaguccagcgccgaggcgaaguucgugaagcagcucgaccagugcgagaugauccugcaggccuccgaguacgaggaccuggagcacaagccggggcggcuccaggacuucuacgacagcaccgccggcaaguucaaccaccccgagaucgugcagcuggucuccgagcuggaggccgagcgcagcaccaacaucgccgcggccgccuccgagccccacagcuga

SEQ ID NO: 31028 - RNA, 771 nt, Artificial Sequence
  derived and/or modified sequence opt1 from HDGF__Homo_sapiens__NP_001119522
augcaccccgagggcgggcaguucgugccgcagcugcucggccaccuccuggccaccaagcugaagcgcuuccugcugagcaagggcggccggcgcgcccagauccccgacgucucccgggcgacgccccacaccaucgacgagaugcccgaggccgccgucaagagcaccgccaacaaguaccagguguucuucuucgggacccacgagaccgccuuccucggcccgaaggaccuguuccccuacgaggaguccaaggagaaguucggcaagcccaacaagcgcaagggguucagcgagggccugugggagaucgagaacaaccccacggugaaggcguccggguaccagagcucccagaagaaguccugcguggaggagccggagcccgagcccgaggccgccgagggcgacggggacaagaagggcaacgccgagggcagcagcgacgaggaggggaagcucgugaucgacgagcccgcgaaggagaagaacgagaagggcgcccugaagcggcgcgccggggaccugcucgaggacuccccgaagcggcccaaggaggccgagaaccccgagggcgaggagaaggaggccgcgacccuggaggucgagcgcccccugccgauggagguggagaagaacagcacccccuccgagcccggcagcgggcgggggcccccgcaggaggaggaggaggaggaggacgaggaggaggaggccaccaaggaggacgccgaggcccccgggauccgcgaccacgagucccucuga

SEQ ID NO: 31029 - RNA, 756 nt, Artificial Sequence
  derived and/or modified sequence opt1 from HDGFL1__Homo_sapiens__NP_612641
augagcgccuacggcaugcccauguacaaguccggggaccugguguucgccaagcucaagggcuacgcgcacuggccggcccgcaucgagcacaugacccagcccaaccgguaccaggucuucuucuucgggacccacgagacggccuuccugagccccaagcgccuguuccccuacaaggagugcaaggagaaguucggcaagccgaacaagcggcgcggguucuccgccggccucugggagaucgagaacaaccccaccgugcaggccagcgacugcccccuggcguccgagaagggcagcggggacggccccuggccggagcccgaggccgccgagggggacgaggacaagcccacccacgccggcgggggcggcgacgagcuggggaagcccgacgacgacaagccgaccgaggaggagaagggcccccucaagcgguccgcgggggacccgcccgaggacgcccccaagcgccccaaggaggccgcccccgaccaggaggaggaggccgaggcggagcgggccgccgaggccgagcgcgccgcggccgccgccgccgcgacggccguggacgaggagagccccuuccuggucgccguggagaacggcuccgccccgagcgagcccggccuggugugcgagccgccccagcccgaggaggaggagcuccgggaggaggaggucgccgacgaggaggcgucccaggaguggcacgccgaggcccccgggggcggggaccgcgacagccuguga

SEQ ID NO: 31030 - RNA, 612 nt, Artificial Sequence
  derived and/or modified sequence opt1 from HDGFRP3__Homo_sapiens__NP_057157
auggcccgcccccggccgcgcgaguacaaggccggcgaccugguguucgcgaagaugaagggguacccccacuggcccgcccggaucgacgagcuccccgagggcgccgucaagccgcccgccaacaaguaccccaucuucuucuucgggacccacgagaccgccuuccugggccccaaggaccuguucccguacaaggaguacaaggacaaguucggcaagagcaacaagcgcaagggguucaacgagggccucugggagaucgagaacaaccccggggugaaguucacgggcuaccaggcgauccagcagcaguccagcuccgagaccgagggggagggcgggaacaccgccgacgccagcuccgaggaggagggcgaccggguggaggaggacggcaaggggaagcgcaagaacgagaaggccggcagcaagcggaagaaguccuacaccagcaagaaguccagcaagcagucccgcaagagccccggggacgaggacgacaaggacugcaaggaggaggagaacaaguccagcuccgagggcggcgacgcggggaacgacacgcggaacaccaccagcgaccugcagaagaccuccgagggcacguga

SEQ ID NO: 31031 - RNA, 756 nt, Artificial Sequence
  derived and/or modified sequence opt1 from HDHD1__Homo_sapiens__NP_001129037
auggccgccccgccccagcccgugacccaccugaucuucgacauggacggccuccugcugggguacaccggcagcaucgucgcggccgccuccggggagagcucccgcggccuccagagccgguggacggacaccgagcgccuguacuccgugguguuccaggagaucugcaaccgguacgacaagaaguacagcugggacgucaagucccuggugauggggaagaaggcccucgaggccgcgcagaucaucaucgacgugcugcagcugcccaugagcaaggaggagcucgucgaggagucccagaccaagcugaaggagguguuccccaccgccgcccugaugcccggcgccgagaagcucaucauccaccuccgcaagcacggcauccccuucgcgcuggccacgagcuccgggagcgccuccuucgacaugaagaccagccggcacaaggaguucuucucccuguucagccacaucgugcugggcgacgaccccgagguccagcacgggaagcccgacccggacaucuuccuggccugcgccaagcgcuucuccccgccgcccgcgauggagaagugccucguguucgaggacgcccccaacggcguggaggccgcccuggccgcggggaugcaggucgugauggugcccgacggcaaccugagccgggaccucaccaccaaggccacgcugguccugaacucccuccaggacuuccagcccgagcuguucggccugcccagcuacgaguga

SEQ ID NO: 31032 - RNA, 3708 nt, Artificial Sequence
  derived and/or modified sequence opt1 from HDLBP__Homo_sapiens__NP_001230829
augcaccuggccgagcgcgaccgguggcuguucguggccaccgucaugaugcacuucgugagcaucaaguccggcuuccccgggcucugcgugggcguccgcagcaccauguccagcguggcggugcugacgcaggaguccuucgccgagcaccggagcgggcucgucccgcagcagaucaagguggccacccugaacuccgaggaggagagcgacccgcccaccuacaaggacgccuucccgccccugcccgagaaggccgcgugccucgaguccgcccaggagcccgccggcgccugggggaacaagauccgccccaucaaggcgagcgugaucacccaggucuuccacgugccccuggaggagcggaaguacaaggacaugaaccaguucggcgagggcgagcaggccaagaucugccuggagaucaugcagcgcacgggggcccaccucgagcugucccuggccaaggaccagggccucagcaucaugguguccgggaagcuggacgccgucaugaaggcgcggaaggacaucguggcccgccugcagacccaggccagcgccaccguggccauccccaaggagcaccaccgguucgucaucggcaagaacggggagaagcuccaggaccuggagcugaagaccgcgacgaagauccagaucccccgccccgacgacccguccaaccagaucaagaucaccggcaccaaggagggcaucgagaaggcccggcacgaggugcuccugaucagcgccgagcaggacaagcgcgccguggagcggcuggaggucgagaaggccuuccaccccuucaucgcggggcccuacaaccgccucgugggcgagaucaugcaggagaccgggacgcggaucaacaucccgccgcccuccgugaaccgcaccgagaucgucuucaccggcgagaaggagcagcuggcccaggccguggcccggaucaagaagaucuacgaggagaaggccaacagcuucaccguguccagcgucgcggcccccagcuggcugcaccgcuucaucaucggcaagaaggggcagaaccucgccaagaucacgcagcagaugcccaaggugcacaucgaguucaccgagggcgaggacaagaucacccuggaggggcccaccgaggacgucaacguggcccaggagcagaucgagggcauggugaaggaccugaucaaccggauggacuacgucgagaucaacaucgaccacaaguuccaccgccaccucaucgggaaguccggcgcgaacaucaaccggaucaaggaccaguacaaggugagcgugcgcaucccgcccgacuccgagaaguccaaccugauccgcaucgagggcgacccccaggggguccagcaggccaagcgggagcugcucgagcuggccucccgcauggagaacgagcggacgaaggaccugaucaucgagcagcgcuuccaccggaccaucaucggccagaagggggagcgcauccgggagauccgcgacaaguuccccgaggugaucaucaacuuccccgaccccgcccagaaguccgacaucgugcagcuccggggccccaagaacgaggucgagaagugcaccaaguacaugcagaagaugguggccgaccugguggagaacagcuacagcaucuccgucccgaucuucaagcaguuccacaagaacaucaucgggaagggcggcgcgaacaucaagaagauccgcgaggagagcaacaccaagaucgaccugcccgccgagaacuccaacagcgagacgaucaucaucaccgggaagcgggccaacugcgaggccgcccgcucccggauccucagcauccagaaggaccuggcgaacaucgccgagguggagguguccauccccgccaagcugcacaacagccucaucggcaccaaggggcgccugauccgguccaucauggaggagugcggcgggguccacauccacuucccgguggagggcagcggcuccgacaccguggucauccgcgggcccagcagcgacguggagaaggccaagaagcagcugcuccaccuggccgaggagaagcagacgaaguccuucaccguggacauccgggcgaagcccgaguaccacaaguuccugaucggcaagggcgggggcaagauccgcaagguccgggacagcaccggggcccgcgugaucuuccccgccgccgaggacaaggaccaggaccucaucaccaucaucggcaaggaggacgcggugcgcgaggcccagaaggagcuggaggcccugauccagaaccucgacaacgucguggaggacuccaugcugguggacccgaagcaccaccggcacuucgucauccgccgggggcagguccugcgcgagaucgccgaggaguacggcggggugauggugagcuucccccgguccggcacgcagagcgacaaggugacccugaagggcgccaaggacugcguggaggcggccaagaagcgcauccaggagaucaucgaggaccucgaggcccaggucacccuggagugcgccaucccccagaaguuccaccgguccgugauggggcccaagggcagccgcauccagcagaucacccgggacuucuccgugcagaucaaguucccggaccgcgaggagaacgccguccacagcacggagcccguggugcaggagaacggggacgaggcgggcgaggggcgggaggccaaggacugcgaccccggcagcccccgccggugcgacaucaucaucaucagcggccgcaaggagaagugcgaggccgccaaggaggcccuggaggcgcucgucccggugaccaucgagguggagguccccuucgaccugcaccgguacgugaucgggcagaagggcuccgggauccgcaagaugauggacgaguucgaggugaacauccacguccccgcccccgagcugcagagcgacaucaucgccaucaccggccucgccgcgaaccuggaccgggccaaggccgggcugcucgagcgcgugaaggagcugcaggccgagcaggaggaccgggcccugcgcuccuucaagcucagcgugaccgucgacccgaaguaccaccccaagaucaucggccggaagggcgcggugaucacccagauccgccuggagcacgacgugaacauccaguuccccgacaaggacgacgggaaccagccccaggaccagaucacgaucaccggcuacgagaagaacaccgaggccgcccgcgacgccauccugcggaucgucggggagcucgagcagaugguguccgaggacgucccgcuggaccaccgcgugcacgcccggaucaucggcgcgcgcgggaaggccauccggaagaucauggacgaguucaagguggacauccgcuucccccagagcggcgcccccgaccccaacugcgucaccgugacgggccugccggagaacguggaggaggccaucgaccacauccucaaccuggaggaggaguaccuggccgacgucguggacagcgaggcgcuccagguguacaugaagccgcccgcccacgaggaggccaaggcccccucccggggguucgucgugcgcgacgcccccuggaccgcgagcuccagcgagaaggcccccgacauguccagcuccgaggaguuccccagcuucggcgcccagguggccccgaagacccugcccugggggcccaagcgguga

SEQ ID NO: 31033 - RNA, 6435 nt, Artificial Sequence
  derived and/or modified sequence opt1 from HEATR1__Homo_sapiens__NP_060542
augaccagccuggcccagcagcugcagcgccuggcccugccccaguccgacgccagccuccugucccgggacgagguggccagccuccuguucgacccgaaggaggccgccaccaucgaccgcgacacggccuucgcgaucggcugcaccgggcuggaggagcugcucggcaucgaccccuccuucgagcaguucgaggcgccccucuucagccagcuggccaagacccucgagcgguccguccagaccaaggccgugaacaagcagcuggacgagaacaucagccuguuccucauccaccuguccccguacuuccugcucaagccggcgcagaagugccuggaguggcugauccaccgcuuccacauccaccucuacaaccaggacagccugaucgccugcgugcugcccuaccacgagacgcggaucuucguccgcgugauccagcuccugaagaucaacaacuccaagcaccggugguucuggcugcuccccgugaagcagagcggggucccccuggccaagggcacccugaucacccacugcuacaaggaccucggguucauggacuucaucugcucccuggugaccaagagcgugaaggucuucgccgaguacccgggcuccagcgcccagcugcgcgugcuccuggcguucuacgccuccacgaucgugagcgcccuggucgccgccgaggacguguccgacaacaucaucgcgaagcuguuccccuacauccagaagggccucaagagcagccugcccgacuaccgggccgccaccuacaugaucaucugccagaucuccgugaaggucaccauggagaacaccuucgugaacagccucgccucccagaucaucaagacgcugaccaagauccccagccugaucaaggacgggcucuccugccugaucgugcugcuccagcgccagaagccggagagccugggcaagaagcccuucccccaccugugcaacguccccgaccucaucaccauccugcacgggaucuccgagaccuacgacgugagcccgcugcugcacuacaugcucccccaccugguggucuccaucauccaccacgugacgggcgaggagaccgaggggauggacggccagaucuacaagcggcaccuggaggccauccucaccaagaucagccugaagaacaaccuggaccaccuccuggcgucccuccuguucgaggaguacaucagcuacuccagccaggaggagauggacuccaacaaggugagccugcugaacgagcaguuccucccccugauccgccugcucgaguccaaguacccccggacccuggacgucgugcuggaggagcaccucaaggagaucgccgaccugaagaagcaggagcuguuccaccaguucgucagccucuccacgagcggcgggaaguaccaguuccuggccgacagcgacaccucccugaugcucagccugaaccacccgcuggcccccgugcgcauccucgccaugaaccaccugaagaagaucaugaagaccuccaaggagggcguggacgagagcuucaucaaggaggcgguccuggcccggcucggggacgacaacaucgacguggugcuguccgccaucagcgccuucgagaucuucaaggagcacuucuccagcgaggucaccaucuccaaccugcucaaccuguuccagcgcgcggagcugagcaagaacggcgagugguacgaggugcucaagaucgccgccgacauccugaucaaggaggagauccuguccgagaacgaccagcucagcaaccagguggucgugugccugcugcccuucauggugaucaacaacgacgacacggaguccgccgagaugaagaucgccaucuaccucagcaaguccggcaucugcagccugcacccccugcuccgggggugggaggaggcgcuggagaacgucaucaaguccaccaagccgggcaagcugaucgggguggccaaccagaagaugaucgagcuccuggccgacaacaucaaccugggcgaccccagcagcaugcucaagaugguggaggaccugaucuccgucggggaggaggagagcuucaaccugaagcagaaggugaccuuccacgugauccucuccguccuggugagcugcugcuccagccugaaggagacccacuuccccuucgccauccgcguguucucccuccugcagaagaagaucaagaagcuggagagcgucaucacggccguggagauccccuccgaguggcacaucgagcucaugcuggaccggggcaucccgguggagcugugggcgcacuacgucgaggagcucaacagcacccagcgcguggccguggaggacuccgucuuccugguguucagccugaagaaguucaucuacgcccucaaggcccccaaguccuuccccaagggcgacaucugguggaacccggagcagcugaaggaggacagccgggacuaccugcaccuccugaucgggcuguucgagaugaugcucaacggcgccgacgcggugcacuuccgcguccugaugaagcuguucaucaaggugcaccucgaggacguguuccagcuguucaaguucugcuccguccuguggaccuacgggagcucccucagcaacccccugaacugcuccgugaagaccgugcugcagacgcaggcccucuacgucggcugcgccaugcugagcagccagaagacccagugcaagcaccagcuggccuccaucagcucccccguggugaccagccuccugaucaaccuggggucccccgucaaggaggugcgccgggcggccauccagugccuccaggcccugagcggcguggccuccccguucuaccugaucaucgaccaccucaucagcaaggccgaggagaucaccuccgacgcggccuacgucauccaggaccuggccacgcuguucgaggagcuccagcgcgagaagaagcucaagagccaccagaagcuguccgagacccugaagaaccuccugagcugcguguacuccugccccagcuacaucgccaaggaccugaugaaggugcuccagggcgucaacggggagauggugcugucccagcugcuccccauggccgagcagcugcuggagaagauccagaaggagcccaccgcggugcucaaggacgaggccaugguccugcaccugacccucggcaaguacaacgaguucagcgugucccugcugaacgaggaccccaagagccucgacaucuucaucaaggccgugcacaccacgaaggagcuguacgccgggaugcccaccauccagaucaccgcccuggagaagaucaccaagcccuucuucgcggccaucuccgacgagaagguccagcagaagcuccugcggaugcuguucgaccuccuggugaacugcaagaacagccacugcgcccagacggucagcuccguguucaagggcaucagcgugaacgccgagcagguccgcaucgagcuggagcccccggacaaggcgaagccccucgggaccgugcagcagaagcggcgccagaagaugcagcagaagaagucccaggaccuggagagcgugcaggaggucggcggcuccuacuggcagcgggugacccugauccucgagcugcugcagcacaagaagaagcuccgcagcccccagauccuggugcccacccuguucaaccuccugucccggugccuggagccgcucccccaggagcaggggaacauggaguacacgaagcagcugauccugagcugccuccugaacaucugccagaagcugucccccgacggcgggaagauccccaaggacauccucgacgaggagaaguucaacgucgagcugaucgugcagugcauccgccugagcgagaugccgcagacccaccaccacgcccuccugcugcucggcaccguggccggcaucuuccccgacaagguccugcacaacaucauguccaucuucaccuucaugggggccaacgugaugcggcuggacgacacguacagcuuccaggugaucaacaagaccgucaagauggugauccccgcccucauccaguccgacagcggcgacuccaucgaggugagccgcaacgucgaggagaucguggugaagaucaucuccgucuucguggacgcgcugccccacgugccggagcaccggcgccugcccauccucguccagcugguggacacccugggggccgagaaguuccucuggauccugcugauccuccuguucgagcaguacgugaccaagacgguccuggccgccgccuacggcgagaaggacgcgauccucgaggccgacaccgaguucugguucagcgugugcugcgaguucuccgugcagcaccagauccagagccugaugaacauccugcaguaccuccugaagcugcccgaggagaaggaggagaccaucccgaaggccgucagcuucaacaaguccgagagccaggaggagaugcuccagguguucaacguggagacccacacguccaagcagcugcggcacuucaaguuccugagcgucuccuucaugagccagcuccuguccagcaacaacuuccugaagaaggugguggaguccgggggccccgagauccucaagggccuggaggagcgccugcucgagaccguccugggguacaucagcgccguggcccaguccauggagcggaacgcggacaagcugaccgugaaguucuggcgcgcccuccugagcaaggccuacgaccugcucgacaaggucaacgcccugcugcccaccgagacguucauccccgugauccggggccucguggggaacccgcugcccuccguccgccgcaaggcccuggaccuccugaacaacaagcugcagcagaacaucagcuggaagaagaccaucgugacccgguuccucaagcuggugcccgaccugcucgcgaucguccagcgcaagaagaaggagggcgaggaggagcaggccaucaaccggcagaccgcccuguacacgcugaagcuccugugcaagaacuucggggccgagaaccccgacccguucgugcccgugcugaacaccgcggucaagcugaucgcccccgagcgcaaggaggagaagaacgugcucggcuccgcccugcugugcaucgccgaggugaccagcacccucgaggcccuggcgaucccccagcugccgucccucaugcccagccugcugacgaccaugaagaacaccuccgagcucgucagcagcgagguguaccugcuguccgcccucgccgcccugcagaaggucguggagacccugccccacuucaucagccccuaccucgagggcauccugucccaggugauccaccuggagaagaucacgagcgagaugggguccgccagccaggcgaacauccggcucaccucccugaagaagacccuggccaccacccucgccccgcgcguccugcugcccgccaucaagaagacguacaagcagaucgagaagaacuggaagaaccacaugggccccuucaugagcauccuccaggagcacaucggggugaugaagaaggaggagcugaccucccaccagagccagcugaccgccuucuuccucgaggcgcuggacuuccgggcccagcacuccgagaacgaccuggaggaggugggcaagaccgagaacugcaucaucgacugccucgucgccaugguggugaagcugagcgaggucacguuccgcccccuguucuucaagcuguucgacugggccaagaccgaggacgcgccgaaggaccggcugcugaccuucuacaaccucgccgacugcaucgccgagaagcugaaggggcuguucacccucuucgccggccaccuggugaagcccuucgccgacacgcugaaccaggugaacaucuccaagaccgacgaggcguucuucgacagcgagaacgaccccgagaagugcugccuccugcugcaguucauccucaacugccuguacaagaucuuccuguucgacacccagcacuucaucuccaaggagcgcgccgaggcccucaugaugccccuggucgaccagcuggagaaccggcucggcggggaggagaaguuccaggagcgcgugaccaagcaccugaucccgugcaucgcccaguucagcguggccauggcggacgacucccuguggaagccccucaacuaccagauccugcugaagacgcgggacagcucccccaagguccgcuucgccgcccucaucaccgugcuggcccuggccgagaagcucaaggagaacuacaucgugcugcugcccgagagcaucccguuccucgcggagcugauggaggacgagugcgaggaggucgagcaccagugccagaagaccauccagcagcuggagaccgugcucggcgagccccugcagagcuacuucuga

SEQ ID NO: 31034 - RNA, 2043 nt, Artificial Sequence
  derived and/or modified sequence opt1 from HEATR3__Homo_sapiens__NP_891552
augggcaagagccgcaccaagcgguucaagcgcccccaguucuccccgaccggggacugccaggccgaggccgcggccgccgccaacggcaccgggggcgaggaggacgacgggcccgccgcggagcugcucgagaagcugcagcaccccagcgccgaggugcgggagugcgccugcgccggccuggcgcgccucguccagcagcggcccgcccugccgggccuggcccgccgggacgccgugcgccggcucgggccccugcugcucgaccccucccuggccgugcgcgagaccgcggccggcgcccugcggaaccucagcgccugcgggggcuucgaggucugcgacgacauggugaccaaggacaucaugacgccccugguggcccugcucaaggagugcuccgcggggcuggacagcaacgagaugucccugcaggagaagaaggaccagaaccgcaacagcaucgagaacaucgccaacgagacggucaacgugcucuggaacaucugcgagugcuccagccgggccguguccaucuucaacaaggagggcugccuggagaucguccugaaguaccucagccgcuucccgaccaacguggaccuggccaucuccguggccuacugccugcagaccgucaccgaggacaaccccgagcuccugaaguccuucuccgcgacggcccugaacaugcucgagagcgcccugcugucccccgugagcuccauggagagccuccugcugaagacccucguggccggcaccaucuggaaccugaaggacaucauccccugcaagagccaggccgagaucaucaacgcgcugcucaagauccuguccgagguccuggggauggacgccggcgagauggugauccagaugaaggaggccgagacccagcggcucaagacggccgcggaggccgaggagauccuggagaacaccaacggggacgaccugaucgaggacgacgagauggagggcaucagccacaagcgccgggugcgccggaagaccuucgucuccgaccuccugccgcccaccgacaaggagcugcgcgagacgaucgcccuccugaccgcccagcagaccgcccuggagaucaucgugaacaugugcugcaacgaggaccccagcgacgacgagugggaggagcucuccagcuccgacgagagcgacgcguucauggagaacuccuucagcgagugcggcgggcagcuguucagcccccugugccugagccacgaggugcacaccgcccucacgaacuaccugaucccgaagaagaucuucgagaagaccgccuuccccaacuccaucgccgucgaccugugcagccggaaccccaccuggaagccccucauccgcaagaugaacaccauccagugccgcgcccuguucugccugcagucccucgugagccugcuggacguggagcaccucggcggggcggccgcccugcagacgcuggcccagcaccucucccagcugcuguucagccagccggacuucgccaagcacgucgacuuccucgaggcgaucuccagcgcccugcgggcccugcuccagaccauggccagcaagaacaucucccagugcaugacccccgaccagcugaugacccugugcaaggcgggcauccacagcuccaacguggggguccgcgugaacguggucagcauccucggcaucacgggcuccgugcuggccaaggaggacgggacccuggagacccucaagaacaucggcugcuuccugcuggaggugaccacgaaggaccccagccucgucguggccggggaggcccuggacgcccuguucgacguguucgcggacggcaaggaggccgagcgggccuccauccagaucaagcuccugagcgcccugaaggaguuccagcccgucuucaagaugaagauccgcaaggaggggcggggcaacuacuccaccgaccagcucugcgugcuggacaacgugaagaugaaccugcgccgguucaucgccuaccaggagaccgucgagaagcgccucaccagcuga

SEQ ID NO: 31035 - RNA, 6216 nt, Artificial Sequence
  derived and/or modified sequence opt1 from HEATR5B__Homo_sapiens__NP_061897
auggagcuggcccacagccuccugcugaacgaggaggcccucgcgcagaucaccgaggccaagcgccccguguucaucuucgaguggcugcgguuccuggacaagguccucguggccgccaacaagaccgacgugaaggagaagcagaagaagcuggucgagcagcugacgggccucaucuccagcuccccggggccccccacccgcaagcugcuggccaagaaccucgcggcccuguacagcaucggcgacaccuucaccguguuccagacgcuggacaagugcaacgacaucauccggaacaaggacgacaccgccgccuaccuccccaccaagcuggcggccguggccugcgucggggccuucuacgagaagaugggccgcaugcugggguccgccuucccggagaccgugaacaaccuccugaagagccugaaguccgcggagagccagggccgguccgagauccucaugagccugcagaaggugcuguccggccucgggggcgccgccgccagcucccaccgcgacaucuacaagaacgcccggagccugcugacggaccgcuccauggcgguccggugcgccguggccaagugccuccuggagcugcagaacgaggccguguucauguggaccgccgagcucgagaacaucgcgacccugugcuucaaggcccuggagaacagcaacuacgggguccgcguggccguguccaagcuccugggcaccgucauggccacggcccugaugcccaagcaggcgaccgugaugcggcagaacgugaagcgcgccaccuucgacgagguccucgagcugauggccaccggguuccugcggggcggcagcggguuccucaaguccggcggggagaugcugaaggugggcggcagcgugaaccgcgagguccgggugggggugacgcaggccuacgucguguucgucaccacccugggcgggcaguggcucgagcgcagcuucgcgaccuuccugucccacgugcuggaccucgugagccacccccgggccacgcagacccacgucgaggccguguacucccgccggugcgugagcuucauccugcgcgccaccgucggcucccugcucggggagaaggcccagaucgcggccgccaaggagaucugccaggccaucggcaagcagaugaaggccguggaggcgguggucaacgacaccagcggcgagaacaaguccggggccgccgacaucgccgccagccagcacgugauggugugcgcgcugcaggagcugggcucccugguccagagccucaacgccacggccuccccccugauccaggaggccagcaucgggcugcucgagaucgugaccuccgugcugcugcacccgagcauggcggcccggcucgccgccgccuggugccugcgcugcgucgcgguggcccugcccuuccagcucacccccuuccuggaccgcugcgccgagcggcugaacaaccucaagaccucccccgaggccgugagcggcuacuccuucgccauggcggcccugcuggggggcguccaccagugcccgcucggcaucccccacgccaaggggaagaugguggugagcaucgccgaggaccugcugcgcacggccgcgcagaacucccggcucagccugcagcgcacccaggccggcuggcugcuccugggggcccugaugacccucggccccagcgucgugcgguaccaccugcccaagaugcugcuccuguggcgcaacguguucccgcggucccugaaggagcucgaggccgagaaggcgcgcggggacagcuucaccuggcaggucacgcuggagggccgggccggcgcccugugcgccaugcgcuccuucguggcccacugccccgagcuccugaccgaggacgugauccggaagcugaugacccccaucgagugcgcgaugaccaugaugagccacauccccuccgucaugaaggcccacggggcccaccucaaggccagcgccgcgauggugcgccugcggcuguacgacauccucgcccugcugccgcccaagacguacgagggcuccuucaacgcccuccugcgcgagcugguggccgaguucacccucaccgacaacagcgccaacaccaccacgucccugcugcggagccucugccacuacgacgacuccguccugcuggggagcuggcuccaggagaccgaccacaaguccaucgaggaccagcugcagcccaacagcgcguccggcagcggcgcccuggagcacgaccccuccagcaucuaccuccgcaucccggccggggaggccgugcccggcccccugccccugggggugagcgucaucgacgccuccguggcgcucuucggcguggucuucccgcacgugagcuacaagcaccggcugcagaugcuggaccacuucgccgagugcgugaagcaggccaaggggguccgccagcaggccgugcagcucaacaucuucaccgcggugcuguccgcccugaagggccucgccgagaacaagagcacccugggccccgaggagguccggaaguccgcccugacgcucgugauggggccccuggacaacccgaaccccauccugcgcugcgccgcgggcgaggcccucgggcgcauggcccagguggucggcgaggccaccuucaucgcccggauggcgcaguacagcuucgacaagcugaaguccgcccgcgacguggugagccggaccgggcacucccuggcccucggcugccugcaccgcuacgucggcgggaucggcagcgggcagcaccugaagaccuccgugagcauccuccuggcccuggcccaggacggcacgucccccgaggugcagaccuggagccuccacucccuggcgcugaucgucgacagcuccgggcccauguaccggggcuacguggagccgacccucagccugguccugacccuccugcugacggugccccccucccacaccgaggugcaccagugccucggccgcugccugggggccaucaucaccaccgucggccccgagcugcaggggaacggcgccacgaccagcaccauccggagcuccugccucguggggugcgccaucacccaggaccacagcgacucccuggugcaggcggccgccaucagcugccugcagcagcuccacauguucgccccgcgccacgucaaccuguccagccuggugcccucccugugcgugcaccucugcagcucccaccugcugcuccggcgcgccgcggucgccugccugcggcagcuggcccagcgcgaggccgccgaggugugcgaguacgcgaugagccucgccaagaacacgggcgacaaggaguccagcuccgccaacgugagccccuucgcccccggcgucuccagccggaccgacauccacugccgccaccagggggugaacaucaccgagaccggccuggaggggcugcucuucggcaugcuggaccgggagacggaccgcaagcugugcuccgacauccacgacacccucggccacaugcugagcucccuggccguggagaagcucagccacuggcugaugcugugcaaggacguccucgcggccagcuccgacaugagcaccgccacccugcuguccagcgggaaggacgaggaggccgagaagaaggacgagauggacgacgacacgauguucaccacccucggcgaggaggacaaguccaagccguucguggcgccccggugggccacccgcguguucgccgccgacugccugugccggaucaucaaccugugcgagaacgccgaccaggcgcacuucgaccucgcccuggcccgcagcgccaagcugcggaaccccacgaacgaccuccugguccugcaccucuccgaccugauccgcauggccuucauggcggccaccgaccacagcaaccagcugcgcauggccgggcuccaggcccuggaggacaucaucaagaaguucgccuccgugcccgagccggaguuccccggccacgugauccuggagcaguaccaggcgaacgucggggccgcccuccggcccgccuucagccaggacacccccuccgacaucaucgccaaggcgugccaggugugcagcaccuggaucggcuccggcguggucagcgaccugaacgaccugcgccgggugcacaaccuccugguguccagccuggacaagguccaggccgggaagggcuccagcucccagcucuaccgcgagagcgccacgaccauggagaagcuggccgugcugaaggcgugggccgagguguacgucguggccaugaacaucaagaaggaggccgagagcaagccgaagcgggccaucaagaacaccgacgacgacgacgacgacugcgggaccaucgacgagcucccccccgacucccugaucacccuggugcagcccgagcucccgacgcugagccgccuguggcucgcggcccugaaggacuacgcccugcucacccugcccgccgaguucuccagccagcugcccccggacggcggggccuucuacacccccgagaccaucgacacggcgcggcuccacuaccgcaacuccugggcccccauccugcacgccgucgcccuguggcucaacagcaccggcuucaccugcuccgagagcaccgaggccgcggccaucuccggccugcagaagcggagcacguccgugaaccugaaccaggccagcggggccgugggcuccgcgaagagccuccccgagaucaacaaggaccgcaugcaccugauccugggggucuccauccaguuccucugcagcccgcggcccgaggagcccaucgagcacgugaccgccugccugcaggcccugcacacccuccuggacucccccuacgcccgcgugcacaucgccgaggaccagcugaucggcgucgagcuccugagcgugcugcaccggcuccugcugaccuggaacccguccagcgugcagcuccuggucacggggguggugcagcagaucguccgcgcggcccaggacuaccugcaggagaagcggaacacccucaacgaggacgacauggagaaggaggccugcaccgugcugggcgagggcggggacagcggcgggcugauccccggcaagucccucguguucgccaccauggagcugcugauguucauccucguccgccacaugccccaccugagcacgaagguguccgacagccccucccacaucgccaccaagacccggcugagcgaggaguccgcgcgccucguggccgccaccgucacgauccugagcgaccugccgucccucugcagccccgccggcugcaugaccauccugcccaccauccuguuccucaucgcccggauccugaaggacaccgcgaucaaguccgccgacaaccaggugcccccgcccgucagcgccgcccugcaggggaucaaguccaucgugacgcucagcauggcgaagaccgaggccggcgugcagaagcaguggaccgcccugauccgcuccacccuggccugcauccuggaguacagccagcccgaggacuccguccccacgccggacgaggugagcaugcucaccgccaucgcgcuguuccugugguccgccagcaacgagaucaucggggugcagagccuccagaacggcugcaugaaccgcuucaagaacgcccugaacuccugcgaccccuggguccaggccaagugcuaccagcugcuccugagcguguuccagcacuccaaccgggcccugagcacccccuacauccacucccucgcgcccaucguggucgagaagcugaaggccguggagcgcaaccggccggccagcaacaucgagcugcucgccgugcaggaggggaucaagguccuggagacccugguggcccucggcgaggagcagaaccgcgugcagcugcuggcgcuccugguccccacgcugaucuccuaccuccuggacgagaacagcuucgccuccgccagcuccgccagcaaggaccugcacgaguucgcccuccagaaccugaugcacaucggcccccuguacccccacgcguucaagaccgugaugggggccgccccggagcucaaggugcggcuggagaccgccguccgcgcgucccaggccagcaaggccaaggccgccgcgcggcagcccgcccccgccauccacuccgccccgaccaucaagcugaagacgagcuucuucuga

SEQ ID NO: 31036 - RNA, 3546 nt, Artificial Sequence
  derived and/or modified sequence opt1 from HEATR6__Homo_sapiens__NP_071353
auggccgccgugcaggucgugggcagcuggcccuccgugcagccgcgcgaggcgccccgggaggccauccccgagcgcgggaacggcuuccggcugcucagcgcccgccugugcgcccugcggcccgacgacuccagcuccgcccgcaccgagauccaccuccuguucgaccagcugaucagcgagaacuacuccgaggggagcggcgucgcgccggaggacguguccgcccuccuggugcaggccugccggcuggucccccucaaccagaaccaccuggugagcaaggugucccagcugauccaccaccuccugaaccgccugcaggucaucguggacgagcagcaccucgacuuccugcuggccuacaccaucagcgcgauccaccagugcuccagcuggacgcaccgggagauccuccaggcccuggccgcccugguguacugcaacggguccaagugccagaaguaccuccccgagcugcugggcaacaccggccuccugaugaagcugagcgaccucgcccaguccgaccccgagguccgccgggcggccgugcacugcauggccaaccugugccugagcgugccggggcagcccuaccucgaggagcccuaccagaacgucugcuuccaggccuuccugaccauccugcagucccccaagagcagcgacauggacgacaucaccuucugcaugcuccugcagaacgcccugaagggcauccagucccuccugaacgggggccgcaugaagcugacgcagaccgacgagcucggggcgcugcuggccgugcucaagaaguucauguuccacggccugccgggccugaacaucgagaugcccaccgugcucuaccccacgccccugccgcaguacgacgggcggacccccaucaagccccagcagagcgaguccagcgccucccgccccacccugaacaagaagaagaaguccaaggucaagccgaagaagauccagcagggcgaggaggaggagaaggaguccagcggggagaucgaggccgcccccgugaccggcaccggccgggugaaccuccacgaggggaacacguggugccccuccagccugggcguccagucccugccccuggacgggagcggcgcggccgagaaggacgggguguccagcuccuucagcuccagcuccuggaagcgcgugagcagcuccgagagcgacuucuccgacgccgagggcggcaugcagagcaagaugcgguccuaccaggccaagguccgccagggggcccucgugugcuuccugagcaccaucaaguccaucgagaagaagguccuguacggcuacuggagcgcguucaucccggacacccccgagcucgggagcccccagagcgugucccugaugacccugacgcucaaggaccccagcccgaagacccgggccugcgcccuccaggugcuguccgccauccuggagggcagcaagcaguuccuguccgucgcggaggacaccagcgaccaccgccgggccuucacccccuucuccgugaugaucgccugcagcauccgcgagcugcaccgcugccuccugcuggcccucguggccgagagcuccagccagacggucacccagaucaucaagugccuggcgaaccugguguccaacgcccccuacgaccggcucaagcugagccugcucaccaagguguggaaccagaucaagccguacauccgccacaaggacgucaacgugcggguguccagccugacccugcucggggccaucgucuccacgcacgcgccccugcccgaggugcagcugcuccugcagcagcccugcagcuccggccugggcaacagcaacuccgccaccccgcaccucagcccgcccgacugguggaagaaggcccccgccgggcccucccuggaggagaccagcguguccagccccaagggcuccagcgagcccugcuggcugauccgccucugcaucuccaucgucgugcugcccaaggaggacagcugcagcggguccgacgccggcagcgccgccggguccaccuacgagccgagccccaugcggcuggaggcgcuccaggugcugacgcugcucgcccgcggcuacuucuccaugacccaggccuaccugauggagcugggcgaggucaucugcaagugcaugggggaggccgaccccagcauccagcuccacggcgcgaagcugcuggaggagcucgggaccggccugauccagcaguacaagcccgacuccaccgccgccccggaccagcgggcccccguguuccugguggucauguucuggacgaugaugcucaacggcccccugccccgcgcccugcagaacagcgagcacccgacccuccaggcguccgccugcgacgcccugagcuccauccugcccgaggccuucagcaaccuccccaacgaccggcagaugcugugcaucaccgugcugcucgggcugaacgacuccaagaaccgccuggugaaggccgcgaccagccgggcccucggcgucuacgugcuguuccccugccugcgccaggacgugaucuucgucgccgacgccgccaacgcgauccucaugucccuggaggacaagagccugaacgugcgggccaaggccgccuggucccucgggaaccugacggacacccugaucgugaacauggagaccccggaccccagcuuccaggaggaguucuccggccuccugcugcucaagaugcugcgcagcgcgaucgaggccagcaaggacaaggacaaggucaaguccaacgccgugcgggcccuggggaaccuccugcacuuccugcagcccagccacaucgagaagccgaccuucgccgagaucaucgaggaguccauccaggcgcucaucagcaccgugcugacggaggccgccaugaagguccgcuggaacgccugcuacgccaugggcaacguguucaagaaccccgcgcugccccucggcaccgcccccuggaccucccaggccuacaacgcccugaccagcguggucacguccugcaagaacuucaaggugcggauccgcagcgccgcggcccuguccgugccggggaagcgggagcaguacggcagcgucgaccaguacgcccgcaucuggaacgcccucgugaccgcccugcagaaguccgaggacaccaucgacuuccuggaguucaaguacugcgugagccuccgcacccagaucugccaggcgcugauccaccuccugucccuggccagcgccuccgaccugcccugcaugaaggagacgcucgagcugagcgggaacaugguccaguccuacauccugcaguuccugaaguccggcgccgagggggacgacaccggcgcgccccacagcccccaggagcgggaccagauggugcgcauggcccucaagcacaugggcagcauccaggccccgaccggggacaccgcccggcgcgccaucaugggcuuccuggaggagauccuggcggugugcuucgacagcuccgggagccagggcgcccuccccgggcugacgaaccaguga

SEQ ID NO: 31037 - RNA, 570 nt, Artificial Sequence
  derived and/or modified sequence opt1 from HEBP1__Homo_sapiens__NP_057071
augcugggcaugaucaagaacagccucuucggguccguggagaccuggcccuggcagguccugagcaagggcgacaaggaggagguggccuacgaggagcgcgccugcgagggcgggaaguucgcgaccguggaggucacggacaagcccguggacgaggcccugcgggaggccaugcccaagguggccaaguacgccgggggcaccaacgacaagggcaucgggaugggcaugaccguccccaucuccuucgcgguguuccccaacgaggacgggagccuccagaagaagcugaaggugugguuccgcaucccgaaccaguuccaguccgacccgcccgcccccagcgacaaguccgucaagaucgaggagcgggagggcaucaccguguacagcaugcaguucgggggcuacgccaaggaggccgacuacguggcgcaggccacgcgccugcgggccgcccucgagggcaccgccaccuaccgcggggacaucuacuucugcaccggcuacgacccgcccaugaagcccuacgggcggcgcaacgagaucuggcugcugaagacguga

SEQ ID NO: 31038 - RNA, 618 nt, Artificial Sequence
  derived and/or modified sequence opt1 from HEBP2__Homo_sapiens__NP_055135
auggccgagccccugcagccggaccccggcgccgcggaggacgccgccgcccaggccguggagacccccggguggaaggcgcccgaggacgccggcccgcagcccgggagcuacgagauccgccacuacggccccgccaagugggucuccaccagcguggaguccauggacugggacagcgccauccagacgggguucaccaagcucaacuccuacauccagggcaagaacgagaaggagaugaagaucaagaugaccgcgcccgugaccagcuacgucgagccgggcuccgggcccuucagcgaguccacgaucaccaucagccuguacauccccuccgagcagcaguucgacccgccccggccccuggagagcgacguguucaucgaggaccgcgccgagaugaccguguucguccgguccuucgacggcuucagcuccgcccagaagaaccaggagcagcuccugacccuggccagcauccuccgcgaggacgggaagguguucgacgagaagguguacuacacggccggcuacaacucccccgucaagcugcugaaccggaacaacgagguguggcucauccagaagaacgagcccaccaaggagaacgaguga

SEQ ID NO: 31039 - RNA, 1632 nt, Artificial Sequence
  derived and/or modified sequence opt1 from HECA__Homo_sapiens__NP_057301
augcccaacccgaagaacagcaagggcgggcgcaagaacaagcgggccaacuccagcggcgacgagcaggagaacggggccggcgcgcuggccgccgccggggccgcgggcgccgccgccggcggggcgcucgccgccgccgccggcugcggggcggccgccgccggcgcccccggggcgggcggcgccgccggggccggcggggccggcaccggcgcggccaacgccgccgccgcggccggggccgccgcggccggcgacgccaagaacgaggcccccugcgccacgccccugaucugcuccuucgggcgcccgguggaccuggagaaggacgacuaccagaaggucgugugcaacaacgagcacugccccugcagcaccuggaugcaccuccagugcuucuacgagugggaguccagcauccuggugcaguucaacugcaucggccgggcgcgcuccuggaacgagaagcagugccggcagaacauguggaccaagaagggguacgaccuggccuuccgcuucugcagcugccggugcggccagggccaccucaagaaggacaccgacugguaccaggucaagcgcaugcaggacgagaagaagaagaaguccgggagcgagaagaacaccggccggccgcccggggaggccgccgaggaggccaagaagugccgcccgcccaacaagccccagaagggccccucccacgaccugccccggcgccacagcauggaccggcagaacucccaggagaaggcggugggggccgccgccuacggcgcccgcagccccggcgggucccccggccagagcccgcccacgggguacuccauccugagccccgcgcacuucuccggcccccggagcagccgcuaccucggggaguuccugaagaacgccauccaccuggagccccacaagaaggccauggccggcggccacguguuccggaacgcgcacuucgacuacuccccggccgggcucgccguccaccgcggcgggcacuucgacacccccgugcaguuccugcggcgccuggaccucagcgagcugcugacccacaucccccggcacaagcucaacaccuuccacgugcgcauggaggacgacgcccaggucggccagggcgaggaccugcgcaaguucauccuggccgcgcucuccgccagccaccggaacguggugaacugcgcccugugccaccgcgcccugcccgucuucgagcaguucccgcucguggacgggacgcuguuccugucccccagccggcacgacgagaucgaguacgacgugcccugccaccuccagggccgccugaugcaccuguacgccgucugcguggacugccucgagggggugcacaagaucaucugcaucaagugcaagucccggugggacggcagcuggcaccagcuggggaccauguacaccuacgacauccuggcggccucccccugcugccaggcccgccucaacugcaagcacugcggcaagccggucaucgacgugcggaucggcaugcaguacuucagcgaguacuccaacgugcagcagugcccccacugcgggaaccuggacuaccacuucgucaagcccuucagcuccuucaaggugcuggaggccuacuga

SEQ ID NO: 31040 - RNA, 2343 nt, Artificial Sequence
  derived and/or modified sequence opt1 from HECTD2__Homo_sapiens__NP_001271203
augagcgaggccgugcgcguccccucccccgccacgccccuggugguggcggccgccgcccccgaggagcggaagggcaaggagagcgagcgcgagaagcugcccccgaucgucuccgccggggcgggcgccaccgccgggcuggaccggggcgccaaggggcagaucagcaccuucuccagcuucaucuccgcggugagccccaagaaggaggccgccgagaaccgcuccagccccgcccaccugguguuccccaacaucaagaacguccgggagccgccgcccaucugccucgacgugcgccagaagcagcggaccuccauggacgccagcuccagcgagaugaaggcgcccgugcugcccgagcccauccugcccauccagcccaagaccgucaaggacuuccaggaggacguggagaaggugaaguccagcggcgacuggaaggccguccacgacuucuaccucaccacguucgacuccuucccggagcugaacgccgccuucaagaaggacgccaccgcgagcuucaacaccaucgaggacuccggcaucaacgccaaguucgugaacgccguguacgacacccugcucaacacgccccaggacguccagaagaccgugcugaaggggaucaucaacagccugcuccgcgaguggaagggcccccggaccaaggacgaccugcgcgccuacuucauccugcuccagaacccccaguucaacaacaccagcacguacgugaucuacgcccaccuccugcggcagaucgcgacccucgucgaggccgaccaccacuuccuggugcacugguucaagaagcaguacucccgccugagccagaagcgguucaagcagcucguggagcgccugcugcaguucaucucccuccggcuguucccggccaagcccgaggaguucccgcccaucaccaagugcagcugguggauccccuccgccgccaagguccuggcgcuccugaacaccgccaacaaccuggugcacccgccccucauccccuacacggacuucuacaacagcacccuggaccacaucgaccugauggaggaguaccacaccuggcagaacuucgggaacucccaccgcuucagcuucugccaguaccccuucgugaucuccgucgccgccaagaagaucaucauccagcgggacagcgagcagcagaugaucaacaucgcgcgccagucccucguggacaaggucagccggcgccagcggcccgacaugaacauccuguuccugaacaugaaggugcgccgcacccaccucguguccgacagccuggacgagcugacgcggaagcgcgccgaccucaagaagaagcugaaggucaccuucgugggcgaggccgggcuggacaugggcggccucaccaaggagugguuccugcugcucauccggcagaucuuccaccccgacuacgggauguucaccuaccacaaggacucccacugccacugguucagcuccuucaagugcgacaacuacagcgaguuccgccuggugggcauccugauggggcucgccgucuacaacuccaucacgcuggacauccgguucccgcccugcugcuacaagaagcugcugagcccgcccaucauccccagcgaccagaacauccccgugggcaucugcaacgugaccgucgacgaccucugccagaucaugcccgagcuggcccacggccuguccgagcuccugagccacgaggggaacguggaggaggacuucuacuccaccuuccagguguuccaggaggaguucggcaucaucaagagcuacaaccugaagcccgggggcgacaagaucuccgucaccaaccagaaccgcaaggaguacgugcagcucuacacggacuuccugcugaacaagagcaucuacaagcaguucgcggccuucuacuacggguuccacuccgugugcgccagcaacgcccucaugcugcugcggccggaggaggucgagauccucgugugcggcucccccgaccuggacaugcacgcccugcagcgcagcacccaguacgacggcuacgcgaagaccgaccucaccaucaaguacuucugggacgugguccugggguucccccuggaccuccagaagaagcugcugcacuucacgaccggcuccgaccgggugcccgucgggggcauggccgaccucaacuucaagaucagcaagaacgagaccuccaccaacugccugccgguggcccacacgugcuucaaccagcugugccucccgcccuacaagagcaagaaggaccugaagcagaagcugaucaucgggaucuccaacagcgagggcuucggccucgaguga

SEQ ID NO: 31041 - RNA, 12855 nt, Artificial Sequence
  derived and/or modified sequence opt1 from HECTD4__Homo_sapiens__NP_001103132
augggccugcugcugguguucccccugauccagagccagagccgcaccgaccccagccucugcaacaucaccgccgaggugcugcugaacugccuccgggacugccagccccugucccugaccaaggagcccgccgacugccucaacgggaucgagacccugcugugcagcuggcucgaggagaccuccgacaccggccgccacaucccccacaagcagaaggagaacgccgccgccgcccugguggcccuggccugcgcccgggggagccucaagacguucgugcacaccgugcaccuccugcagaagcagaccgaccucggcucccugcccguggccgacgugcuguaccgccuccugcugcucgagggcggccccggcagccccuccugccugcucgggggcaagcacaucgugagcuggggguacgaggacaugcuccccgcccccgacuccaacaccggcagcuccagcgagaacaaggacgcggaccuggggcggugccugacggccgacggccucuaccuguacaccaccaacuccgugggccgcggggugagcaagcugggcuccgggcuccacggcacccugcggggcuucguguacugccgcaacgaggagcuggagcccggguggguggccuucggcagcgggucccuccugcaccggcccgugagcuucgacaacaagccccacagccuguuccaggugaucgaccagaacacgcuccaggugugccagguggugcccaugcccgccaaccaccuccccaucggcuccaccaugagcaccgugcaccuguccagcgacgggaccuacuucuacuggaucuggucccccgccagccucaacgagaagacgccgaagggccacuccguguucauggacaucuucgagcuggucguggagaacggcguguucgucgccaacccccugcaggagcgcaccauccucaugcggaaggagggggagagcgccaaguccaucaacgagaugcugcugagccgccucucccgguaccgcgccagccccuccgccacccuggccgcgcugaccggcagcacgaucuccaacacccugaaggaggaccaggccgccaacaccagcugcgggcucccccugaagaugcugcggaagaccccgaucuacacgugcggcaccuaccucgugaugcuggugcccccgcccgggggcuccggcagcuccgccacccgcagccuguucgggggcaccagcgggcucuccagccugaagauccuggccuccagccucgucuacaacaucuccgacggccaguucacgagccgggcggaccugaucgacgccgccggguccagccugggccgcggcgcccucgugcccgggcugggcgccugcuacgacaccgucaacaacaugcuguggaccugcuccaacgacuacaucgaccaguggugcaaccccgggaaccaggcguuccacuacgugugccagcggcucggcgugagccacaucaucaccgagcccaaggaggaggccaucacgaccaacgaggucaucaaccagcugcugcaccacgugggcgccaugugcauccaccagcucaaccugcuggccaccaaccccaaccucccgaucaccuccgugcuggggaagcagcaccccaucgaggcgcaccaccugagcuccaucugcgacaucauggagaaggccauggucaacggcgacacgugcaucauccgcugcauccucgugguguuccaggucguguucaaguucuucuucagcccccagaccgagcggaaccgcgacaucauccgccgguccgggcugcugcucuggcagcugcugauggccccgaaggaccagaucugccccgagauccagaaggaggugugccucgccaucagcuccggccugaacauccuguaccccggggagaccgagaucaacaaccuccugaagcugguccucaccgagggcgagcgcaacagcggccugagccagcugcgggacgugauccucaccaaccuggccgagcagcugcagaacaaccgcuucggguccgacgaggacgaccacuaccggcucaacgacgagcugcugcacuacauccucaagaucgugguccgcgagagcugcauccugaucacgaagugccagaccguguccaaggacgacuuccagaagcugcucagcaccgugcccgcggccuccagcugccugcgguaccugauggccguccagaaccaccuccuguccaacaccauccugaucaagccggacgagaacgacgacagcgacuccagccuccagggcgagacgcugaaggugcaggagcugaagguguccauccucgcccuggccacccagauccugaccgggugcgacgagguccucgagaugcugcagcaggucaccacggcgcugaucaacagcgacaucgccgaccgcgagcagcggcucaagggccuggagcaggucaccaaggccaccaugcuggggcaccuccugcccguccugcucaccucccugaugcaccccaaccugcagacgcucaucauggccgacgcccugaugccccagcuggugcagcucgugcuguacaccagccagaccgcgcugcuccugaagacccagugcccggucuucgccgaggugggcugcucccccugcggcgcccccgaccagaagugccgccuguuccccgacgagcggaugcucgaggagaaggaggagccgggguuccugacgggccugaagauccccgcccccugggcggccgggaagaccguggagaccguccaccccgugcgcgacaacuacaaguucaaggagaccgugcacaucccgggcgcccggugccucuaccugcgcuucgacagccggugcuccagccaguacgacuacgacaagcuggucaucuacgccgggcccaacacgaacucccgcaagguggccgaguacggcggcaacacccucggguacggcagccggagcgugcuggggaccggcuggcccaaggaccuggucaagugcaucagcccgcccagccucaacuucaagguggagggggacaccgugacguucuccuucgagaugcgcagcggccgggagcacaacacccccgacaaggcgauguggggcuucgccugcaccguccgcgcccaggaguccagcgaggacguguccgggggccugcccuuccugguggaccucgcccuggggcugagcguccuggccugcuccaugcuccgcauccuguacaacggccccgagaucaccaaggaggaggaggcgugccaggagcugcuccggagcaagcugcugcagcgcugccaguggcaggucgaggccaacggcgugaucucccccgcccucacgcccagccccuccccgcugccccugaccaucgaggaggaccgggaguucaccuaccccagcgacguccucgugcccccgguggggaacuacuucgaccugccccgcauccggcugccgcccggcaucaugaucaagcuccgcgagaucuccgggcgggcccgcccgcaguuccggcccagcaucaaggaggucauccagcccgacgugauggaggagaugguggucuccugcgugaucaagcaccugaaccuggucgacgcccuccagagccugaucaacuuccaguaccaggaggagcacgcggaggaguacgaccugcucugcaagaucaugggcgagaccuucaagaagcugaacgccauggagcgccagcugcaguccguggccgagcucgagcagaaguggcagagcgagguggacgacgccaugcaggggaagcuggagaacaacaugcccuucuucuacgacuaccacuucaacgagaacaagaugaaggagcuggagcuccugugcagcaugaaggaggucuccuucgacggcaacgaccuggagaacauggugcucagccugcgggagaaguuccugcaggaggugaacucccucauccagaagccgagccacccccuggcgaagacgaagacccuggucaagucccucaugaaccgcgccgagcugcugcuccacgugaccaucgccgcccagagcggccugacccgguccaucagcgggacgcccgccgagacccccgcgugcaaguccgccagcgagaccaaggugaucucccacgccguccgccagccgguguuccugcggagcauguccgcccccagcgaccucgagaugaucggcaacgaggaccuggaguucacccgcgccaaccagcggcgccggcacgugaccucccaccgcagcuccagcuucacgcugcuccagucccuggcgaucgaggacagccgggacaagcccaccuacagcguccugcucgggcagcuguucgccuucaucggcaccaaccccgaccaggccguguccagcuccagcuuccugcucgccgcccagacccgcuggcgccgggggaacacgcgcaagcaggcgcuggugcacaugcgggagcugcucaccgccgccguccgcgugggcggcgugacccaccuggucgggccggugaccauggugcugcagggcgggccccggaucgaggagcucacgugcggcgggauggucgagcagguccaggaggccuucggcgagaccaugaccuccguggucagccugugcgcccgcuaccccaucgcgugcgccaacuccaucggccugcucugcaccauccccuacacgcggagcgaggagaagugccuggugcgcuccgggcuggugcagcucauggaccggcugugcagccuguccaaccagaccgagagcuccagcuccgagaagcagaccaagaagcagaaggucgccaccauggccugggcggccuuccaggugcucgccaaccgcugcguggagugggagaaggaggagggcgggagcacggaggccguccacuccggccuggcccgccaggugagcucccugcucaccaaccaccuggcgcgcgccaccgagugcugcggcaaccaggccgccgggaacgacgcccugcaggacgugcucagccugcugaacgaccucagccggucccacaucggcaaggcgauccugagccagccggccugcgucuccaagcugcucagccugcugcucgaccagcgccccucccccaagcuggugcugaucauccuccagcugugccgggccgcccugccccucaugagcguggaggacugcgggaacgucgagcugccgcccugguccuacagcgugcccucccugaacagcgagcaggaggacccguccgaccccgccagcaagaucgcgucccuccugcuggccaagcucgccgacuacgugguccccggcugccagaccgugcugagccccacggccuccgagccggacaccacccugaccaagacgagccccaagaacucccucaagggggacaaggaccccggcgaggagagcgaggcgguggacggcaagcuguccaucuucauccacaagcgcgaggaccagagcagccacgagguccugcagccccuccuguccagcuccgaggggcggccguuccgccugggcaccggggccaacauggagaagguggugaagauggaccgggacaugaccaagggcgggugcugcgaggucaucaccgaggaggccgccgccgcgcuccgcaaggccacgaagugggcccagagcggccugaucguguccaucgggccgcccguggagagcaucaaccccgagaccgucuccgggcugagcaccggcgacaagaagaagaccgcccagacguccaucugccgcgagcggaacagcgagcuggcccgcaccgacccggugcggcccuucaucuccgggcacguggcgaacagcauggccgccgaggucaucgcccuccugcacucccugcucauggcccccgagagcaacgcggcccagaucuggaccaccacggccgagaaggugcugucccgcgcccugauguacaucccccagcucggcaaguacgcggagagcauccuggagaacggguccagcagcggccggaagcuggccaagcuccagcgcaucgcccggcaggccgucgccgcgcugugcgcccugggcggguucaaggagaccaucaagaucggcuccgagguccaggugcucgggcgcggcaucagcggguccaucggcgucguggccagcaucaacgagcaggagggcaucgccaccgugcgguucccgcccaucgacugccgcaagaccucccaggccagcgacacccugacgaucccccugucccggcucugcgucccccgcagcgaggcgcugccgcugcacaagcucuccaucaccgagaagguggugcaggccguccagagcaugcugcugccccaggaggggucccucagcauccacaccucccugcccgccaccggcgacgggagcgcccccgugauggccgugguccggcugcucgcggagauccgcacgcgggccugccuggugauggcccagcugcucgaggacucccuguucugcgaggaguucauccagcagugcccggccgccguggagguccugaaccucguggcgcaggagugcagcgccggcgagcgccuggccguggucgaggugcagugcgagcggcugcgcaugcucuaccgggacugcgcccggccgccgcccccgccccugcaggcggaccggcgccagcccaaggagaucaccuggucccccagccgcguguucccgcccguccgggccugcauguucuccagccaccugaccagcgugaccuuccucgccgaccccuccgccggcgggggccugccgcgcgggacguucaucuacgccaccagcccccugcccgugcaggcgcccuccuucuacugggagaucgagaucgucagcuacggcgacaccgacgacgacaccgggccgaucguguccuucggcuucacgaccgaggccgagaagcgggacggcgccuggaccaaccccguggggaccugccucuuccacaacaacggccgcgccguccacuacaacgggagcucccugcugcaguggaaguccgugcggcucgacgugacgcugucccccggcgacgucgccgggaucggcugggagcgcaccgagggcacgccgccgccgcccgggcagcccgcgaagggccggguguacuucaccuacugcgggcagcgccugagccccuaccucgaggacguguccggcgggauguggcccgucgugcacauccagaagaagaacacgaagacccgggccaacuucggcagccgccccuucgccuacgccgagggccaggcccaccggaacgcggccgaccugugcaccgaccuggccgaggagaucuccgccaacuucgaggcgcuccccuucgccauggccagcgacuccgacaacgacgccgggaccagcaucgccuccgaccccggcacgcacgggccgcccugccgcaucgcggccguggccaccgcccagcagcaguacgacagcgacaccuccugccacuacaaggucgagcugagcuacgagaacuucaucaccagcggccccgacccgcacccgccgcccaucgccgacgacgaguccgacgacgacgacgacgacgacaucccccaggaggaccacuacgcgcugcucgugaaggccugggagacgaagguguuccccaccauccggcgccgguuccgcaacgaggccgagcggaaguccgggcuggaccagaucaagggcgcccugcagcucggcauggucgacaucgcccgccagaccguggaguuccuguacgaggagaacgggggcaucccccgggaccuguaccuccccaccaucgaggacaucaaggacgaggcgaacaaguucacgaucgacaaggugcgcaaggggcugaccgucgugacccgcucccccgacagcaacaacguggccuccagcgccgucggcaccgcccugcccaaguucgcgauccggggcaugcucaagacguucgggcugcacggcguggugcuggacgucgacuccgugaacgagcucgugcaggucgagaccuaccugcgcagcgagggggugcugguccgguacugguaccccaucgacaugcucgagcgcccgcccgccggcuaccggcgcaccgccaccaacgggcuggugacgcuggacaacaccaaccuccagauccaccgggagcugcugcgcugcgaggccgcccucgcgcggcuguacugccgcauggcccugcucaacaucuucgcccccaagcugccccaccuguucacccggcuguuccacaucccggccauccgcgacaucacccuggagcaccuccagcuccuguccaaccagcugcucgcgccgccccugcccgacggcaccaucagcuccagcuccauccugcucgcgcagagccugcagcacugcauccacucccagaacugcagcgccacggaccuguucuaccagggcaacucccagaccgugcgggaguggcucaacgucgccaucacccgcacccugcaccagggggaggagagccugcucgagcugacgaagcagaucugcuccuuccugcagaccgccccggagcaguuccccagcgaggaguuccccaucagcgaguccaaggugaacauggacgugaacuuccccggcgccgcguucgucguggugagcugcaaggagucccagagcggguuccggaaggacuccagccucuacaaggccccgugggcccgcguccugguguacggccuggggcacaaggugaagcggaacggccagcugaaccucaucgaggccgccugcuacccccgcgacgcgucccccgccaacaccggccuggcgcccccgcccaccgccgaccaguaccccagcgucgugcuguccacggaccgggugcacaucaagcucggggucagcccgccgcccggcgcggugcuggugcugcacucccucccccuggaguucccccuggccauggccuucgccgagcagcuccugagcuggaaguccgaggacagcgaggggaaguccgaggacgagcccgacaccauccccaccagcguccugcuccaggugguggagcugcugggcaacuuccucuggaccacggacauggccgcgugcgucaaggagcugguguuccaccuccuggccgagcugcugcgcaccgugcacacccuggagcagcggcgccaccccgccgggcuguccagcuccaucgcccugcagcucaaccccugccuggccaugcugauggcgcuccagagcgagcugcacaagcuguacgacgaggagacccagaacugggucagcggcggcgccugcgggggcuccgggggcgccgccgccggcgaccaggggcgcuucagcacguacuuccacgcgcucauggagggcugccuggccguggccgaggugacccugcccaccaacauguccgucaccgccagcggggugacguccgcgaccgcccccaaccucagcgacuccagcuccagcuccagcuccagccccggccagacgccccagucccccagccugcuguccaagcggaagaaggugaagaugaagcgcgagaaggccagcuccagcgggaagcggcagagcucccgcaccgucgacagcgaccccaccgugcucuccaucggcggcagcaagcccgaggacaugcugugguuccaccgggcccugacccuccugaucauccugcgccaccucacccggaaggacccgcaggggcugggcgugaccuccgacgccaucgcggacgccugccaggcccuggucgggcccacggcccacagccgccuccuggugaucuccggcauccccacccaccuggacgagggggugguccggggcgccauccgcaaggcgugcaacgcccacggcgggguguucaaggacgagaucuacaucccccuccaggaggaggacaccaagaagccgaaggacaaggccgagggcggggacggcaagguggagcccgagaagacccuggccuuccccgggacggacagcauggaggucuccaccagcuccagccugacccccgccauguccaucagcgcguccgccagcaccucccaggccagcaucugcagcucccagggcaucagccagacgguguccgaccucagcguggacccgcugcccgccggccuggagcuccccaucccgcccgggcugcuggagccccacgccgucuccagccaggagucccucgacaucagccugugcuccaccggcagccuggggucccucggcagccugggggagccccuggacaacgcggagaccgccuccgugagcgacaugggcuccauguacaccgugaccagccucgacaaccagccccuggccgcccggcccaucaagggcuucgcggucguggagauccgcucccgggccaagaucgagaagauccgcgccagccuguucaacaacaacgaccucaucgggcuguccagccuggacggcgaggacgagcucauggagaugagcacggaggagauccugaccguguccgucgugaaccagagccuguucgacacccaggggucccccggccucgaggacuacuucaacgacaagagcaucaagggcgagaagcuggugcccggggcccgggagguccugaccgagaucuucaaguccugcgcccacagcgagcagacgcucucccugaccccggcgaagcccauccgcgugagcgacaucuaccuguccaaggagcagaucaacagccagacccccggcaaccuccugcaccuguucuucaccaacguccggcccccgaagaaggugcucgaggaccagcugacgcagauccugcgcaaguacggggugcccaagcccaaguucgacaaguccaaguacagcaaggccggcaaggagcagcaccccgucaaggugguguccaccaagcggccgaucaccaagccgcccgccaaggacaaggccguccucaacagcgugucccgcaccgcccugagcgagaagaagcccacggugaagccgaagucccccgagaaguccaagcccgacgagaaggaccccgagaaguccccgaccaagaagcaggagguccccgaggagaaguaccugacccucgagggguuccacaaguucgugaucgaccgcgcgcggcaggacauccgcagcguguggcgggccauccugagcugcggcuacgaccugcacuucgagcgcugcgccugcaucgacguccggcacgcccagaaggccucccgcaaguggacccucgagauggacguggcgcuggugcaguacaucaaccagcugugccggcaccucgccaucacgcccgcccgccugcacccccacgaggucuaccuggacccggccgacgcggccgacccccggguggccugccugcucaacgugcccaucgagagccugcgccugcgguucgcccuccugcagucccugaacaccacccucgagaccuucuuccugccccuggucgagcuccgccagacgccgauguacacccacagcaucgccgcgcugcugaaggaggccaagggccucaucuucuacgacaccaaggugaccgugaugaaccggguccugaacgccacggugcagcgcaccgccgaccacgccgcgcccgagaucacccuggacccccucgagaucgucgggggcgagauccgggccuccgagaacagcuacuucugccaggccgcccgccagcuggccuccguccccagcucccagcugugcgugaagcucgcgagcgggggcgacccgaccuacgccuucaacauccgguucacgggggaggaggugcacggcaccuccggcagcuuccgccacuuccuguggcaggucugcaaggagcugcaguccagcucccucagccugcugcuccugugccccuccagcgccgugaacaagaacaaggggaaguacauccugacccccuccccgaucaccuacggcgaggagcagcuccugcacuuccuggggcagcuccugggcaucgccauccgggcggacgugccccugccccucgaccugcugcccagcuucuggaagacgcucgucggggagccgcuggaccccgagcaggaccugcaggaggccgacauccucaccuacaacuacgugaagaaguucgagagcaucaacgacgagaccgagcuggaggcccugugcgccgagaucgccucccagcaccucgcgaccgagagccccgacucccccaacaagccgugcugccgcuucacguaccugaccaugaccggcgaggagguggagcugugcagccggggccgccacauccucgucgccugggagaacaaggacaucuacgccgccgccauccgcucccugcggcugcgcgagcuccagaacguggagugcgugaccgcgguccgggccgggcugggcagcaucaucccccugcagcuccugaccaugcugagcccccuggagauggagcugcgcacgugcgggcugcccuacaucaaccucgaguuccugaaggcccacaccauguaccaggugggccugauggagaccgaccagcacaucgaguucuucuggggcgcccucgagauguucacccaggaggagcugugcaaguucaucaaguucgccugcaaccaggagcggaucccguucacgugccccugcaaggacgggggccccgacaccgcgcacgugcccccguaccccaugaagaucgcgccgcccgacgggaccgccggcagcccggacucccgcuacauccgggucgagaccugcauguucaugaucaagcugccccaguacagcucccucgagaucaugcuggagaagcugcgcugcgccauccacuaccgggaggacccccucagcggguga

SEQ ID NO: 31042 - RNA, 4719 nt, Artificial Sequence
  derived and/or modified sequence opt1 from HECW1__Homo_sapiens__NP_001273988
augcugcuccaccugugcagcgugaagaaccuguaccagaaccgcuuccucggccuggccgccauggcgucccccagccggaacucccagagccgccggcgcugcaaggagccccugcgguacuccuacaaccccgaccaguuccacaacauggaccuccgcgggggcccccacgacggggucaccaucccccggagcaccuccgacacggaccuggugaccagcgacucccgcagcacccugaugguguccagcuccuacuacagcaucggccacucccaggaccucgucauccacugggacaucaaggaggagguggacgccggggacuggaucggcauguaccugaucgacgaggugcugagcgagaacuuccucgacuacaagaaccggggcgucaacgggucccaccgcggccagaucaucuggaagaucgacgccagcuccuacuucguggagccggagaccaagaucugcuucaaguacuaccacggggugagcggcgcccugcgggccacgacccccagcgucaccgugaagaacuccgcggcccccaucuucaagagcaucggggccgacgagaccgugcagggccagggcucccgccggcugaucagcuucucccucagcgacuuccaggccauggggcugaagaagggcauguucuucaaccccgacccguaccugaagaucuccauccagcccgggaagcacagcaucuuccccgcgcucccccaccacggccaggagcgccgguccaagaucaucggcaacacggucaacccgaucuggcaggccgagcaguucagcuucgugucccugcccaccgacgugcuggagaucgaggucaaggacaaguucgccaagagccgccccaucaucaagcgguuccucgggaagcuguccaugcccgugcagcgccugcucgagcggcacgccaucggcgaccgcguggucagcuacacccuggggcggcgccugccgaccgaccacguguccggccagcuccaguuccgcuucgagaucacgagcuccauccaccccgacgacgaggagaucagccuguccaccgagcccgagagcgcccagauccaggacagccccaugaacaaccugauggaguccgggagcggcgagccgcgguccgaggcgcccgagagcuccgagagcuggaagcccgagcagcucggcgagggguccgugcccgacggcccggggaaccagagcaucgagcugucccgccccgccgaggaggccgccgucaucaccgaggccggcgaccaggggauggugagcgugggccccgagggcgcgggggagcugcucgcccagguccagaaggacauccagcccgccccguccgccgaggagcuggccgagcagcuggaccucggcgaggaggcgagcgcccugcugcucgaggacggggaggcccccgccuccaccaaggaggagccccuggaggaggaggccacgacccagagccgggcgggccgcgaggaggaggagaaggagcaggaggaggagggggacguguccacccuggagcagggcgagggccggcuccagcugcgcgccagcgucaagcggaagucccgcccgugcagccugcccgugagcgagcucgagaccgugaucgccuccgccugcggggaccccgagacgccccggacccacuacauccgcauccacacccugcugcacagcaugccguccgcgcagggcgggagcgccgccgaggaggaggacggcgccgaggaggaguccacccucaaggacagcuccgagaaggacggccugagcgaggucgacacgguggccgcggaccccuccgcccuggaggaggaccgggaggagcccgagggggccacccccggcaccgcccacccggggcacagcggcgggcacuuccccucccuggccaacggcgcggcccaggacggcgacacccaccccagcacgggguccgagagcgacuccagcccccgccagggcggggaccacuccugcgagggcugcgacgccagcugcugcuccccgagcugcuacagcuccagcugcuacuccaccagcugcuacuccagcuccugcuacagcgccuccugcuacagccccuccugcuacaacgggaaccgguucgccagccacacccgcuucuccagcguggacuccgcgaagaucagcgaguccaccgucuucagcucccaggacgacgaggaggaggagaacagcgccuucgagagcgugcccgacuccaugcagagccccgagcucgacccggaguccacgaacggcgccggccccuggcaggacgagcuggccgcgcccagcgggcacguggagcggucccccgagggccuggagagcccggucgccgggcccuccaaccgccgggaggacugggaggcccgcaucgacagccacggccggguguucuacguggaccacgucaaccgcaccaccaccuggcagcgccccacggccgccgcgacccccgacgggaugcggcgcuccggcagcauccagcagauggagcagcucaaccggcgcuaccagaacauccagcggaccaucgccaccgagcgcuccgaggaggacagcggcucccagagcugcgagcaggccccggccgggggcgggggcgggggcggcuccgacagcgaggccgaguccagccaguccagccuggaccugcggcgcgaggggagccucucccccgugaacagccagaagaucacccugcugcuccagucccccgcggugaaguucaucacgaacccggaguucuucaccguccugcacgccaacuacagcgccuaccggguguucaccuccagcacgugccugaagcacaugauccucaaggugcgccgggacgcccgcaacuucgagcgguaccagcacaaccgcgaccuggucaacuucaucaacauguucgccgacacccggcuggagcucccccgcggcugggagaucaagaccgaccagcaggggaaguccuucuucguggaccacaacagccgggcgaccaccuucaucgacccccgcaucccccugcagaacggccggcugccgaaccaccucacgcaccgccagcaccuccagcggcugcgcuccuacagcgccggcgaggccuccgaggugagccgcaaccgcggggccucccuccuggcgcggcccggccacagccuggucgccgccauccggucccagcaccagcacgagagccucccccuggccuacaacgacaagaucguggccuuccugcgccagcccaacaucuucgagaugcuccaggagcggcagccgucccuggcgcgcaaccacacccugcgggagaagauccacuacauccgcaccgaggggaaccacggccucgagaagcugagcugcgacgccgaccuggugauccuccugucccuguucgaggaggagaucaugagcuacgucccccuccaggccgccuuccaccccggguacagcuucagcccccggugcagcccgugcuccagcccccagaacucccccggccugcagcgcgccagcgcgcgggcccccuccccguaccgccgggacuucgaggccaagcugcgcaacuucuaccggaagcucgaggccaagggcuucgggcagggccccgggaagaucaagcugaucauccgccgggaccaccuccuggagggcaccuucaaccaggugauggccuacagccgcaaggagcugcagcggaacaagcuguacgugacguucgucggggaggagggccucgacuacuccggccccagccgcgaguucuucuuccugcugucccaggagcuguucaaccccuacuacgggcuguucgaguacagcgcgaacgacaccuacaccgugcagaucuccccgaugagcgccuucguggagaaccaccuggagugguuccgcuucuccggccggauccucgggcuggcccugauccaccaguaccuccuggacgccuucuucacccgccccuucuacaaggcccugcuccggcugcccugcgaccugagcgaccucgaguaccuggacgaggaguuccaccagucccugcaguggaugaaggacaacaacaucacggacauccucgaccugaccuucaccgucaacgaggagguguucggccaggugaccgagcgcgagcugaaguccgggggcgcgaacacgcaggucaccgagaagaacaagaaggaguacaucgagcggauggugaaguggcgcguggagcggggcgucgugcagcagaccgaggcccucgugcgcggguucuacgaggucguggacucccggcuggugagcgucuucgacgcccgcgagcuggagcucgugaucgccggcaccgcggagaucgaccugaacgacuggcggaacaacacggaguaccgcgggggcuaccacgacggccaccuggugauccggugguucugggccgccgucgagcgcuucaacaacgagcagcggcuccgccugcugcaguucgugaccgggaccagcuccgugcccuacgagggcuucgccgcccuccgggggagcaacggccugcgccgguucugcaucgagaagugggggaagaucaccucccugccgcgcgcgcacacgugcuucaaccggcucgaccugccgcccuaccccagcuacuccaugcuguacgagaagcuccugaccgccgucgaggagaccagcaccuucggccuggaguga

SEQ ID NO: 31043 - RNA, 4719 nt, Artificial Sequence
  derived and/or modified sequence opt1 from HECW2__Homo_sapiens__NP_065811
auggccagcuccgcccgcgagcaccuccucuucgugcggcgccggaacccccagaugcgcuacacccugagccccgagaaccugcagucccucgcggcccagagcuccaugcccgagaacaugacccugcagcgggccaacagcgacacggaccuggucaccuccgagagccgcuccagccucaccgccuccauguacgaguacacccugggccaggcccagaaccugaucaucuucugggacaucaaggaggagguggaccccagcgacuggaucgggcucuaccacaucgacgagaacucccccgcgaacuucugggacagcaagaaccggggcgugacggggacccagaagggccagaucgucuggcgcaucgagccggggcccuacuucauggagcccgagaucaagaucugcuucaaguacuaccacggcaucuccggcgcccugcgggccaccacccccugcaucacggugaagaacccggccgugaugaugggggcggagggcauggagggcggggccagcgggaaccugcacucccgcaagcucgucagcuucacccuguccgaccugcgggccgugggccucaagaagggcauguucuucaaccccgaccccuaccugaagaugagcauccagcccgggaagaaguccuccuucccgaccugcgcccaccacggccaggagcgccggagcaccaucaucuccaacacgaccaaccccaucuggcaccgcgagaaguacagcuucuucgcccugcucaccgacgugcuggagaucgagaucaaggacaaguucgcgaagucccggcccaucaucaagcgcuuccuggggaagcucaccauccccguccagcggcugcuggagcgccaggccaucggcgaccagaugcucagcuacaaccugggccggcgccugccggccgaccacguguccggguaccuccaguucaagguggaggucacgagcuccgugcacgaggacgccagccccgaggccgugggcaccauccugggggucaacuccgugaacggcgaccuggggagccccuccgacgacgaggacaugcccggcagccaccacgacucccaggugugcagcaacggcccggucuccgaggacagcgcggccgacgggacccccaagcacuccuuccggaccagcagcacgcucgagaucgacaccgaggagcugaccuccaccagcucccgcacgagcccgccccgcggccggcaggacucccugaacgacuaccucgacgccaucgagcacaacgggcacagccgccccggcaccgcgaccugcuccgagcggagcaugggggccucccccaagcugcgcagcuccuuccccaccgacacgcggcugaacgcgaugcuccacaucgacagcgacgaggaggaccacgaguuccagcaggaccugggcuaccccuccagccuggaggaggagggcgggcucaucauguucucccgcgccagccgggccgacgacggcucccugaccagccagaccaagcuggaggacaacccgguggagaacgaggaggccagcacccacgaggccgcguccuucgaggacaagcccgagaaccugcccgagcuggccgagagcagccugccggccgggcccgcccccgaggagggcgagggcgggcccgagccgcagcccagcgccgaccagggcuccgccgagcucugcgggagccaggagguggaccagcccacguccggcgccgacaccgggaccagcgacgccuccggcggcagccgccgggccgucuccgagaccgagagccuggaccagggguccgagcccagccagguguccagcgagacggagccguccgaccccgcgcgcaccgagagcguguccgaggccagcacccggcccgagggcgagagcgaccuggagugcgccgacuccagcugcaacgaguccgucaccacccagcucagcuccguggacacgcgcugcagcucccuggagagcgcccgguuccccgagaccccggccuucuccagccaggaggaggaggacggggcgugcgccgccgagcccaccuccagcggccccgccgaggggucccaggagagcgucugcaccgccggcucccugcccguggugcaggucccgagcggcgaggacgaggggcccggcgcggaguccgccacggugcccgaccaggaggagcugggggagguguggcagcgccggggcagccucgagggggccgccgcggccgccgagagcccgccccaggaggagggcuccgccggcgaggcccaggggaccugcgagggcgcgaccgcccaggaggagggggccaccggcgggagccaggccaacggccaccagccccugcgcucccugcccagcguccggcaggacgugucccgcuaccagcggguggacgaggcccugcccccgaacugggaggcgcgcaucgacagccacggccgcaucuucuacgucgaccacgugaaccggacgaccaccuggcagcgccccaccgcgcccccggcgccccaggugcuccagcgguccaacagcauccagcagauggagcagcugaaccgccgguaccaguccauccgccggacgaugaccaacgagcgccccgaggagaacaccaacgccaucgacggggccggcgaggaggccgacuuccaccaggccagcgccgacuuccggcgcgagaacauccucccccacuccaccagccggucccgcaucacgcugcugcuccagagcccgcccgucaaguuccugaucucccccgaguucuucaccgugcugcacagcaaccccuccgccuaccggauguucaccaacaacacgugccucaagcacaugaucaccaaggugcgccgggacacccaccacuucgagcgcuaccagcacaaccgggaccuggucggguuccugaacauguucgccaacaagcagcucgagcugccgcgcggcugggagaugaagcacgaccaccaggggaaggccuucuucguggaccacaacagccggaccaccacguucaucgacccccgccugccccuccaguccagccggcccaccuccgcccuggugcaccgccagcaccugacccgccagcggagccacagcgccggcgaggucggcgaggacucccgccacgccgggccgcccgugcucccccggcccagcuccaccuucaacacggugagccgcccgcaguaccaggacaugguccccguggcguacaacgacaagaucguggccuuccugcggcagcccaacaucuucgagauccugcaggagcgccagcccgaccucacccggaaccacucccugcgcgagaagauccaguucauccggaccgagggcaccccggggcugguccgccucagcuccgacgccgaccuggugaugcugcucagccuguucgaggaggagaucauguccuacgugccgccccacgcccugcuccaccccagcuacugccagagcccccggggcucccccgucuccagcccccagaacucccccggcacgcagcgcgccaacgcgcgggccccggcccccuacaagcgcgacuucgaggccaagcugcggaacuucuaccgcaagcuggagaccaagggguacggccaggggcccggcaagcucaagcugaucauccggcgcgaccaccuccuggaggacgccuucaaccagaucaugggguacagccggaaggaccugcagcgcaacaagcuguacgugaccuucgugggcgaggagggccucgacuacuccgggccgagccgcgaguucuucuuccuggucucccgggagcuguucaaccccuacuacggccucuucgaguacagcgcgaacgacaccuacacggugcagaucagccccauguccgccuucguggacaaccaccacgagugguuccgcuucagcgggcggauccugggccuggcccucauccaccaguaccugcuggacgccuucuucacccgccccuucuacaaggcccuccugcggauccugugcgaccucuccgaccuggaguaccuggacgaggaguuccaccagagccuccaguggaugaaggacaacgacauccacgacauccuggaccugaccuucaccgucaacgaggagguguucgggcagaucaccgagcgcgagcucaagccgggcggcgcgaacauccccgugacggagaagaacaagaaggaguacaucgagcggauggucaaguggcgcaucgagcgcgggguggugcagcagaccgagucccugguccggggcuucuacgaggugguggacgcccggcuggucagcguguucgacgcccgcgagcucgagcuggugaucgccgggaccgcggagaucgaccuguccgacuggcggaacaacaccgaguaccgcggcggguaccacgacaaccacaucgucauccggugguucugggccgccguggagcgcuucaacaacgagcagcggcuccgccugcugcaguucgugacgggcaccagcuccauccccuacgagggcuucgccagccuccggggguccaacggcccccgccgguucugcgucgagaagugggggaagaucaccgcccugccgcgcgcgcacacgugcuucaaccgccuggaccucccgcccuaccccagcuucuccaugcuguacgagaagcugcucaccgccguggaggagaccagcaccuucggccuggaguga

SEQ ID NO: 31044 - RNA, 4146 nt, Artificial Sequence
  derived and/or modified sequence opt1 from HEG1__Homo_sapiens__NP_065784
auggccagcccccgcgccucccgguggccgcccccccugcuccugcugcuccugccccugcuccugcugccgcccgcggcccccggcacccgcgaccccccgcccagccccgcccggcgcgcccucucccuggccccccuggcgggggccggccucgagcugcagcuggagcggcgcccggagcgggagcccccccccaccccgccccgcgagcggcgcgggcccgccacgcccggcccgagcuaccgggcccccgagcccggggcggccacccagcgcggccccuccggccgggccccgcgcgggggcagcgccgacgccgcguggaagcacuggcccgaguccaacaccgaggcccacguggagaacaucaccuucuaccagaaccaggaggacuucagcacggucuccagcaaggagggggugauggugcagaccuccggcaagagccacgccgccuccgacgcccccgagaaccucacccugcuggcggagaccgccgacgcccgggggcgcagcggcuccagcucccggacgaacuucaccauccuccccgucggcuacagccuggagaucgccaccgcccugaccucccagagcgggaaccucgcgagcgagucccugcaccugccgagcuccagcuccgaguucgacgagcgcaucgccgccuuccagacgaagagcggcaccgccuccgagauggggaccgagcgggccaugggccucagcgaggaguggaccgugcacucccaggaggcgacgaccagcgccuggucccccagcuuccugcccgcccuggagaugggcgagcucaccaccccgucccgcaagcggaacagcuccgggcccgaccugagcuggcugcacuucuaccgcacggccgcguccagcccccuccuggaccuguccagcagcuccgagagcaccgagaagcucaacaacuccaccggccugcagagcuccagcgugucccagaccaagacgaugcacgucgccaccguguucaccgacgggggcccccgcacccugcggagccucacggugucccuggggccggucagcaagaccgagggcuuccccaaggacucccgcaucgccaccaccagcuccagcgugcugcucucccccagcgccguggagucccggcgcaacagccgggucacgggcaaccccggggacgaggaguucaucgagccgagcaccgagaacgaguucggccugaccucccugcgcuggcagaacgacagccccaccuucggggagcaccagcucgccuccagcuccgaggugcagaacggcagccccaugucccagacggagaccgugagccgguccgucgcgcccaugcgcgggggcgagaucaccgcccacuggcugcugaccaacagcaccacguccgccgacgugaccggcagcuccgccagcuacccggagggggugaacgccuccguccucacccaguucagcgacuccaccgugcagagcggcgggucccacacggcgcugggcgaccggagcuacagcgaguccagcuccaccagcuccagcgagucccugaacagcuccgccccccgcggggagcggagcaucgccggcaucuccuacggccaggugcgcgggaccgccaucgagcagcggaccagcuccgaccacacggaccacaccuaccucagcuccaccuucaccaagggcgagcgcgcccugcugagcaucacggacaacuccagcuccagcgacaucgucgagagcuccaccagcuacaucaagaucuccaacagcucccacagcgaguacuccagcuucuuccacgcgcagaccgagcgguccaacaucagcuccuacgacggggaguacgcccagcccagcaccgagucccccgugcugcacacgagcaaccucccguccuacacccccaccaucaacaugcccaacaccagcgugguccuggacacggacgccgaguucguguccgacagcuccagcagcuccagcuccagcuccagcuccagcuccagcggccccccgcugccccuccccuccgucagccagucccaccaccuguucagcuccauccugcccagcacccgcgccuccgugcaccuccugaagagcaccuccgacgcgagcaccccguggagcuccagccccuccccccugccggugagccucacgaccuccaccagcgccccccuguccgucagccagaccacgcugccccaguccagcuccacccccgugcucccgcgggcccgcgagacccccgugaccagcuuccagacguccaccaugaccagcuucaugaccaugcugcacuccagccagacggccgaccugaagucccagagcaccccccaccaggagaaggucaucaccgaguccaagagccccagccucgugucccugccgaccgagagcaccaaggccgugacgaccaacuccccccugccccccagccucaccgaguccagcaccgagcagacgcugccggcgaccuccaccaaccuggcccagaugagccccaccuucacgaccaccauccucaagaccucccagccccugaugacgacccccggcacccugagcuccaccgccagccucgucacggggccgaucgccgugcagaccaccgccggcaagcagcugucccugacccaccccgagauccucgugccccagaucagcacggaggggggcaucuccaccgagcggaaccgcgucaucguggacgcgaccaccgggcugaucccccugacgagcgugccgaccuccgccaaggagaugaccaccaagcucggcgucacggccgaguacagccccgccagccgcucccugggcaccagccccuccccccagaccaccguggugagcacggccgaggaccuggcgccgaaguccgccaccuucgccguccagagcuccacccagagccccaccacgguguccagcuccgccagcgugaacuccugcgcggucaaccccugccuccacaacggggagugcguggccgacaacaccagccggggcuaccacugccgcugccccccguccuggcagggggacgacugcagcguggacgucaacgagugccuguccaaccccugccccagcaccgccaugugcaacaacacccagggcuccuucaucugcaagugcccggugggguaccagcuggagaagggcaucugcaaccucgugcggaccuucgucacggaguucaagcugaagcgcaccuuccugaacaccaccguggagaagcacagcgaccuccaggagguggagaacgagaucacgaagacccugaacaugugcuucagcgcccugcccuccuacauccggagcaccguccacgccucccgcgagagcaacgcgguggugaucucccuccagaccacguucagccuggccuccaacgucacccuguucgaccucgccgaccggaugcagaagugcgugaacagcugcaaguccagcgccgaggugugccagcugcugggcucccagcgccggaucuuccgcgccgggagccucugcaagcggaagucccccgagugcgacaaggacaccagcaucugcaccgaccuggacggcgucgcgcugugccagugcaaguccggguacuuccaguucaacaagauggaccacagcugccgcgccugcgaggacggcuaccggcucgagaacgagacgugcauguccugccccuucgggcugggcggccugaacugcgggaacccguaccagcucaucaccguggugaucgccgccgccggcgggggccugcugcucauccuggggaucgcgcugaucgucaccugcugccgcaagaacaagaacgacaucagcaagcucaucuucaaguccggcgacuuccagaugagccccuacgccgaguaccccaagaacccccggagccaggaguggggccgcgaggccaucgagaugcacgagaacggguccaccaagaaccugcugcagaugacggacguguacuacagcccgaccuccgugcggaaccccgagcucgagcgcaacggccuguaccccgccuacaccgggcugcccggcagccggcacuccugcaucuucccgggccaguacaaccccagcuucaucuccgacgagagccgccggcgcgacuacuucuga

SEQ ID NO: 31045 - RNA, 2655 nt, Artificial Sequence
  derived and/or modified sequence opt1 from HELLS__Homo_sapiens__NP_001275996
augcccgccgagcgcccggccggcagcgggggcuccgaggcgcccgccaugguggagcagcuggacaccgccgucaucacccccgccaugcucgaggaggaggagcagcuggaggccgcggggcuggagcgggagcgcaagaugcucgagaaggcccggaugagcugggaccgcgaguccacggagauccgguaccgccggcugcagcaccuccucgagaaguccaacaucuacagcaaguuccugcugaccaagauggagcagcagcagcucgaggagcagaagaagaaggagaagcuggagcgcaagaaggagagccugaaggugaagaagggcaagaacuccaucgacgccagcgaggagaagcccgugaugcggaagaagcgcgggcgggaggacgaguccuacaacaucagcgaggucauguccaaggaggagauccucagcguggccaagaagaacaagaaggagaacgaggacgagaacuccagcuccaccaaccugugcguggaggaccugcagaagaacaaggacagcaacuccaucaucaaggaccgccucagcgagaccguccggcagaacacgaaguucuucuucgacccggugcgcaagugcaacggccagcccgugcccuuccagcagcccaagcacuucaccggcggggucaugcggugguaccagguggagggcauggaguggcugcgcaugcugugggagaacgggaucaacggcauccucgcggacgagauggggcugggcaagaccgugcagugcaucgccaccaucgcccugaugauccagcggggcgucccggggcccuuccucgugugcggcccccuguccacgcugcccaacuggauggccgaguucaagcgcuucaccccggacauccccaccaugcucuaccacgggacccaggaggagcggcagaagcuggugcgcaacaucuacaagcggaagggcacgcugcagauccaccccgucgugaucaccagcuucgagaucgccaugcgcgaccgcaacgcgcuccagcacugcuacuggaaguaccugaucguggacgagggccaccggaucaagaacaugaagugccgccugauccgggagcucaagcgcuucaacgccgacaacaagcugcugcucaccgggacgccccugcagaacaaccugagcgagcucuggucccugcugaacuuccuccugccggacgucuucgacgaccucaagagcuucgaguccugguucgacaucaccagccuguccgagaccgccgaggacaucaucgccaaggagcgggagcagaacgugcugcacaugcugcaccaggagcgcaucccccggauguacgugagcgaguucaccgacgagggcuucuucgaggggaagcuccccucccgcaaggaccuguacgacauccggcccuacgagaacaccuaccugcucaagcugcacacgaacuucgagauccugaccccguuccugcuccgccggcucaagagcgacgucgcccuggaggugccgcccaagcgcgagguggucguguacgcgccccuguccaagaagcaggagaucuucuacaccgccaucgucaaccggaccaucgccaacauguucggcagcuccgagaaggagacgaucgagcugagccccaccgggcgccccaagcggcgcacccggaaguccaucaacuacagcaagaucgacgacuuccccaacgagcuggagaagcucaucucccagauccagcccgagguggaccgcgagcgggccguggucgaggugaacaucccgguggagagcgaggucaaccugaagcugcagaacaucaugaugcuccugcgcaagugcugcaaccaccccuaccugaucgaguaccccaucgacccggugacccaggaguucaagaucgacgaggagcucgugacgaacuccggcaaguuccugauccuggaccgcaugcuccccgagcugaagaagcggggccacaagguccugcuguucagccagaugaccuccaugcuggacauccugauggacuacugccaccuccgcgacuucaacuucagccggcuggacgggagcauguccuacagcgagcgcgagaagaacaugcacuccuucaacaccgaccccgagguguucaucuuccuggugagcacccgggccggcgggcucggcaucaaccugacggcggccgacaccgucaucaucuacgacuccgacuggaacccccagagcgaccugcaggcccaggaccgcugccaccggaucgggcagaccaagccggugguggucuaccgccucgugaccgccaacacgaucgaccagaagaucguggagcgggccgcggccaagcgcaagcuggagaagcugaucauccacaagaaccacuucaagggcggccaguccgggcucaaccugagcaagaacuuccuggaccccaaggagcucauggagcugcugaagucccgggacuacgagcgcgagaucaagggcagccgggagaaggucaucuccgacaaggaccucgagcugcugcucgaccgcagcgaccugaucgaccagaugaacgccuccgggcccaucaaggagaagaugggcaucuucaagauccuggagaacagcgaggacuccagccccgagugccucuucuga

SEQ ID NO: 31046 - RNA, 3306 nt, Artificial Sequence
  derived and/or modified sequence opt1 from HELQ__Homo_sapiens__NP_598375
auggacgagugcggcagccgcauccggcgccgggugucccugcccaagcgcaaccggccgagccucgggugcaucuucggcgcccccaccgccgcggagcuggagcccggggacgagggcaaggaggaggaggagauggucgccgagaaccgccggcgcaagaccgccggggugcugcccguggagguccagccgcuccugcuguccgacagccccgagugccucgugcugggcggcggggacacgaaccccgaccugcuccggcacaugcccaccgaccgcggcgugggggaccagccgaacgacuccgaggucgacauguucggcgacuacgacagcuucaccgagaacuccuucaucgcccagguggacgaccuggagcagaaguacaugcagcugcccgagcacaagaagcacgccaccgacuucgcgacggagaaccucugcagcgaguccaucaagaacaagcugagcaucaccaccaucgggaaccugaccgagcuccagacggacaagcacaccgagaaccaguccggcuacgagggcgugaccaucgagcccggggccgaccugcuguacgacguccccagcucccaggccaucuacuucgagaaccuccagaacagcuccaacgaccugggcgaccacagcaugaaggagcgggacuggaaguccagcucccacaacaccgugaacgaggagcugccgcacaacugcaucgagcagccccagcagaacgacgagagcagcuccaaggugcgcacgagcuccgacaugaaccggcgcaagagcaucaaggaccaccucaagaacgccaugaccgggaacgcgaaggcccagacccccaucuucucccggagcaagcagcugaaggacacccugcucuccgaggagaucaacgucgccaagaagacgguggagagcuccagcaacgaccugggccccuucuacucccugccgagcaaggugcgcgaccucuacgcccaguucaagggcaucgagaagcuguacgaguggcagcacacgugccugacccucaacuccguccaggagcggaagaaccugaucuacagccugcccaccuccgggggcaagacccucguggccgagauccugaugcugcaggagcuccugugcugccgcaaggacgugcugaugauccuccccuacgucgcgaucgugcaggagaagaucagcgggcuguccagcuucggcaucgagcugggguucuucguggaggaguacgccggcuccaagggccgguucccgcccaccaagcgccgggagaagaagucccucuacaucgccaccaucgagaaggggcacagccuggucaacagccugaucgagaccggccgcaucgacagccucgggcuggugguggucgacgagcugcacaugaucggcgaggggucccgcggcgccacgcucgagaugacccuggccaagauccuguacaccagcaagaccacgcagaucaucggcauguccgcgacccugaacaacguggaggaccuccagaaguuccugcaggccgaguacuacaccagccaguuccggcccgucgagcugaaggaguaccucaagaucaacgacaccaucuacgagguggacuccaaggccgagaacgggaugacguucagccgccugcugaacuacaaguacuccgacacccucaagaagauggaccccgaccaccugguggcccuggucaccgaggugauccccaacuacagcugccucguguucugcccguccaagaagaacugcgagaacgucgccgagaugaucugcaaguuccugagcaaggaguaccugaagcacaaggagaaggagaagugcgaggugaucaagaaccucaagaacaucggcaacgggaaccugugccccgugcugaagcggaccauccccuucggcgucgcguaccaccacuccgggcucacgagcgacgagcgcaagcugcuggaggaggccuacuccaccggcgugcucugccuguucacgugcaccagcacccuggccgccggcgugaaccuccccgcccggcgcgucauccugcgggcgccguacguggccaaggaguuccugaagcgcaaccaguacaagcagaugaucgggcgggccggccgcgccgggaucgacaccaucggcgaguccauccucauccugcaggagaaggacaagcagcagguccuggagcucaucaccaagccccuggagaacugcuacagccaccuggugcaggaguucaccaagggcauccagacccucuuccugagccugaucgggcucaagaucgcgacgaaccuggacgacaucuaccacuucaugaacggcaccuucuucggggugcagcagaaggugcugcucaaggagaagucccugugggagaucaccgucgagagccugcgguaccucaccgagaagggccugcugcagaaggacacgaucuacaaguccgaggaggaggugcaguacaacuuccacaucaccaagcucgggcgcgccagcuucaagggcaccaucgaccuggccuacugcgacauccuguaccgggaccucaagaagggccuggaggggcuggugcucgagucccugcugcaccucaucuaccugaccacgcccuacgaccuggucagccagugcaacccggacuggaugaucuacuuccgccaguucucccagcucagccccgccgagcagaacguggccgcgauccugggcguguccgagagcuucaucgggaagaaggccuccggccaggccaucgggaagaaggucgacaagaacguggugaaccggcuguaccucagcuucguccuguacacccugcucaaggagaccaacaucuggaccguguccgagaaguucaacaugccccgcggcuacauccagaaccugcugacgggcaccgccagcuucuccagcugcgugcuccacuucugcgaggagcuggaggaguucugggucuaccgggcccugcucguggagcugaccaagaagcugaccuacugcgugaaggcggagcucaucccccugauggaggucacgggggugcuggagggccgcgccaagcagcucuacuccgccggguacaagagccugaugcaccuggccaacgccaacccggaggugcucguccggaccaucgaccaccugucccgccgccaggcgaagcagaucgugagcagcgccaagaugcugcuccacgagaaggccgaggcccugcaggaggagguggaggagcugcuccggcugcccuccgacuuccccggcgcggucgccagcuccaccgacaaggccuga

SEQ ID NO: 31047 - RNA, 729 nt, Artificial Sequence
  derived and/or modified sequence opt1 from HELT__Homo_sapiens__NP_001287710
augagcgacaagcugaaggagcgcaagcggacccccgugucccacaaggucaucgagaagcgccggcgcgaccggaucaaccgcugccucaacgagcugggcaagaccgugcccauggcccuggccaagcagagcuccgggaagcucgagaaggcggagauccuggagaugacggugcaguaccugcgggcccuccacagcgccgacuucccccgcggccgggagaaggccgagcugcuggccgaguucgcgaacuacuuccacuacggguaccacgagugcaugaagaaccucguccacuaccugaccaccguggagcgcauggagaccaaggacacgaaguacgcccggauccuggccuuccuccaguccaaggcccgccugggcgcggagcccgccuucccgccccuggggagccuccccgagcccgacuucuccuaccagcugcaccccgccggcccggaguucgccggccacagccccggggaggccgcgguguucccccagggcuccggggccggccccuucccguggccgcccggggccgcccggagccccgcccugcccuaccuccccuccgcgcccgucccccuggccagcccggcccagcagcacucccccuuccugacccccgugcagggccucgaccgccacuaccugaaccugaucggccacgcccaccccaacgcccucaaccugcacaccccgcagcacccgcccgugcuguga

SEQ ID NO: 31048 - RNA, 7950 nt, Artificial Sequence
  derived and/or modified sequence opt1 from HELZ2__Homo_sapiens__NP_001032412
auggccgugugggaggccgagcagcugggcgggcuccagcgcggcgaccugcugacgccgcccgcccccgacggggacggccggaccgcgccccuggggcagccgcccggcgcccagcuguacugccccgccugccuggugacgugccacagccaggaggccuucgagaaccacugcgcguccagcgagcacgcccagaugguggccuucgaccaggcccuccccugggagcaccgcagcccgccgcccggccugagcaaguucgagcugugccccaagcccgaccucugcgaguacggggacgccugcaccaaggcccacuccgcccaggagcugcaggagugggugcggcgcacccaggccgucgagcugcggggccaggccgccuggcaggacgggcucgugcccuaccaggagcgccugcuggccgaguaccagcgguccuccuccgaggugcucguccuggccgagacccuggacggcgugcgcgugaccugcaaccagccccucauguaccaggcccaggagcggaagacccaguacuccuggaccuucgccguccacagcgaggagccccugcugcacguggcgcuccugaagcaggagcccggggccgacuucucccugguggcccccggccugccgcccggccgccuguacgcccgcggcgagcgcuuccggguccccagcuccaccgccgacuuccaggugggcgugcgcguccaggcggccagcuucgggaccuucgagcagugggugguguucgacuucggccggcgccccguccugcuccagaagcugggccugcagcucgggcagggccggcgccccgggcccugccggaaccuggcccugggccaccccgaggagauggagcgcuggcacaccgggaaccggcacguggugcccggcgucgagcgcaccgccgagcagaccgcccucauggcgaaguacaagggccccgcccuggcccuggaguucaaccgcuccagcguggccuccgggcccaucagccccaccaacuaccggcagcgcaugcaccaguuccucuacgaggaggaggcggcccagcagcagcugguggccaagcugacccuccggggccaggucuuccugaagaccgcccugcagacccccgcccucaacaugcuguucgcgccgcccggggcccuguacgccgaggugcccguccccuccagccucaugcccgacaccgaccagggcuuccugcuggggcgcgccgugagcaccgcccucguggcgcccguccccgcccccgacaacaccguguucgaggugcggcuggagcgccgggccuccagcgagcaggcccuguggcugcuccugcccgcccgcugcugccuggcgcucggccugcagcccgaggcccggcugguccucgaggugcaguuccagaucgaccccaugaccuuccgccuguggcaccaggccguggacacgcugcccgaggagcagcucgucgugcccgaccugccgaccugcgcccugccccggcccugguccgugccgccccugcgccggggcaaccgcaagcaggagcuggcggucgcccugaucgccggguggggccccggggacggccggcgcgugccgccccugcugaucuacgggcccuucggcaccggcaagaccuacacgcuggccauggccagccucgaggugauccggcgccccgagaccaagguccugaucugcacccacaccaacuccgcggccgacaucuacauccgggaguacuuccacagccacguguccgggggccaccccgaggccacgccccugcgcgugauguacaccgaccgcccccucagccagaccgaccccgucacccugcaguacugcugccugacggacgaccggcaggccuuccggccgcccacccgggccgagcucgcgcgccaccgggugguggucaccaccacgucccaggcccgcgagcugcgggugccggugggguucuucagccacauccugaucgacgaggccgcccagaugcucgagugcgaggcccugacgccccucgcguacgccucccacggcacccgccucguccuggccggcgaccacaugcaggucacgccccgccuguucagcguggcccgcgcgcgggccgccgagcacacccuccugcaccgccuguuccucugcuaccagcaggagacgcacgaggucgcccggcagucccgccugguguuccacgagaacuaccggugcaccgacgccaucgugagcuucaucucccgccacuucuacgucgcgaaggggaaccccauccacgcccggggcaaggugccgccccacccccgccacuacccccugauguucugccacguggccgggagcccggaccgggacauguccauggccagcuggcucaaccuggccgagaucgcgcaggucguggagaaggugcaggaggccuacaacaccuggcccuccugcuggggcgggcgcgagcagcggugcaucugcgucgugagccacggcgcccaggugagcgcccugcgccaggagcuccgccggcgcgaccugggccaggucuccguggggagcuucgagauccugcccggccggcaguuccgcguggucgugcucuccaccgugcacacgugccagagccugcugucccccggggcccucgcgccggaguucuucaccgacgcccggguccugaacaccgugcugacccgcgcccagagccagcucguggucgugggcgacgccguggcccugugcuccuucggggcgugcggcaagcugugggagagcuucauccgggagugcgucgagcgccacuccgugugccccgagggccucagcauggagcaggucgagcaggggguggcccagcggcgccgguggccgccccggggcacgcaggccggggccgcgggcaacugggaggccgccccggagcccgugggggaccuggccgaggagcaggccgcggucgugaccgccauggugaaggccgagcccggcgacgaggcccugucccccgccagccgggacaucaccgcgaccacggcccagaccgaggccgccgccgcgccggccggcgacgccgucaaggaggacguggugcccggggccugcgcggccggcgccgccgccgcggccggggucgaguccaccgaggccgaggacgccgaggccgacuucuggcccugggacggcgagcucaacgcggacgacgccauccugcgcgagcugcucgacgagagccagaaggugauggugaccgucggggaggacggccugcuggacacgguggcccggcccgagucccuccagcaggcccgccuguacgagaaccugccgcccgccgcgcuccggaagcugcugcacgccgagcccgagcgcuaccggcacugcagcuucgugcccgagaccuucgagcgcgccuccgccaucccgcucgacgacgcgagcagcggccccauccagguccgcgggcggcuggacugcggcauggccuucgccggggacgaggugcuggugcagcuccuguccggcgacaaggcccccgagggccgccugcgggggcgcguccucggcgugcugaagcggaagcgccacgagcuggccuucgugugccggauggacaccugggacccgcgcaucaugguccccaucaacgggagcgugaccaagaucuucguggcggagcucaaggaccccucccagguccccaucuacagccugcggaagggccgccugcagcggguggggcucgagcgccugacggccgaggcccggcacucccgccuguucugggugcagaucguccucuggcggcagggcuucuacuacccgcugggcaucgugcgcgaggugcugcccgaggccagcaccugggagcaggggcuccggauccugggccuggaguacucccuccgcgugccgcccagcgaccaggccaccaucaccaaggugcugcagaaguaccacacggagcuggggcggguggcgggccgccgggaggacugccgcgccuuccucaccuucaccgucgacccgcagggggccugcaaccuggacgacgcccuguccgugcgcgaccugggcccccggugcgagguggccguccacaucaccgacguggcgagcuucgugccccgcgacggcguccucgacguggaggcccggcgccagggggccgccuucuacgcccccggccgggagccggugcccaugcugcccgcgucccugugccaggacguccucagccugcugcccgggcgcgaccggcucgccaucucccuguuccugacgauggagaaggccagcggccagcucaagucccugcgcuucgccccgagcguggugcaguccgaccggcagcugagcuacgaggaggcggaggaggucauccgccagcaccccggggccggccgggagcuccccgcccgccuggacuccguggacgccugcguggucgccgcgugcuacuucagccggcugcuccgccggcaccgccugcggagcgacugcuucuacgagcagcccgacgaggacggcacccugggguuccgcgccgcccacaucauggugaaggaguacaugauccaguucaaccggcucguggccgaguuccuggucggcuccgagugcacccgcaccgugacgccgcugcgcuggcagcccgcgccccggagccagcagcucaaggcgcugugcgagaagcacggggaccgcgucccccugucccuccaccugggccaccaccuccacggcgggggcgggagcccgcccgacacccggcuccaccuccuggccucccucuggaagcagguccaguucgccgcccgcacccaggacuacgagcagaugguggaccuggugaccacggacgacaugcaccccuuccuggcccccgcgggccgggaccuccgcaaggcccuggagcggagcgccuucgggcgcugcgcccggggccaccagcagcagggcgggcacuacucccuccagguggacugguacaccugggcgaccagcccgauccgccgguaccucgacgugguccugcagcgccagauccugcucgcccugggccacgggggcuccgccuacagcgcccgggacaucgacgggcugugccaggccuucucccuccagcacgcgcuggcccagagcuaccagcgccgggcccgcucccugcaccucgccgugcagcugaaggcccagccccuggacaagcucggcuucguggucgacguggaggcgggcagccggugcuuccgccugcuguuccccuccaaccgggagacccucccggaccccugccccgugcccuacgggagccugcagcuggccgagcacccgcacgcccucgccggccgccccgggcugcggcugcucuggcgccgccgggucuacuccgcccagggcagcagcccgccccugccgcugcccgggaccgugcccgacccccacacgcucgcgguggagaccgcccuguggaagcagcugcucgagcuggucgagcugcagcgcuggccggaggccgccgcgcucauccaggagaagggcgaggccagccagcggcgcgagcugguccaggugcagcggagccacugcggccacuuccuggaggucgcccgcgagcucggguccggcgacacccuccaggugcagcuggggaccagccuccagcacggcuuccuggugcccagcccccagcuguggacggucgcccccggguucucccucugccuggagcacguggagcggccgggcgacugcuucuccggccgcguguaccgggcgccccgcgaccgguaccgcgacgucgacgaguacgcgugcgugugggagcccuucugcgcccuggagagcgccaccggggccguggccgagaacgacuccgucacccuccagcaccugagcguguccugggaggcgagccggacgccccagggccagcugcagggggccuuccgccucgaggccgccuuccuggaggagaacugcgccgacaucaacuucuccugcugcuaccugugcauccggcucgagggccugccggcgcccacggccagcccccgccccggcccguccagccuggggcccggccucaacguggaccccgggaccuacaccugggucgcccacggccagacccaggacugggaccaggagcggcgcgccgaccggcaggaggccccgcgccgcgugcaccuguucgugcaccacauggggauggagaagguccccgaggaggugcugcggcccggcacccucuucaccguggagcugcugcccaagcagcucccggaccugcgcaaggaggaggcgguccggggccuggaggaggccagcccccuggugaccagcaucgcccuggggcgccccgugccccagccgcugugccgggucauccccucccgcuuccucgagcggcagaccuacaacauccccggcgggcgccacaagcugaaccccagccagaacguggccgugcgggaggcgcuggagaagccguucacggucauccaggggccgcccgggaccggcaagaccaucgugggccugcacaucguguucugguuccacaaguccaaccaggagcagguccagcccgggggcccgccccgcggggagaagcggcucggcgggcccugcauccuguacugcggccccagcaacaagagcguggacgugcuggccggccuccugcugcgccggauggagcucaagccgcugcgcgucuacuccgagcaggccgaggccagcgaguuccccgugccccggguggggucccgcaagcugcuccggaaguccccgcgcgagggccggcccaaccagucccugcgcagcaucacccugcaccaccggauccgccaggcccccaaccccuacuccagcgagaucaaggcguucgacacgcgccuccagcgcggggagcuguucucccgcgaggaccuggucugguacaagaaggugcucugggaggcccggaaguucgagcuggaccgccacgaggucauccugugcacgugcagcugcgccgccuccgccagccucaagauccuggacgugcggcagauccugguggacgaggcgggcauggccaccgagcccgagacccucaucccgcugguccaguucccccaggccgagaagguggugcugcucggggaccacaagcagcugcgccccgucgugaagaacgagcggcugcagaaccucggccuggaccgcucccuguucgagcgguaccacgaggacgcccacaugcucgacacgcaguaccgcaugcacgagggcaucugcgccuucccgagcguggcguucuacaaguccaagcugaagaccuggcaggggcugcggcggccgcccagcguccucggccacgccgggaaggaguccugccccgugaucuucggccacgugcagggccacgagcggagccugcuggucuccaccgacgaggggaacgagaacagcaaggccaaccucgaggagguggccgaggugguccgcaucaccaagcagcugacgcugggccggaccguggagccgcaggacaucgcggugcucacccccuacaacgcccaggccagcgagaucuccaaggcccugcgccgggaggggaucgccggcgucgcggugagcuccaucaccaagagccagggguccgaguggcgcuacgugcuggucagcacggugcggaccugcgccaaguccgaccucgaccagcgccccaccaagagcuggcugaagaaguuccugggcuucguggucgaccccaaccaggugaacguggccgucacccgcgcccaggagggccucugccugaucggggaccaccuccugcugcggugcugcccgcuguggcgcucccuccuggacuucugcgaggcccagcagacgcuggugcccgcgggccaggugcgggucugccgccggcccaccaugcccagcuga

SEQ ID NO: 31049 - RNA, 5829 nt, Artificial Sequence
  derived and/or modified sequence opt1 from HELZ__Homo_sapiens__NP_055692
auggaggaccgccgcgccgagaaguccugcgagcaggccugcgagucccugaagcgccaggacuacgagauggcgcucaagcacugcaccgaggcccugcugagccucgggcaguacagcauggccgacuucaccgggcccugcccccuggagaucgagcgcaucaagaucgagagccugcucuaccgcaucgccagcuuccugcagcugaagaacuacgugcaggccgacgaggacugccggcacgugcucggcgaggggcuggccaagggcgaggacgccuuccgcgccgugcugugcugcaugcagcucaaggggaagcugcagcccgugagcaccauccuggccaagucccucaccggcgagagccugaacggcauggucaccaaggaccugacccggcucaagacccugcuguccgagaccgagaccgcgaccagcaacgcccucuccggguaccacguggaggaccuggacgagggcagcugcaacggguggcacuuccggccgccgccccggggcaucacguccagcgaggaguacacccugugcaagcgcuuccucgagcaggggaucugccgguacggcgcccagugcaccuccgcccacagccaggaggagcuggccgaguggcagaagcgcuacgccucccggcugaucaagcucaagcagcagaacgagaacaagcagcugagcggcuccuacauggagacccugaucgagaaguggaugaacagccucagccccgagaaggugcuguccgagugcaucgagggggucaagguggagcacaaccccgaccugagcgugacggucuccaccaagaagucccaccagaccuggaccuucgcccucacgugcaagcccgcccgcaugcuguaccggguggcccugcucuacgacgcccaccgcccccacuucuccaucaucgccaucagcgccggcgacuccaccacccaggugagccaggagguccccgagaacugccaggaguggaucgggggcaagauggcccagaacggccuggaccacuacguguacaagguggggaucgccuucaacaccgagaucuucggcacguuccggcagaccaucgucuucgacuucgggcuggagcccgugcucaugcagcgcgugaugaucgacgccgcguccaccgaggaccuggaguaccugaugcacgccaagcagcagcucgucaccacggccaagcggugggacagcuccagcaagaccaucaucgacuucgagcccaacgagaccaccgaccuggagaagucccugcucauccgcuaccagaucccccugagcgccgaccagcuguucacgcaguccgugcucgacaagagccugaccaaguccaacuaccagagccggcugcacgaccugcucuacaucgaggagaucgcccaguacaaggagaucuccaaguucaaccugaaggugcagcugcagauccucgcgagcuucaugcugaccggcgucagcgggggcgccaaguacgcccagaacggccagcuguucgggcgcuucaagcucaccgagacgcuguccgaggacacccuggccggccgccucgugaugaccaaggugaacgcggucuaccugcugcccgugcccaagcagaagcucguccagacccaggggacgaaggagaagguguacgaggccaccaucgaggagaagaccaaggaguacaucuuccugcggcugagccgcgagugcugcgaggagcucaaccugcggcccgacugcgacacccagguggagcugcaguuccagcucaaccgccugccccugugcgagaugcacuacgcccucgaccggaucaaggacaacggcguccuguuccccgacaucuccaugacccccacgauccccuggagccccaaccgccagugggacgagcagcuggacccccggcucaacgccaagcagaaggaggccgugcuggcgaucaccacgccccuggccauccagcucccgcccgugcugaucaucgggcccuacggcaccggcaagacguucacccuggcccaggccgucaagcacauccuccagcagcaggagacccgcauccugaucugcacccacuccaacagcgccgcggaccuguacaucaaggacuaccuccaccccuacguggaggccgggaacccccaggcccggccccugcgcguguacuuccggaaccgcugggucaagacggugcaccccgugguccaccaguacugccugaucuccagcgcccacuccaccuuccagaugccccagaaggaggacauccucaagcaccgggugguggucgugacccugaacaccagccaguaccugugccagcucgaccuggagcccggcuucuucacgcacauccugcucgacgaggccgcgcaggccauggagugcgagaccaucaugccccuggcccuggccacccagaacacccgcaucgugcucgcgggggaccacaugcagcugucccccuucgucuacagcgaguucgcccgggagcgcaaccugcacgugucccuccuggaccggcuguacgagcacuaccccgccgaguuccccugccgcauccuccugugcgagaacuaccggagccacgaggccaucaucaacuacacguccgagcuguucuacgagggcaagcucauggccagcgggaagcagcccgcgcacaaggacuucuacccccugaccuucuucaccgcccgcggcgaggacgugcaggagaagaacuccaccgccuucuacaacaacgccgaggucuucgaggugguggagcgcgucgaggagcugcggcgcaaguggcccguggccuggggcaagcucgacgacgggagcaucggcguggucacgcccuacgcggaccagguguuccggauccgcgccgagcugcggaagaagcgccugagcgacgugaacgucgagcgggugcucaacgugcaggggaagcaguuccgcguccuguuccuguccaccgugcggacccgccacacgugcaagcacaagcagacgcccaucaagaagaaggagcagcuccuggaggacagcaccgaggaccuggacuacggcuuccucuccaacuacaagcugcugaacaccgccaucacccgggcccagagccucguggccgucgugggcgaccccaucgcgcugugcuccaucgggcgcugccggaaguucugggagcgcuucaucgcccugugccacgagaacagcucccuccacggcaucacguucgagcagaucaaggcccagcuggaggcccuggagcucaagaagaccuacgugcugaacccccuggcgcccgaguucaucccccgggcccuccgccugcagcacagcggguccaccaacaagcagcagcaguccccgcccaagggcaagucccugcaccacacccagaacgaccacuuccagaacgacgggaucguccagcccaaccccagcgugcucaucggcaaccccauccgggccuacacgccgccgccgccccugggcccccaccccaaccuggggaagucccccagccccgugcagcgcaucgacccccacaccggcaccuccauccucuacguccccgccguguacgggggcaacguggucaugagcgugccccugcccgugcccuggaccggguaccagggccgguucgccgucgacccccgcaucaucacgcaccaggcggccauggccuacaacaugaaccugcuccagacccacggccgggggucccccauccccuacggccuggggcaccacccgcccgugaccaucggccagccccagaaccagcaccaggagaaggaccagcacgagcagaaccgcaacggcaagagcgacaccaacaacuccggccccgagaucaacaagauccgcaccccggagaagaagcccacggagcccaagcaggucgaccuggagagcaacccccagaaccggagcccggagucccgccccagcgucguguaccccuccaccaaguucccccggaaggacaaccucaacccgcgccacaucaaccugccccugcccgcgccccacgcccaguacgcgaucccgaaccggcacuuccacccccucccccagcugccccgcccgcccuuccccaucccgcagcagcacacccugcugaaccagcagcagaacaaccuccccgagcagcccaaccagaucccgccccagcccaaccaggucgugcagcagcagagccagcugaaccagcagccccagcagcccccgccccagcugucccccgccuaccaggccggccccaacaacgccuucuucaacagcgccguggcgcaccggccccagagcccgcccgccgaggccgucauccccgagcagcagccgccgcccaugcuccaggaggggcacagcccccugcgcgccaucgcccagccgggccccauccugcccucccaccucaacagcuucaucgacgagaaccccuccgggcugccgaucggcgaggcgcuggaccggauccacgggagcguggcccucgagacccugcgccagcagcaggcccgguuccagcagugguccgagcaccacgccuuccugagccagggcuccgugcccuacccccaccaccaccacccccaccuccagcaccucccccagccgccccugggccugcaccagccgcccguccgcgcggacuggaagcugacgagcuccgccgaggacgagguggagaccaccuacagccgguuccaggaccugauccgcgagcucucccaccgggaccagagcgagacccgcgagcuggccgagaugccgccgccccagagccggcugcuccaguaccgccaggugcagucccgguccccgcccgccguccccuccccgcccagcuccacggaccacagcucccacuucagcaacuucaacgacaacucccgcgacaucgagguggccagcaaccccgcguucccccagcgccugccgccccagaucuucaacucccccuucagccugcccuccgagcaccucgcgcccccgccccugaaguaccuggcccccgacggggccuggaccuucgccaaccuccagcagaaccaccugaugggcccgggguuccccuacggccugccgccccucccgcaccggccgccccagaacccguucgugcagauccagaaccaccagcacgccaucggccaggagcccuuccacccccugagcucccgcaccgucagcuccagcucccugcccagccucgaggaguacgagccgcgggggcccggccgcccccuguaccagcggcgcaucagcuccagcuccgugcagcccugcagcgaggagguguccaccccgcaggacagccuggcccagugcaaggagcuccaggaccacuccaaccagagcuccuucaacuucagcucccccgagagcugggucaacacgaccuccagcacccccuaccagaacauccccugcaacggguccagccggaccgcccagccgcgcgagcugaucgcgccgcccaagacggugaagcccccggaggaccagcugaaguccgagaaccucgaggugagcuccagcuucaacuacagcguccugcagcaccugggccaguucccgccccucaugcccaacaagcagaucgccgaguccgcgaacagcuccagcccgcaguccagcgccgggggcaagcccgccauguccuacgccagcgcgcugcgggcgccgcccaagccgcggccgccgcccgagcaggccaagaaguccagcgacccgcugucccucuuccaggagcugagccugggcuccagcuccgggagcaacggcuucuacuccuacuucaaguga

SEQ ID NO: 31050 - RNA, 1455 nt, Artificial Sequence
  derived and/or modified sequence opt1 from HEMGN__Homo_sapiens__XP_011517148
auggaccugggcaaggaccagagccaccucaagcaccaccagacccccgacccgcaccaggaggagaaccacucccccgaggugaucgggaccuggagccugcgcaaccgggagcugcuccgcaagcggaaggccgaggugcacgagaaggagacgucccaguggcuguucggcgagcagaagaagcgcaagcagcagcggaccgggaagggcaaccgccgggggcgcaagcggcagcagaacaccgagcugaagguggagccccagccccagaucgagaaggagaucguggagaaggcccucgcgccgaucgagaagaagaccgagccgcccggcagcaucacgaaggucuuccccuccguggccagcccccagaaggugguccccgaggagcacuucuccgagaucugccaggagagcaacaucuaccaggagaacuucuccgaguaccaggagaucgccgugcagaaccacagcuccgagaccugccagcacgugagcgagcccgaggaccugucccccaagauguaccaggagaucagcguccugcaggacaacuccagcaagaucugccaggacaugaaggagccggaggacaacucccccaacacgugccaggugaucagcgugauccaggaccaccccuucaagauguaccaggacauggccaagcgcgaggaccucgcccccaagaugugccaggaggcggccgucccgaagauccugcccugccccaccuccgaggacaccgccgaccuggccggcugcagccuccaggcguaccccaagccggacgugcccaagggguacauccuggacaccgaccagaaccccgccgagcccgaggaguacaacgagaccgaccagggcaucgccgagaccgaggggcuguucccgaagauccaggagaucgccgagcccaaggaccucagcacgaagacccaccaggaguccgccgagcccaaguaccugccccacaagaccugcaacgagaucaucgugccgaaggcgcccagccacaagaccauccaggagacgccccacuccgaggacuacagcaucgagaucaaccaggagaccccgggcuccgagaaguacagccccgagaccuaccaggagauccccgggcuggaggaguacucccccgagaucuaccaggagaccagccagcucgaggaguacuccccggagaucuaccaggagacgcccggccccgaggaccugagcaccgagaccuacaagaacaaggacguccccaaggagugcuucccggagccccaccaggagaccggcgggccccagggccaggaccccaaggcccaccaggaggacgccaaggacgccuacacguucccgcaggagaugaaggagaagcccaaggaggagcccgggauccccgccauccugaacgagucccacccggagaacgacguguacagcuacguccucuucuga

SEQ ID NO: 31051 - RNA, 1251 nt, Artificial Sequence
  derived and/or modified sequence opt1 from HEPACAM__Homo_sapiens__NP_689935
augaagcgcgagcggggcgcccugagccgcgccucccgggcgcuccgccuggcccccuucguguaccugcuccugauccagaccgacccgcuggagggggucaacaucaccagccccgugcggcucauccacggcacgguggggaaguccgcccugcugagcguccaguacuccagcaccuccagcgaccgccccguggugaaguggcagcucaagcgggacaagcccgucaccguggugcaguccaucggcaccgaggucaucgggacgcugcgcccggacuaccgggaccgcauccggcuguucgagaacggcagccuccugcuguccgaccuccagcuggccgacgagggcaccuacgagguggagaucagcaucaccgacgacaccuucacgggggagaagaccaucaaccugaccguggacguccccaucucccgcccccaggugcucguggccagcaccacgguccuggagcuguccgaggcguucacccucaacugcagccacgagaacggcaccaagcccuccuacaccuggcugaaggacgggaagccgcugcucaacgacagccggaugcugcugucccccgaccagaaggugcucacgaucacccgcgugcugauggaggacgacgaccuguacagcugcauggucgagaaccccaucagccagggccggucccuccccgugaagaucaccguguaccgccggagcucccuguacaucauccugagcaccgggggcaucuuccuccuggucacgcuggugaccgugugcgccugcuggaagccguccaagcgcaagcagaagaagcucgagaagcagaacagccuggaguacauggaccagaacgacgaccggcugaagcccgaggccgacacccucccccgcuccggcgagcaggagcggaagaaccccauggcccuguacauccugaaggacaaggacagcccggagaccgaggagaaccccgcgcccgagccccgcuccgccacggagccggggccgcccggcuacagcgucucccccgccgugcccgggcgcagccccggccuccccauccgguccgcccgccgguacccccgcagcccggcccggucccccgcgaccggccgcacccacagcuccccgccccgggcccccagcucccccgggcgcagccggagcgccucccgcacccugcggacggccggcguccacaucauccgcgagcaggacgaggccgggcccguggagaucagcgcguga

SEQ ID NO: 31052 - RNA, 3483 nt, Artificial Sequence
  derived and/or modified sequence opt1 from HEPH__Homo_sapiens__NP_001124332
augugggccauggagagcggccaccuccucugggcccugcuguucaugcagucccucuggccccagcugaccgacggggcgacccgcguguacuaccugggcauccgggacguccaguggaacuacgccccgaaggggcgcaacgugaucacgaaccagccccucgacagcgacaucguggccuccagcuuccugaaguccgacaagaaccggaucggcgggaccuacaagaagaccaucuacaaggaguacaaggacgacagcuacaccgacgaggucgcccagcccgccuggcugggcuuccucggccccgugcugcaggcggaggugggggacgucauccugauccaccucaagaacuucgccacgcgcccguacaccauccacccccacggcguguucuacgagaaggacuccgaggggagccuguaccccgacggcuccagcgggccccugaaggccgacgacuccgugccgcccggcggcagccacaucuacaacuggaccauccccgaggggcacgcccccaccgacgcggacccggccugccucacguggaucuaccacucccacgucgacgcgccccgggacaucgccaccggccugaucgggccccugaucacgugcaagcgcggcgcccucgacggcaacagcccgccccagcggcaggacguggaccacgacuucuuccugcuguucuccguggucgacgagaaccucagcuggcaccugaacgagaacaucgccaccuacugcuccgaccccgccagcguggacaaggaggacgagacguuccaggaguccaaccgcaugcacgccaucaacggguucguguucggcaaccugcccgagcucaacaugugcgcccagaagcgggucgccuggcaccuguucgggaugggcaacgagaucgacgugcacaccgcguucuuccacgggcagaugcugaccacccgcggccaccacacggacguggccaacaucuuccccgccaccuucgucaccgccgagauggugccgugggagcccggcaccuggcucaucagcugccaggugaacagccacuuccgggacgggaugcaggcccuguacaaggucaaguccugcagcauggcgccgcccguggaccugcucacgggcaaggugcgccaguacuucaucgaggcccacgagauccagugggacuacgggcccaugggccacgacggguccaccggcaagaaccugcgggagcccggcagcaucuccgacaaguucuuccagaaguccuccagccgcaucgggggcaccuacuggaagguccgguacgaggccuuccaggacgagaccuuccaggagaagaugcaccuggaggaggaccgccaccucgggauccugggccccgugauccgggccgaggucggggacacgauccaggugguguucuacaaccgcgccucccagcccuucagcaugcagccgcacggcgucuucuacgagaaggacuacgagggcaccguguacaacgacggguccagcuaccccggccugguggcgaagcccuucgagaaggucaccuaccgguggaccgugccgccccacgccgggcccacggcccaggaccccgccugccucaccuggauguacuucuccgcggccgacccgauccgcgacaccaacagcggccuggugggcccccugcucgucugccgggccggggcccugggcgccgacgggaagcagaagggcguggacaaggaguucuuccugcuguucaccgugcuggacgagaacaaguccugguacagcaacgcgaaccaggccgccgccaugcuggacuuccgccuccuguccgaggacaucgagggguuccaggacagcaaccgcaugcacgccaucaacggcuuccuguucuccaaccucccccggcuggacaugugcaagggcgacacggucgcguggcaccuccuggggcugggcaccgagaccgacgugcacggggugauguuccagggcaacaccguccagcugcaggggaugcgcaagggcgccgccaugcuguucccccacacguucgugauggccaucaugcagccggacaaccucggcaccuucgagaucuacugccaggccgggagccaccgggaggcgggcaugcgcgccaucuacaacgugagccagugccccgggcaccaggccacgccccggcagcgcuaccaggccgcgcggaucuacuacaucauggccgaggaggucgagugggacuacugccccgaccgcuccugggagcgggaguggcacaaccagagcgagaaggacuccuacggcuacaucuuccugagcaacaaggacgggcugcucggcucccgcuacaagaaggccguguuccgggaguacaccgacggcaccuuccgcaucccgcggccccgcaccgggcccgaggagcaccugggcauccuggggccccucaucaagggcgaggugggggacauccugaccgucguguucaagaacaacgccagccggccguacuccgugcacgcccacggcguccuggagagcaccaccguguggccccucgcggccgagcccggcgagguggucacguaccaguggaacauccccgagcgcuccgggccgggccccaacgacagcgccugcguguccuggaucuacuacagcgccguggaccccaucaaggacauguacuccgggcuggucggcccccuggccaucugccagaagggcauccucgagccgcacgggggccggagcgacauggaccgcgaguucgcgcugcuguuccucaucuucgacgagaacaaguccugguaccuggaggagaacguggccacccacgggagccaggaccccggcuccaucaaccugcaggacgagaccuuccucgagagcaacaagaugcacgccaucaacgggaagcuguacgccaaccugcggggccucaccauguaccagggcgagcgcguggccugguacaugcuggcgauggggcaggacgucgaccugcacacgauccacuuccacgccgagagcuuccucuaccgcaacggcgagaacuaccgggccgacgugguggaccuguuccccgggaccuucgaggucguggagaugguggccuccaacccgggcaccuggcugaugcacugccacgucaccgaccacgugcacgcggggauggagacccucuucaccguguucagccgcaccgagcaccugagcccccugaccgucaucacgaaggagaccgagaaggugccgccccgggacaucgaggagggcaacgugaagaugcucggcaugcagauccccaucaagaacgucgagaugcuggccagcgugcugguggccaucuccgucacccuccugcugguggugcucgcccucgggggcgucgugugguaccagcaccgccagcggaagcugcgccggaaccgccggagcauccuggacgacuccuucaagcugcugagcuucaagcaguga

SEQ ID NO: 31053 - RNA, 267 nt, Artificial Sequence
  derived and/or modified sequence opt1 from HEPN1__Homo_sapiens__NP_001032647
augggcaacugggggcugggcaucgcccccuggguggacggggagagcgagcucgaguuccgccggcugggcaugcaggggccgcuggaggcccuccgccggcgcgaguggaacacccagcgggcguccuucagcuucuccuuccugaucgcccugagcccccacaccgucgacuacugccacuccuacgagcuguucaaccgccgguggcacggccacgugcucgccacgcagcgccccagccuguucauccucaugcugguguga

SEQ ID NO: 31054 - RNA, 14586 nt, Artificial Sequence
  derived and/or modified sequence opt1 from HERC1__Homo_sapiens__NP_003913
auggccaccaugaucccgccggugaagcugaaguggcucgagcaccugaacagcuccuggaucaccgaggacagcgagagcaucgccacccgggagggcguggccgugcuguacagcaagcugguguccaacaaggagguggugccccugccccagcagguccugugccucaaggggccccagcugcccgacuucgagcgggagagccuguccagcgacgagcaggaccacuaccucgacgcccugcuguccagccagcucgcccuggccaagauggugugcuccgacagccccuucgccggcgcccugcgcaagcggcuccuggugcugcagcgcguguucuacgcccucuccaacaaguaccacgacaaggggaaggucaagcagcagcagcacagccccgaguccagcuccggcagcgccgacgugcacuccgugagcgagcggccccgcagcuccaccgacgcccugaucgagauggggguccggaccggccugagccuccuguucgcgcugcuccgccaguccuggaugaugcccgugagcggccccgggcugucccugugcaacgacgugauccacaccgccaucgaggucgugagcucccugccgccccucagccuggccaacgaguccaagaucccgcccaugggccucgacugccugagccaggugaccaccuuccugaagggggucaccauccccaacuccggcgccgacacccucgggcggcgccuggccagcgagcugcuccugggccuggcggcccagcggggcucccuccgcuaccugcuggaguggaucgagauggcccucggggccagcgccguggugcacaccauggagaagggcaagcugcuguccagccaggaggggaugaucuccuucgacugcuucaugaccauccucaugcagaugcggcgcagccugggcuccagcgcggaccggagccaguggcgcgagcccacccggaccuccgacggccugugcagccucuacgaggccgcccugugccuguucgaggaggucugccgcauggccuccgacuacagccggacgugcgccucccccgacagcauccagaccggggacgcgcccaucguguccgagaccugcgagguguacgucuggggcagcaacuccagccaccagcugguggaggggacccaggagaagauccuccagcccaagcuggcccccuccuucagcgacgcccagacgaucgaggccggccaguacugcaccuucgucaucuccaccgacgggagcgugcgcgccugcggcaagggcuccuacgggcggcugggccucggggacagcaacaaccaguccacccugaagaagcugacguucgagccccaccgcagcaucaagaaggugagcuccagcaagggcuccgacgggcacacccucgcguucaccaccgagggcgaggucuucagcuggggcgacggggacuacggcaagcuggggcacggcaacuccagcacgcagaaguaccccaagcugauccaggggccccuccagggcaaggugguggucugcguguccgccggcuaccgccacagcgccgccgugaccgaggacggggagcuguacaccuggggcgagggggacuucggccggcugggccacggggacuccaacagccgcaacauccccacccucgucaaggacaucuccaacgugggcgaggugagcugcggguccagccacacgaucgcgcuguccaaggacggccggaccgucuggagcuucgggggcggcgacaacgggaagcugggccacggggacaccaaccgcguguacaagcccaaggugaucgaggcccuccagggcauguucauccggaaggucugcgccgggucccagagcucccuggcccugaccagcacgggccagguguacgccuggggcugcggggcgugccucggcugcgggagcuccgaggccaccgcccugcgccccaagcugaucgaggagcucgccgccacccggaucguggacgucagcaucggcgacucccacugccuggcgcugagccacgacaacgagguguacgccugggggaacaacuccaugggccagugcggccaggggaacagcaccggccccaucacgaagcccaagaagguguccgggcucgacggcaucgccauccagcagaucagcgccgggaccucccacagccuggccuggaccgcgcugccccgcgaccggcaggucguggccuggcaccgccccuacugcguggaccucgaggaguccaccuucagccaccuccgcuccuuccuggagcgcuacugcgacaagaucaacagcgagaucccgccccuccccuuccccuccagccgggagcaccacuccuuccugaagcugugccucaagcugcugagcaaccaccucgcccuggcccuggcgggcggcgucgccaccuccauccucgggcgccaggccggcccccugcggaaccuccuguuccgccugauggacagcacggugcccgacgagauccaggagguggucaucgagacccugagcgugggggccaccaugcuccugccgccccugcgggagcgcauggagcuccugcacucccugcucccccagggcccggaccggugggagagccuguccaagggccagcgcaugcagcuggacaucauccucaccagccugcaggaccacacgcacguggccucccugcucggguacagcucccccagcgacgcggccgaccuguccagcgucugcaccggcuacgggaaccuguccgaccagcccuacggcacccagagcugccaccccgacacccaccucgccgagauccugaugaagacgcugcuccgcaaccugggguucuacaccgaccaggccuucggcgagcuggagaagaacuccgacaaguuccuccugggcaccagcuccagcgagaacucccagccggcccaccuccacgagcuccugugcagccugcagaagcagcuccuggcguucugccacaucaacaacaucuccgagaacagcagcuccguggcccugcuccacaagcaccuccagcugcuccugccccacgccaccgacaucuacagccgguccgccaaccugcucaaggagagccccuggaacggguccgugggcgagaagcugcgcgacgucaucuacgugagcgccgcgggguccaugcugugccagaucgugaacagccuccugcugcuccccgucuccguggcccggccgcugcugagcuaccuccuggaccugcugccgccccuggacugccugaaccgccugcuccccgccgccgaccugcuggaggaccaggagcuccaguggccgcugcacggcgggcccgagcugaucgaccccgcgggccucccccugccgcagcccgcccaguccuggguguggcuggucgaccucgagcggacgaucgcccugcugaucggccgcugccucgggggcaugcugcaggggagccccguguccccggaggagcaggacaccgccuacuggaugaagacgccccuguucagcgacggcguggagauggacacgccccagcucgacaagugcauguccugccugcuggaggucgcccucagcgggaacgaggagcagaagcccuucgacuacaagcugcggccggagaucgcgguguacguggaccuggcccucggcugcuccaaggagcccgcccgcagccuguggaucuccaugcaggacuacgccgucagcaaggacugggacagcgccacgcuguccaacgagagccuccuggacaccgugucccgguucgugcuggcggcccuccugaagcacaccaaccugcucagccaggccugcggcgagucccgcuaccagcccgggaagcaccugagcgaggucuaccggugcguguacaaggugcgcucccggcugcucgccugcaagaaccuggagcugauccagacccgcagcuccagccgggaccgcuggaucuccgagaaccaggacagcgccgacgucgacccccaggagcacuccuucacgcggaccaucgacgaggaggcggagauggaggagcaggccgagcgcgaccgggaggagggccacccggagcccgaggacgaggaggaggagcgcgagcacgaggugaugaccgccgggaagaucuuccagugcuuccucagcgcccgggaggucgcccgcucccgcgaccgggaccgcaugaacagcggcgcgggcuccggggcccgggccgacgacccgccgccccagagccagcaggagcgccggguguccaccgaccugcccgagggccaggacguguacacggccgcgugcaacagcgucauccaccgcugcgcccugcucauccugggggugagccccgugaucgacgagcugcagaagcggcgcgaggagggccagcuccagcagcccuccaccagcgccuccgagggcgggggccugaugacccggagcgagucccugaccgccgagagccgccucguccacacgucccccaacuaccggcugaucaagagccgcuccgagagcgaccugucccagcccgagagcgacgaggagggguacgcccucuccggccggcgcaacguggaccuggaccuggcggccagccaccggaagcgcgggcccaugcacucccagcucgagagccuguccgacagcugggcccggcugaagcacagccgcgacuggcucugcaacuccagcuacuccuucgagagcgacuucgaccugaccaagucccugggcgugcacacccucaucgagaacgucgugagcuucguguccggggacgucggcaacgcccccggcuucaaggagccggaggagagcauguccaccagcccccaggccuccaucaucgcgauggagcagcagcagcugcgggccgagcugcgccucgaggcccugcaccagauccuggugcuccugagcgggauggaggagaagggcuccaucagccuggccgggucccgccucagcuccggcuuccagagcuccacgcugcugaccagcgugcggcuccaguuccuggccgggugcuucggccugggcaccgucgggcacaccggcgggaagggcgagagcgggcgccuccaccacuaccaggacggcauccgggcggccaagcgcaacauccagaucgagauccagguggccgugcacaagaucuaccagcagcuguccgccacgcuggagcgggcgcuccaggccaacaagcaccacaucgaggcccagcagcgccugcugcucgucaccguguucgcccugagcgugcacuaccagcccgucgacgugucccuggccaucagcaccggccuccugaacgugcugucccagcucugcgggaccgacaccaugcugggccagccccugcagcuccugccgaagacgggggucagccagcuguccaccgcgcucaagguggccagcacccggcugcugcagauccucgccaucaccacgggcaccuacgccgacaagcugucccccaaggugguccagagccugcucgaccugcugugcucccagcucaagaaccugcugagccagaccggcgugcugcacauggccuccuucggggagggcgagcaggaggacggggaggaggaggagaagaagguggacagcuccggcgagaccgagaagaaggacuuccgcgcggcccuccggaagcagcacgccgccgagcugcaccugggggacuuccucgucuuccugcgccggguggugagcuccaaggccauccagagcaagauggcgucccccaaguggacggagguccugcucaacaucgccagccagaagugcagcuccggcaucccccuggugggcaaccugcgcacccggcuccuggcccugcacgugcucgaggccguccugccggcgugcgagagcgggguggaggacgaccagauggcccagaucguggagcgccuguucucccuccugagcgacugcaugugggagacccccaucgcccaggccaagcacgccauccagaucaaggagaaggagcaggagaucaagcugcagaagcagggcgagcucgaggaggaggacgagaaccugcccauccaggaggucuccuucgacccggagaaggcgcagugcugccugguggagaacgggcagauccucacccacggcagcgggggcaagggcuacgggcuggccuccacgggcgugaccagcgggugcuaccaguggaaguucuacaucgucaaggagaaccggggcaacgaggggaccugcgugggcgugucccgcuggcccguccacgacuucaaccaccggaccacgagcgacauguggcuguaccgcgccuacuccggcaaccucuaccacaacggggagcagacccugacccugagcuccuucacccagggcgacuucaucacgugcgugcucgacauggaggcccggaccaucagcuucgggaagaacggcgaggagcccaagcuggccuucgaggacguggacgcggccgagcuguaccccugcgucauguucuacuccagcaacccgggggagaaggugaagaucugcgacaugcagaugcgcggcacgccccgggaccuccugcccggcgaccccaucugcuccccgguggccgccguccuggccgaggcgaccauccagcucauccgcauccugcaccgcacggaccgguggaccuacugcaucaacaagaagaugauggagcgccugcacaagaucaagaucugcaucaaggagagcgggcagaagcucaagaagucccggagcgugcagagccgcgaggagaacgagaugcgggaggagaaggaguccaaggaggaggagaagggcaagcacacccgccacgggcuggccgaccugagcgagcuccagcugcggacccugugcaucgaggucuggcccgugcucgccgugaucggcggcgucgacgccgggcugcgcgugggcgggcggugcgugcacaagcagacgggccgccacgccacccugcucggggucgugaaggagggcuccaccagcgcgaaggugcagugggacgaggccgagaucaccaucuccuuccccacguucuggagccccuccgacaccccgcuguacaaccuggagcccugcgagccccuccccuucgacgucgcccgguuccgcggccugaccgccagcgugcugcucgaccugaccuaccugacgggggugcacgaggacaugggcaagcaguccaccaagcggcacgagaagaagcaccgccacgagagcgaggagaagggggacgucgagcagaagccggaguccgagagcgcgcucgacaugcggaccggccugaccuccgacgacgugaagucccaguccaccacgagcuccaagagcgagaacgagaucgccuccuucagccuggaccccacccuccccagcguggagucccagcaccagaucaccgaggggaagcgcaagaaccacgagcacaugagcaagaaccacgacgucgcccaguccgagauccgggccgugcagcugagcuaccuguaccucggcgccaugaagucccugagcgcgcugcucggcugcuccaaguacgccgagcugcugcucauccccaaggugcuggccgagaacgggcacaacagcgacugcgccuccagcccggucgugcacgaggacguggagaugcgcgccgcgcugcaguuccucaugcggcacauggucaagcgcgccgugaugcgcucccccaucaagcgggcccugggccuggccgaccucgagcgcgcccaggcgaugaucuacaagcuggugguccacgggcugcucgaggaccaguucggcgggaagaucaagcaggagaucgaccagcaggccgaggagagcgaccccgcccagcaggcccagacccccgugacgaccuccccgagcgcguccagcaccaccuccuucaugagcuccagccuggaggacacgaccaccgccaccacgcccgugaccgacaccgagaccguccccgccagcgagucccccggcgugaugccgcugagccuccugcggcagauguucuccagcuaccccacgaccaccgugcugcccacccgccgggcccagacgccgcccaucuccagccuccccaccucccccagcgacgaggucggccgccggcagucccugaccagcccggacucccagagcgcccgccccgcgaaccggaccgcccuguccgaccccagcucccgccucagcacgagcccgccgccgcccgccaucgccgugccccugcuggagaugggguucagccuccggcagaucgccaaggcgauggaggccaccggcgcccgcggggaggccgacgcccagaacaucaccgugcuggcgauguggaugaucgagcaccccggccacgaggacgaggaggagccccagagcggcuccaccgccgacagccggcccggggccgccguccugggcuccgggggcaagagcaacgaccccugcuaccuccagucccccggggacauccccagcgcggacgccgccgagauggaggagggcuucuccgagagccccgacaaccuggaccacacggagaacgccgccuccggcagcgggcccuccgcgcgcggccggagcgccgugacccgccggcacaaguucgaccuggccgcccgcacccuccuggcccgggcggccgggcuguaccgcuccgugcaggcccaccggaaccagagccgccgcgagggcaucucccuccagcaggacccgggggcccuguacgacuucaaccuggacgaggagcuggagaucgaccucgacgacgaggccauggaggcgauguucggccaggaccugaccagcgacaacgacauccugggcauguggauccccgagguccucgacuggcccacguggcacgugugcgaguccgaggaccgggaggagguggucgugugcgagcugugcgagugcagcguggucuccuucaaccagcacaugaagcgcaaccaccccgggugcggccggagcgccaaccgccagggguaccggagcaacggcuccuacguggacgggugguucggcggcgagugcgggagcggcaacccguacuaccugcucugcgggaccugccgcgagaaguaccuggccaugaagaccaaguccaagagcaccuccagcgagcgguacaagggccaggcccccgaccugaucgggaagcaggacuccguguacgaggaggacugggacaugcucgacgucgacgaggacgagaagcugacgggcgaggaggaguucgagcugcucgccggcccccuggggcugaacgaccgccggaucgugccggagcccgugcaguuccccgacagcgacccccucggcgcguccgucgccauggugaccgccaccaacagcauggaggagacccugaugcagaucgggugccacggcuccguggagaaguccuccagcggccgcaucacgcugggggagcaggccgcggcccucgccaacccgcacgaccgggucguggcccugcgccgggucaccgccgcggcccaggugcugcucgcccgcaccauggugaugcgggcccugucccugcucagcgucuccggcagcuccugcagccuggccgcggggcuggagagccucggccugaccgacauccgcacccuggugcggcucaugugccuggccgccgccgggcgcgccggccuguccacgagccccuccgcgauggccagcaccuccgagcggagccgcggcgggcacuccaaggccaacaagcccaucagcugccucgccuaccuguccaccgcggugggcugccuggccagcaacgcccccuccgccgccaagcuccugguccagcugugcacccagaaccucaucagcgcggccacgggggugaaccugaccaccguggacgacuccauccagcgcaaguuccugccgagcuuccuccggggcaucgccgaggagaacaagcuggucaccucccccaacuucguggugacgcaggcccuggucgcccuccuggcggacaagggggccaagcugcgccccaacuacgacaagagcgagguggagaagaagggcccccucgagcuggccaacgcccuggccgcgugcugccucuccagccggcuguccagccagcaccgccagugggccgcccagcagcuggugcggacccucgccgcccacgaccgcgacaaccagaccacccugcagacgcuggcggacaugggcggggaccuccggaagugcagcuucaucaagcuggaggcccaccagaaccgcgucaugaccugcguguggugcaacaagaagggccugcucgccaccuccgggaacgacggcaccauccggguguggaacgucacgaagaagcaguacagccugcagcagaccugcguguucaaccgccuggagggggacgccgaggagucccucggcagcccguccgaccccagcuucucccccgugagcugguccaucagcggcaaguaccuggcgggggcccuggagaagauggucaacaucuggcaggucaacggcgggaagggccucguggacauccagccccacugggucuccgcccuggccuggccggaggagggccccgccaccgcguggagcggggagucccccgagcugcuccuggugggccggauggacgggagccugggccucaucgagguggucgacguguccaccaugcaccgccgggagcuggagcacugcuaccgcaaggacgugagcgucacgugcaucgccugguucuccgaggaccggcccuucgccgugggguacuucgacggcaagcugcuccugggcaccaaggagccgcuggagaagggcgggaucgugcucaucgacgcccacaaggacacccugaucagcaugaagugggaccccaccgggcacauccugaugacgugcgccaaggaggacuccgucaagcucuggggcagcaucagcgggugcuggugcugccugcacucccugugccaccccagcaucgugaacggcaucgcguggugccgccuccccggcaagggguccaagcugcagcugcucauggccaccggcugccagagcgggcuggugugcgucuggcggaucccgcaggacaccacccagacgaacgugaccuccgccgagggcuggugggagcaggagagcaacugccaggacggguaccgcaaguccagcggcgccaagugcguguaccagcugcggggccacaucacccccguccgcaccguggccuucuccagcgacgggcucgcgcugguguccggcgggcugggcgggcucaugaacaucuggagccugcgggacggcuccguccugcagacgguggugaucggcagcggggccauccagaccaccgucuggauccccgaggugggcguggccgccugcuccaaccgcagcaaggacguccugguggugaacugcaccgcggagugggccgccgccaaccacguccucgccacgugccgcaccgcgcugaagcagcagggggugcugggccucaacauggcccccugcaugcgggccuuccuggagcgccugccgaugaugcuccaggagcaguacgccuacgagaagccccacgucgugugcggcgaccagcuggugcacucccccuacaugcagugccuggccagccucgcggucgggcugcaccuggaccagcuccugugcaacccgcccgugccgccccaccaccagaacugccugccggaccccgccuccuggaaccccaacgagugggccuggcucgagugcuucagcaccaccaucaaggccgccgaggcgcugaccaacggcgcccaguuccccgagagcuucacggugccggaccuggagcccguccccgaggacgagcucguguuccugauggacaacuccaaguggaucaacgggauggacgagcagaucaugagcugggccaccucccggcccgaggacuggcaccugggcgggaagugcgacguguaccucuggggcgccggccgccacgggcagcuggcggaggccggccggaacgucauggugccggccgccgcccccagcuucucccaggcgcagcaggucaucugcgggcagaacugcaccuucgucauccaggccaacggcaccgugcuggccugcggggagggcagcuacggccgccucgggcagggcaacuccgacgaccugcacgugcugacggucaucagcgcccuccagggguucguggugacccagcuggucaccuccugcggcagcgacgggcacuccauggcccugaccgagagcggcgagguguucuccuggggcgacggggacuacggcaagcucgggcacggcaacagcgaccggcagcgccggccccgccagaucgaggcgcugcagggcgaggaggugguccagauguccugcggguucaagcacagcgccguggugacguccgacggcaagcuguucaccuucgggaacggcgacuacgggcggcucggccugggcaacaccagcaacaagaagcugcccgagcgcgucaccgcccucgagggguaccagaucggccagguggccugcgggcugaaccacacgcuggccgugagcgcggacggcuccauggucugggccuucggggacggcgacuacggcaagcucgggcugggcaacagcaccgccaaguccagcccgcagaagaucgacgugcugugcgggaucggcaucaagaagguggccugcgggacccaguucuccgucgcccucaccaaggacggccacguguacacguucggccaggaccggcugaucgggcugcccgagggccgcgcgcggaaccacaaccgcccccagcagauccccgugcucgccggggucaucaucgaggacguggccgugggcgccgagcacacccuggcgcuggccagcaacggggacgucuacgccuggggcuccaacagcgagggccagcucgggcugggccacaccaaccacgugcgggagccgacccuggugacggggcuccagggcaagaacguccgccagaucuccgccggccggugccacagcgccgcguggaccgcgccgcccgugcccccgcgcgcccccgggguguccgucccccugcagcugggccuccccgacaccgugccgccccaguacggggcccugcgcgaggugagcauccacaccguccgggcccgccugcggcuccuguaccacuucuccgaccugauguacagcuccuggcgccuccugaaccugagccccaacaaccagaacuccacgagccacuacaacgcgggcaccugggggaucgugcagggccagcuccggccgcugcuggcgccccggguguacacccuccccaugguccgguccaucggcaagaccauggugcaggggaagaacuacggcccccagaucacggugaagcgcaucagcacccgggggcgcaagugcaagccgaucuucguccagaucgcccgccagguggucaagcugaacgccagcgaccugcgccuccccucccgggccuggaaggugaagcuggugggcgagggggccgacgacgccggcggcgucuucgacgacaccaucaccgagaugugccaggagcuggagacggggaucguggaccuccugauccccagccccaacgccaccgccgaggugggcuacaaccgcgaccgguuccuguucaacccguccgcgugccucgacgagcaccugaugcaguucaaguuccuggggauccucaugggcgucgccauccgcaccaagaagccccuggaccugcaccucgcgccccugguguggaagcagcugugcugcgugccccucacccuggaggaccuggaggaggucgaccuccuguacgugcagacgcugaacagcauccuccacaucgaggacuccgggaucaccgaggagagcuuccacgagaugaucccgcuggacuccuucgugggccagagcgccgacggcaagaugguccccaucauccccgggggcaacuccaucccccugaccuucagcaaccggaaggaguacguggagcgcgccaucgaguaccggcuccacgagauggaccgccagguggcggccguccgggaggggauguccuggaucgugccggugccccugcugagccuccugaccgccaagcagcuggagcagauggucugcggcaugcccgagaucuccguggaggugcugaagaaggucgugcgcuaccgcgagguggacgagcagcaccagcucguccagugguucuggcacacccuggaggaguucagcaacgaggagcgggugcuguucaugcgcuucguguccgggcggagccgccuccccgccaacacggccgacaucucccagcgguuccagaucaugaaggucgaccgcccguacgacagccugcccaccucccagaccugcuucuuccagcugcggcugccgcccuacagcagccagcuggugauggcggagcgccugcgguacgccaucaacaacugccgcuccaucgacauggacaacuacaugcucagccggaacguggacaacgccgagggcuccgacaccgacuacuga

SEQ ID NO: 31055 - RNA, 14505 nt, Artificial Sequence
  derived and/or modified sequence opt1 from HERC2__Homo_sapiens__NP_004658
augcccagcgagagcuucugccuggccgcccaggcgcggcuggacagcaaguggcugaagaccgacauccagcuggccuucacccgggacggccucugcgggcuguggaacgagauggugaaggacggcgagaucguguacaccgggaccgaguccacccagaacggcgagcugccgccccggaaggacgacagcguggagcccuccgggaccaagaaggaggaccucaacgacaaggagaagaaggacgaggaggagacccccgcccccaucuaccgggccaagagcauccuggacuccuggguguggggcaagcagcccgacgugaacgagcugaaggagugccucagcgugcuggugaaggagcagcaggcccuggcggugcaguccgccaccaccacccucagcgcccugcggcugaagcagcggcucgugauccuggagcgguacuucaucgcccugaaccggaccguguuccaggagaacgucaaggugaaguggaaguccagcggcaucucccugccgcccguggacaagaaguccucccggcccgcggggaagggcgucgaggggcuggcccgggugggcagccgcgccgcccuguccuucgccuucgcguuccuccggcgcgccuggcggagcggggaggacgccgaccugugcuccgagcugcuccaggagagccuggacgcccugcgcgcccuccccgaggcgagccuguucgacgaguccaccgugagcuccgucuggcuggaggugguggagcgggccacccgcuuccuccggagcgucgugaccggcgacgugcacggcacccccgccaccaaggggcccggcuccaucccccugcaggaccagcaccuggcccucgccauccugcuggagcucgcgguccagcgcgggacccugagccagaugcuguccgccauccuccugcugcuccagcugugggacagcggcgcccaggagaccgacaacgagcgguccgcccagggcacgagcgcgccccuccucccccugcugcagcgcuuccaguccaucaucugccggaaggacgcgccccacagcgagggggacaugcaccuccuguccggcccccugagccccaacgaguccuuccugcgcuaccucacccugccccaggacaacgagcuggccaucgaccuccgccagaccgccgugguggucauggcccaccuggaccggcuggcgacccccugcaugccgccccucugcagcucccccacgagccacaaggggucccugcaggaggugaucggcugggggcugaucggcuggaaguacuacgccaacgucaucggccccauccagugcgaggggcucgccaaccugggcgugacccagaucgccugcgccgagaagcgcuuccugauccucagccggaacgggcgcguguacacccaggcguacaacagcgacacccuggccccgcagcugguccagggccucgccucccggaacaucgugaagaucgccgcccacagcgacgggcaccacuaccuggcgcuggccgccacgggcgagguguacuccuggggcugcggggacggcgggcgccucggccacggggacaccgucccccuggaggagcccaaggugaucagcgccuucuccggcaagcaggccggcaagcacgugguccacaucgcgugcgggagcaccuacuccgccgccaucaccgccgagggcgagcuguacacgugggggcggggcaacuacggccgccucgggcacggcagcuccgaggacgaggcgauccccaugcugguggccgggcugaagggccucaaggugaucgacgucgccugcgggagcggcgacgcccagacccuggccgugaccgagaacggccaggugugguccuggggcgacggcgacuacgggaagcugggccgcggcgggagcgacgggugcaagaccccgaagcucaucgagaagcugcaggaccuggacgucgugaaggugcgcugcgggucccaguucagcaucgcgcucacgaaggacggccaggucuacuccugggggaagggcgacaaccagcggcuggggcacggcaccgaggagcacgugcgcuaccccaagcugcucgagggccugcaggggaagaaggugaucgacgucgccgccggcagcacccacugccuggcccucaccgaggacuccgaggugcacagcugggggagcaacgaccagugccagcacuucgacacgcugcgggugaccaagcccgagccggccgcgcugcccggccucgacaccaagcacaucgucgggaucgccugcggccccgcccaguccuucgccuggagcuccugcagcgagugguccaucggccugcgcgugcccuucguggucgacaucugcagcaugaccuucgagcagcuggaccuccugcugcgccagguguccgaggggauggacggcagcgccgacuggccgccgccccaggagaaggagugcguggcggucgccacccucaaccugcugcgccuccagcugcacgccgccaucucccaccagguggaccccgaguuccuggggcucggccugggcagcauccugcucaacucccugaagcagacgguggucacccuggcgagcuccgccggggugcucagcaccgugcaguccgccgcccaggccguccugcagagcggcugguccgugcugcucccgaccgcggaggagcgggcccgcgcccugagcgcccugcuccccugcgccguguccgggaacgaggucaacaucagccccggccggcgcuucaugaucgaccugcugguggggagccucauggcggacggcggccuggaguccgcccugcacgccgccaucacggccgagauccaggacaucgaggcgaagaaggaggcccagaaggagaaggagaucgacgagcaggaggccaacgccagcaccuuccaccgcucccggacgccccuggacaaggaccugaucaacaccgggaucugcgagagcuccggcaagcagugccugccgcucgugcagcugauccagcagcugcuccgcaacaucgccagccagacggucgcgcggcugaaggacguggcccgccggaucuccagcugccuggacuucgagcagcacucccgcgagcggagcgccucccucgaccugcugcuccgcuuccagcggcugcugaucagcaagcucuaccccggggaguccaucggccagaccagcgacaucuccagccccgagcugaugggggugggcucccugcucaagaaguacaccgcccugcugugcacccacaucggcgacauccuccccgucgcggccagcaucgccuccacgagcuggcgccacuucgccgagguggccuacaucguggagggggacuucaccggcguccugcugccggagcucguggugagcaucguccugcugcuguccaagaacgcggggcucaugcaggaggccggcgccgugccccugcucggcgggcuccuggagcaccuggaccgguucaaccaccucgcccccgggaaggagcgcgacgaccacgaggagcuggccuggcccgggaucauggagagcuucuucaccggccagaacugccggaacaacgaggaggucacccugauccgcaaggcggaccucgagaaccacaacaaggacgggggcuucuggacggugaucgacggcaagguguacgacaucaaggacuuccagacccagucccugaccgggaacagcauccuggcccaguucgccggcgaggacccggucguggcccucgaggccgcgcugcaguucgaggacacccgggaguccaugcacgccuucugcguggggcaguaccuggagcccgaccaggagaucgucacgauccccgaccucggcagccuguccagcccccugaucgacaccgagcgcaaccucgggcugcugcucggccugcacgccuccuaccuggccaugagcaccccgcucucccccguggagaucgagugcgcgaaguggcugcagagcuccaucuucagcggcgggcugcagaccucccagauccacuacagcuacaacgaggagaaggacgaggaccacugcuccagccccggcgggacgccggccuccaagagccggcucugcagccaccgccgggcccugggcgaccacucccaggccuuccugcaggccaucgcggacaacaacauccaggaccacaacgugaaggacuuccucugccagaucgagcgcuacugccggcagugccaccugaccacccccaucauguucccgcccgagcacccggucgaggagguggggcgccugcuccugugcugccugcucaagcacgaggaccugggccacguggcccugagccucguccacgccggcgcccuggggaucgagcaggucaagcaccgcacccugcccaaguccguggucgacgugugccggguggucuaccaggccaagugcagccucaucaagacgcaccaggagcagggccgcuccuacaaggaggugugcgcgcccgugaucgagcggcugcgcuuccuguucaacgagcuccggcccgccgucugcaacgaccugagcaucauguccaaguucaagcugcucagcucccugccgcgcuggcggcgcaucgcccagaagaucauccgggagcgccggaagaagcgcgugcccaagaagcccgagagcaccgacgacgaggagaagaucgggaacgaggaguccgaccuggaggaggccugcauccucccccacagcccgaucaacguggacaagcggcccaucgccaucaagucccccaaggacaaguggcagccccugcugagcaccgucaccggcgugcacaaguacaaguggcucaagcagaacgugcaggggcuguacccccagagcccccuccucagcacgaucgcggaguucgcccugaaggaggagcccgucgacguggagaagaugcgcaagugccugcucaagcagcuggagcgggccgaggugcgccuggagggcaucgacaccauccucaagcuggccuccaagaacuuccugcuccccagcguccaguacgcgauguucugcggcuggcagcggcugaucccggaggggaucgacaucggcgagccccugaccgacugccucaaggacguggaccugaucccgcccuucaaccgcaugcugcucgaggugaccuucgggaagcuguacgccugggccguccagaacauccggaacgugcugauggacgccuccgccaaguucaaggagcucggcauccagccggugccccugcagacgaucaccaacgagaaccccagcgggcccagccugggcaccaucccgcaggcgcgcuuccuccuggucaugcuguccaugcucacccugcagcacggcgccaacaaccuggaccuccugcugaacagcgggaugcucgcccugacccagacggcccugcgccucaucggccccuccugcgacaacguggaggaggacaugaacgccagcgcgcagggggccuccgccaccgugcuggaggagacccggaaggagaccgcccccguccagcugccggugagcggccccgagcucgccgcgaugaugaagaucggcacgcgcgugaugcgcgggguggacuggaaguggggcgaccaggacgggccgccgcccggccuggggcgcgugaucggcgagcugggcgaggacggguggauccgggugcagugggacaccggcuccaccaacagcuaccgcauggggaaggagggcaaguacgaccucaagcuggccgagcugcccgccgccgcccagcccuccgcggaggacagcgacaccgaggacgacuccgaggccgagcagacggagcggaacauccaccccaccgccaugauguucaccagcaccaucaaccuccugcagacgcugugccuguccgccgggguccacgcggagaucaugcagagcgaggccaccaagacccucugcggccugcugcgcaugcucguggaguccggcaccacggacaagaccagcucccccaaccggcugguguaccgcgagcagcaccggagcuggugcacccugggguucguccgcuccaucgcccucacgccccaggugugcggcgcccugagcagcccccaguggaucacgcugcucaugaagguggucgaggggcacgcccccuucaccgcgaccucccugcagcggcagauccuggccgugcaccuccugcaggccguccugcccagcugggacaagaccgagcgcgcccgggacaugaagugccucguggagaagcuguucgacuuccugggcucccuccugacgaccugcagcuccgacgugccccugcuccgcgagagcacccugcggcgccggcgcguccggccccaggccucccugaccgcgacgcacagcuccacccucgccgaggaggugguggcccugcugcgcacccuccacagccugacccaguggaacgggcugaucaacaaguacaucaacucccagcuccgcagcaucacgcacuccuucgucggccggcccagcgagggcgcccagcuggaggacuacuucccggacuccgagaaccccgaggucggcgggcugauggccgugcucgcggucaucggcgggaucgacgggcgccugcggcucgggggccaggugaugcacgacgaguucggggagggcaccgugacccgcaucacccccaaggggaagaucacgguccaguucagcgacaugcggaccugccgcgugugcccccugaaccagcugaagccgcugcccgccguggccuucaacgucaacaaccuccccuucaccgagcccaugcuguccgugugggcccagcuggugaaccucgcgggcagcaagcuggagaagcacaagaucaagaaguccaccaagcaggccuucgccggccaggucgaccuggaccuccugcggugccagcagcugaagcucuacauccugaaggccgggcgcgcccugcucucccaccaggacaagcugcggcagauccugagccagccggcggugcaggagaccggcacggugcacaccgacgacggggccgucgugucccccgaccucggcgacaugagccccgaggggccccagccgcccaugauccugcugcagcagcuccuggccuccgccacccagcccagcccggugaaggccaucuucgacaagcaggagcuggaggcggccgcccucgccgucugccagugccuggccguggaguccacccaccccagcucccccggcuucgaggacugcagcuccagcgaggcgacgacccccguggccguccagcacauccgcccggcccgggugaagcgccggaagcagucccccgugcccgcccugcccaucgucgugcagcucauggagaugggcuucagccgccggaacaucgaguucgcgcugaagucccugaccggggccagcggcaacgccuccagccucccggggguggaggcccuggucggcuggcugcucgaccacuccgacauccaggugaccgagcugagcgacgccgacacggugagcgacgaguacuccgacgaggaggucguggaggacguggacgacgcggccuacagcauguccaccggggccgucgugaccgagagccagaccuacaagaagcgcgccgacuuccuguccaacgacgacuacgccguguacguccgggagaacauccaggugggcaugauggugcgcugcugccgggcguacgaggaggucugcgagggcgacguggggaaggugaucaagcucgaccgcgacggccugcacgaccugaacguccagugcgacuggcagcagaagggcgggacguacugggugcgcuacauccacguggagcucaucggguacccgccgcccagcuccagcucccacaucaagaucggcgacaagguccgggugaaggccagcgucaccaccccgaaguacaaguggggcuccgugacccaccagagcgugggggucgugaaggccuucuccgccaacggcaaggacaucaucguggacuucccccagcagagccacuggacggggcugcuguccgagauggagcucguccccagcauccaccccggcgugaccugcgacggcugccagauguucccgaucaacgggucccgcuucaagugccggaacugcgacgacuucgacuucugcgagaccugcuucaagaccaagaagcacaacacgcgccacaccuucggccggaucaacgagcccgggcagagcgccguguucugcggccgcuccgggaagcagcugaagcggugccacagcagccagcccggcaugcugcucgacuccuggagccgcauggucaagucccugaacgugagcuccagcgugaaccaggcgucccggcugaucgacggcagcgagcccugcuggcaguccagcgggucccagggcaagcacuggauccgccucgagaucuucccggacguccuggugcaccggcugaagaugaucguggaccccgccgacagcuccuacaugcccagccucgucgugguguccgggggcaacagccugaacaaccugaucgagcucaagaccaucaacaucaaccccuccgacaccacggucccgcugcugaacgacugcaccgaguaccaccgcuacaucgagaucgccaucaagcagugccggagcuccgggaucgacugcaagauccacggccucauccugcugggccgcauccgggccgaggaggaggaccucgccgcggugcccuuccuggccagcgacaacgaggaggaggaggacgagaaggggaacagcggcucccugauccgcaagaaggccgccgggcuggagagcgcggccaccauccggaccaagguguucgucuggggccucaacgacaaggaccagcucgggggccugaagggcuccaagaucaaggugcccagcuucuccgagacgcucagcgcccugaacgugguccagguggccgggggcuccaagagccuguucgccgugaccgucgaggggaagguguacgcgugcggcgaggccaccaacgggcgccucggccugggcaucuccagcgggaccgugccgaucccccggcagaucacggcccuguccagcuacgucgugaagaagguggccguccacuccggcgggcgccacgccaccgcgcucaccguggacggcaagguguucagcuggggcgagggggacgacggcaagcuggggcacuucucccggaugaacugcgacaagccccgccugaucgaggcccucaagaccaagcgcauccgggacaucgccugcggcagcucccacagcgccgcccugacguccagcggggagcuguacaccuggggccucggcgaguacgggcgccugggccacggggacaacaccacccagcugaagcccaagauggucaaggugcuccugggccaccgggugauccaggucgcgugcgggagccgcgacgcccagacgcuggcccucaccgacgagggccugguguucuccuggggcgacggggacuucggcaagcuggggcggggcgggagcgagggcugcaacaucccgcagaacaucgagcgccucaacggccagggggugugccagaucgagugcggcgcccaguucucccuggcgcugaccaagagcggggucguguggaccuggggcaagggcgacuacuuccggcucgggcacggcuccgacgugcacguccgcaagccccaggugguggaggggcugcggggcaagaagaucguccacguggccgugggggcccugcacugccucgccgucaccgacagcggccagguguacgccuggggcgacaacgaccacgggcagcagggcaacgggacgaccaccgucaaccgcaagcccacccuggugcagggccuggaggggcagaagaucacgcggguggcgugcggcuccagccacuccgucgccuggaccaccguggacguggccacccccagcguccacgagccggugcuguuccagacggcccgcgacccccugggcgccuccuaccugggggugcccagcgacgcggacuccagcgccgccuccaacaagaucagcggcgccuccaacagcaagcccaaccggccgucccucgccaagauccugcugagccucgacgggaaccuggcgaagcagcaggcccugagccacauccucaccgcccugcagaucauguacgcccgcgacgccgucgugggcgcgcugaugcccgccgccaugaucgcccccguggagugccccuccuucagcuccgcggccccgagcgacgccuccgccauggccagccccaugaacggggaggagugcaugcucgcggucgacaucgaggaccggcugucccccaaccccuggcaggagaagcgcgagaucgugagcuccgaggacgccgugaccccgagcgccgucacccccuccgcccccagcgccuccgcgcggcccuucaucccggugacggacgaccugggcgccgccagcaucaucgccgagaccaugaccaagaccaaggaggacguggagucccagaacaaggccgcgggccccgagccccaggcccucgacgaguucacgagccugcugaucgccgacgacacccgcgucgugguggaccuccugaagcuguccgucugcagccgggccggggaccgcggccgcgacgugcucagcgcggugcuguccgggaugggcaccgccuacccccaggucgccgacaugcugcucgagcugugcgugaccgagcuggaggacguggccacggacagccaguccgggcggcucagcucccagccggucgugguggagagcucccaccccuacaccgacgacaccagcaccuccggcacggucaagauccccggcgccgaggggcugcgcguggaguucgaccggcagugcagcaccgagcgccggcacgacccgcugaccgugauggacggcgucaaccgcaucguguccgugcggagcgggcgcgagugguccgacuggagcuccgagcuccggauccccggcgacgagcugaaguggaaguucaucagcgacggcuccgucaacggguggggcuggcgcuucaccguguaccccaucaugcccgcggccgggccgaaggagcugcucagcgaccggugcgugcuguccugccccagcauggaccuggucacgugccuccuggacuuccgccugaaccucgccagcaaccgguccaucgugccccgccuggccgccagccuggcggccugcgcccagcucuccgcccuggccgcgagccaccggaugugggcccugcagcgccuccggaagcugcugaccaccgaguucggccaguccaucaacaucaaccgccuccugggggagaacgacggcgagacccgggcccugagcuucacgggcuccgcccucgcggcccuggugaaggggcugcccgaggcccuccagcgccaguucgaguacgaggacccgaucguccggggcgggaagcagcugcugcacagccccuucuucaaggugcucguggcccuggccugcgaccuggagcucgacacccugcccugcugcgcggagacccacaagugggccugguuccgccgcuacugcauggccucccgggucgccguggcccuggacaagcgcacgccccugccgcgccuguuccuggacgagguggcgaagaagauccgcgagcugauggccgacagcgagaacauggacguccuccacgagucccacgacaucuucaagcgggagcaggacgagcagcuggugcaguggaugaaccgccggcccgacgacuggacgcugagcgccggcggguccggcaccaucuacggcugggggcacaaccaccgcggccagcucgggggcaucgagggggccaaggugaagguccccacccccugcgaggcccuggcgacccugcggccggugcagcucaucggcggcgagcagacccuguucgccgucacggccgacgggaagcuguacgccaccggcuacggggccggcggccgccucgggaucggcgggaccgagagcguguccacccccacgcugcuggagagcauccagcacguguucaucaagaaggucgcggugaacuccggcgggaagcacugccucgcccugagcuccgagggcgagguguacagcuggggcgaggccgaggacgggaagcugggccacgggaaccggagccccugcgaccgcccccgggucaucgagucccuccgcggcaucgaggugguggacgucgccgccgggggcgcccacagcgccugcgugaccgccgccggcgaccuguacaccugggggaagggccgguacgggcgccugggccacuccgacagcgaggaccagcucaagccgaagcugguggaggcgcugcaggggcaccgggucguggacaucgccugcggcuccggcgacgcccagacccucugccugacggacgacgacaccguguggagcuggggcgacggcgacuacgggaagcugggccgcgggggcuccgacggcugcaagguccccaugaagaucgacagccucaccgggcugggcguggugaaggucgagugcgggucccaguucagcguggcccugaccaaguccggcgccguguacacguggggcaagggggacuaccaccggcucggccacgggagcgacgaccacguccgccgcccccgccaggugcagggccugcaggggaagaaggugaucgcgaucgccaccggcucccugcacugcgucugcugcaccgaggacggcgagguguacaccuggggcgacaacgacgaggggcagcucggggacggcacgaccaacgccauccagcgcccccggcugguggccgcccugcaggggaagaaggucaaccgcguggcgugcggcagcgcccacacccucgccugguccaccagcaagccggccuccgcgggcaagcugcccgcccaggugcccauggaguacaaccaccuccaggagauccccaucaucgcccuccggaaccgccugcugcuccugcaccaccugagcgagcuguucugcccgugcauccccauguucgaccuggaggggucccuggacgagacgggccucgggcccagcgucggcuucgacacccugcgggggauccugaucagccagggcaaggaggccgccuuccgcaagguggugcaggcgaccaugguccgggaccgccagcacggcccggugguggagcucaaccggauccaggucaagcgcucccggagcaagggcggccuggccgggcccgacggcaccaaguccguguucgggcagaugugcgccaagaugagcuccuucggccccgacagccugcuccugccccaccgcguguggaaggucaaguucgugggcgaguccguggacgacugcgggggcggguacagcgaguccaucgccgagaucugcgaggagcugcagaacggccucacgccgcugcugaucgucacccccaacggccgggacgagagcggggccaaccgcgacugcuaccuccugucccccgcggcccgggcccccgugcacagcuccauguuccgcuuccugggcgugcuccuggggaucgccauccggaccggcagcccgcugucccucaaccuggccgagcccgucuggaagcagcuggcggggaugagccucaccaucgccgaccuguccgagguggacaaggacuucauccccggccugauguacauccgcgacaacgaggccacgagcgaggaguucgaggccaugucccuccccuucaccgugccgagcgcgagcggccaggacauccagcuguccagcaagcacacccacaucacccuggacaaccgggccgaguacguccgccucgccaucaacuaccgccugcacgaguucgacgagcaggucgccgccgugcgggaggggauggcgcgcgucgugcccgucccccugcucucccuguucacgggcuacgagcuggagaccauggugugcgggagccccgacaucccgcuccaccuccugaaguccguggccaccuacaagggcaucgagcccagcgccucccucauccagugguucugggaggucauggagagcuucuccaacaccgagcggagccuguuccugcgcuucgugugggggcggacgcgccucccccggaccaucgccgacuuccgcggccgggacuucgugauccagguccuggacaaguacaacccgcccgaccacuuccugcccgaguccuacacgugcuucuuccuccugaagcugccccgcuacagcugcaagcagguccucgaggagaagcugaaguacgccauccacuucugcaaguccaucgacaccgacgacuacgcgcggaucgcccugaccggcgagcccgccgccgacgacagcuccgacgacagcgacaacgaggacguggacuccuucgccagcgacuccacgcaggacuaccucaccgggcacuga

SEQ ID NO: 31056 - RNA, 2799 nt, Artificial Sequence
  derived and/or modified sequence opt1 from HERC3__Homo_sapiens__NP_001258531
augaccaccgaggacagcguggccgucccccgccugauccagaagcucaaccagcagacgauccuccagguguccugcggcaacuggcacugccuggcccuggcggccgacgggcaguucuucaccuggggcaagaacagccacgggcagcugggccuggggaaggaguucccgucccaggccagcccccagcgggugcgcucccucgagggcaucccccuggcccaggucgccgcgggcggggcccacagcuucgcccugucccucagcggcgccguguucggguggggcaugaacaacgcggggcagcugggccuguccgacgagaaggaccgggagagccccugccacgugaagcuccugcgcacccagaaggucguguacaucuccugcggcgaggagcacaccgccgugcugaccaagagcgggggcgucuucaccuucggggccggcuccugcggccagcucgggcacgacagcaugaacgacgaggugaacccgcggcgcgugcuggagcugaugggcuccgaggucacccagaucgccugcgggcggcagcacacccucgccuucgugcccagcuccggccugaucuacgcguucgggugcggcgcccgcggccagcuggggacgggccacacgugcaacgugaagugccccagccccgucaagggguacugggccgcccacuccggccagcucagcgcccgggcggaccgcuucaaguaccacaucgugaagcagaucuucagcgggggcgaccagaccuucgugcugugcuccaaguacgagaacuacagcccggccgucgacuuccggaccaugaaccaggcccacuacacgucccugaucaacgacgagaccaucgccguguggcgccagaagcucagcgagcacaacaacgccaacaccaucaacggcgugguccagauccuguccagcgcggccugcuggaacggguccuuccuggagaagaagaucgacgagcacuucaagaccagccccaagauccccggcaucgaccucaacuccacgcgggugcuguucgagaagcugaugaacagccagcacuccaugauccucgagcagauccugaacagcuucgaguccugccugaucccccagcucagcuccagcccgcccgacguggaggccaugcgcaucuaccugauccugcccgaguucccccuccugcaggacuccaaguacuacaucacccugaccaucccgcucgccauggccauccugcggcuggacaccaaccccagcaagguccucgacaacugguggucccaggugugccccaaguacuucaugaagcuggucaaccuguacaagggggcggugcucuaccugcugcgcggccggaagacguuccucauccccgugcuguucaacaacuacaucaccgccgcccugaagcugcucgagaagcuguacaaggucaaccugaaggugaagcacguggaguacgacaccuucuacaucccggagaucagcaaccucgucgacauccaggaggacuaccugaugugguuccugcaccaggccgggaugaaggcgcgccccagcaucauccaggacaccgugacgcucugcuccuaccccuucaucuucgacgcccaggccaagaccaagaugcugcagaccgacgccgagcugcagaugcaggucgccgugaacggcgcgaaccuccagaacguguucaugcugcugacccucgagccccugcuggcccggagcccguuccucgugcugcacguccgccggaacaaccuggugggcgacgcccuccgcgagcuguccauccacagcgacaucgaccugaagaagccccucaaggugaucuucgacggggaggaggccgucgacgccggcggggugacgaaggaguucuuccugcugcuccugaaggagcugcucaaccccaucuacggcauguucaccuacuaccaggacuccaaccugcugugguucagcgacacgugcuucguggagcacaacugguuccaccucaucggcaucacgugcgggcuggcgaucuacaacuccaccgucguggaccugcacuucccccucgcccuguacaagaagcugcucaacgugaagccgggccuggaggaccugaaggagcucagccccaccgaggggcgcucccugcaggagcugcucgacuaccccggcgaggacgucgaggagaccuucugccugaacuucaccaucugccgggagagcuacggggugaucgagcagaagaagcugaucccgggcggcgacaacgugaccgucugcaaggacaaccgccaggaguucguggacgccuacgugaacuacgucuuccagaucuccgugcacgagugguacaccgccuucagcuccggguuccucaaggugugcggcgggaagguccuggagcuguuccagcccagcgagcuccgggccaugauggugggcaacuccaacuacaacugggaggagcuggaggagaccgcgaucuacaagggggacuacagcgccacccaccccaccgugaagcuguucugggagacguuccacgaguucccccucgagaagaagaagaaguuccugcuguuccucaccggcuccgaccgcaucccgaucuacggcauggccagccugcagaucgucauccagagcaccgccuccggggaggaguaccugcccguggcgcacacgugcuacaaccuccuggaccugcccaaguacagcuccaaggagauccucagcgcccggcugacccaggcccuggacaacuacgagggcuucucccucgccuga

SEQ ID NO: 31057 - RNA, 3075 nt, Artificial Sequence
  derived and/or modified sequence opt1 from HERC5__Homo_sapiens__NP_057407
auggagcgccggagccgccggaagucccgccggaacggccgcagcaccgccgggaaggccgcggccacccagcccgccaaguccccgggcgcccagcuguggcuguuccccagcgccgcggggcuccaccgggcccugcuccgccggguggaggucacgcgccagcugugcugcucccccggccggcuggccgugcucgagcgcgggggcgccggcgugcagguccaccagcugcuggcggggagcggcggggcccggacccccaagugcaucaagcucggcaagaacaugaagauccacuccguggaccagggggccgagcacaugcugauccugagcuccgacggcaagccguucgaguacgacaacuacagcaugaagcaccuccgcuucgaguccauccugcaggagaagaagaucauccagaucacgugcggcgacuaccacagccuggcccucuccaagggcggggagcuguucgccugggggcagaaccugcacggccagcucggcguggggcggaaguuccccagcaccaccacgccccagaucgucgagcaccuggcgggcgugccccuggcccagaucuccgccggggaggcccacagcauggcccucuccaugagcggcaacaucuacuccugggggaagaacgagugcggccagcugggccuggggcacaccgagagcaaggacgacccgagccucaucgagggccuggacaaccagaagguggaguucgucgcgugcgggggcucccacagcgcccugcucacccaggacgggcugcuguucaccuucggcgccggcaagcacgggcagcucggccacaacuccacccagaacgagcugcgccccugccugguggccgagcucgugggguaccgggucacccagaucgccugcggccgcuggcacacccuggcguacgugagcgaccuggggaagguguucuccuucggcagcggcaaggacgggcagcucggcaacgggggcacgcgggaccagcugaugccccugcccgucaagguguccagcuccgaggagcucaagcuggagagccacaccuccgagaaggagcugaucaugaucgccggcgggaaccagagcauccuccuguggaucaagaaggagaacuccuacgugaaccugaagcgcaccaucccgacccucaacgagggcacggucaagcgguggaucgccgacguggagaccaagcgcuggcagagcaccaagcgcgagauccaggagaucuucuccagccccgccugccugaccggguccuuccugcggaagcgccggacgaccgagaugaugcccguguaccucgaccugaacaaggcccgcaacaucuucaaggagcugacccagaaggacuggaucaccaacaugaucacgaccugccugaaggacaaccuccugaagcggcugcccuuccacagcccgccccaggaggcgcucgagaucuucuuccugcugcccgagugccccaugaugcacaucuccaacaacugggagagccucgucgugccguucgccaagguggucugcaagaugagcgaccaguccagccuggugcuggaggaguacugggccacccuccaggaguccaccuucagcaagcugguccagauguucaagacggccgugaucugccagcuggacuacugggacgaguccgcggaggagaacggcaacgugcaggcccuccuggagaugcugaagaagcuccaccgcgucaaccaggugaagugccagcugcccgagagcaucuuccagguggacgagcugcuccaccggcugaacuucuucgucgaggugugccgccgguaccuguggaagaugaccguggacgccuccgagaacguccagugcugcgugaucuucagccacuuccccuucaucuucaacaaccucuccaagaucaagcugcugcacaccgacacccuccugaagaucgagagcaagaagcacaaggccuaccugcgcuccgccgcgaucgaggaggagcgggagagcgaguucgcccuccgccccacguucgaccugaccgugcggcgcaaccaccugaucgaggacguccucaaccagcugucccaguucgagaacgaggaccugcggaaggagcucugggugagcuucuccggggagaucggcuacgaccugggcggggugaagaaggaguucuucuacugccuguucgccgagaugauccagccggaguacggcauguucauguaccccgagggggccagcugcaugugguuccccgucaagcccaaguucgagaagaagcgcuacuucuucuucggcgugcucugcgggcugucccuguucaacugcaacguggccaaccucccguucccccuggcgcuguucaagaagcuccuggaccagaugcccagccuggaggaccucaaggagcugagcccggaccugggcaagaaccuccagacccugcuggacgacgagggcgacaacuucgaggaggucuucuacauccacuucaacgugcacugggaccggaacgacaccaaccucauccccaacggguccagcaucacggugaaccagaccaacaagcgcgacuacgucuccaaguacaucaacuacaucuucaacgacagcgugaaggccguguacgaggaguuccggcgcggcuucuacaagaugugcgacgaggacaucaucaagcuguuccaccccgaggagcugaaggacgucaucguggggaacaccgacuacgacuggaagaccuucgagaagaacgcccgcuacgagcccggcuacaacuccagccacccgaccaucgugauguucuggaaggccuuccacaagcucacgcuggaggagaagaagaaguuccuggucuuccucaccgggaccgaccggcugcagaugaaggaccugaacaacaugaagaucaccuucugcugccccgaguccuggaacgagcgcgaccccauccgggcccucacgugcuucagcgugcuguuccugcccaaguacuccaccauggagaccguggaggaggcgcuccaggaggccaucaacaacaaccgcggcuucggcuga

SEQ ID NO: 31058 - RNA, 2961 nt, Artificial Sequence
  derived and/or modified sequence opt1 from HERC6__Homo_sapiens__NP_001158608
auguacuucugcuggggcgccgacagccgcgagcugcagcggcgccggaccgccgggucccccggcgcggagcuccugcaggccgccagcggggagcgccacucccugcuccugcugaccaaccaccgggugcucagcugcggcgacaacucccgcgggcagcugggccggcgcggcgcccagcgcggggagcugccggagcccauccaggcccucgagacgcugaucgucgaccuggugagcugcggcaaggagcacucccucgcggugugccacaaggggcgggucuucgccuggggcgccgggagcgagggccagcugggcaucggggaguucaaggagaucuccuucacccccaagaagaucaugacccugaacgacaucaagaucauccaggugagcugcggccacuaccacucccucgcccugagcaaggacucccagguguucagcugggggaagaacucccacggccagcugggccucgggaaggaguuccccagccaggcguccccgcagcggguccgcagccuggagggcaucccccuggcccagguggccgccgggggcgcccacuccuucgcgcucagccugugcgggaccagcuucggcuggggcuccaacagcgccgggcagcuggcccucuccggccggaacgugcccguccagagcaacaagccccuguccgugggggcccugaagaaccucggcguggucuacaucagcugcggggacgcccacacggcggugcugacccaggacggcaagguguucaccuucggcgacaaccgcuccgggcagcugggcuacagcccgacccccgagaagcgggggccccagcucgucgagcgcaucgacggccuggugucccagaucgacugcgggagcuaccacacgcuggccuacgugcacaccaccggccaggucguguccuucggccacgggcccagcgacaccuccaagccgacgcaccccgaggcccucaccgagaacuucgacaucagcugccugaucuccgccgaggacuucguggacguccaggugaagcacaucuucgccggcaccuacgcgaacuucgugaccacgcaccaggacaccagcuccacccgggcccccgggaagacccugcccgagaucagccgcaucucccagagcauggccgagaaguggaucgccgucaagcggcgcagcacggagcacgagauggccaaguccgagauccggaugaucuucagcuccccggcgugccucaccgccagcuuccugaagaagcgcggcaccggcgagaccacguccaucgacguggaccuggagauggcccgcgacaccuucaagaagcucaccaagaaggaguggaucagcuccaugaucaccacgugccuggaggacgaccugcuccgggcccugcccugccacagcccccaccaggaggcgcuguccgucuuccuccugcugcccgagugcccggugaugcacgacagcaagaacuggaagaaccucgugguccccuucgccaaggccgugugcgagauguccaagcagagccuccaggugcugaagaagugcugggccuuccugcaggaguccagccucaacccccugauccagaugcugaaggccgcgaucaucucccagcuccugcaccagaccaagaccgagcaggaccacugcaacgucaaggcccugcucgggaugaugaaggagcugcacaaggugaacaaggccaacugccgccugcccgagaacaccuucaacaucaacgagcucagcaaccugcugaacuucuacaucgaccggggccgccagcuguuccgggacaaccaccugauguccgagaagaaggccuacaugcugaugcacgagacgauccuccagaagaaggacgaguucccgcccagcccccgcuucauccugcgggugcgccggagccgccuggucaaggacgcccuccggcagcugucccaggcggaggccaccgacuucugcaaggugcugguggucgaguucaucaacgagaucugccccgagagcgggggcguguccagcgaguucuuccacugcauguucgaggagaugaccaagccggaguacgggauguucauguaccccgagaugggcuccugcaugugguuccccgccaagccgaagcccgagaagaagcgcuacuuccucuucggcaugcugugcgggcugagccucuucaaccugaacguggccaaccugcccuucccccucgcccuguacaagaagcugcucgaccagaagccgucccuggaggaccugaaggagcucagcccccggcugggcaagucccugcaggagguccucgacgacgcggccgacgacaucggggacgcccugugcauccgcuucagcauccacugggaccagaacgacguggaccugauccccaacggcaucuccauccccguggaccagaccaacaagcgggacuacgucagcaaguacaucgacuacaucuucaacguguccgugaaggccgucuacgaggaguuccagcgcggguucuaccgggugugcgagaaggagauccuccgccacuucuacccggaggagcugaugacggcgaucaucggcaacaccgacuacgacuggaagcaguucgagcagaacagcaaguacgagcagggcuaccagaagucccaccccaccauccagcuguucuggaaggccuuccacaagcucacccuggacgagaagaagaaguuccuguucuuccucaccgggcgggaccgccugcacgcccgcggcauccagaagauggagaucguguuccggugccccgagacguucagcgagcgcgaccaccccaccuccaucacgugccacaacauccugagccucccgaaguacuccaccauggagcggauggaggaggcccugcaggucgccaucaacaacaaccgcggguucgugagccccaugcugacccagagcuga

SEQ ID NO: 31059 - RNA, 1173 nt, Artificial Sequence
  derived and/or modified sequence opt1 from HERPUD1__Homo_sapiens__NP_001010989
auggagagcgagaccgagcccgagcccgugacccugcucgucaagucccccaaccagcgccaccgggaccuggagcugagcggcgaccgcgggugguccgugggccaccucaaggcccaccugagccggguguaccccgagcgcccccggccggaggaccagcgccugaucuacuccgggaagcuccugcuggaccaccagugccuccgggaccugcugcccaaggagaagcgccacguccuccaccuggugugcaacgucaagagccccuccaagaugcccgagaucaacgccaagguggcggagagcacggaggagccggccggcuccaaccgggggcaguaccccgaggacagcuccagcgacggccugcgccagcgggaggugcuccgcaaccuguccagccccggcugggagaacaucucccggcccgaggccgcccagcaggccuuccaggggcugggcccgggguucagcggcuacacccccuacggguggcuccagcuguccugguuccagcagaucuacgcgcgccaguacuacaugcaguaccuggccgccaccgccgcgagcggcgccuucgugcccccgcccuccgcccaggagauccccgucgugagcgcccccgcccccgcgccgauccacaaccaguuccccgccgagaaccagcccgccaaccagaacgccgcgccccagguggucgugaacccgggcgccaaccagaaccuccggaugaacgcccagggcggccccaucguggaggaggacgacgagaucaaccgcgacuggcuggacuggaccuacagcgccgccacguucuccgucuuccugagcauccucuacuucuacuccagccugucccgguuccugauggugaugggggccaccguggucauguaccuccaccacgugggcugguuccccuuccgcccccggccggugcagaacuuccccaacgacgggcccccgcccgacgucgugaaccaggaccccaacaacaaccugcaggaggggaccgaccccgagaccgaggacccgaaccaccucccgcccgaccgcgacgugcuggacggcgagcagacgagccccuccuucaugagcaccgcguggcuggucuucaagaccuucuucgccucccugcuccccgaggggccgcccgccaucgccaacuga

SEQ ID NO: 31060 - RNA, 843 nt, Artificial Sequence
  derived and/or modified sequence opt1 from HES1__Homo_sapiens__NP_005515
augcccgccgacaucauggagaagaacagcuccagccccguggccgcgacccccgccuccgucaacaccacgcccgacaagcccaagaccgccagcgagcaccgcaaguccagcaagcccaucauggagaagcggcgccgggcccgcaucaacgagucccugagccagcucaagacccugauccuggacgcccucaagaaggacuccagccggcacuccaagcuggagaaggcggacauccuggagaugaccgugaagcaccuccgcaaccugcagcgggcccagaugacggccgcccugagcaccgaccccuccgugcucggcaaguaccgcgcgggguucagcgagugcaugaacgaggucacccgguuccuguccacgugcgagggcgugaacaccgaggugcgcacccggcugcucgggcaccuggccaacugcaugacccagaucaacgccaugaccuaccccggccagccccacccggcccugcaggccccgccgccgcccccgcccgggcccggcggcccccagcacgcgcccuucgccccgccgccgccccucguccccauccccgggggcgccgcgccgccgcccgggggcgcccccugcaagcuggggagccaggccggcgaggccgccaagguguucggcggguuccaggugguccccgcccccgacggccaguucgccuuccugauccccaacggggcguucgcccacuccggccccgugauccccguguacacgagcaacuccggcaccagcgucgggcccaacgccgugagccccuccagcggccccucccucaccgccgacagcauguggcgccccuggcggaacuga

SEQ ID NO: 31061 - RNA, 522 nt, Artificial Sequence
  derived and/or modified sequence opt1 from HES2__Homo_sapiens__XP_011539915
augggccugccccgccgggccggggacgccgcggagcuccgcaagagccugaagccgcugcucgagaagcggcgccgggcccgcaucaaccagucccugagccagcugaagggccucauccugccccugcucgggcgggagaacuccaacugcagcaagcuggagaaggccgacgugcuggagaugaccguccgcuuccuccaggagcugcccgccuccagcuggcccaccgccgcgccgcugcccugcgacuccuaccgggagggcuacagcgccugcguggcccgccucgcccgggugcugcccgcgugccgcguccuggagcccgccguguccgcccggcuccuggagcaccuguggcgccgggccgccagcgcgacgcucgacgggggccgcgccggcgacuccagcgggccguccgcccccgcccccgcccccgcgagcgccccggagcccgccuccgcccccgugcccagcccgcccuccccgcccugcggccccgggcuguggcggcccugguga

SEQ ID NO: 31062 - RNA, 669 nt, Artificial Sequence
  derived and/or modified sequence opt1 from HES6__Homo_sapiens__NP_001136325
auggcgcccccggccgcccccggccgcgaccggguggggcgcgaggacgaggacggcugggagacccgcggggaccggaaggcccggaagccccuggucgagaagaagcgccgggcccgcaucaacgagagccuccaggagcugcggcugcuccuggccggcgccgaggcgaagcuggagaacgccgaggugcucgagcugaccgugcgccggguccagggggugcugcgcggccgggcccgcgagcgggagcagcuccaggccgaggcguccgagcgcuucgccgccggcuacauccagugcaugcacgaggugcacacguucgucagcacgugccaggccaucgacgccaccguggcggccgagcugcugaaccaccuccuggaguccaugccccugcgggaggggagcuccuuccaggaccuccugggcgacgcccuggccgggccgccccgcgcccccggccggagcggguggcccgcgggcggcgccccggggucccccauccccagcccgcccggccccggggacgaccucugcuccgaccuggaggaggcccccgaggccgagcugagccaggcccccgcggagggcccggaccucgugcccgccgcccugggcucccugaccaccgcccagaucgcccgcagcgucuggcggcccugguga

SEQ ID NO: 31063 - RNA, 693 nt, Artificial Sequence
  derived and/or modified sequence opt1 from HES7__Homo_sapiens__NP_001159439
auggugacccgcgaccgggccgagaaccgcgacggccccaagaugcugaagccccucgucgagaagcggcgccgggaccgcaucaaccggagccuggaggagcugcgccuccugcugcucgagcggacccgcgaccagaaccugcggaaccccaagcuggagaaggccgagauccucgaguucgccgugggguaccugcgcgagcggucccgcguggagccgcccgccgccgccgcccccggcgucccccggagccccgugcaggacgcggaggcccuggccuccugcuaccucagcggguuccgcgagugccugcugcggcucgccgcguucgcccacgacgccucccccgccgcccgcgcgcagcuguucagcgcccugcacggcuaccuccggcccaagccgccccgccccaagcccguggacccccggccgcccgcgccccgccccucccuggaccccgccgcccccgcccuggggcccgcccuccaccagcgcccgcccguccaccagggccaccccagcccccggugcgccuggucccccagccugugcagcccccgcgccggcgacuccggggcccccgcgccgcugacgggccuccugccgccgcccccgccgccccaccggcaggacggggcccccaaggcgccccugccgcccccgcccgccuucuggcgccccuggcccuga

SEQ ID NO: 31064 - RNA, 558 nt, Artificial Sequence
  derived and/or modified sequence opt1 from HESX1__Homo_sapiens__NP_003856
augagccccucccugcaggagggcgcccagcucggggagaacaagccgagcaccugcuccuucagcaucgagcgcauccugggccuggaccagaagaaggacugcgugccccucaugaagccccaccggcccugggccgacaccugcuccagcuccgggaaggacggcaaccugugccugcacgucccgaacccccccagcgggaucuccuuccccagcgugguggaccacccgaugcccgaggagcgcgcguccaaguacgagaacuacuucagcgccuccgagcggcucagccugaagcgcgagcuguccugguaccggggccgccggccccgcacggccuucacccagaaccagaucgagguccucgagaacguguuccgggugaacugcuaccccggcaucgacauccgcgaggaccuggcccagaagcugaaccucgaggaggaccggauccagaucugguuccagaaccgccgggccaagcugaagcgcagccaccgggagucccaguuccugauggcgaagaagaacuucaacaccaaccuccuggaguga

SEQ ID NO: 31065 - RNA, 1590 nt, Artificial Sequence
  derived and/or modified sequence opt1 from HEXA__Homo_sapiens__NP_000511
augaccagcucccgccugugguucagccuccugcuggccgccgcguucgccggccgggccaccgcccucuggcccuggccgcagaacuuccagacguccgaccagcgcuacgugcuguaccccaacaacuuccaguuccaguacgacgucagcuccgccgcgcagcccgggugcagcgugcuggacgaggccuuccagcgguaccgcgaccuccuguucggcuccgggagcuggccccggccguaccugaccggcaagcgccacacccucgagaagaacgugcuggucguguccguggucacccccgggugcaaccagcugcccacgcucgagagcguggagaacuacacccugaccaucaacgacgaccagugccugcuccuguccgagaccguguggggcgcccugcggggccucgagacguucagccagcuggucuggaaguccgccgaggggaccuucuucaucaacaagaccgagaucgaggacuucccccgcuucccgcaccggggccugcuccuggacaccagccgccacuaccugccccucuccagcauccuggacacgcuggacgugauggcguacaacaagcucaacguguuccacuggcaccuggucgacgaccccuccuuccccuacgagagcuucaccuucccggagcugaugcggaagggguccuacaaccccgugacccacaucuacaccgcccaggacgugaaggaggucaucgaguacgcccgccuccggggcauccgcgugcuggccgaguucgacacgcccgggcacacccugagcuggggccccggcaucccggggcuccugacccccugcuacagcggcuccgagcccagcgggaccuucggccccgugaacccgucccugaacaacacguacgaguucaugagcaccuucuuccucgaggucuccagcguguuccccgacuucuaccugcaccugggcggggacgagguggacuucacgugcuggaaguccaaccccgagauccaggacuucaugcggaagaagggcuucggggaggacuucaagcagcucgagagcuucuacauccagacccugcuggacaucgucuccagcuacggcaagggguacgugguguggcaggaggucuucgacaacaaggugaagauccagcccgacaccaucauccaggucuggcgcgaggacaucccggugaacuacaugaaggagcucgagcuggugaccaaggccggcuuccgggcgcugcucuccgcccccugguaccugaaccgcaucagcuacggccccgacuggaaggacuucuacaucgucgagccccuggccuucgaggggaccccggagcagaaggcccucgugaucggcggggaggccugcauguggggcgaguacguggacaacaccaaccuggucccccggcuguggccccgcgcgggggccguggccgagcggcugugguccaacaagcucacgagcgaccugaccuucgccuacgagcgccugucccacuuccgcugcgagcuccugcggcgcggcgugcaggcccagccgcugaacgucggcuucugcgagcaggaguucgagcagaccuga

SEQ ID NO: 31066 - RNA, 1671 nt, Artificial Sequence
  derived and/or modified sequence opt1 from HEXB__Homo_sapiens__NP_000512
auggagcugugcggccucgggcugccccgcccgcccaugcugcucgcccugcugcucgccacccugcuggcggccaugcucgcccugcugacccagguggcccucgucguccagguggccgaggcggcccgggcccccagcguguccgccaagcccggcccggcgcuguggccccugccccucagcgugaagaugacgcccaaccugcugcaccucgccccggagaacuucuacaucucccacagccccaacuccaccgccgggcccagcugcacccugcuggaggaggccuuccgccgguaccacggcuacaucuucggguucuacaaguggcaccacgagcccgccgaguuccaggcgaagacccaggugcagcagcuccuggucuccaucacgcugcagagcgagugcgacgccuucccgaacaucuccagcgacgaguccuacacccuccuggugaaggagcccguggccguccugaaggccaaccgcguguggggcgcccuccggggccuggagaccuucagccagcugguguaccaggacuccuacgggaccuucacgaucaacgagagcaccaucaucgacagcccccgcuucucccaccggggcauccucaucgacaccucccgccacuaccugcccgucaagaucauccugaagacccucgacgcgauggccuucaacaaguucaacgugcugcacuggcacaucguggacgaccagagcuucccguaccaguccaucacguuccccgagcugagcaacaaggggagcuacucccucagccacgucuacacccccaacgacgugcggauggugaucgaguacgcccgccugcggggcauccgcguccugcccgaguucgacaccccggggcacacccucuccuggggcaagggccagaaggaccugcugacgcccugcuacagccggcagaacaagcucgacuccuucgggcccaucaaccccacccugaacaccaccuacagcuuccugacgaccuucuucaaggagaucuccgagguguucccggaccaguucauccaccucggcggggacgagguggaguucaagugcugggagagcaaccccaagauccaggacuucaugcgccagaagggcuucggcaccgacuucaagaagcuggaguccuucuacauccagaagguccuggacaucaucgccaccaucaacaaggggagcaucguguggcaggagguguucgacgacaaggccaagcucgcgcccggcacgaucgucgagguguggaaggacuccgccuaccccgaggagcugagccgggucaccgccuccggguucccggugauccugagcgcccccugguaccuggaccucaucuccuacggccaggacuggcgcaaguacuacaagguggagccccuggacuucgggggcacccagaagcagaagcagcuguucaucggcggggaggccugccucuggggcgaguacgucgacgcgaccaaccugacgccgcggcuguggccccgcgccagcgccgugggggagcggcucugguccagcaaggacgugcgcgacauggacgacgccuacgaccggcugacccgccaccgcugccggauggucgagcgcggcaucgcggcccagccccuguacgccggguacugcaaccacgagaacauguga

SEQ ID NO: 31067 - RNA, 1758 nt, Artificial Sequence
  derived and/or modified sequence opt1 from HEXDC__Homo_sapiens__NP_775891
augagcggcuccacccccuuccagaugcgccuggugcaccucgaccugaagggggccccgcccaaggucagcuaccuguccgagaucuucccccucuuccgggcccugggcgcgaacgggcugcucaucgaguacgaggacauguuccccuacgagggcccgcugcgccugcuccgggccaaguacgccuacagccccuccgagaucaaggagauccugcaccuggccgggcucaacgagcuggaggugaucccccuggugcagaccuucggccacauggaguucguccucaagcacacggccuucgcgcaccuccgcgaggugggcagcuuccccugcacccugaacccgcacgaggccgagucccucgcccuggugggggccaugaucgaccagguccuggagcuccaccccggcgcgcagcggcugcacaucgggugcgacgagguguacuaccugggcgagggggaggccagccgccgguggcuccagcaggagcagaacuccaccggcaagcugugccugagccacaugcgcgccguggccuccggcgucaaggcccggcgccccagcgugacgccccucgugugggacgacaugcugcgggaccugccggaggaccagcucgcggccuccggggucccccagcugguggagcccgugcugugggacuacaccgccgaccucgacguccacggcaaggugcugcugaugcagaaguaccgccggugcggguucccccagcucugggccgccagcgcguucaagggcgccaccggcccgucccaggccgugccgcccgucgagcaccaccuccgcaaccacgugcaguggcuccagguggccgggagcggccccaccgacucccugcaggggaucauccugaccggcuggcagcgguacgaccacuacagcguccugugcgagcugcugcccgccggggugcccucccuggcggccugccuccagcugcugcuccgcggcggcuucgacgaggacgugaaggccaaggucgagaaccugcuggggaucagcagccuggagaagacggaccccgugcggcaggcccccugcuccccgcccugcccccuccugccccugccguucccccgccccuggcggcagcuguucagcgccggccuguccgcggggcgcggcccggcccccagccuggccgccaccucccucccccugagccacaaguccgcgagcaucugcgccgcccuguggaugcggugcuggcgcgccaccgggaugucccucgccggcagcgcgcccaccacggccuccggcagcuccagcacccgcuccugguucagcaccuccagcccgcagcgguccgccagcuggcacagcggggcccccuccugccgcagcuggcggcugcccugcuccuggcugagcacccgcaugcccuggcgguccggcuggcgcaagacgugcaccccggccugcagcgggugcaagcucugcugccggaccuccgcgcgcugccugccgccccggugccacccgcccgcccuggccggcacccuccugcgcacgcccgaggggcgggcccacgcccgcggccugcuccuggaggcgggcggggcccugcacugccagauggccugggccauccgggcgcacgucggcguggugcccagcgggcccgccgucuccugcccccacagcgugcccgagggccccggccagccccucggggagcgccuggagaacaccgagggcuccagcaccgggcggccggcccuguga

SEQ ID NO: 31068 - RNA, 1080 nt, Artificial Sequence
  derived and/or modified sequence opt1 from HEXIM1__Homo_sapiens__NP_006451
auggccgagcccuuccugagcgaguaccagcaccagccgcagaccuccaacugcaccggcgccgcggccgugcaggaggagcucaaccccgagcgcccgcccggggccgaggagcggguccccgaggaggacagccgcuggcagucccgggccuucccccagcugggcgggcgccccggccccgagggggagggcagccuggagucccagccgccgccccuccagacgcaggccugccccgagagcuccugccugcgggagggcgagaaggggcagaacggcgacgacagcuccgccgggggcgacuucccgccgcccgcggagguggagcccacccccgaggccgagcugcucgcccagcccugccacgacagcgaggcguccaagcugggggcccccgccgccggcggcgaggaggagugggggcagcagcagcgccagcugggcaagaagaagcaccggcgccggcccagcaagaagaagcgccacuggaagcccuacuacaagcucaccugggaggagaagaagaaguucgacgagaagcagucccugcgggccagccgcauccgggcggagauguucgccaaggggcagcccguggcccccuacaacaccacgcaguuccugauggacgaccacgaccaggaggagcccgaccucaagaccggccuguacuccaagcgcgccgccgccaagagcgacgacaccuccgacgacgacuucauggaggagggcggggaggaggacggcgggagcgacggcaugggcggggacggcuccgaguuccugcagcgggacuucagcgagaccuacgagcgcuaccacacggagagccuccagaacauguccaagcaggagcugaucaaggaguaccuggagcucgagaagugccugagccggauggaggacgagaacaaccgccugcggcucgaguccaagcgccucgggggcgacgacgcgcggguccgcgagcuggagcuggagcuggaccgccugcgggccgagaaccuccagcugcugaccgagaacgagcuccaccgccagcaggagcgggccccgcugagcaaguucggggacuga

SEQ ID NO: 31069 - RNA, 927 nt, Artificial Sequence
  derived and/or modified sequence opt1 from HEY1__Homo_sapiens__NP_001035798
augaagcgcgcccaccccgaguacagcuccagcgacuccgagcuggacgagaccaucgagguggagaaggagagcgccgacgagaacggcaaccucuccagcgcgcugggguccaugagcccgaccacguccagccagauccuggcccggaagcgccggcgcggcaucaucgagaagcggcgccgggaccgcaucaacaacucccucagcgagcugcggcgccugguccccuccgccuucgagaagcaggucauggagcaggggagcgccaagcucgagaaggccgagauccugcagaugaccguggaccaccugaagaugcuccacaccgcgggcgggaagggcuacuucgacgcccacgcccuggccauggacuaccggucccugggcuuccgcgagugccucgcggagguggcccgguaccugagcaucaucgaggggcuggacgccuccgacccccuccgcgugcggcuggugagccaccugaacaacuacgccucccagcgcgaggccgcgagcggcgcccacgccgggcucggccacauccccugggggaccgucuucggccaccacccgcacaucgcccacccccugcugcucccccagaacggccacgggaacgccggcacgaccgcgagccccaccgagccgcaccaccaggggcggcugggcuccgcccaccccgaggcccccgcccugcgcgcgcccccgagcggcucccucgggcccgugcugcccguggucaccagcgccuccaagcugagcccgccccuccuguccagcguggccucccugagcgccuuccccuucuccuucggcagcuuccaccuccugucccccaacgcccugagccccuccgccccgacgcaggcggccaaccucgggaagcccuaccggcccuggggcaccgagaucggggccuucuga

SEQ ID NO: 31070 - RNA, 1014 nt, Artificial Sequence
  derived and/or modified sequence opt1 from HEY2__Homo_sapiens__NP_036391
augaagcgccccugcgaggagaccaccagcgaguccgacauggacgagacgaucgacgugggcagcgagaacaacuacuccgggcagagcaccuccagcgucauccggcugaacuccccgaccaccacgagccagaucauggcccgcaagaagcggcgcggcaucaucgagaagcggcgccgggaccgcaucaacaacucccucagcgagcugcggcgccuggugcccaccgccuucgagaagcagggguccgcgaagcucgagaaggccgagauccugcagaugaccguggaccaccugaagaugcuccaggccaccggcgggaagggcuacuucgacgcccacgcccuggcgauggacuucaugagcaucggcuuccgggagugccugacggaggucgcccgcuaccucuccagcguggaggggcuggacuccagcgacccccugcgggugcgccucgucucccaccugagcacgugcgccacccagcgggaggccgcggccaugaccuccagcauggcccaccaccaccacccccugcacccgcaccacugggccgccgcguuccaccaccuccccgccgcccugcugcagcccaacggccuccacgccagcgaguccacccccugccgccugagcaccaccuccgaggugccgcccgcccacgggagcgcgcugcucaccgccacguucgcccacgccgacuccgcccugcggaugcccagcaccggcuccguggcgcccugcgucccgccccugagcaccucccuccugagccuguccgccaccgugcacgccgccgccgcggccgccacggccgcggcccacagcuucccccucuccuucgccggggccuuccccaugcugccgcccaacgccgcggccgccguggccgccgcgaccgccaucagcccgccccuguccgucagcgccaccuccagcccccagcagaccuccagcggcacgaacaacaagcccuaccgccccuggggcaccgaggugggggccuucuga

SEQ ID NO: 31071 - RNA, 1047 nt, Artificial Sequence
  derived and/or modified sequence opt1 from HFE__Homo_sapiens__NP_000401
augggcccccgcgcccggccggcccugcuccugcugaugcuccugcagaccgcggugcugcaggggcgccuccugcggagccacucccugcacuaccucuucaugggcgccagcgagcaggaccuggggcugucccucuucgaggcccugggcuacgucgacgaccagcuguucguguucuacgaccacgagagccgccggguggagccccgcacccccugggucuccagccggaucuccagccagauguggcuccagcugucccagagccugaaggggugggaccacauguucaccguggacuucuggaccaucauggagaaccacaaccacuccaaggagagccacacccuccaggugauccugggcugcgagaugcaggaggacaacuccaccgagggcuacuggaaguacggguacgacggccaggaccaccuggaguucugccccgacacgcucgacuggcgcgccgccgagccgcgggcguggcccaccaagcuggagugggagcgccacaagauccgggcccgccagaaccgggccuaccuggagcgcgacugccccgcccagcuccagcagcugcuggagcucgggcggggcguccuggaccagcaggucccgccccuggugaaggugacccaccacgugaccagcuccgugacgacccuccgcugccgggcgcugaacuacuacccccagaacaucaccaugaaguggcugaaggacaagcagcccauggacgccaaggaguucgagcccaaggacguccucccgaacggggacggcaccuaccagggcuggaucacgcuggccgugccgcccggggaggagcagcgcuacacgugccagguggagcaccccggccuggaccagccccucaucgucaucugggagcccagccccuccgggacccuggugaucggcgugaucagcggcaucgccgucuucguggugauccuguucaucgggauccucuucaucauccugcggaagcgccagggcucccgcggggccaugggccacuacguccuggcggagcgggaguga

SEQ ID NO: 31072 - RNA, 4308 nt, Artificial Sequence
  derived and/or modified sequence opt1 from HFM1__Homo_sapiens__XP_011539154
augcucaagagcaacgacugccuguucucccuggagaaccuguucuucgagaagcccgacgagguggagaaccacccggacaacgagaagucccucgacugguuccugccgcccgcgccccugaucagcgagauccccgacacccaggagcucgaggaggagcuggagagccacaagcugcucggccaggagaagcgccccaagaugcugaccuccaaccugaagaucacgaacgaggacaccaacuacaucagccucacccagaaguuccaguucgccuuccccuccgacaaguacgagcaggacgaccugaaccuggagggggucggcaacaacgaccucagccacaucgccgggaagcugaccuacgccucccagaaguacaagaaccacaucggcacggagaucgcccccgagaaguccgugccggacgacaccaagcuggugaacuucgccgaggacaagggggagagcaccagcgucuuccggaagcgccucuucaagaucuccgacaacauccacggcagcgccuacuccaacgacaacgagcuggacagccacaucggcuccgugaagaucgugcagaccgagaugaacaagggcaagagccggaacuacuccaacagcaagcagaaguuccaguacagcgcgaacgucuucacggccaacaacgccuucuccgccagcgagaucggggaggggauguucaaggcgcccuccuucagcguggccuuccagccccacgacauccaggaggugaccgagaacggccuggggucccucaaggccgucaccgagauccccgccaaguuccgcagcaucuucaaggaguucccguacuucaacuacauccaguccaaggccuucgacgaccugcuguacaccgaccggaacuucgugaucugcgcgcccacgggcagcggcaagaccguggucuucgagcucgccaucacccgccugcugauggaggugccccuccccuggcugaacaucaagaucguguacauggccccgaucaaggcccugugcucccagcgguucgacgacuggaaggagaaguucgggcccaucggccucaacugcaaggagcugaccggggacacggucauggacgaccuguucgagauccagcacgcccacaucaucaugaccacccccgagaagugggacagcaugacccgcaaguggcgggacaacucccucgugcagcuggugcgccuguuccucaucgacgagguccacaucgugaaggacgagaaccggggccccacgcuggagguggucgugagccgcaugaagaccgugcaguccgucagccagacccugaagaacaccuccacggcgaucccgaugcgguucguggccgucagcgccaccauccccaacgccgaggacaucgccgaguggcucuccgacggcgagcgccccgcggugugccugaagauggacgagagccaccggcccgugaagcugcagaaggucgugcucggguucccgugcuccagcaaccagaccgaguucaaguucgaccugacccugaacuacaagaucgccagcgugauccagauguacuccgaccagaagcccacgcucgucuucugcgccacccgcaagggcgugcagcaggccgccagcgugcuggucaaggacgcgaaguucaucaugaccguggagcagaagcagcggcugcagaaguacgccuacuccgugcgcgacagcaagcuccgggacauccugaaggacggggccgccuaccaccacgcgggcauggagcuguccgaccgcaaggucguggagggggccuucaccgugggcgaccugcccguccucuucacgaccagcacccuggccaugggcgugaaccugcccgcccaccucguggucaucaaguccaccaugcacuacgccgggggccuguucgaggaguacagcgagacggacauccugcagaugaucgggcgggcgggccgcccgcaguucgacaccaccgccaccgccgugaucaugacccgccucuccacgcgggacaaguacauccagaugcuggccugccgcgacaccguggagagcucccugcaccggcaccucaucgagcaccugaacgccgagaucguccugcacaccaucaccgacgugaacaucgcgguggaguggauccgcagcacgcuccuguacauccgggcccugaagaaccccucccacuacggguucgccagcggccucaacaaggacggcaucgaggccaagcugcaggagcugugccucaagaaccugaacgaccuguccagccucgaccugaucaagauggacgagggggucaacuucaagcccaccgaggccggccgccugauggcgugguacuacaucaccuucgagaccgugaagaaguucuacacgaucuccgggaaggagacccucagcgaccuggugacccugaucgccggcugcaaggaguuccucgacauccagcugcggaucaacgagaagaagacccugaacacgcucaacaaggacccgaaccgcaucaccauccgguuccccauggaggggcgcaucaagacccgggagaugaaggucaacugccugauccaggcccagcugggcugcauccccauccaggacuucgcccucacccaggacacggcgaagaucuuccgccacggcagccggaucacccgcuggcuguccgacuucguggccgcccaggagaagaaguucgccgugcugcucaacagccugauccuggccaagugcuuccggugcaagcucugggagaacucccugcacgucagcaagcagcuggagaagaucgggaucacccucuccaacgcgaucgugaacgccggccugaccagcuucaagaagaucgaggagacggacgcccgcgagcuggagcucauccugaaccggcacccgcccuucgggacccagaucaaggagaccgugauguaccugcccaaguacgagcucaaggucgagcagaucacccgcuacuccgacacgaccgccgagauccuggugaccgugauccugcggaacuucgagcagcuccagaccaagcgcacggccagcgacucccacuacgucacccugaucaucggcgacgcggacaaccaggugguguaccugcacaagaucaccgacagcguccuccugaaggccggcuccugggccaagaagaucgccgugaagcgcgcccucaagagcgaggaccuguccaucaaccugaucagcuccgaguucguggggcuggacauccagcagaagcucaccgucuucuaccuggagcccaagcgguucggcaaccagaucacgaugcagcgcaagagcgagacccagaucucccacagcaagcacuccgacaucagcaccaucgcggggcccaacaagggcaccacggccagcaagaagccggggaaccgggagugcaaccaccugugcaaguccaagcacacgugcggccacgacugcugcaagaucggcguggcccagaaguccgagaucaaggagagcaccaucagcuccuaccucagcgaccugcgcaaccggaacgccguguccagcgucccgcccgugaagcgccugaagauccagaugaacaagucccagagcguggaccucaaggaguucggguucacccccaagcccucccugcccagcaucucccggagcgaguaccugaacaucuccgagcuccccaucauggagcagugggaccagcccgagaucuacggcaagguccgccaggagccgagcgaguaccaggacaaggaggugcugaacgugaacuucgagcuggggaacgaggucugggacgacuucgacgacgagaaccucgaggugaccuccuucagcaccgacaccgagaagaccaagaucuccggcuucgggaacacccugagcagcuccacgcggggcagcaagcugccccuccaggaguccaagagcaaguuccagcgcgagauguccaacagcuucgucuccagccacgagauguccgacaucagccuguccaacagcgcgaugcccaaguucuccgccagcuccaugaccaagcugccccagcaggccggcaacgccgugaucgugcacuuccaggagcggaagccgcagaaccucagccccgagaucgagaagcagugcuucaccuucuccgagaagaaccccaacagcuccaacuacaagaaggucgacuucuucauccgcaacagcgagugcaagaaggagguggacuucagcauguaccaccccgacgacgaggccgacgagaugaagucccugcuggggaucuucgacggcaucuucuga

SEQ ID NO: 31073 - RNA, 1338 nt, Artificial Sequence
  derived and/or modified sequence opt1 from HGD__Homo_sapiens__NP_000178
auggccgagcugaaguacaucagcggcuucgggaacgagugcuccagcgaggacccccgcugcccgggcucccuccccgaggggcagaacaacccccaggugugccccuacaaccuguacgccgagcagcugagcggcuccgcguucacgugcccgcggagcaccaacaagcgcuccuggcucuaccggauccugcccagcgucucccacaagcccuucgagagcaucgacgagggccaggugacccacaacugggacgagguggaccccgacccgaaccagcugcgcuggaagcccuucgagauccccaaggccucccagaagaaggucgacuucgugagcgggcuccacacccugugcggcgccggggacaucaaguccaacaacggccuggccauccacaucuuccucugcaacaccagcauggagaaccggugcuucuacaacuccgacggggacuuccugaucgugccccagaagggcaaccugcucaucuacaccgaguucgggaagaugcugguccagccgaacgagaucugcgugauccagcgcggcaugcgguucagcaucgacguguucgaggagacgcgcggcuacauccuggaggucuacggggugcacuucgagcuccccgaccugggccccaucggggccaacggccuggcgaacccccgggacuuccucaucccgaucgccugguacgaggaccgccaggugcccggcggguacaccgucaucaacaaguaccagggcaagcuguucgccgccaagcaggacgugucccccuucaacguggucgcguggcacgggaacuacacccccuacaaguacaaccugaagaacuucauggugaucaacagcguggccuucgaccacgccgacccguccaucuucaccguccucacggccaagagcgugcggcccggcguggccaucgcggacuucgucaucuucccgccccgcuggggcguggccgacaagaccuuccggccgcccuacuaccaccgcaacugcaugagcgaguucauggggcugauccggggccacuacgaggccaagcagggcggguuccugcccgggggcgggucccuccacagcaccaugacgccccacggccccgacgccgacugcuucgagaaggccuccaaggugaagcuggcgcccgagcgcaucgccgacggcaccauggccuucauguucgagagcucccugagccucgccgucaccaagugggggcugaaggccucccggugccuggacgagaacuaccacaagugcugggagccccucaagagccacuucaccccgaacucccgcaaccccgcggagcccaacuga

SEQ ID NO: 31074 - RNA, 1968 nt, Artificial Sequence
  derived and/or modified sequence opt1 from HGFAC__Homo_sapiens__NP_001519
augggccgcugggccugggugcccagcccguggcccccgcccgggcugggccccuuccuccugcugcuccugcugcuccugcugcucccccggggguuccagccccagcccggcgggaaccgcaccgaguccccggagcccaacgccaccgcgacgcccgccauccccaccauccuggucaccagcgugaccuccgagacgccggccaccagcgcccccgaggccgagggcccccaguccggcgggcugcccccgccgccccgggcggugcccagcuccagcagcccccaggcccaggcccucaccgaggacggccgccccugccgguuccccuuccgcuacgggggccggaugcugcacgccugcaccuccgagggguccgcgcaccgcaaguggugcgccacgacccacaacuacgaccgggaccgcgccuggggcuacugcgucgaggccacgcccccgcccggcgggcccgccgcgcuggaccccugcgccagcggcccgugccucaacgggggcuccugcagcaacacccaggacccccaguccuaccacugcagcugcccccgggccuucaccggcaaggacugcgggaccgagaagugcuucgacgagacccgcuacgaguaccuggagggcggggaccggugggcccgcgugcggcagggccacguggagcagugcgagugcuucgggggccgcaccuggugcgagggcacgcggcacaccgccugccuguccagcccgugccucaacggcgggaccugccaccugaucgucgcgaccgggacgaccgugugcgccugcccgcccggcuucgccgggcgccugugcaacaucgagcccgacgagcggugcuuccucggcaacggcaccggguaccgcggcguggccuccaccagcgccagcgggcuguccugccuggcguggaacagcgaccuccuguaccaggagcugcacgucgacuccgugggcgccgccgcccuccuggggcugggcccccacgccuacugccggaaccccgacaacgacgagcgccccuggugcuacguggucaaggacagcgcgcucuccugggaguacugccgccuggaggccugcgagagccugacgcgggugcagcucucccccgaccugcuggccacccucccggagcccgccagccccggccgccaggcgugcgggcggcgccacaagaagcggaccuuccugcgcccccggaucaucggcggguccagcucccugccgggcagccaccccuggcucgccgccaucuacaucggcgacuccuucugcgccgggagccuggugcacacgugcugggucguguccgccgcgcacugcuucagccacuccccgccccgcgacagcguguccgucgugcugggccagcacuucuucaaccggaccaccgacgugacccagaccuucgggaucgagaaguacauccccuacacgcucuacagcgucuucaaccccagcgaccacgaccuggugcugauccgccucaagaagaagggcgaccggugcgccacccgcucccaguucgugcagcccaucugccugcccgagccggggagcaccuuccccgccggccacaagugccagaucgccggcugggggcaccuggacgagaacgucuccggcuacagcuccagccuccgggaggcccuggugccccuggucgcggaccacaagugcuccagccccgagguguacggggccgacaucuccccgaacaugcugugcgccggcuacuucgacugcaagagcgacgccugccagggggacuccggcggcccccucgccugcgagaagaacgggguggcguaccuguacggcaucaucagcuggggcgacgggugcgggcgccugcacaagcccggcgucuacacccggguggccaacuacguggacuggaucaacgaccgcauccggccgccccgccggcucgucgcccccuccuga

SEQ ID NO: 31075 - RNA, 2187 nt, Artificial Sequence
  derived and/or modified sequence opt1 from HGF__Homo_sapiens__NP_000592
augugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcuga

SEQ ID NO: 31076 - RNA, 1173 nt, Artificial Sequence
  derived and/or modified sequence opt1 from HGH1__Homo_sapiens__NP_057542
augggcgaggccggggccggcgcgggggccagcggcgggcccgaggccuccccggaggccgagguggucaagcugcuccccuuccuggcccccggcgcgcgcgccgaccugcaggccgccgcggugcggcacgugcucgcccugaccggcugcgggcccggccgcgcccugcucgccgggcaggccgcgcugcugcaggcccucauggagcuggccccggccagcgcccccgcgcgggacgccgcccgcgcccuggucaaccucgccgcggaccccggccugcacgagacccugcucgccgccgaccccgggcugccggcccggcugaugggccgcgcccucgacccccaguggcccugggcggaggaggccgccgccgcgcuggccaaccugucccgggagcccgccccgugcgccgcccucauggcggcccuggccgccgccgagcccgcggacagcggccuggagcgccucgugcgggcccugugcacgcccggguacaacgcccgcgcgccccugcacuaccucgccccgcugcuguccaaccucagccagcggcccgccgcccgcgccuuccugcuggaccccgaccggugcgugguccagcgccuccugccccugacccaguacccggacuccagcgugcggcgcggcgggguggucggcacccuccggaacugcugcuucgagcaccgccaccacgaguggcugcugggccccgagguggacauccuccccuuccugcugcucccccuggccgggccggaggacuucuccgaggaggagauggagcggcugcccguggaccuccaguaccugccgcccgacaagcagcgcgagcccgacgcggacauccggaagaugcuggucgaggccaucaugcuccugaccgccacggcccccggccgccagcagguccgcgaccagggggccuaccugauccugcgggagcuccacagcugggagcccgagccggacgugcgcaccgcgugcgagaagcugauccaggugcugaucggcgacgagcccgagcgggggauggagaaccuccuggagguccaggugcccgaggacguggagcagcagcugcagcagcucgacugccgcgagcaggagcagcuggagcgggagcuggcccccgagccguggguggagcgcgccacccccaccuga

SEQ ID NO: 31077 - RNA, 2334 nt, Artificial Sequence
  derived and/or modified sequence opt1 from HGS__Homo_sapiens__NP_004703
augggccgcgggagcggcaccuucgagcggcugcucgacaaggccaccucccagcugcugcucgagacggacugggagagcauccugcagaucugcgaccugauccgccagggggacacccaggccaaguacgcggugaacuccaucaagaagaaggucaacgacaagaacccccacguggcccucuacgcccuggaggugauggagagcgucgugaagaacugcggccagaccgugcacgacgaggucgccaacaagcagaccauggaggagcugaaggaccuccugaagcgccagguggaggugaacguccggaacaagauccuguaccucauccaggccugggcgcacgccuuccggaacgagcccaaguacaagguggugcaggacacguaccagaucaugaaggucgaggggcacguguuccccgaguucaaggaguccgacgccauguucgccgcggagcgcgcccccgacuggguggacgccgaggagugccaccggugccgcguccaguucggcgugaugacccggaagcaccacugccgcgccugcggccagaucuucugcgggaagugcagcuccaaguacagcaccauccccaaguucggcaucgagaaggaggugcgggucugcgagccgugcuacgagcagcugaaccgcaaggccgaggggaaggcgaccuccacgaccgagcugccgcccgaguaccucaccagcccccugucccagcagagccagcugccgcccaagcgggacgagaccgcccuccaggaggaggaggagcugcagcuggcccucgcccugucccagagcgaggccgaggagaaggagcgccugcggcagaaguccacguacaccagcuaccccaaggcggagcccaugcccuccgccagcuccgccccgcccgccagcagccucuacuccagccccgugaacuccagcgcgccccuggccgaggacaucgaccccgagcuggcccgcuaccucaaccggaacuacugggagaagaagcaggaggaggcccgcaagucccccacccccagcgccccggugccccugaccgagcccgccgcgcagcccggcgaggggcacgccgccccgacgaacgucguggagaacccccugcccgagaccgacucccagcccaucccgcccagcggcggccccuucuccgagccgcaguuccacaacggggagagcgaggagucccacgagcaguuccucaaggcccugcagaacgcggugaccaccuucgucaaccggaugaaguccaaccacaugcgcggccggagcaucacgaacgacagcgccgugcugucccucuuccagagcaucaacgggaugcacccccagcugcuggagcuccugaaccagcuggacgagcgccgccucuacuacgagggccugcaggacaagcuggcccagauccgggacgcccgcggcgcccucuccgcgcugcgggaggagcaccgcgagaagcugcggcgcgccgccgaggaggccgagcggcagcgccagauccagcucgcccagaagcuggagaucaugcggcagaagaagcaggaguaccuggagguccagcgccagcucgcgauccagcggcugcaggagcaggagaaggagcgccagaugcggcuggagcagcagaagcagaccgugcagaugcgcgcccagaugcccgccuucccccugccguacgcccagcuccaggccaugcccgcggccgggggcgugcuguaccagcccagcgggcccgccuccuucccgagcaccuucagccccgccggcuccgucgaggggagccccaugcacggcguguacaugucccagcccgcgccggccgccggccccuaccccagcaugcccuccaccgccgccgacccgagcaugguguccgcguacauguaccccgccggggccacgggcgcccaggccgcgccccaggcccaggccgggcccaccgccagcccggccuacuccagcuaccagcccacccccaccgcgggcuaccagaacgucgccucccaggcgccccagagccugccggccaucucccagccgccccagagcuccacgaugggguacaugggcagccaguccgugagcaugggcuaccagcccuacaacaugcagaaccucaugaccacccugcccagccaggacgccucccugccgccccagcagcccuacaucgccgggcagcagcccauguaccagcagauggcccccagcggcgggcccccgcagcagcagccgcccguggcccagcagccccaggcccagggcccgcccgcgcagggguccgaggcccagcucaucagcuucgacuga

SEQ ID NO: 31078 - RNA, 1908 nt, Artificial Sequence
  derived and/or modified sequence opt1 from HGSNAT__Homo_sapiens__NP_689632
augagcggcgccgggcgcgcccuggcggcccuccugcuggccgccuccgugcucagcgccgcgcugcuggcccccggcggguccagcggccgggacgcccaggccgcgccgccccgcgaccucgacaagaagcggcacgccgagcugaagauggaccaggcccugcuccugauccacaacgagcugcucuggaccaaccugaccgucuacuggaaguccgagugcugcuaccacugccuguuccaggugcucgugaacgucccccagagccccaaggccgggaagccguccgccgcggccgccagcguguccacgcagcacggcagcauccugcagcugaacgacacccucgaggagaaggaggugugccgccuggaguaccgguucggcgaguucgggaacuacucccugcucgucaagaacauccacaacggcgugagcgagaucgccugcgaccuggccgugaacgaggaccccgucgacuccaaccugcccgugagcaucgcguuccucaucgggcuggccgugaucaucgucaucuccuuccugcgccuccugcugagccucgacgacuucaacaacuggaucuccaaggccaucagcucccgggagaccgaccgccugaucaacagcgagcugggcagccccucccggaccgacccgcucgacggggacgugcagcccgccacguggcgccugagcgcccugccgccccggcuccgcuccguggacaccuuccggggcaucgcgcugauccugauggucuucgugaacuacggcgggggcaaguacugguacuucaagcacgccagcuggaacgggcucaccguggccgaccuggucuuccccugguucguguucaucaugggcuccagcaucuuccuguccaugaccagcauccuccagcgcggcugcuccaaguuccggcugcuggggaagaucgccuggcgcagcuuccuccugaucugcaucggcaucaucaucgugaaccccaacuacugccuggggccccucuccugggacaagguccggauccccggcgugcugcagcgccugggggugacguacuucgucguggccguccuggagcuccuguucgcgaagccggugcccgagcacugcgccagcgagcgguccugccugagccuccgcgacaucaccuccagcuggccccaguggcugcugauccucgugcuggagggccuguggcucggccugaccuuccugcuccccgucccggggugccccaccggcuaccuggggcccggcgggaucggcgacuucggcaaguaccccaacugcaccgggggcgccgccggguacaucgaccggcugcuccugggcgacgaccaccuguaccagcacccguccagcgcggugcucuaccacacggagguggccuacgaccccgaggggauccugggcaccaucaacuccaucgucauggccuuccugggcgugcaggccgggaagauccuccuguacuacaaggcccgcaccaaggacauccugauccgcuucacggcguggugcugcauccucggccugaucagcguggcccugaccaaggucagcgagaacgagggguucauccccgugaacaagaaccucuggucccugagcuacgugaccacccuguccagcuucgccuucuucauccuccugguccuguaccccgugguggacgucaagggccucuggacgggcaccccguucuucuaccccgggaugaacuccauccugguguacgugggccacgaggucuucgagaacuacuuccccuuccaguggaagcugaaggacaaccagagccacaaggagcaccucacccagaacaucguggccaccgcccugugggugcugaucgcguacauccucuaccggaagaagaucuucuggaagaucuga

SEQ ID NO: 31079 - RNA, 1071 nt, Artificial Sequence
  derived and/or modified sequence opt1 from HHAT__Homo_sapiens__NP_001164035
augcugccccgcugggagcucgcccuguaccugcucgccagccugggcuuccacuucuacuccuucuacgagguguacaaggucagccgggagcacgaggaggagcuggaccaggaguucgagcucgagaccgacacccuguucgggggccugaagaaggacgcgacggacuucgagugguccuucuggauggagugggggaagcaguggcucguguggcugcugcucggccacaugguggucagccagauggccacccugcuggcccgcaagaugcagcagcaggagcacgacucccucaaggccagccugugcgugcuggcccucgggcugggccggcugcucugcuggugguggcuggcggagcugauggcccaccucauguacaugcacgccaucuacuccagcaucccgcugcuggagaccguguccugcuggacccucggcgggcuggcccuggcgcagguccucuucuucuacgugaaguaccuggugcuguucggcguccccgcccuccugaugcgccuggacgggcucacgccgcccgcccugccccggugcgugagcaccauguucuccuucaccggcauguggcgcuacuucgacguggggcugcacaacuuccucauccgguacgucuacauccccgugggcggcagccagcacgggcugcugggcacccucuucuccacggccaugaccuucgccuucgugagcuacuggcacgggggcuacgacuaccuguggugcugggcggcccugaacuggcucggcgucaccguggagaacggggugcgccggcuggucgagacccccugcauccaggacucccuggcccgcuacuucagcccccaggcccggcgccgguuccacgccgcgcucgccuccugcagcacguccaugcugauccugagcaaccugguguuccucggcgggaacgaggugggcaagaccuacuggaaccgcaucuucauccagggguggccgugggucacccugagcgugcugggcuuccucuacugcuacucccacgugggcaucgccugggcccagaccuacgccacggacuga

SEQ ID NO: 31080 - RNA, 1515 nt, Artificial Sequence
  derived and/or modified sequence opt1 from HHATL__Homo_sapiens__NP_065758
augggcaucaagaccgcccugcccgccgcggagcucgggcuguacagccuggugcucuccggcgcccuggccuacgccgggcgcggccugcucgaggccagccaggacggggcgcaccggaaggccuuccgcgaguccguccggccgggcugggaguacaucggccgcaagauggacguggccgacuucgagugggugaugugguucaccagcuuccggaacgucaucaucuucgcccuguccgggcacgugcuguucgcgaagcucugcacgaugguggcccccaagcugcgcagcuggauguacgccgucuacggcgcccuggccgugauggggaccaugggccccugguaccuccugcugcuccuggggcacugcgugggccuguacgucgcgucccuccugggccagcccuggcugugccucgggcugggccuggccagccucgccuccuucaagauggacccgcugaucagcuggcaguccggguucgugaccggcaccuucgaccugcaggagguccucuuccacggcgggagcuccuucacggugcugcggugcaccagcuucgcccuggaguccugcgcccaccccgaccgccacuacagccucgcggaccugcugaaguacaacuucuaccuccccuucuucuucuucggccccaucaugaccuucgaccgguuccacgcccaggugucccagguggagccgguccgccgggagggggagcuguggcacauccgcgcccaggccggccugagcgugguggccaucauggcggucgacaucuucuuccacuucuucuacauccucaccauccccuccgaccugaaguucgccaaccggcugcccgacagcgcccucgccgggcuggccuacagcaaccugguguacgacugggugaaggcggccguccucuucggcguggugaacacggucgccugccuggaccaccuggacccgccccagccgcccaagugcaucaccgcccucuacguguucgcggagacccacuucgaccgcggcaucaacgacuggcugugcaaguacgucuacaaccacaucgggggcgagcacuccgccgugauccccgagcuggccgccaccguggccacguucgcgaucaccacccucuggcuggggcccugcgacaucgucuaccuguggagcuuccugaacugcuucggccucaacuucgagcuguggaugcagaagcuggccgagugggggccccucgcccggaucgaggccucccugagcgugcagaugucccgccgggugcgcgcccuguucggcgcgaugaacuucugggccaucaucauguacaaccucgucagccugaacucccugaaguucaccgagcucguggcccggcgccugcugcucacgggcuucccccagaccacccugagcauccuguucgugaccuacugcgggguccagcucgugaaggagcgggagcgcacgcuggcccuggaggaggagcagaagcaggacaaggagaagcccgaguga

SEQ ID NO: 31081 - RNA, 813 nt, Artificial Sequence
  derived and/or modified sequence opt1 from HHEX__Homo_sapiens__NP_002720
augcaguacccccacccgggccccgccgccggggcggugggcgucccccuguacgcccccaccccgcuccugcagcccgcccaccccacccccuucuacaucgaggacauccuggggcgcggcccggccgcccccacgcccgcgcccacccucccgagccccaacuccagcuucaccucccuggugagccccuaccggacccccguguacgagccgacgcccauccaccccgccuucucccaccacagcgccgccgcgcuggccgccgccuacgggcccggcggcuucgggggcccgcucuaccccuucccccgcaccgucaacgacuacacccacgcccugcugcggcacgacccccucgggaagccgcugcuguggucccccuuccuccagcgcccccugcacaagcggaagggcggccaggugcgcuucagcaacgaccagaccaucgagcuggagaagaaguucgagacgcagaaguaccucuccccgcccgagcggaagcgccuggcgaagaugcugcagcucagcgagcgccaggugaagaccugguuccagaaccggcgggccaaguggcgccggcugaagcaggagaacccccaguccaacaagaaggaggagcuggagagccucgacuccagcugcgaccagcgccaggaccugcccuccgagcagaacaagggggccagccuggacuccagccagugcuccccgagccccgccagccaggaggaccucgaguccgagaucagcgaggacuccgaccaggaggucgacaucgagggcgacaagagcuacuucaacgccggguga

SEQ ID NO: 31082 - RNA, 2103 nt, Artificial Sequence
  derived and/or modified sequence opt1 from HHIP__Homo_sapiens__NP_071920
augcugaagaugcucagcuucaagcugcugcuccuggccguggcccugggcuucuucgagggggacgcgaaguucggcgagcgcaacgagggguccggcgcccggcgccggcgcugccucaacgggaacccgcccaagcggcugaagcgccgggaccgccggaugaugagccagcuggagcuccuguccggcggcgagaugcugugcgggggcuucuacccccgccucagcugcugccugcgguccgacagccccgggcugggccgccucgagaacaagaucuucuccgucaccaacaacaccgagugcgggaagcugcuggaggagaucaagugcgcccucugcagcccccacucccagagccuguuccacuccccggagcgggaggugcuggagcgcgaccucgugcugccccugcucugcaaggacuacugcaaggaguucuucuacacgugccggggccacauccccggcuuccugcagaccaccgccgacgaguucugcuucuacuacgcccgcaaggacgggggccugugcuuccccgacuucccgcggaagcagguccgcgggcccgcgagcaacuaccucgaccagauggaggaguacgacaagguggaggagaucucccggaagcacaagcacaacugcuucugcauccaggagguggucagcggccugcgccagcccgugggcgcccugcacuccggggacggcagccagcggcuguucauccuggagaaggagggguacgugaagauccugacccccgagggcgagaucuucaaggagccguaccucgacauccacaagcugguccaguccgggaucaagggcggcgacgagcgcgggcugcucagccuggccuuccaccccaacuacaagaagaacggcaagcuguacguguccuacacgaccaaccaggagcgcugggccaucgggccccacgaccacauccuccggguggucgaguacaccgugagccgcaagaacccccaccagguggaccugcggaccgcgcgcgucuuccuggagguggccgagcuccaccggaagcaccugggcgggcagcuccucuucggcccggacggcuuccuguacaucauccugggggacggcaugaucacgcucgacgacauggaggagauggacgggcugagcgacuucaccggcuccgugcugcgccuggacgucgacaccgacaugugcaacgugcccuacagcaucccccgguccaacccccacuucaacagcaccaaccagccgcccgagguguucgcccacgggcuccacgaccccggccgcugcgccgucgaccggcaccccacggacaucaacaucaaccugaccauccugugcuccgacagcaacggcaagaaccgcuccagcgcccggauccuccagaucaucaaggggaaggacuacgaguccgagccgagccugcuggaguucaagcccuucuccaacggcccccucgucgggggcuucguguaccgcggcugccagagcgagcggcuguacggguccuacguguucggcgaccgcaacgggaacuuccugacccuccagcagagccccgugaccaagcaguggcaggagaagccgcugugccugggcacguccgggagcugccggggcuacuucuccggccacauccucggguucggcgaggacgagcugggggaggucuacauccugagcuccagcaagagcaugacccagacccacaacggcaagcucuacaagaucguggaccccaagcgcccccugaugccggaggagugccgggcgaccgugcagcccgcccagacgcugaccuccgagugcagccgccucugccggaacggguacugcacccccaccggcaagugcugcugcucccccggcugggagggggacuucugccgcacggccaagugcgagccggccugccgccacggcggggucugcgugcggcccaacaagugccugugcaagaagggcuaccuggggccccagugcgagcaggucgaccgcaacauccggcgcgugacccgggccggcauccucgaccagaucaucgacaugaccagcuaccugcuggaccucaccuccuacaucguguga

SEQ ID NO: 31083 - RNA, 2349 nt, Artificial Sequence
  derived and/or modified sequence opt1 from HHIPL1__Homo_sapiens__NP_001120730
auggcccgcgcccgggcgggcgcccugcucgcccugugggugcugggggccgccgcgcacccccagugccucgacuuccgcccgcccuuccggcccacccagccccugcgccugugcgcccaguacagcgacuucggcugcugcgacgaggggcgggacgccgagcucacccgccgguucugggcccuggcgucccgcgucgacgccgccgagugggccgccugcgcgggcuacgcccgggaccugcucugccaggagugcagcccguacgccgcccaccuguacgacgccgaggaccccuucacgccccugcgcaccgugcccgggcucugccaggacuacugccuggacauguggcacaagugccggggccuguuccgccaccucuccaccgaccaggagcugugggcgcuggagggcaaccucgcccgguucugccgcuaccugagccuggacgacaccgacuacugcuucccguaccuccuggugaacaagaaccugaacuccaaccucgggcacgucguggccgacgccaagggcugccugcagcugugccucgaggagguggccaacgggcugcggaaccccgucgcgauggugcacgcccgcgacggcacgcaccgguucuucguggccgagcaggucgggcuggugugggccuaccuccccgaccgcagccggcugggcaagcccuuccugaacaucucccgcgugguccucaccagcccgugggagggcgacgagcggggguuccugggcaucgccuuccaccccuccuuccagcacaaccgccgccuguacguguacuacagcguggggauccgguccagcgaguggauccgcaucuccgaguuccgggucagcgaggacgacgagaacgcgguggaccacuccagcgagcgcaucauccucgaggugaaggagcccgccuccaaccacaacggcggccagcugcuguucggggacgacggcuaccucuacaucuucaccggggacggcgggauggccggcgaccccuucggcaccuucgggaacgcccagaacaagagcgcgcugcugggcaagguccuccggaucgacguggaccgcaaggagcgggggcugccguacggcaucccgcccgacaaccccuucgugggggaccccgccgcccagcccgaggucuacgcccugggcgugcgcaacauguggcggugcuccuucgaccgcggcgaccccagcagcgggacgggccgggggcgccucuucugcggcgacguggggcagaacaaguucgaggaggucgacguggucgagcggggcggcaacuacggguggcgcgcccgggagggcuucgagugcuacgaccgcucccugugcgcgaacaccagccugaacgaccuccugcccaucuucgccuacccgcacaccguggggaaguccgugaccggcggcuacgucuaccgggggugcgaguaccccaaccugaacggccuguacaucuucggggacuucaugagcggccgccucaugucccugcaggagaaccccgggacgggccaguggcaguacagcgagaucugcaugggccacgggcagaccugcgaguuccccggccugaucaacaacuacuacccguacaucaucuccuucggggaggacgaggccggcgagcucuacuucaugagcaccggggagcccuccgccaccgcgccccggggcgugguguacaagaucaucgacgccagccgccgcgccccgcccggcaagugccagauccagcccgcccaggucaagauccggucccgccugauccccuucgugccgaaggagaaguucauccccaagacgcggagcacgccccgccccaccgcccgggccccgacccgcgcgccccggcgcgggcggcccaccgccgcgcccccggcccccacgccccgccccgcccggccgacccagcagcccggcucccgccgcgggggcgggcggcggcgcggccggcugaacagcgccucccgcgccuuccgggacggcgaggugcgccucguccggcccgccgggcugagcuccggcagcgggcgcguggagguguucgucggcgggcgcuggggcaccgugugcgacgacuccuggaacaucagcggcgccgcgguggucugccggcagcugggguucgccuacgccgugcgcgccgugaagcgggccgaguucggccagggcgggagccuccccauccugcuggacgacguccgcugcgcgggcugggagcggaaccuccuggagugccagcacaacggggugggcacccacaacugcgagcacgacgaggacgccgggguggucugcucccaccagaacccggaccuguga

SEQ ID NO: 31084 - RNA, 1596 nt, Artificial Sequence
  derived and/or modified sequence opt1 from HHLA1__Homo_sapiens__NP_001138567
augcugggcuuccucagccgcgggcccuccaugaagcugugcaugggccuggccugcgugcucagccuguggaacaccgucuccgggaucaagggcgaggccaagaaggagaaggggaugaccuuccugccgacgaccgugagcggccuccgggaggaggagcgcaaggagaagggcguggcguuccuggccaccaccgagcugcccgcccgguccaucgaccucagcgcccugaaccugacggagcucgucaacgggaugcugucccgcgcccugaaggacagcaagaaguucuucucccuccugagcgugaccuccuacagcuccuucgcguuccacaaguucagcguggccgucuacaacaucuccaaccugaagaccguggaccccgccaaguuccccacccgguacugcuacugccucaacaaccgcacgaacgaccugagcgacuucaccgcccugcucguggacaucaucggcaacuccaccagcuaccugaccgagaucuucaaguccacgagcauccugagcgucaaccaguccaacgagagcgacugcaucuucaucugcgugaugaccgggaaguccggccggaaccucagcgacuucugggagaucgaggagaaguacccgaucaucaacuacaccuucaccuccgggcugagcggcgugcugggcgcggccacgcgcgggaccgcccggaccuccaagcccaccaccaagagccagaagacgcuccccuccaccagccccggccacuggacccaguccacgccgugggccagcgcccugcgcuccagccccuggaccgagaccgcggcccccuccgagaccgaggagacgcugaacaccgggcggcccccggagcuccccgcccgcgccaccgccaccugguucagcgcgucccacacgcugcccgcccuggccacccggcgcgucgcccggacccaguggcucaccgccgaccgccagacgugggcgagcaucuccagcgugcccugggcccagaccaucagcgagaagaagccgggcggcucccugugggagacccggagcuccccgcccaccaccgccgggacggaggaggccaugaacaccaccagccugcucgcccccgcggccgagaucauggccacccccggcucccccagccaggccucccccacgcugggggcguucacccacggcacccagacccccagcccgacgaaggccaccgcgccccgcuacccccagaccggggaccuguccgccgaguggcccuucaccgccggcgaggagccggugcucgucccccggccccaccaggugagccgcugcccgcagccccuguucaaggugggcgccauggccgccgcgccccugacgcucgccauccagcggcugaaccccugccugauggagcucugccaguucuuccagcagugccugugcaugucccagcgcagcccgcgcaccgaggacaugcgguacugccuggaguacuacuccugguuccucaagaacgccaccuacaucugccagcgcgucaagcgggugagccacucccacacccugaagcagaagugccuggagaacaucugcaagagcguguga

SEQ ID NO: 31085 - RNA, 1194 nt, Artificial Sequence
  derived and/or modified sequence opt1 from HHLA2__Homo_sapiens__NP_001269487
augaaggcccagaccgcccugagcuucuuccucauccugaucaccucccugagcggcucccaggggaucuucccccucgcguucuucaucuacgugccgaugaacgagcagaucgucaucggccgccuggacgaggacaucauccugcccagcuccuucgagcgggggagcgagguggugauccacuggaaguaccaggacuccuacaagguccacagcuacuacaagggcuccgaccaccucgagagccaggacccccgcuacgccaaccggacgucccuguucuacaacgagauccagaacgggaacgccagccuguucuuccgccgggugucccuccuggacgagggcaucuacacgugcuacgugggcaccgccauccaggucaucaccaacaagguggugcugaaggucgggguguuccucacccccgugaugaaguacgagaagcgcaacaccaacagcuuccugaucugcuccguccugagcguguacccgcggcccaucaucaccuggaagauggacaacacccccaucuccgagaacaacauggaggagacgggcagccucgacuccuucagcaucaacagcccccugaacaucaccggguccaacagcuccuacgagugcaccaucgagaacagccugcucaagcagaccuggacgggccgcuggaccaugaaggacgggcugcacaagaugcaguccgagcacgugagccuguccugccagccggucaacgacuacuucagccccaaccaggacuucaaggugaccuggucccggaugaaguccggcaccuucagcgugcucgccuacuaccugagcuccagccagaacacgaucaucaacgagucccgcuucagcuggaacaaggagcugaucaaccaguccgacuucagcaugaaccucauggaccugaaccuguccgacagcggcgaguaccucugcaacaucagcuccgacgaguacacccugcugaccauccacaccguccacguggagcccagccaggagacggcgucccacaacaaggggcucuggauccuggugcccagcgccauccuggccgccuuccuccugaucugguccgucaagugcugccgggagcgcugcugcgugccgcccggcgagcggugccccagcgcgcccgacaacggggaggagaacgugccgcuguccggcaaggucuga

SEQ ID NO: 31086 - RNA, 1359 nt, Artificial Sequence
  derived and/or modified sequence opt1 from HIAT1__Homo_sapiens__XP_011540259
augacccagggcaagaagaagaagcgcgccgccaaccggagcaucaugcuggcgaagaagaucaucaucaaggacgggggcacgccccaggggaucggcuccccgagcguguaccacgccgucaucgugaucuuccucgaguucuucgccugggggcugcugaccgcccccacccucgugguccugcacgagaccuuccccaagcacaccuuccugaugaacggccucauccagggcgugaaggggcugcuguccuuccucagcgcgccccugaucggcgcccuguccgacgugugggggcgcaagagcuuccuccugcugacggucuucuucacgugcgccccgaucccccucaugaagaucucccccuggugguacuucgccgugaucagcguguccggcgucuucgccgugaccuucagcguggucuucgcguacguggccgacaucacccaggagcacgagcgguccauggccuacgggcuggugagcgccaccuucgccgcgucccuggucaccagccccgccaucggcgccuaccucggccgcguguacggggacucccugguggucgugcuggccaccgccaucgcgcuccuggacaucugcuucauccugguggccgucccggagagccuccccgagaagaugcggcccgccuccuggggcgcccccaucagcugggagcaggccgacccguucgcgaucaugaaguucucccccgagagcguggccgccuucaucgccgugcuggggauccugagcaucaucgcccagaccaucguccucucccugcugaugcgcagcaucggcaacaagaacacgauccuccugggccugggguuccagauccuccagcuggcgugguacggcuucggguccgagcccuggaugaugugggccgccggcgccguggcggccaugagcuccaucaccuuccccgccgucagcgcccuggugucccggaccgccgacgcggaccagcagggggugguccagggcaugaucaccggcauccgcgggcucugcaacggccuggggccggcccuguacggcuucaucuucuacaucuuccacguggagcucaaggagcugcccaucacggggaccgaccugggcaccaacaccagcccccagcaccacuucgagcagaacuccaucauccccggcccgcccuuccucuucggggccugcagcgugcugcuggcccuccuggucgcccuguucauccccgagcacacgaaccucucccugcggagcuccagcuggcgcaagcacugcggcucccacagccacccccacaacacccaggcgccgggggaggccaaggagccccugcugcaggacaccaacguguga

SEQ ID NO: 31087 - RNA, 1011 nt, Artificial Sequence
  derived and/or modified sequence opt1 from HIBADH__Homo_sapiens__NP_689953
auggccgccagccugcgccuccugggcgcggccuccgggcugcgguacuggagccgccggcuccgccccgccgccggcuccuucgccgcggugugcagccgguccgucgccagcaagaccccggugggguucaucggccuggggaacaugggcaaccccauggccaagaaccugaugaagcacggcuacccccucaucaucuacgacguguuccccgacgccugcaaggaguuccaggacgcgggggagcaggucguguccagcccggccgacguggccgagaaggccgaccgcaucaucaccaugcugcccacguccaucaacgccaucgaggcguacagcggcgccaacgggauccugaagaaggucaagaagggcucccuccugaucgacagcuccaccaucgaccccgccgugagcaaggagcuggccaaggagguggagaagaugggggccgucuucauggacgcgcccguguccggcggcgugggggccgcccggagcggcaaccucaccuucauggucgggggcguggaggacgaguucgccgccgcgcaggagcugcugggcugcaugggguccaacguggucuacugcggcgccguggggaccggccaggccgccaagaucugcaacaacaugcuccuggccaucagcaugaucgggacggcggaggccaugaaccugggcauccgccucggccuggacccgaagcugcucgccaagauccugaacauguccagcgggcggugcuggagcuccgacaccuacaaccccgugcccggcgucauggacggggugcccagcgccaacaacuaccagggcggguucggcaccacccugauggcgaaggaccucggccuggcccaggacuccgccacgagcaccaaguccccgauccugcucgggagccuggcccaccagaucuaccgcaugaugugcgccaagggcuacuccaagaaggacuucagcuccguguuccaguuccugcgggaggaggagaccuucuga

SEQ ID NO: 31088 - RNA, 1161 nt, Artificial Sequence
  derived and/or modified sequence opt1 from HIBCH__Homo_sapiens__NP_055177
augggccagcgcgagauguggcggcugaugagccgcuucaacgccuucaagcggaccaacaccauccuccaccaccuccgcauguccaagcacacggacgccgcggaggaggugcugcuggagaagaaggggugcaccggcgucaucacccugaaccggcccaaguuccugaacgcccucacccugaacaugauccgccagaucuacccgcagcugaagaagugggagcaggaccccgagacguuccucaucaucaucaagggggccggcgggaaggccuucugcgccggcggcgacauccgggugaucagcgaggcggagaaggccaagcagaagaucgcccccguguucuuccgcgaggaguacaugcugaacaacgccgucggguccugccagaagcccuacguggcgcugauccacggcaucaccaugggcggcgggguggggcucagcguccacggccaguuccggguggccaccgagaagugccuguucgccaugccggagaccgccaucgggcuguuccccgacgugggcgggggcuacuuccucccccgccugcagggcaagcugggguacuuccucgcccugacgggcuuccggcugaaggggcgcgacgucuaccgggcgggcaucgccacccacuucguggacuccgagaagcucgccaugcuggaggaggaccugcucgcccucaagagccccuccaaggagaacaucgccagcgugcuggagaacuaccacaccgaguccaagaucgaccgcgacaagagcuucauccuggaggagcacauggacaagaucaacuccugcuucagcgcgaacaccgucgaggagaucaucgagaaccugcagcaggacggguccagcuucgcccuggagcagcucaaggugaucaacaagauguccccgacgagccugaagaucacccugcggcagcucauggagggcuccagcaagacccugcaggaggugcugaccauggaguaccgccucucccaggccugcaugcggggccacgacuuccacgaggggguccgcgccgugcugaucgacaaggaccagagccccaaguggaagcccgccgaccugaaggaggugacggaggaggaccucaacaaccacuucaagagccugggcuccagcgaccugaaguucuga

SEQ ID NO: 31089 - RNA, 2202 nt, Artificial Sequence
  derived and/or modified sequence opt1 from HIC1__Homo_sapiens__NP_001091672
augaccuuccccgaggccgacauccugcucaagagcggcgagugcgccgggcagaccaugcuggacacgauggaggcgccgggccacucccgccagcugcuccugcagcugaacaaccagcggaccaagggguuccucugcgacgugaucaucgucgugcagaacgcccuguuccgcgcccacaagaacgugcuggccgccagcuccgcguaccucaagagccuggucgugcacgacaaccugcucaaccuggaccacgacauggugucccccgccgucuuccggcuggugcucgacuucaucuacaccggccgccuggccgacggggccgaggcggccgccgccgccgcgguggcccccggcgccgagcccagccugggcgccguccucgccgcggccuccuaccugcagaucccggaccugguggcccucugcaagaagcggcugaagcgccacgggaaguacugccaccuccggggcgggggcgggggcggcgggggcuacgcccccuacgggcgccccggccggggccuccgcgccgcgacccccgugauccaggccugcuacccgagccccgucgggcccccgcccccgcccgccgccgagcccccguccggccccgaggccgcggugaacacgcacugcgccgagcuguacgccagcgggcccggccccgccgcggcccugugcgccuccgagcggcgcugcagcccgcucugcgggcuggaccuguccaagaaguccccgcccggcagcgccgcccccgagcggccccuggcggagcgcgagcugccgccccggcccgacagcccgcccuccgccggccccgccgccuacaaggagccgccccuggcccuccccagccugccgccccugcccuuccagaagcucgaggaggcggccccgcccuccgaccccuuccgcgggggcagcgggagccccggccccgagccgcccgggcggcccgacggccccucccugcuguaccgcuggaugaagcacgagcccggccucgggagcuacggcgacgagcuggggcgggagcgcggcucccccagcgagcggugcgaggagcgcgggggcgacgccgccgugucccccggcgggccgccccugggccucgcgcccccgccccgcuaccccgggagccuggacggccccggcgccgggggcgacggggacgacuacaaguccagcuccgaggagaccggcagcuccgaggaccccagcccgcccgggggccaccuggagggcuaccccugcccccaccucgccuacggggagcccgaguccuucggcgacaaccuguacgucugcauccccugcgggaagggcuuccccagcuccgagcagcugaacgcccacguggaggcccacguggaggaggaggaggcgcucuacgggcgggccgaggccgccgaggucgccgcgggcgccgccggccuggggccgcccuucggcgggggcggggacaagguggccggcgcccccggcgggcugggcgagcugcuccgccccuaccggugcgcgagcugcgacaaguccuacaaggaccccgccacccugcgccagcacgagaagacccacuggcugacgcggcccuacccgugcaccaucugcgggaagaaguucacccagcgcggcaccaugacgcggcacaugcgcagccaccucgggcugaagcccuucgccugcgacgccugcggcaugcgguucacccgccaguaccggcugaccgagcacaugcgcauccacuccggcgagaagcccuacgagugccaggugugcgggggcaaguucgcccagcagcggaaccucaucagccacaugaagaugcacgcggucgggggcgccgccggcgccgcgggggcccuggccggccucgggggccugcccggggugccgggccccgacggcaaggggaagcuggacuuccccgagggcguguucgccgucgcccgccugaccgcggagcagcucagccugaagcagcaggacaaggccgccgccgccgagcugcucgcgcagacgacccacuuccugcacgaccccaagguggcccuggagucccucuacccgcuggccaaguucaccgccgagcuggggcucagccccgacaaggccgcggagguccugucccagggcgcccaccuggccgccgggcccgacggccggaccaucgaccgcuucagccccacguga

SEQ ID NO: 31090 - RNA, 1848 nt, Artificial Sequence
  derived and/or modified sequence opt1 from HIC2__Homo_sapiens__NP_055909
auggugagcggcccccuggcccugcgcuggugcgccugggcggggcggggcgacauggggccggacauggagcugcccucccacagcaagcagcugcuccugcagcugaaccagcagcgcaccaagggcuuccucugcgacgucaucaucaugguggagaacuccaucuuccgggcccacaagaacgugcuggccgccagcuccaucuacuucaagagccugguccuccacgacaaccugaucaaccuggacaccgacaugguguccagcacgguguuccagcagauccucgacuucaucuacaccgggaagcugcugcccuccgaccagcccgccgagccgaacuucagcacccuccugaccgcggccuccuaccugcagcuccccgagcuggccgcccugugccgccggaagcucaagcgcgcgggcaagcccuucggcagcgggcgggccggcuccacggggaugggccggcccccgcgcagccagcgccuguccaccgccagcgucauccaggcccgguaccaggggcugguggacggccgcaagggcgcccacgcgccccaggagcucccccaggccaagggguccgacgacgagcuguuccugggcgggagcaaccaggacuccgugcagggccucggccgggccgucugccccgccgggggcgaggccgggcugggcgggugcagcagcuccaccaacggcagcuccggcgggugcgagcaggagcugggccucgaccugagcaagaaguccccgccccugccgcccgcgacccccgggccccaccucacgcccgacgacgccgcccagcugagcgacucccagcacggcagcccgcccgccgccuccgcgccgcccguggccaacagcgccuccuacagcgagcucgggggcacccccgacgagcccauggaccuggagggcgccgaggacaaccaccugucccugcucgaggcccccgggggccagccccgcaagagccugcggcacuccacccgcaagaaggagugggggaagaaggagcccguggcgggcagcccguucgagcggcgcgaggccgggcccaagggccccugcccgggcgaggagggggagggcgucggggaccgggugcccaacggcauccuggccuccggcgccgggcccagcggccccuacggggagccgcccuaccccugcaaggaggaggaggagaacggcaaggacgcguccgaggacagcgcccagagcggguccgagggcggcagcgggcacgccuccgcccacuacauguaccgccaggagggcuacgagaccgugagcuacggggacaaccucuacgucugcauccccugcgccaagggcuucccguccagcgagcagcugaacgcgcacguggagacgcacaccgaggaggagcuguucaucaaggaggagggggccuacgagaccggcuccggcggggccgaggaggaggccgaggaccucagcgcccccuccgcggccuacaccgccgagccccggcccuucaagugcagcgugugcgagaagacguacaaggacccggccacccugcgccagcacgagaagacccacuggcugacccgccccuuccccugcaacaucugcggcaagauguucacgcagcgggggaccaugacccgccacaugcggucccaccucggccugaagcccuucgccugcgacgagugcgggaugcgcuucacccggcaguaccgccugacggagcacaugcggguccacagcggcgagaagccguacgagugccagcugugcggcgggaaguucacccagcagcgcaaccucaucucccaccuccggaugcacaccagccccuccuga

SEQ ID NO: 31091 - RNA, 2367 nt, Artificial Sequence
  derived and/or modified sequence opt1 from HID1__Homo_sapiens__NP_085133
auggggagcaccgacuccaagcugaacuuccgcaaggccgugauccagcucaccacgaagacccagcccgucgaggccaccgacgacgcguucugggaccaguucugggccgacaccgccacgagcgugcaggacguguucgcccuggucccggccgcggagauccgggccgugcgcgaggagucccccagcaaccuggccacccucugcuacaaggccguggagaagcugguccagggggcggaguccggcugccacagcgagaaggagaagcagaucgugcugaacugcucccggcuccugacccgcgugcugcccuacaucuucgaggaccccgacuggcggggguucuucuggagcaccgucccgggcgccgggcgcggcggccagggggaggaggacgacgagcacgcccggccccucgccgagucccugcugcucgccaucgcggaccugcuguucugccccgacuucacggugcagagccaccgccgguccaccguggacagcgccgaggacguccacucccucgacagcugcgaguacaucugggaggccggcgugggguucgcccacagcccccagccgaacuacauccacgacaugaaccgcauggagcugcugaagcuccugcugaccugcuucagcgaggccauguaccucccgcccgcgcccgaguccggcagcaccaaccccugggugcaguucuucugcuccacggagaaccggcacgcccugccccuguucaccagccuccugaacaccgucugcgccuacgaccccgugggguacggcauccccuacaaccaccuccuguucagcgacuaccgcgagccgcugguggaggaggccgcccagguccugaucgugacccucgaccacgacuccgcgagcuccgccagccccacgguggacggcaccaccaccgggacggccauggacgacgccgacccgcccggccccgagaaccuguucgucaacuaccugucccggauccaccgcgaggaggacuuccaguucauccucaaggggaucgcccggcugcugagcaacccccuccugcagaccuaccugcccaacuccaccaagaagauccaguuccaccaggagcuccuggugcuguucuggaagcucugcgacuucaacaagaaguuccuguucuucgugcugaaguccuccgacguccucgacauccuggugcccauccuguucuuccucaacgacgcgcgcgccgaccagagccgggucggccugaugcacaucggcguguucauccugcugcuccuguccggggagcgcaacuucggcgugcggcugaacaagccguacagcauccgcguccccauggacauccccguguucaccgggacgcacgccgaccuccugaucguggucuuccacaagaucaucaccuccggccaccagcggcugcagccccucuucgacugccugcugaccaucguggugaacgucagcccguaccucaagucccugagcauggugaccgccaacaagcugcuccaccuccuggaggcguucuccacgaccugguuccuguucagcgccgcccagaaccaccaccugguguucuuccugcucgaggucuucaacaacaucauccaguaccaguucgacgggaacuccaaccugguguacgccaucauccgcaagcgcagcaucuuccaccagcuggccaaccuccccaccgacccgcccaccauccacaaggcgcugcagcggcgccggcgcacgcccgagccccugagccggaccggcucccaggagggcaccagcauggaggggucccgccccgccgccccggccgagcccggcacccucaagacgagccugguggccacccccgggaucgacaagcugaccgagaagucccaggucagcgaggacggcacccuccggucccuggagcccgagccgcagcagagccuggaggacgggucccccgcgaagggcgagcccagccaggccuggcgcgagcagcggcgccccuccaccagcuccgccagcggccagugguccccgacgcccgagugggugcucagcuggaaguccaagcugccccugcagaccaucaugcggcuccuccaggugcuggucccccagguggagaagaucugcaucgacaaggggcugaccgacgagagcgagauccugcgcuuccugcagcacggcacccucguggggcugcugccggucccccaccccauccucauccggaaguaccaggccaacagcggcacggccaugugguuccgcaccuacauguggggcgugaucuaccugcggaacguggacccgcccgucugguacgacaccgacgugaagcuguucgagauccagcgcguguga

SEQ ID NO: 31092 - RNA, 2553 nt, Artificial Sequence
  derived and/or modified sequence opt1 from HIF1A__Homo_sapiens__NP_001230013
augagcucccagugccgcagccuggagaacaaguucguguuccucaaggagggccuggggaacuccaagcccgaggagcuggaggagauccggaucgagaacggccgcaucagcuccgagcggcgcaaggagaagucccgggacgccgcccgcucccggcgcagcaaggaguccgaggucuucuacgagcucgcgcaccagcugccgcugccccacaacgugagcucccaccucgacaaggccagcgugaugcggcugaccaucuccuaccugcgcguccggaagcuccuggacgccggggaccuggacaucgaggacgacaugaaggcccagaugaacugcuucuaccucaaggcccuggacggcuucgugauggugcugaccgacgacggggacaugaucuacaucagcgacaacgucaacaaguacaugggccucacgcaguucgagcugaccggccacuccguguucgacuucacccaccccugcgaccacgaggagaugcgcgagaugcugacccaccggaacgggcucgugaagaagggcaaggagcagaacacgcagcgcagcuucuuccugcggaugaagugcacccugaccucccgcgggcggaccaugaacaucaagagcgcgacguggaagguccuccacugcaccggccacauccacguguacgacaccaacuccaaccagccccagugcggguacaagaagccgcccaugaccugccuggugcugaucugcgagcccaucccccacccgagcaacaucgagaucccccucgacagcaagacguuccugucccgccacagccuggacaugaaguucuccuacugcgacgagcggaucaccgagcucaugggcuacgagcccgaggagcugcugggccgcagcaucuacgaguacuaccacgcccucgacuccgaccaccugaccaagacccaccacgacauguucacgaaggggcaggucaccaccggccaguaccggaugcuggccaagcgcgggggcuacguguggguggagacccaggccacggucaucuacaacaccaagaacagccagccccagugcaucgugugcgugaacuacgucguguccggcaucauccagcacgaccucaucuucagccugcagcagaccgagugcgugcugaagccggucgaguccagcgacaugaagaugacccagcuguucacgaagguggaguccgaggacaccagcucccucuucgacaagcugaagaaggagcccgacgcgcucacccugcuggcccccgccgccggggacaccaucaucagccucgacuucggcuccaacgacacggagaccgacgaccagcagcuggaggaggugccccuguacaacgacgucaugcucccgagccccaacgagaagcugcagaacaucaaccuggccaugagcccccuccccaccgcggagaccccgaagccccugcgcagcuccgccgaccccgcccugaaccaggagguggcccugaagcucgagcccaacccggagagccuggagcugagcuucacgaugccccagauccaggaccagacccccucccccagcgacggguccacccggcagagcuccccggagcccaacagccccuccgaguacugcuucuacgucgacagcgacauggugaacgaguucaagcucgagcugguggagaagcuguucgccgaggacaccgaggcgaagaacccguucuccacgcaggacaccgaccucgaccuggagaugcuggcccccuacauccccauggacgacgacuuccagcuccgcagcuucgaccagcugagcccccuggaguccuccagcgccuccccggagagcgccagcccccaguccaccgucaccguguuccagcagacccagauccaggagcccacggccaacgcgaccaccaccacggccaccaccgacgagcucaagaccgugacgaaggaccggauggaggacaucaagauccugaucgccagccccuccccgacccacauccacaaggagaccaccagcgccacguccagccccuaccgcgacacccagucccggaccgccagccccaaccgcgcgggcaagggggucaucgagcagaccgagaagucccacccccggagcccgaacgugcuguccguggcccucagccagcgcacgaccguccccgaggaggagcugaaccccaagauccuggcccuccagaacgcccagcggaagcgcaagauggagcacgacggcucccuguuccaggcggugggcaucgggacccugcuccagcagcccgacgaccacgccgccaccacgagccuguccuggaagcgggugaagggcugcaagagcuccgagcagaacgggauggagcagaagaccaucauccugaucccgagcgaccucgccugccgccugcugggccaguccauggacgagagcgggcucccccagcugaccuccuacgacugcgaggucaacgcccccauccagggcagccggaaccugcuccagggcgaggagcugcugcgcgcgcucgaccaggugaacuga

SEQ ID NO: 31093 - RNA, 1050 nt, Artificial Sequence
  derived and/or modified sequence opt1 from HIF1AN__Homo_sapiens__NP_060372
auggccgccaccgcggccgaggccguggccagcggcuccggggagccccgcgaggaggccggcgcgcuggggccggccugggacgagagccagcuccgguccuacagcuuccccacccgccccaucccccggcugucccagagcgacccgcgcgccgaggagcugaucgagaacgaggagcccgucgugcucacggacaccaaccugguguaccccgcccugaagugggaccucgaguaccugcaggagaacaucggcaacggggacuucuccgucuacagcgcguccacccacaaguuccuguacuacgacgagaagaagauggccaacuuccagaacuucaagccccggagcaaccgcgaggagaugaaguuccacgaguucguggagaagcuccaggacauccagcagcggggcggcgaggagcgccuguaccugcagcagacccucaacgacacgguggggcggaagaucgucauggacuuccugggcuucaacuggaacuggaucaacaagcagcaggggaagcgcggcugggggcagcugaccuccaaccuccugcugaucggcauggagggcaacgugaccccggcccacuacgacgagcagcagaacuucuucgcccagaucaagggguacaagcggugcauccucuucccgcccgaccaguucgagugccuguaccccuaccccgugcaccaccccugcgaccgccagagccaggucgacuucgacaaccccgacuacgagcgguuccccaacuuccagaacguggugggcuacgagaccgucguggggccgggcgacgugcuguacauccccauguacugguggcaccacaucgagucccuccugaacggcgggaucacgaucaccgucaacuucugguacaagggcgcccccacccccaagcgcaucgaguacccgcugaaggcgcaccagaagguggccaucaugcggaacaucgagaagaugcucggggaggcccugggcaacccccaggagguggggccccugcucaacaccaugaucaagggccgcuacaacuga

SEQ ID NO: 31094 - RNA, 2004 nt, Artificial Sequence
  derived and/or modified sequence opt1 from HIF3A__Homo_sapiens__NP_690007
auggacuggcaggaccaccgcagcaccaccgagcugcggaaggagaagucccgcgacgccgcccggagccgccggucccaggagacggaggugcucuaccagcuggcgcacacccugcccuucgcccgcggcgucagcgcccaccucgacaaggccuccaucaugcggcugaccaucagcuaccugcgcaugcaccggcucugcgccgcgggggaguggaaccaggugggcgccgggggcgagccgcuggacgccugcuaccugaaggcccucgagggguucgugaugguccugaccgcggagggcgacauggccuaccuguccgagaacgugagcaagcaccucggccugucccagcuggagcucaucgggcacagcaucuucgacuucauccaccccugcgaccaggaggagcugcaggacgcccugacgccccagcagacccucucccgccggaagguggaggcccccaccgagcgcugcuucagccugcggaugaaguccacccugacgagccgcggccggacccucaaccugaaggccgcgaccuggaagguccugaacugcuccgggcacaugcgcgccuacaagccgcccgcccagaccagccccgccggcucccccgacagcgagccgccccuccagugccuggugcugaucugcgaggccaucccccaccccgggucccucgagccgccccugggccggggcgcguuccugagccgccacagccucgacaugaaguucacguacugcgacgaccggaucgccgagguggccggguacucccccgacgaccugaucggcugcagcgccuacgaguacauccacgcccuggacuccgacgcggucagcaaguccauccacacccuccugagcaaggggcaggccgugaccggccaguaccgcuuccuggcccgguccggcggguaccucuggacccagacgcaggccaccguggucagcggcgggcgcggcccccaguccgagagcaucgugugcgugcacuuccugaucucccaggucgaggagaccgggguggugcugagccucgagcagaccgagcagcacucccgccggccgauccagcgcggcgcccccagccagaaggacacgcccaaccccggcgacucccuggacaccccggggccccggauccuggcguuccuccacccgcccagccuguccgaggccgcccuggccgcggacccccgccgguucugcagccccgaccuccgccggcugcugggccccauccucgacggggccuccgucgccgccacccccagcaccccgcuggccacgcgccacccccagagcccccuguccgcggaccugccggacgagcuccccgugggcaccgagaacgugcaccggcuguucaccagcgggaaggacaccgaggccgucgagacggaccuggacaucgcccaggacgccgacgcccucgaccuggagaugcuggcgcccuacaucuccauggacgacgacuuccagcucaacgccagcgagcagcugccccgcgccuaccaccggccgcugggcgccgugccccgcccccgggcccgcuccuuccacggccucagcccgcccgcgcuggagcccucccugcucccccggugggggagcgacccccgccuguccugcagcuccccgagccggggcgaccccuccgccagcucccccauggccggggcccgcaagcggacccuggcgcagagcuccgaggacgaggacgagggcguggagcuccuggggguccggcccccgaagcgcagccccagccccgagcacgagaacuuccuccuguucccccugucccugagcuuccuccugaccggcggcccggcccccgggucccugcaggaccccagcacgccccuccugaaccugaacgagccgcucggccuggggcccucccugcucagccccuacuccgacgaggacaccacccagccgggcggccccuuccagccccgcgccgggagcgcccaggccgacuga

SEQ ID NO: 31095 - RNA, 324 nt, Artificial Sequence
  derived and/or modified sequence opt1 from HIGD1A__Homo_sapiens__NP_001093138
auggagcagaagcugguggaggagauccugcaggccaucaccaugagcaccgacacgggcgucucccugcccagcuacgaggaggaccagggguccaagcugauccgcaaggccaaggaggcgccguucgugcccgugggcaucgccggguucgccgccaucgucgccuacggccucuacaagcucaagagccgggggaacaccaagauguccauccaccugauccacaugcgcguggcggcccagggcuucguggucggcgccaugaccguggggaugggcuacagcauguaccgggaguucugggccaagcccaagcccuga

SEQ ID NO: 31096 - RNA, 294 nt, Artificial Sequence
  derived and/or modified sequence opt1 from HIGD1C__Homo_sapiens__NP_001103089
augagcuccgacaaccaguggagcgccgacgaggacgagggccagcugucccgccucauccgcaagagccgggacucccccuucgugccgaucgggaucgccggcuucgucaccguggugagcugcgggcuguacaagcugaaguaccggcgcgaccagaagauguccauccaccucauccacaugcgggucgcggcccagggcuucguggugggggccgucacccugggcgugcuguacagcauguacaaggacuacauccgcccccgguucuucuccgagagcaagaaguga

SEQ ID NO: 31097 - RNA, 321 nt, Artificial Sequence
  derived and/or modified sequence opt1 from HIGD2A__Homo_sapiens__NP_620175
auggccacccccggcccggugauccccgagguccccuucgagcccagcaagccgcccgugaucgaggggcugagccccaccguguaccgcaaccccgagagcuucaaggagaaguucguccggaagacgcgcgagaacccgguggugcccaucggcugccucgccaccgcggccgcccugaccuacgggcuguacuccuuccaccggggcaacagccagcgcucccagcucaugaugcggacccgcaucgccgcccagggguucacggucgcggccauccugcugggccucgccgugaccgccaugaagucccggcccuga

SEQ ID NO: 31098 - RNA, 192 nt, Artificial Sequence
  derived and/or modified sequence opt1 from HILPDA__Homo_sapiens__NP_001092256
augaagcacgugcugaaccucuaccugcugggcgucgugcucacccugcugagcaucuucgugcgcgucauggagucccucgaggggcugcuggagagccccuccccgggcaccagcuggacgacccggucccagcucgccaacaccgagcccaccaaggggcugcccgaccaccccagccgcuccauguga

SEQ ID NO: 31099 - RNA, 1260 nt, Artificial Sequence
  derived and/or modified sequence opt1 from HINFP__Homo_sapiens__NP_001230188
augcccccgcccggcaaggugccccgcaaggagaaccuguggcuccagugcgagugggggagcugcuccuucgucugcagcaccauggagaaguucuucgagcacgugacccagcaccuccagcagcaccuccacggcuccggggaggaggaggaggaggaggaggaggacgacccccuggaggaggaguucagcugccuguggcaggagugcggcuucugcucccuggacagcuccgccgaccugauccggcacguguacuuccacugcuaccacacgaagcugaagcagugggggcugcaggcccuccagagccaggcggaccugggcccgugcauccuggacuuccagucccgcaacgucauccccgacauccccgaccacuuccucugccugugggagcacugcgagaacagcuucgacaaccccgagugguucuaccggcacguggaggcccacucccugugcugcgaguacgaggccgugggcaaggacaacccggucgugcucugcggguggaagggcugcacgugcaccuucaaggaccgcagcaagcugcgggagcaccuccgcucccacacccaggagaagguggucgccugcccgaccugcgggggcauguucgccaacaacaccaaguuccuggaccacauccggcgccagaccagccuggaccagcagcacuuccagugcucccacugcagcaagcgguucgcgaccgagcgccugcuccgggaccacaugcgcaaccacgugaaccacuacaagugcccccugugcgacaugacgugcccccugcccuccagccuccggaaccacaugcgcuuccggcacuccgaggaccgccccuucaagugcgacugcugcgacuacagcugcaagaaccugaucgaccugcagaagcaccucgacacccacagcgaggagcccgccuaccggugcgacuucgagaacugcaccuucuccgcccgcagccugugcuccaucaagagccacuaccggaaggugcacgagggggacuccgagccccgcuacaagugccacgucugcgacaagugcuucacccggggcaacaaccugacggugcaccuccgcaagaagcaccaguucaaguggccgagcggccacccccgcuuccggcuggggcacuucugcaucccccugcccggcuucgccgcgcucuacgccccgaccucccccgggacccgcaacaugaagauggccaucugcggcugcagcugguucgccacccggguguga

SEQ ID NO: 31100 - RNA, 381 nt, Artificial Sequence
  derived and/or modified sequence opt1 from HINT1__Homo_sapiens__NP_005331
auggccgacgagaucgccaaggcccagguggcgcgccccggcggggacaccaucuucggcaagaucauccggaaggagaucccggccaagaucaucuucgaggacgaccgcugccuggccuuccacgacaucagcccccaggcccccacccacuuccuggucauccccaagaagcacaucucccagaucagcguggcggaggacgacgacgagucccugcuggggcaccucaugaucgugggcaagaagugcgccgccgaccuggggcugaacaagggcuaccggauggucgugaacgagggcagcgacgggggccaguccguguaccacguccaccuccacgugcucgggggccgccagaugcacuggccgcccggguga

SEQ ID NO: 31101 - RNA, 492 nt, Artificial Sequence
  derived and/or modified sequence opt1 from HINT2__Homo_sapiens__NP_115982
auggccgccgcggugguccuggccgccggccugcgcgccgcccggcgcgcgguggccgccaccggggugcggggcgggcagguccgcggcgccgcgggggugaccgacggcaacgagguggccaaggcccagcaggccacgcccggcggggccgcgccgaccaucuucagccggauccuggacaagucccugcccgccgacauccucuacgaggaccagcagugccuggucuuccgcgacguggcgccccaggcccccgugcacuuccuggucaucccgaagaagcccaucccccggaucagccaggccgaggaggaggaccagcagcuccugggccaccuccugcugguggccaagcagaccgccaaggccgaggggcugggcgacggguaccgccucgugaucaacgacggcaagcugggcgcccaguccgucuaccaccuccacauccacgugcucgggggccggcagcugcaguggcccccgggguga

SEQ ID NO: 31102 - RNA, 2961 nt, Artificial Sequence
  derived and/or modified sequence opt1 from HIP1__Homo_sapiens__NP_001230127
auggaccgcauggccagcuccaugaagcagguccccaacccccugcccaaggugcucagccggcgcggcgugggggccggccuggaggcggccgagcgggaguccuucgagcgcacccagaccgugagcaucaacaaggccaucaacacgcaggaggucgccgugaaggagaagcacgcccggaccugcauccuggggacccaccacgagaagggcgcgcagaccuucugguccguggucaaccgccucccccugagcuccaacgccgugcugugcuggaaguucugccacguguuccacaagcuccugcgggacgggcaccccaacguccugaaggacagccuccgcuaccggaacgagcuguccgacaugagccgcauguggggccaccuguccgagggcuacgggcagcucugcagcaucuaccugaagcugcuccggacgaagauggaguaccacaccaagaacccgcgcuuccccggcaaccugcagauguccgaccggcagcuggacgaggccggggagagcgacgugaacaacuucuuccagcucaccguggagauguucgacuaccuggagugcgagcugaaccucuuccagaccgucuucaacucccuggacaugagccgcuccgugagcgugacggccgcgggccagugccggcuggcgccccucauccaggucauccuggacugcucccaccuguacgacuacaccgugaagcuccuguucaagcugcacagcugccuccccgccgacacccugcaggggcaccgcgaccgguucauggagcaguucaccaagcugaaggaccucuucuaccgcagcuccaaccugcaguacuucaagcggcugauccagaucccgcagcuccccgagaacccgcccaacuuccugcgcgccagcgcccuguccgagcacaucagccccguggucgugauccccgcggaggccuccagccccgacuccgagcccgugcucgagaaggacgaccugauggacauggacgccagccagcagaaccuguucgacaacaaguucgacgacaucuucggcuccagcuucuccagcgacccguucaacuucaacucccagaacggcgucaacaaggacgagaaggaccaccucaucgagcggcuguaccgcgagaucagcgggcugaaggcccagcucgagaacaugaagacggagucccagcgcguggugcugcagcugaagggccacgucagcgagcucgaggccgaccuggcggagcagcagcaccuccggcagcaggccgccgacgacugcgaguuccugcgcgccgagcuggacgagcugcggcgccagcgggaggacaccgagaaggcccagcgcucccugagcgagaucgagcggaaggcgcaggccaacgagcagcgcuacuccaagcucaaggagaaguacagcgagcuggugcagaaccacgccgaccugcuccggaagaacgccgaggucaccaagcaggucagcauggcccgccaggcccagguggaccuggagcgggagaagaaggagcuggaggacucccucgagcgcaucagcgaccaggggcagcggaagacccaggagcagcuggaggugcuggagucccucaagcaggagcuggccacgagccagcgcgagcuccaggugcugcagggcucccuggagaccagcgcccaguccgaggccaacugggcggccgaguucgccgagcuggagaaggagcgggacagccucguguccggcgccgcccaccgcgaggaggagcugagcgcgcugcggaaggagcuccaggacacccagcugaagcuggccuccaccgaggagagcaugugccagcucgccaaggaccagcgcaagaugcugcuggucgggucccggaaggccgccgagcaggucauccaggacgcgcucaaccagcuggaggagccgccccugaucagcugcgccggcuccgccgaccaccuccugagcacggugaccuccaucagcagcugcaucgagcagcuggagaaguccuggagccaguaccucgccugccccgaggacaucuccgggcugcugcacagcaucacccuccuggcccaccugaccuccgacgcgaucgcccacggcgccacgaccugccuccgcgccccgcccgagcccgcggacagccugaccgaggccugcaagcaguacgggcgcgagacccuggccuaccucgccucccuggaggaggagggcagccuggagaacgccgacuccacggcgaugcggaacugccucagcaagaucaaggccaucggcgaggagcugcugccccgcgggcucgacaucaagcaggaggagcugggcgaccugguggacaaggagauggccgccaccuccgccgcgaucgagaccgccaccgcccggaucgaggggacggccagccccaaggaguucuacgccaagaacucccgcuggaccgagggccucaucagcgcguccaaggccgugggguggggcgccaccgugauggucgacgccgcggaccugguggugcagggccgggggaaguucgaggagcugauggucugcagccacgagaucgccgccuccaccgcccagcucguggccgcgagcaaggugaaggccgacaaggacucccccaaccuggcccagcugcagcaggccagccgcggcgucaaccaggccacggcgggggugguggccagcaccaucuccggcaagagccagaucgaggagaccgacaacauggacuucuccagcaugacccucacccagaucaagcggcaggagauggacucccagguccgcgugcuggagcuggagaacgagcuccagaaggagcggcagaagcugggggagcugcgcaagaagcacuacgagcucgccggcguggccgagggcugggaggaggggacggaggccagcccgcccacccugcaggaggucgugaccgagaaggaguga

SEQ ID NO: 31103 - RNA, 3207 nt, Artificial Sequence
  derived and/or modified sequence opt1 from HIP1R__Homo_sapiens__NP_003950
augaacagcaucaagaacgugcccgcccgcguccugucccggcgcccgggccacagccucgaggccgagcgggagcaguucgacaagacccaggccaucuccaucagcaaggccaucaacacccaggaggcccccgugaaggagaagcacgcccgccggaucauccuggggacgcaccacgagaagggcgccuucaccuucugguccuacgcgaucgggcugccccuccccagcuccagcauccuguccuggaaguucugccacgugcugcacaagguccuccgcgacggccacccgaacgugcugcacgacugccagcgguaccgcagcaacauccgggagaucggggaccuguggggccaccuccacgaccgcuacggccagcuggugaacgucuacaccaagcugcuccugaccaagaucuccuuccaccugaagcacccccaguuccccgccgggcucgaggugacggacgaggugcuggagaaggccgccggcaccgacgucaacaacaucuuccagcugaccguggagauguucgacuacauggacugcgagcucaagcugagcgaguccguguuccggcagcugaacaccgcgaucgccgucagccagauguccagcgggcagugccgccucgcgccccugauccaggugauccaggacugcucccaccuguaccacuacacggugaagcuccuguucaagcugcacagcugccucccggccgacacccugcagggccaccgggaccgcuuccacgagcaguuccacucccugcggaacuucuuccgccgggccagcgacaugcucuacuucaagcgccugauccagaucccccggcugcccgaggggcccccgaacuuccuccgcgccagcgcccuggccgagcacaucaagcccgucguggugauccccgaggaggcccccgaggacgaggagccggagaaccugaucgagaucuccaccggcccgcccgccggcgagcccgucgugguggcggaccucuucgaccagaccuucgggccgcccaacggcagcgucaaggacgaccgggaccugcagaucgagucccugaagcgcgagguggagaugcuccgcagcgagcuggagaagaucaagcuggaggcccagcgguacaucgcccagcucaagucccaggugaacgcccuggagggggagcuggaggagcagcgcaagcagaagcagaaggcccucgucgacaacgagcagcugcggcacgagcuggcgcagcuccgcgccgcccagcuggagggcgagcggagccagggccugcgcgaggaggccgagcggaaggccuccgcgacggaggcccgcuacaacaagcugaaggagaagcacagcgagcucgugcacguccacgccgagcugcugcggaagaacgccgacaccgcgaagcagcucaccgugacccagcagucccaggaggagguggcccgcgucaaggagcagcuggccuuccagguggagcaggucaagcgggagagcgagcugaagcucgaggagaaguccgaccagcuggagaagcugaagcgcgagcucgaggccaaggccggggagcuggcgcgggcccaggaggcccugagccacacggagcaguccaagagcgagcucuccagccgccuggacacccuguccgccgagaaggacgcccucagcggcgcggugcggcagcgcgaggccgaccugcuggccgcccagucccucgugcgggagaccgaggccgcgcugagccgcgagcagcagcggagcucccaggagcagggggagcugcagggccgccucgccgagcgcgagagccaggagcaggggcugcggcagcgccugcucgacgagcaguucgccgugcugcggggcgccgcggccgaggccgccggcauccugcaggacgccgucuccaagcucgacgacccccugcaccuccgcugcaccagcucccccgacuaccuggugagccgggcgcaggaggcccuggacgccguguccacgcuggaggaggggcacgcccaguaccucaccagccuggccgacgcguccgcccuggucgccgcccucacccgcuucagccaccuggccgcggacaccaucaucaacggcggggccacgucccaccuggcccccaccgaccccgccgaccggcucaucgacacgugccgcgagugcggcgcgcgggcccuggagcugauggggcagcuccaggaccagcaggcccugcgccacaugcaggccagccuggugcggacgccccuccagggcauccugcagcugggccaggagcucaagcccaagucccuggacgugcgccaggaggagcugggggccgucguggacaaggagauggcggccaccagcgccgccaucgaggacgccgugcggcgcaucgaggacaugaugaaccaggcgcggcacgccuccagcggcgucaagcucgaggugaacgagcgcauccugaacuccugcaccgaccugaugaaggccauccggcuccuggugaccaccagcacgagccugcagaaggagaucgucgaguccgggcgcggcgccgccacccagcaggaguucuacgcgaagaacagccgguggaccgaggggcucaucuccgccagcaaggccgugggcuggggcgccacccagcugguggaggccgcggacaaggucgugcugcacacggggaaguacgaggagcucaucgugugcucccacgagaucgccgccagcaccgcccagcuggucgcggccuccaaggugaaggccaacaagcacagcccgcaccugucccgccuccaggagugcagccggaccgugaacgagcgcgccgccaacgucguggcguccaccaagagcggccaggagcagaucgaggaccgcgacaccauggacuucuccgggcugagccugaucaagcucaagaagcaggagauggagacccaggugcggguccuggagcuggagaagacccucgaggccgagcgcaugcggcugggcgagcugcgcaagcagcacuacgugcucgccggcgccuccgggagccccggcgaggagguggccauccggcccuccaccgcgccgcgcagcgucaccacgaagaagccgccccuggcccagaagcccuccguggcgccccggcaggaccaccagcuggacaagaaggacgggaucuaccccgcccagcucgugaacuacuga

SEQ ID NO: 31104 - RNA, 2349 nt, Artificial Sequence
  derived and/or modified sequence opt1 from HIPK1__Homo_sapiens__XP_011539282
augaccuucuacagcuggauccccuaccaccgccaggccccgcugaaccaccggcgcgugugcuccgccgagggcgcggggagccccggccccgcccucgacccccgguggcugccgaccgaggcccaccuccuggaggcccaccgccugcugcuccaguccguccugugcgaccggccccgcgagagcauccagcugcacuuccggcucuccauggccagccagcuccagguguucuccccgcccagcguguccagcuccgcguucugcagcgccaagaagcugaagaucgagcccuccgggugggacgucagcggccaguccagcaacgacaaguacuacacgcacuccaagacccugcccgccacccaggggcaggccaacagcucccaccagguggcgaacuucaacauccccgccuacgaccagggccugcugcuccccgccccggccguggagcacaucgucgugaccgccgcggacagcagcggcuccgccgccacgagcaccuuccaguccagccagacccugacccaccgcuccaacgugagccugcucgagcccuaccagaagugcgggcugaagcggaaguccgaggaggucgacagcaacggcuccgugcagaucaucgaggagcacccgccccugaugcuccagaaccgcacgguggucggggccgccgcgaccaccaccacggugaccaccaagagcuccagcuccagcggcgagggggacuaccagcuggugcagcacgagauccugugcuccaugaccaacagcuacgagguccucgaguuccugggccggggcacguucggccagguggccaagugcuggaagcgcuccaccaaggagaucguggccaucaagauccugaagaaccaccccagcuacgcccggcaggggcagaucgaggucuccauccucagccgccugagcuccgagaacgccgacgaguacaacuucgugcggagcuacgagugcuuccagcacaagaaccacacgugccugguguucgagaugcucgagcagaaccuguacgacuuccugaagcagaacaaguucagcccccucccccugaaguacauccgccccauccugcagcaggucgcgaccgcccucaugaagcugaagucccuggggcucauccacgccgaccugaagccggagaacaucaugcugguggaccccgugcggcagcccuaccgcgucaaggugaucgacuucggcuccgccagccacgucuccaaggccgugugcagcaccuaccuccagucccgguacuaccgcgcgcccgagaucauccugggccugccguucugcgaggccaucgacauguggagccucgggugcgugaucgccgagcuguuccugggcuggccccucuaccccggggccuccgaguacgaccagauccgguacaucagccagacccagggccugcccgcggaguaccugcuguccgccgggaccaagaccacgcgcuucuucaaccgcgacccgaaccucggcuacccccuguggcggcugaagacccccgaggagcacgagcucgagaccggcaucaagagcaaggaggcccgcaaguacaucuucaacugccuggacgacauggcccaggucaacauguccaccgaccuggaggggacggacaugcucgccgagaaggcggaccggcgcgaguacaucgaccugcugaagaagaugcucaccaucgacgccgacaagcggaucaccccgcugaagacccugaaccaccaguucgugacgaugacccaccuccuggacuucccccacagcaaccacgugaaguccugcuuccagaacauggagaucugcaagcgccggguccacauguacgacaccgugagccagaucaagagccccuucaccacgcacguggcccccaacaccuccaccaaccugaccaugagcuucuccaaccagcucaacaccguccacaaccaggccagcgugcuggccuccagcuccacggcggccgccgccacccugagccucgccaacuccgacgugagccugcugaacuaccaguccgcgcucuacccgagcuccgccgcccccguccccggcguggcccagcagggggugagccugcagcccggcaccacccagaucugcacgcagaccgacccguuccagcagaccuucaucgucugcccgcccgcguuccagaccgggcugcaggccacgaccaagcacuccggcuuccccgugcgcauggacaacgccgugcccaucgucccccaggcccccgccgcgcagccccuccagauccagagcggcgugcugacccagaccugccgggagaagaucucccgccacagcuga

SEQ ID NO: 31105 - RNA, 3516 nt, Artificial Sequence
  derived and/or modified sequence opt1 from HIPK2__Homo_sapiens__NP_001106710
auggcccccguguacgagggcauggccagccacguccagguguucuccccgcacacccugcagagcuccgcguucugcagcgugaagaagcucaagaucgagcccuccagcaacugggacaugaccggguacggcucccacagcaaggucuacucccagagcaagaacaucccccugucccagcccgccacgaccaccgugagcaccucccugccggugcccaaccccagccuccccuacgagcagacgaucgucuucccgggguccaccggccacaucguggugaccagcgccuccagcaccuccgucacggggcaggugcugggcggcccccacaaccugaugcgccggagcaccgugagccuccuggacaccuaccagaagugcgggcugaagcgcaaguccgaggagaucgagaacaccagcuccguccagaucaucgaggagcacccccccaugauccagaacaacgccagcggcgccacgguggcgaccgccaccaccuccacggccaccagcaagaacuccgggagcaacuccgagggcgacuaccagcucgugcagcacgagguccugugcagcaugaccaacaccuacgaggugcuggaguuccucgggcggggcacguucggccagguggucaagugcuggaagcgcgggaccaacgagaucguggccaucaagauccugaagaaccacccguccuacgcgcggcagggccagaucgaggugagcauccuggcccgccucuccaccgagagcgccgacgacuacaacuucguccgggccuacgagugcuuccagcacaagaaccacaccugccugguguucgagaugcuggagcagaaccucuacgacuuccugaagcagaacaaguucuccccccugccccucaaguacauccgccccgugcugcagcaggucgccacggcgcugaugaagcucaagagccuggggcugauccacgccgaccucaagccggagaacaucaugcugguggaccccucccggcagcccuaccgcgucaaggugaucgacuucggcagcgccucccacgugagcaaggccgucugcagcaccuaccugcagucccgguacuaccgcgcccccgagaucauccucggccugccguucugcgaggcgaucgacauguggagccuggggugcgugaucgccgagcucuuccugggcuggccccuguaccccggggccuccgaguacgaccagauccgguacaucagccagacccagggccuccccgccgaguaccugcuguccgccgggaccaagacgacccgcuucuucaaccgggacaccgacagcccguacccccucuggcgccugaagacccccgacgaccacgaggcggagacgggcaucaaguccaaggaggcccggaaguacaucuucaacugccuggacgacauggcccaggugaacaugaccaccgaccucgagggcagcgacaugcuggucgagaaggccgaccgccgggaguucaucgaccugcucaagaagaugcugaccaucgacgccgacaagcgcaucacgcccaucgagacccugaaccacccguucgugaccaugacccaccuccuggacuucccccacuccacccacgugaagagcugcuuccagaacauggagaucugcaagcggcgcgucaacauguacgacacggugaaccaguccaagacccccuucaucacccacguggcgccgagcaccuccacgaaccugaccaugaccuucaacaaccagcugaccacgguccacaaccagcccagcgccgccuccauggccgcgguggcccagcgcagcaugccccuccagaccgggaccgcccagaucugcgcccggcccgacccguuccagcaggcccugaucgugugcccccccggcuuccaggggcugcaggcgucccccagcaagcacgccggcuacagcguccgcauggagaacgccgugccgaucgugacccaggcccccggggcccagccccuccagauccagcccggccugcuggcgcagcaggccuggccguccggcacgcagcagauccuccugccccccgccuggcagcagcugaccggggucgccacccacaccagcgugcagcacgccacggugauccccgagaccauggcgggcacccagcagcucgccgacuggcggaacacccacgcccacgggucccacuacaacccgaucaugcagcagcccgcccugcugacgggccacgucacccuccccgcggcccagccccugaacguggggguggcccacgucaugcgccagcagccgaccagcaccacguccagccggaaguccaagcagcaccagagcuccgugcgcaacgugagcaccugcgaggucuccagcucccaggccaucagcuccccccagcggagcaagcgcgugaaggagaacacccccccccggugcgccauggugcacuccagcccggcgugcuccaccagcgucacgugcggcuggggcgacguggccagcuccaccacccgcgagcggcagcgccagaccaucgugauccccgacacgcccagcccgaccgucuccgugaucaccaucagcuccgacaccgacgaggaggaggagcagaagcacgcccccacgagcaccguguccaagcagcggaagaacgucaucagcugcgugaccgugcacgacucccccuacagcgacuccagcuccaacaccagccccuacuccguccagcagcgcgccgggcacaacaacgccaacgcguucgacaccaagggcagccuggagaaccacugcacggggaacccgcggaccaucaucgugcccccccucaagacccaggccuccgaggugcuggucgagugcgacagccuggugcccgugaacaccucccaccacagcagcuccuacaagagcaaguccagcuccaacgucacgagcaccuccggccacagcuccggcagcuccagcggggccaucaccuaccgccagcagcggccgggcccccacuuccagcagcagcagccccucaaccugucccaggcccagcagcacaucaccacggaccgcaccgggagccaccggcgccagcaggccuacaucacccccaccauggcgcaggccccguacuccuucccccacaacagccccucccacggcacggugcacccccaccuggccgccgcggccgccgccgcccaccucccgacccagccccaccuguacaccuacaccgcgcccgccgcccuggggagcacgggcaccguggcccaccucgucgccucccagggcagcgcgcgccacaccgugcagcacaccgccuaccccgccagcaucgugcaccaggucccgguguccauggggccccggguccugcccagccccacgauccacccgucccaguaccccgcccaguucgcccaccagaccuacaucagcgcgucccccgccagcaccguguacaccggcuacccccuguccccggccaaggugaaccaguaccccuacaucuga

SEQ ID NO: 31106 - RNA, 3585 nt, Artificial Sequence
  derived and/or modified sequence opt1 from HIPK3__Homo_sapiens__NP_001265092
auggccagccaggugcuggucuacccgcccuacguguaccagacccaguccagcgccuucugcuccgugaagaagcucaaggucgagcccagcuccugcguguuccaggagcgcaacuacccccggaccuacgugaacggccgcaacuucgggaacagccacccgcccacgaagggcuccgcguuccagaccaagauccccuucaaccggccccgcgggcacaacuucagccugcagaccuccgccgucgugcugaagaacaccgccggcgccacgaaggugaucgccgcgcaggcccagcaggcccacguccaggcgccccagaucggggccuggcggaaccgccuccacuuccuggagggcccgcagcggugcggccugaagcgcaagagcgaggagcucgacaaccacuccagcgccaugcagaucguggacgagcuguccauccugcccgccaugcuccagaccaacauggggaaccccgugaccgucgugaccgccacgaccggcagcaagcagaacugcaccaccggggagggcgacuaccagcuggugcagcacgagguccugugcuccaugaagaacacguacgaggugcucgacuuccuggggcggggcaccuucggccagguggucaagugcuggaagcgcgggaccaacgagaucguggccaucaagauccugaagaaccaccccagcuacgcgcggcagggccagaucgagguguccauccucgcccgccugagcaccgagaacgccgacgaguacaacuucguccgggccuacgagugcuuccagcaccgcaaccacacgugccugguguucgagaugcucgagcagaaccuguacgacuuccugaagcagaacaaguucuccccgcucccccugaaggugauccggcccauccugcagcaggucgccaccgcgcucaagaagcucaagagccuggggcugauccacgccgaccugaagcccgagaacaucaugcugguggacccgguccgccagcccuaccgggugaaggugaucgacuucggcagcgccucccacgucagcaagaccgugugcuccaccuaccuccagagccgcuacuaccgggcccccgagaucauccugggccugcccuucugcgaggccaucgacauguggucccucgggugcgugaucgcggagcuguuccugggcuggccgcucuaccccggggcccuggaguacgaccagauccgcuacaucagccagacgcagggccugcccggggagcagcuccugaacgucggcaccaaguccacccgguucuucugcaaggagaccgacaugagccacuccggcuggcgccugaagacgcucgaggagcacgaggccgagaccgggaugaaguccaaggaggcccgcaaguacaucuucaacagccuggacgacguggcccacgugaacaccgucauggaccuggagggcagcgaccuccuggcggagaaggccgaccggcgcgaguucgugucccugcucaagaagaugcugcugaucgacgccgaccugcggaucacccccgccgagacgcucaaccacccguucgugaacaugaagcaccuccuggacuucccccacagcaaccacgucaaguccugcuuccacaucauggacaucugcaagagccaccugaacuccugcgacaccaacaaccacaacaagaccagccugcugcgccccguggcguccagcagcaccgccacgcucaccgccaacuucaccaagaucgggacccugcggucccaggcccugacgaccagcgcccacuccgugguccaccacggcaucccccuccaggcggggaccgcccaguucggcugcggcgacgccuuccagcagacccugaucaucugcccgcccgccauccaggggauccccgccacccacggcaagccgacgagcuacuccauccgcguggacaacaccgugccccuggucacccaggcgcccgccgugcagccccuccagauccggccgggggugcugagccagaccugguccggccgcacgcagcagaugcugguccccgccuggcagcaggucacgccccucgcccccgccaccaccacccugaccagcgaguccguggcggggagccaccggcugggcgacuggggcaagaugaucuccugcagcaaccacuacaacuccgugaugccgcagccccuccugaccaaccagaucacccugagcgcgccccagcccguguccguggggaucgcccacgucguguggccgcagcccgccacgaccaagaagaacaagcagugccagaaccgcagcaacucccuccagaacaccaacaucccccacagcgccuucaucagccccaagaucaucaacggcaaggacguggaggaggucuccugcaucgagacccaggacaaccagaacagcgagggggaggcccggaacugcugcgagacguccauccgccaggacagcgacuccagcguguccgacaagcagcggcagaccaucaucaucgccgacagcccgucccccgccgugagcgucaucaccaucuccagcgacaccgacgaggaggagacgucccagcgccacagccugcgggagugcaagggcucccuggacugcgaggccugccagagcacccucaacaucgaccgcaugugcucccugagcucccccgacagcacccugagcaccuccagcuccggccagagcucccccagcccgugcaagcggcccaacuccaugagcgacgaggagcaggaguccagcugcgacacgguggacgggucccccaccagcgacuccagcggccacgacucccccuucgcggagagcaccuucguggaggacacccacgagaacacggagcucgucuccagcgccgacaccgagaccaagccggccgugugcuccguggucgugccgcccguggagcuggagaacgggcugaacgccgacgagcacauggccaacaccgacagcaucugccagccccucaucaagggccgcagcgcgcccgggcggcugaaccagcccuccgccgucggcacgcgccagcagaagcugaccagcgccuuccagcagcagcaccucaacuucucccaggugcagcacuucggcagcgggcaccaggaguggaacggcaacuucgggcaccgccggcagcaggccuacauccccaccuccgugaccagcaacccguucacgcugucccacggcagccccaaccacaccgccguccacgcgcaccuggccgggaacacccaccucggcggccagcccacccugcugcccuacccguccagcgccacccucuccagcgccgcgcccguggcccaccuccuggccucccccugcacgagccgccccaugcugcagcacccgaccuacaacaucucccaccccagcgggaucgugcaccagguccccgugggccugaacccccggcugcucccgucccccaccauccaccagacccaguacaagcccaucuucccgccccacagcuacaucgccgccucccccgcguacacgggguucccccugagccccaccaagcugagccaguacccguacauguga

SEQ ID NO: 31107 - RNA, 3054 nt, Artificial Sequence
  derived and/or modified sequence opt1 from HIRA__Homo_sapiens__NP_003316
augaagcugcucaagcccaccugggugaaccacaacggcaagccgaucuucagcgucgacauccaccccgacgggaccaaguucgccacgggcgggcagggccaggacuccgggaagguggugaucuggaacaugagccccguccugcaggaggacgacgagaaggacgagaacauccccaagaugcugugccagauggacaaccaccucgccugcgugaacugcgugcgcugguccaacagcggcauguaccuggcguccggcggggacgacaagcugaucauggucuggaagcgggccaccuacaucggcccgagcaccguguucggguccagcggcaagcucgccaacguggagcaguggcgcugcgucuccauccugcggaaccacagcggggacgugauggacguggccuggagcccccacgacgccuggcuggcguccugcuccgucgacaacaccguggugaucuggaacgccgucaaguuccccgagauccucgccacgcugcgcggccacagcggccuggugaaggggcucaccugggaccccgugggcaaguacaucgccucccaggcggacgaccggagccugaaggucuggcgcacccuggacuggcagcucgagaccuccaucacgaagccguucgacgagugcgggggcaccacccacgugcugcggcugagcuggucccccgacggccacuaccucgugagcgcccacgccaugaacaacagcgggcccaccgcccagaucaucgagcgcgagggcuggaagacgaacauggacuucgucgggcaccggaaggccgugaccguggucaaguucaaccccaagaucuucaagaagaagcagaagaacggcuccagcgcgaagccguccugccccuacugcugcugcgccguggggagcaaggaccgcucccugagcgucuggcugaccugccucaagcggccccugguggugauccacgagcuguucgacaaguccaucauggacaucagcuggacccucaacggccugggcauccuggucugcuccauggacgggagcguggccuuccucgacuucucccaggacgagcugggcgacccccugagcgaggaggagaagucccgcauccaccagagcacguacgggaagucccucgccaucaugaccgaggcccagcugagcaccgcggugaucgagaacccggagaugcugaaguaccagcggcgccagcagcagcagcagcucgaccagaaguccgccgccacccgggagaugggcagcgccacguccgucgccgggguggugaacggcgagagccuggaggacauccgcaagaaccugcucaagaagcaggucgagacccggaccgcggacggccgccggcgcaucacgccccugugcaucgcccagcuggacaccggggacuucagcaccgccuucuucaacuccaucccccucagcggcucccuggccgggaccaugcugagcucccacagcagcccccagcuccugccgcuggacuccuccacccccaacagcuucggcgccuccaagcccugcacggagcccgugguggcggccagcgcccggccggccggggacuccgucaacaaggacagcaugaacgcgaccuccacccccgccgcccucagccccuccgugcugaccacgcccagcaagaucgagccgaugaaggccuucgacagccgcuucaccgagcgcuccaaggccacccccggcgcgcccgcccugaccagcaugacgccgaccgccguggagcggcucaaggagcagaaccuggucaaggagcugcgcccccgggaccugcucgaguccagcuccgacagcgacgagaaggugccccuggccaaggccuccagccuguccaagcgcaagcucgagcuggagguggagaccgucgagaagaagaagaagggccggccccgcaaggacagccggcugaugccggugucccucagcgugcagucccccgcggcccugaccgccgagaaggaggccaugugccugagcgcccccgcgcucgcccugaagcugcccaucccgagcccccagcgcgccuucacccuccaggucuccuccgaccccagcauguacaucgagguggagaacgaggugacggucgucgggggcgugaagcugucccggcugaagugcaaccgcgaggggaaggagugggagaccgugcucaccagccggauccugaccgccgcgggcagcugcgacguggugugcgucgccugcgagaagcgcaugcuguccguguucagcacgugcggccggcgccuccugucccccauccugcucccgagccccaucuccacccugcacugcaccgggagcuacgugauggcccugaccgccgccgcgacgcucuccgucugggacgugcaccgccagguggucguggugaaggaggagagccugcacuccauccuggccggcagcgacaugaccgucucccagauccuccugacccagcacgggauccccgugaugaaccugagcgacggcaaggccuacugcuucaaccccucccucagcaccuggaaccugguguccgacaagcaggacagccuggcccagugcgccgacuuccgguccagccucccgucccaggacgcgaugcugugcagcgggccccuggccaucauccagggccggacgagcaacuccggccgccaggccgcccgccucuucagcgucccccacguggugcagcaggagaccacccuggccuaccuggagaaccaggucgcggccgcccucacccugcaguccagccacgaguaccggcacuggcugcucguguacgcccgcuaccuggugaacgagggguucgaguaccggcugcgcgagaucugcaaggaccuccugggccccguccacuacuccacggggagccagugggaguccaccguggugggccugcggaagcgcgagcuccugaaggagcugcucccggucaucgggcagaaccugcgguuccagcgccuguucaccgagugccaggagcagcucgacauccugcgggacaaguga

SEQ ID NO: 31108 - RNA, 1671 nt, Artificial Sequence
  derived and/or modified sequence opt1 from HIRIP3__Homo_sapiens__NP_003600
auggcccgcgagaaggagaugcaggaguucacccggagcuucuuccgcggccggcccgaccuguccacccucacgcacagcaucgugcgccggcgcuaccuggcccacuccgggcggagccaccuggagccggaggagaagcaggcgcucaagcgccuggucgaggaggagcugcucaagaugcaggucgacgaggccgccucccgggaggacaagcuggaccugaccaagaagggcaagcgcccgcccacccccugcagcgaccccgagcggaagcgcuuccgguucaacuccgagagcgaguccgggagcgaggccuccagccccgacuacuucggcccgcccgccaagaacgggguggcggccgaggugucccccgccaaggaggagaacccccgccgggccagcaaggcgguggaggaguccagcgacgaggagcgccagcgggaccuccccgcccagcgcggcgaggaguccagcgaggaggaggagaagggcuacaaggggaagacccggaagaagcccguggucaagaagcaggccccgggcaaggccuccgugagccgcaagcaggcccgggaggagagcgaggaguccgaggcggagcccgugcagcgcacggccaagaaggucgaggggaacaagggcaccaagagccugaaggaguccgagcaggagagcgaggaggagauccuggcccagaagaaggagcagcgcgaggaggagguggaggaggaggagaaggaggaggacgaggagaagggggacuggaagccccggacccgcuccaacggccggcgcaagagcgcccgggaggagcgcuccugcaagcagaagucccaggccaagcggcuccugggcgacagcgacagcgaggaggagcagaaggaggcggccuccagcggggacgacuccggccgcgaccgggagcccccggugcagcgcaagagcgaggaccggacccagcugaagggcgggaagcgccucuccggcagcuccgaggacgaggaggacagcgggaagggcgagcccacggccaaggggucccggaagauggcccgccugggcagcaccagcggggaggaguccgaccuggagcgggaggucagcgacuccgaggccggcggcgggccccagggcgagcgcaagaaccggagcuccaagaaguccagccgcaaggggcggacccgcagcuccagcuccagcuccgacggcagccccgaggcgaagggcgggaaggccggcuccgggcgccggggcgaggaccacccggccgugaugcgccucaagcgguacauccgcgccugcggggcccaccggaacuacaagaagcugcugggcagcugcugcucccacaaggagcgccucagcauccugcgggcggagcuggaggcccucgggaugaagggcacccccagccugggcaagugccgcgcccugaaggagcagcgggaggaggccgcggagguggccucccucgacgucgccaacaucaucagcggguccggccgcccccggcgccggacggccuggaacccccugggggaggccgcgccgcccggcgagcuguaccgccggacccucgacagcgacgaggagcgcccccggcccgccccgcccgacuggucccacaugcgcggcaucaucagcuccgacggggagagcaacuga

SEQ ID NO: 31109 - RNA, 648 nt, Artificial Sequence
  derived and/or modified sequence opt1 from HIST1H1A__Homo_sapiens__NP_005316
augagcgagaccgugcccccggcccccgccgcguccgccgcccccgagaagccccuggccggcaagaaggccaagaagccggcgaaggccgccgccgcgagcaagaagaagcccgccgggcccuccgucagcgagcucaucgugcaggccgccuccagcuccaaggagcgcggcggggugagccuggccgcgcugaagaaggcccucgccgccgccggcuacgacgucgagaagaacaacucccggaucaagcuggggaucaagagccugguguccaagggcacccucgugcagacgaagggcaccggggcgagcggcuccuucaagcugaacaagaaggccagcuccgucgagaccaagcccggggccagcaagguggccaccaagacgaaggccaccggcgcguccaagaagcugaagaaggccaccggggccagcaagaaguccgugaagaccccgaagaaggccaagaagcccgccgcgacgcgcaagagcagcaagaaccccaagaagcccaagaccgucaagccgaagaagguggccaagucccccgccaaggccaaggcggugaagcccaaggccgccaaggcccgggucaccaagcccaagaccgccaagccgaagaaggcggcccccaagaagaaguga

SEQ ID NO: 31110 - RNA, 681 nt, Artificial Sequence
  derived and/or modified sequence opt1 from HIST1H1B__Homo_sapiens__NP_005313
augagcgagaccgcccccgccgagaccgcgacgccggcccccguggagaagucccccgccaagaagaaggccaccaagaaggccgcgggcgccggggccgccaagcgcaaggcgaccgggcccccggucagcgagcugaucaccaaggccguggccgccuccaaggagcggaacggccucagccuggccgcgcugaagaaggcccucgccgccggcggguacgacguggagaagaacaacucccgcaucaagcugggccucaagagccuggucuccaagggcacgcuggugcagaccaaggggaccggcgccagcggguccuucaagcugaacaagaaggcggccagcggcgaggccaagcccaaggccaagaaggccggggcggccaaggccaagaagcccgccggcgccacccccaagaaggcgaagaaggccgccggcgccaagaaggcggugaagaagacgccgaagaaggccaagaagcccgccgccgccggggucaagaagguggcgaagucccccaagaaggccaaggccgccgccaagcccaagaaggcgaccaagagcccggccaagcccaaggccgugaagcccaaggccgccaagcccaaggcggccaagccgaaggccgccaagcccaaggcggccaaggccaagaaggccgccgcgaagaagaaguga

SEQ ID NO: 31111 - RNA, 642 nt, Artificial Sequence
  derived and/or modified sequence opt1 from HIST1H1C__Homo_sapiens__NP_005310
augagcgagaccgcccccgccgcgccggccgccgccccgcccgccgagaaggcgcccgugaagaagaaggccgccaagaaggccggcgggacgccccgcaaggcguccggcccgcccgucagcgagcugaucaccaaggccguggccgccuccaaggagcggagcggggugucccucgccgcgcugaagaaggcccuggccgccgccggcuacgacgucgagaagaacaacagccgcaucaagcucgggcugaagucccuggugagcaagggcacccucgugcagaccaagggcaccggggcguccggcagcuucaagcugaacaagaaggccgccuccggggaggccaagcccaaggucaagaaggccggcgggacgaagcccaagaagcccgugggcgcggccaagaagcccaagaaggccgccggcggggccacccccaagaaguccgcgaagaagaccccgaagaaggccaagaagcccgccgccgcgaccgugacgaagaaggucgccaagagccccaagaaggccaagguggccaagcccaagaaggccgccaagagcgcggccaaggccgugaagccgaaggccgcgaagcccaaggucgugaagcccaagaaggccgcccccaagaagaaguga

SEQ ID NO: 31112 - RNA, 666 nt, Artificial Sequence
  derived and/or modified sequence opt1 from HIST1H1D__Homo_sapiens__NP_005311
augagcgagaccgcgccccuggccccgaccauccccgcccccgccgagaagacccccgugaagaagaaggccaagaaggccggcgccaccgcggggaagcgcaaggccuccggcccgcccgucagcgagcucaucaccaaggccguggccgcguccaaggagcggagcggggugucccuggccgcccugaagaaggcccucgccgcggccggcuacgacgucgagaagaacaacagccgcaucaagcuggggcugaagucccucgugagcaagggcacccuggugcagacgaagggcaccggggccuccggcagcuucaagcugaacaagaaggccgccuccggggagggcaagcccaaggcgaagaaggccggggccgccaagccccggaagccggccggcgcggccaagaagcccaagaaggucgccggcgccgccacccccaagaaguccaucaagaagacccccaagaaggugaagaagccggcgacggccgccgggaccaagaagguggccaagagcgcgaagaaggucaagacgccccagcccaagaaggccgccaagagccccgccaaggccaaggcgccgaagcccaaggccgccaagcccaaguccggcaagcccaaggugaccaaggccaagaaggccgcgccgaagaagaaguga

SEQ ID NO: 31113 - RNA, 660 nt, Artificial Sequence
  derived and/or modified sequence opt1 from HIST1H1E__Homo_sapiens__NP_005312
augagcgagaccgcccccgccgcgccggccgcccccgcccccgccgagaagacccccgugaagaagaaggcgcgcaaguccgccggcgccgccaagcggaaggcgagcgggccgcccgucuccgagcugaucacgaaggccguggccgccagcaaggagcgcuccggcgugagccucgccgcgcugaagaaggcccuggccgccgccggguacgacgucgagaagaacaacucccggaucaagcucggccucaagagccugguguccaaggggacccuggugcagaccaagggcaccggcgcgagcggguccuucaagcugaacaagaaggccgccagcggcgaggccaagcccaaggccaagaaggcgggggccgccaaggccaagaagcccgccggcgcggccaagaagccgaagaaggccacgggggccgcgacccccaagaaguccgccaagaagacccccaagaaggccaagaagcccgccgccgcggccggcgccaagaaggccaagagcccgaagaaggccaaggcggccaagcccaagaaggcccccaagucccccgccaaggccaaggcggucaagccgaaggccgccaagcccaagaccgccaagcccaaggcggccaagcccaagaaggccgccgccaagaagaaguga

SEQ ID NO: 31114 - RNA, 624 nt, Artificial Sequence
  derived and/or modified sequence opt1 from HIST1H1T__Homo_sapiens__NP_005314
augagcgagaccgugcccgccgccuccgcgagcgccggcgucgccgccauggagaagcugccgaccaagaagcgcgggcggaagcccgccggccucaucuccgcgagccgcaaggugcccaaccuguccgugagcaagcugaucacggaggcccucuccgucagccaggagcggguggggaugucccugguggcccugaagaaggcccucgcggccgccggcuacgacgucgagaagaacaacagccgcaucaagcugucccucaagagccuggugaacaaggggauccuggugcagacccggggcaccggcgccuccgggagcuucaagcuguccaagaaggucauccccaagagcacccgcuccaaggccaagaaguccgugagcgcgaagacgaagaagcucgugcugagccgggacagcaaguccccgaagaccgccaagaccaacaagcgcgccaagaagccccgggccaccacgcccaagaccguccgcagcggccggaaggccaagggggcgaagggcaagcagcagcagaagucccccgugaaggcccgcgccagcaaguccaagcugacccagcaccacgaggugaacguccggaaggccaccagcaagaaguga

SEQ ID NO: 31115 - RNA, 393 nt, Artificial Sequence
  derived and/or modified sequence opt1 from HIST1H2AE__Homo_sapiens__NP_066390
augagcggccgcgggaagcagggcgggaaggcccgggccaaggcgaagacccgcuccagccgggccggccugcaguuccccguggggcgcguccaccggcuccugcgcaagggcaacuacuccgagcgggugggcgccggggccccgguguaccuggccgcgguccucgaguaccugaccgccgagauccuggagcucgccggcaacgccgcgcgcgacaacaagaagacgcggaucaucccccgccaccuccagcuggccauccggaacgacgaggagcugaacaagcugcuggggcgcgugaccaucgcccagggcggggugcuccccaacauccaggccguccugcugcccaagaagaccgagagccaccacaaggccaagggcaaguga

SEQ ID NO: 31116 - RNA, 387 nt, Artificial Sequence
  derived and/or modified sequence opt1 from HIST1H2AH__Homo_sapiens__NP_542163
augagcggccgcgggaagcagggcgggaaggcccgggccaaggcgaagacccgcuccagccgggccggccugcaguuccccguggggcgcguccaccggcuccugcgcaagggcaacuacgccgagcgggugggcgccggggccccgguguaccuggcggccguccucgaguaccugaccgccgagauccuggagcucgccggcaacgcggcccgcgacaacaagaagacgcggaucaucccccgccaccuccagcuggccauccggaacgacgaggagcugaacaagcugcuggggaaggugaccaucgcccagggcggggugcuccccaacauccaggccguccugcugcccaagaagaccgagucccaccacaaggcgaaguga

SEQ ID NO: 31117 - RNA, 381 nt, Artificial Sequence
  derived and/or modified sequence opt1 from HIST1H2BG__Homo_sapiens__NP_003509
augcccgagccggccaagagcgcccccgcgcccaagaagggcuccaagaaggccgugaccaaggcccagaagaaggacgggaagaagcgcaagcggagccgcaaggaguccuacagcgucuacguguacaaggugcugaagcagguccaccccgacaccggcaucuccagcaaggccauggggaucaugaacuccuucgugaacgacaucuucgagcggaucgccggcgaggcgagccgccucgcccacuacaacaagcgguccacgaucaccagccgcgagauccagaccgccgugcggcugcugcucccgggggagcuggccaagcacgcggucuccgagggcaccaaggccgugacgaaguacaccagcuccaaguga

SEQ ID NO: 31118 - RNA, 381 nt, Artificial Sequence
  derived and/or modified sequence opt1 from HIST1H2BH__Homo_sapiens__NP_003515
augcccgacccggccaagagcgcccccgcgcccaagaagggcuccaagaaggccgugaccaaggcccagaagaaggacgggaagaagcgcaagcggagccgcaaggaguccuacagcgucuacguguacaaggugcugaagcagguccaccccgacaccggcaucuccagcaaggccauggggaucaugaacuccuucgugaacgacaucuucgagcggaucgccggcgaggcgagccgccucgcccacuacaacaagcgguccacgaucaccagccgcgagauccagaccgccgugcggcugcugcucccgggggagcuggccaagcacgcggucuccgagggcaccaaggccgugacgaaguacaccagcuccaaguga

SEQ ID NO: 31119 - RNA, 381 nt, Artificial Sequence
  derived and/or modified sequence opt1 from HIST1H2BM__Homo_sapiens__NP_003512
augcccgagccggucaagagcgcccccgugcccaagaagggcuccaagaaggccaucaacaaggcgcagaagaaggacgggaagaagcgcaagcggagccgcaaggaguccuacagcguguacguguacaagguccugaagcagguccaccccgacaccggcaucuccagcaaggccauggggaucaugaacuccuucgugaacgacaucuucgagcggaucgccggcgaggccagccgccucgcccacuacaacaagcgguccaccaucacgagccgcgagauccagaccgcggugcggcugcugcucccgggggagcuggccaagcacgccguguccgagggcaccaaggccgugaccaaguacacgagcuccaaguga

SEQ ID NO: 31120 - RNA, 411 nt, Artificial Sequence
  derived and/or modified sequence opt1 from HIST1H3G__Homo_sapiens__NP_003525
auggcccgcaccaagcagaccgcccgcaagagcacgggcgggaaggcgccccggaagcagcuggccaccaaggccgcccggaaguccgccccggcgaccggcggggugaagaagccccaccgcuaccggcccggcaccgucgcccuccgcgagauccggcgcuaccagaaguccacggagcugcugauccggaagcuccccuuccagcgccuggugcgggagaucgcccaggacuucaagaccgaccugcgcuuccagagcagcgccgugauggcgcuccaggaggccugcgaggccuaccuggucgggcuguucgaggacaccaaccucugcgccauccacgccaagcgggugaccaucaugccgaaggacauccagcuggcgcgccggauccgcggcgagcgggccuga

SEQ ID NO: 31121 - RNA, 312 nt, Artificial Sequence
  derived and/or modified sequence opt1 from HIST1H4D__Homo_sapiens__NP_003530
augagcggccgcgggaagggcgggaagggccuggggaagggcggcgccaagcggcaccgcaaggugcuccgggacaacauccaggggaucaccaagcccgccauccgccggcuggcgcgccggggcggggucaagcgcaucuccggccugaucuacgaggagacccgcggggugcucaagguguuccuggagaacgucauccgggacgccgugacguacaccgagcacgccaagcggaagaccgugaccgccauggacgucguguacgcccugaagcgccagggccggacgcucuacggcuucgggggcuga

SEQ ID NO: 31122 - RNA, 411 nt, Artificial Sequence
  derived and/or modified sequence opt1 from HIST3H3__Homo_sapiens__NP_003484
auggcccgcaccaagcagaccgcccgcaagagcacgggcgggaaggcgccccggaagcagcuggccaccaagguggcccggaaguccgccccggccaccggcggggucaagaagccccaccgcuaccggcccggcaccguggcgcuccgcgagauccggcgcuaccagaaguccacggagcugcugauccggaagcuccccuuccagcgccugaugcgggagaucgcccaggacuucaagaccgaccugcgcuuccagagcagcgccgugauggcccuccaggaggcgugcgaguccuaccuggucgggcuguucgaggacaccaaccucugcgugauccacgccaagcgggugaccaucaugccgaaggacauccagcuggcccgccggauccgcggcgagcgggccuga

SEQ ID NO: 31123 - RNA, 8157 nt, Artificial Sequence
  derived and/or modified sequence opt1 from HIVEP1__Homo_sapiens__XP_011512855
augccccggaccaagcagauccacccccggaaccugcgggacaagaucgaggaggcccagaaggagcugaacggcgccgaggugagcaagaaggagauccugcaggccggggugaagggcaccagcgagagccugaagggggugaagcggaagaagaucguggccgagaaccaccugaagaagauccccaagagcccccugcgcaacccccugcaggccaagcacaagcagaacaccgaggagagcuccuucgccgugcugcacagcgccuccgagagccacaagaagcagaacuacauccccgugaagaacggcaagcaguucaccaagcagaacggggagacccccggcaucaucgccgaggccuccaagagcgaggaguccgugagccccaagaagccccuguuccugcagcagcccuccgagcuccggcgcuggcggagcgagggcgccgaccccgccaaguucuccgaccuggacgagcagugcgacagcuccagccuguccagcaagacccgcacggacaacagcgagugcaucuccagccacugcgggaccaccucccccagcuacaccaacacggcguucgacguccuccugaaggccauggagcccgagcuguccacccucagccagaagggcucccccugcgccaucaagaccgagaagcugcggcccaacaagaccgcccgcuccccgcccaagcugaagaacuccagcauggacgcccccaaccagacgucccaggagcucguggcggagagccaguccagcugcaccuccuacaccgugcacaugagcgccgcccagaagaacgagcagggggccaugcaguccgccagccaccuguaccaccagcacgagcacuucguccccaaguccaaccagcacaaccagcagcugcccggcugcagcggguucaccggcagccucacgaaccugcagaaccaggagaacgcgaagcuggagcaggucuacaacaucgccgugaccuccagcgucggccucaccucccccagcucccggagccaggugaccccgcagaaccagcagauggacuccgccagcccccuguccaucagccccgccaacuccacgcaguccccgcccaugcccaucuacaacuccacccacguggccagcgucgugaaccaguccguggagcagaugugcaaccugcuccugaaggaccagaagcccaagaagcaggggaaguacaucugcgaguacugcaaccgcgcgugcgccaagcccagcguccugcucaagcacauccggucccacaccggcgagcgccccuaccccugcgugaccugcggguucagcuucaagaccaaguccaaccuguacaagcacaagaagucccacgcccacaccaucaagcugggccucgugcugcagcccgacgccggcgggcuguuccucagccacgagucccccaaggcccugagcauccacuccgacgucgaggacagcggcgaguccgaggaggagggggcgaccgacgagcggcagcacgaccugggcgccauggagcuccagcccgugcacaucaucaagcgcaugagcaacgccgagacccugcugaaguccagcuucacgcccuccagccccgagaacgugaucggggacuuccuccugcaggaccgguccgccgagagccaggcggucaccgagcugccgaagguggucgugcaccacgugaccgucagcccccugcgcaccgacagccccaaggccauggaccccaagccggagcuguccagcgcccagaagcagaaggaccuccaggugacgaacgugcagccccucuccgccaacaugagccagggcggcgucagccggcuggagaccaacgagaacucccaccagaagggggacaugaacccccuggagggcaagcaggacagccacguggggaccgugcacgcccagcugcagcgccagcaggcgaccgacuacucccaggagcagcagggcaagcuccugagcccccggucccuggggagcacggacuccggcuacuucagccgcuccgagagcgccgaccagaccgucuccccgcccacccccuucgcccgccggcuccccagcaccgagcaggacuccggccgcagcaacgggccguccgccgcccuggugaccacgagcacccccuccgcgcugcccaccggcgagaaggcccuccugcugcccgggcagaugcggccgccccucgccaccaagacgcuggaggagcgcaucagcaagcugaucuccgacaacgaggcccucguggacgacaagcagcuggacagcgucaagccccggcgcaccagccugucccggcgcggcagcaucgacucccccaagagcuacaucuucaaggacuccuuccaguucgaccucaagccgguggggcggcgcaccagcuccagcuccgacauccccaagagccccuucaccccgacggagaaguccaagcaggucuuccugcugagcguccccucccucgacugccugcccaucacccggagcaacuccaugcccaccaccggcuacagcgccgugccggcgaacaucaucccgccgccccacccgcugcgcggcucccagagcuucgacgacaagaucggggccuucuacgacgacguguucgucuccggccccaacgcccccgugccccagagcgggcacccgcggacgcucgugcgccaggccgcgaucgaggacagcuccgccaacgagagccacguccugggcaccggccagucccuggacgagagccaccaggggugccacgccgccggcgaggccauguccgugcggagcaaggcgcucgcccaggggccccacaucgagaagaagaagucccaccagggccgcgggaccauguucgagugcgagaccugccggaaccgcuaccggaagcuggagaacuucgagaaccacaagaaguucuacugcagcgagcugcacggccccaagacgaagguggccaugcgcgagcccgagcacuccccgguccccggcgggcuccagccccagauccugcacuaccgcguggccggcagcuccgggaucugggagcagacgccccagauccggaagcgccggaagaugaaguccgugggcgacgacgaggagcugcagcagaacgaguccgggaccagcccgaaguccagcgagggccuccaguuccagaacgcccugggcugcaaccccucccugcccaagcacaacgucaccauccgcagcgaccagcagcacaagaacauccagcuccagaacucccacauccaccugguggcgcgggggcccgagcagacgauggacccgaagcugagcaccaucauggagcagcagaucagcuccgccgcccaggacaagaucgagcuccagcgccacggcaccgggaucagcgugauccagcacaccaacucccugagccggcccaacuccuucgacaagcccgagcccuucgagcgcgccagcccggucuccuuccaggagcugaaccggacgggcaagagcgggucccucaaggugaucggcaucagccaggaggagucccaccccagccgcgacggcucccacccccaccagcuggcccugagcgacgcgcuccgcggggagcugcaggaguccagccgcaaguccccgagcgagcggcacgugcugggccagcccucccgccucguccggcagcacaacauccaggugcccgagauccuggugaccgaggagcccgaccgcgaccuggaggcccagugccacgaccaggagaaguccgagaaguucagcuggccgcagcgguccgagacccucagcaagcugcccaccgagaagcugccgcccaagaagaagcgccuccggcuggccgagaucgagcacuccagcacggaguccagcuucgacuccacccugagccgcucccucagccgggaguccagccugucccacaccagcuccuucagcgccucccuggacaucgaggacgucagcaagaccgaggcgagcccgaagaucgacuuccucaacaaggccgaguuccugaugauccccgccgggcugaacacgcucaacgugcccggcugccaccgcgagaugcgccggaccgccuccgagcagaucaacugcacccagaccagcauggagguguccgaccugcgcagcaaguccuucgacugcgggagcaucacgcccccgcagaccacgccccugaccgagcuccagccgcccuccagcccgucccgggucggcgugaccggccacgugccccugcuggagcgccggcgcgggccccucguccggcagaucagccugaacaucgcccccgacucccaccugagcccggugcaccccacguccuuccagaacaccgcgcuccccagcgugaacgccguccccuaccagggcccgcagcugaccuccaccagccuggccgaguucuccgccaacacgcuccacagccagacccaggugaaggaccugcaggccgagaccuccaacagcagcuccaccaacguguuccccguccagcagcugugcgacaucaaccuccugaaccagauccacgcgccgcccagccaccaguccacgcagcugagccuccagguguccacccaggggagcaagccggacaagaacuccgugcugagcggcuccagcaaguccgaggacugcuucgcccccaaguaccagcugcacugccaggucuucaccagcggccccuccugcagcuccaacccggugcacagccuccccaaccaggucaucuccgaccccguggggaccgaccacugcgugacgagcgccacccugcccaccaagcugaucgacuccaugagcaacagccacccgcuccugccgcccgagcugcgcccccucggcucccagguccagaaggugccgagcuccuucaugcugcccauccggcugcagagcuccgugcccgccuacugcuucgccacccucacgagccugccccagauccuggucacccaggaccucccgaaccagcccaucugccagaccaaccacuccguggugcccaucagcgaggagcagaacuccguccccacccugcagaaggggcaccagaacgcgcugccgaaccccgagaaggaguuccugugcgagaacguguucagcgagaugucccagaacagcucccucagcgagucccugcccaucacgcagaagaucagcgugggccgccugagcccccagcaggagagcuccgccagcagcaagcggaugcucuccccggccaacagccuggacaucgccauggagaagcaccagaagcgcgccaaggacgagaacggggcggucugcgccaccgacgugcggccccuggaggcccucuccagccgcgugaacgaggccuccaagcagaagaagcccauccugguccgccaggugugcaccaccgagccccuggacggcgugaugcucgagaaggacgucuucagccagccggagaucuccaacgaggcggugaaccugacgaacgugcugcccgccgacaacagcuccaccggcugcagcaaguucgucgugaucgagcccaucuccgagcuccaggaguucgagaacaucaagagcuccaccagccugacccugacggugcgcuccagcccggcccccuccgagaacacccacaucagcccccucaagugcaccgacaacaaccaggagcggaagucccccggggucaagaaccagggcgacaaggugaacauccaggagcagagccagcagccggugaccagccugucccuguucaacaucaaggacacgcagcagcucgccuuccccagccugaagaccaccaccaacuucacguggugcuaccugcuccgccagaagucccugcaccucccccagaaggaccagaagaccagcgccuacaccgacuggaccgucuccgcgagcaaccccaacccgcucgggcugcccaccaagguggcccuggcccuccugaacuccaagcagaacacgggcaagagccuguacugccaggccaucaccacccacuccaagagcgaccuccugguguacuccagcaaguggaaguccagccuguccaagcgggcccucgggaaccagaaguccaccgucguggaguucuccaacaaggacgcgagcgagaucaacuccgagcaggacaaggagaacagccugaucaagagcgagccccgccgcaucaagaucuucgacggcggcuacaaguccaacgaggaguacguguacguccgggggcgcggccgggggaaguacaucugcgaggagugcggcauccgcugcaagaagcccagcaugcugaagaagcacauccggacgcacaccgacgugcgcccguaccacugcaccuacugcaacuucuccuucaagaccaaggggaaccucacgaagcacaugaaguccaaggcccacuccaagaagugcguggaccugggcgucagcgugggccugaucgacgagcaggacaccgaggaguccgacgagaagcagcgguucagcuacgagcgcuccggguacgaccucgaggagagcgacggccccgacgaggacgacaacgagaacgaggacgacgacgaggacucccaggccgagagcgugcuguccgccacccccagcgucaccgccagcccccagcaccuccccagccgguccagccugcaggaccccgugagcacggacgaggacgugcgcaucaccgacugcuucuccgggguccacaccgaccccauggacgugcugccccgggcgcugcucacccgcaugacggugcugagcaccgcccaguccgacuacaaccggaagacccugagcccgggcaaggcccgccagcgggccgcgcgcgacgagaacgacaccauccccuccgucgacacgagccggucccccugccaccagaugagcguggacuaccccgaguccgaggagauccuccgcagcuccauggccggcaaggccguggccaucacccagagcccguccagcguccggcugccgcccgccgcggccgagcacagcccccagaccgccgccgggaugccgagcguggccagcccccaccccgacccgcaggagcagaagcagcagaucacccugcagcccacgcccggccuccccagcccgcacacccaccuguucucccaccucccccuccacagccagcagcagagccgcacccccuacaacauggugcccgucgggggcauccacguggucccggcggggcugaccuacuccacguucgugccccugcaggccggccccgugcagcucaccauccccgccgucagcguggugcaccggacccugggcacccaccgcaacacggucaccgagguguccgggaccaccaacccggccggcguggccgagcugagcuccgucgugcccugcauccccaucgggcagauccgcgugcccggccuccagaaccugagcacgccggggcugcagucccuccccagccuguccauggagaccgucaacaucgugggccuggcgaacaccaacauggcgccccaggugcacccgcccggccucgcccugaacgccgucgggcuccaggugcucaccgcgaaccccagcucccagagcucccccgcgccccaggcccacauccccggccugcagauccugaacaucgcccuccccacgcugauccccagcgugucccaggucgccguggacgcgcagggggcccccgagaugccggccagccaguccaaggccugcgagacccagcccaagcagaccagcguggccuccgcgaaccaggucagccggaccgagagcccccagggccugccgaccgugcagcgcgagaacgccaagaaggugcucaacccgcccgcccccgccggggaccacgcccggcuggacggccuguccaagauggacacggagaaggcggccagcgccaaccacgucaagccgaagcccgagcucaccuccauccagggccagcccgccagcaccucccagccccugcugaaggcccacagcgagguguucaccaagccguccgggcagcagacgcucagccccgaccgccaggugccccggcccaccgcgcugccgcgccggcagcccaccguccacuucuccgacgugagcuccgacgacgacgaggaccgccuggugaucgccaccuga

SEQ ID NO: 31124 - RNA, 7341 nt, Artificial Sequence
  derived and/or modified sequence opt1 from HIVEP2__Homo_sapiens__NP_006725
auggacaccggcgacaccgcccuggggcagaaggccaccucccgcuccggcgagaccgacaaggcguccgggcgguggcgccaggagcaguccgccgugaucaagauguccaccuucggcucccacgaggggcagcggcagccccagaucgagcccgagcagaucggcaacaccgccuccgcccagcuguucggcuccgggaagcuggccucccccuccgagguggugcagcaggucgcggagaagcaguacccgccccaccgccccagccccuacuccugccagcacagccuguccuucccccagcacagccucccccagggcgugaugcacuccacgaagccccaccagagccuggaggggccgcccuggcuguuccccggcccccuccccuccguggccagcgaggaccuguuccccuuccccauccacgggcacuccggcggcuacccccggaagaagaucagcagccugaaccccgccuacucccaguacagccagaaguccaucgagcaggccgaggaggcgcacaagaaggagcacaagcccaagaagcccgggaaguacaucugcccguacugcagccgcgccugcgccaagcccuccgugcucaagaagcacauccggagccacaccggcgagcgccccuaccccugcauccccugcggguucuccuucaagaccaagagcaaccuguacaagcaccggaagucccacgcccacgccaucaaggcgggccugguccccuucaccgagagcgccguguccaagcucgaccuggaggccggcuucaucgacguggaggccgagauccacagcgacggggagcaguccacggacaccgacgaggagagcucccuguucgccgaggcgagcgacaagaugucccccgggccgcccaucccccucgacaucgccagccgcgggggcuaccacgggucccuggaggagagccugggcggccccaugaagguccccauccucaucauccccaagagcgggaucccccugcccaacgaguccagccaguacaucggcccggacaugcugcccaaccccucccucaacaccaaggccgacgacagccacaccgugaagcagaagcuggcccugcggcucuccgagaagaaggggcaggacagcgagcccucccugaaccugcucagcccgcacuccaagggcagcacggacuccggguacuucagccgcuccgagagcgccgagcagcagaucagcccgcccaacaccaacgccaaguccuacgaggagaucaucuucggcaaguacugccggcugagcccccgcaacgcccugagcgugaccaccacgagccaggagcgggccgccaugggccgcaaggggaucauggagccgcucccccacgucaacacccggcuggacgugaagauguucgaggaccccgugucccagcugauccccagcaagggcgacgucgacccgucccagaccagcaugcucaaguccaccaaguucaacagcgagucccgccagccccagaucauccccagcuccauccggaacgaggggaagcuguaccccgccaacuuccagggcagcaacccggugcugcucgaggcgcccguggacuccagcccccugauccgcuccaacagcguccccacguccagcgccaccaaccugaccaucccgcccucccuccgggggagccacuccuucgacgagcgcaugaccggcagcgacgacguguucuaccccggcacgguggggaucccgccccagcgcaugcugcggcgccaggccgccuucgagcugcccagcguccaggagggccacguggagguggagcaccacgggcggaugcucaagggcaucuccagcuccagccugaaggagaagaagcugucccccggcgaccgcgucggguacgacuacgacgugugccggaagccguacaagaagugggaggacagcgagacccccaagcagaacuaccgcgacaucuccugccucagcucccugaagcacggcggggaguacuucauggaccccgucgugccccugcagggcgugccgagcauguucgggacgaccugcgagaaccggaagcgccggaaggagaaguccgucggcgacgaggaggacacgcccaugaucugcagcuccaucgugagcacccccgugggcaucauggcguccgacuacgaccccaagcuccagaugcaggaggggguccgcagcggcuucgccauggccgggcacgagaaccugucccacggccacaccgagcgguucgacccgugccgcccccagcugcagcccgggagccccucccuggugagcgaggagagcccguccgccaucgacagcgacaagauguccgaccucggcggccggaagccgcccgggaacgugaucagcgucauccagcacaccaacucccugagccgccccaacuccuucgagcggagcgaguccgccgagcugguggcgugcacgcaggacaaggccccgagccccuccgagaccugcgacagcgagaucuccgaggcccccgugagccccgagugggccccgcccggcgacggggccgaguccggcgggaagcccagccccucccagcagguccagcagcagagcuaccacacccagccgcgccucgugcggcagcacaacauccaggugcccgagauccgcgucaccgaggagcccgacaagccggagaaggagaaggaggcgcaguccaaggagcccgagaagcccguggaggaguuccaguggccccagcggagcgagacgcugagccagcugccggccgagaagcugccgcccaagaagaagcgccugcgccuggccgacauggagcacuccagcggcgaguccagcuucgaguccaccggcaccgggcucagccggucccccagccaggaguccaaccugagccacuccagcuccuucagcauguccuucgagcgcgaggagaccagcaagcuguccgcccucccgaagcaggacgaguucggcaagcacagcgaguuccugaccgugcccgccggguccuacagccugagcguccccggccaccaccaccagaaggagaugcggcgcugcuccagcgagcagaugcccugcccgcaccccgcggaggugcccgaggugcgguccaagagcuucgacuacgggaaccucucccacgcccccgucagcggcgccgccgcguccacggugagcccgucccgcgagcggaagaagugcuuccuggugcgccaggccagcuucuccggcagccccgagaucucccagggggaggucggcauggaccagagcgugaagcaggagcagcuggagcaccuccacgccgggcugcgguccggcuggcaccacgggccgcccgccgugcugccgccccuccagcaggaggaccccgggaagcaggucgccggccccugcccgccccugagcuccgggccccugcaccucgcgcagccccagaucaugcacauggacagccaggagucccugcgcaacccgcugauccagcccaccagcuacaugaccagcaagcaccuccccgagcagccgcaccuguucccccaccaggagaccauccccuucucccccauccagaacgcccuguuccaguuccaguacccgacggugugcauggugcaccuccccgcccagcagccgcccugguggcaggcccacuucccgcaccccuucgcccagcacccccagaaguccuacggcaagcccuccuuccagaccgagauccacagcuccuacccgcuggagcacgucgcggagcacaccgggaagaagcccgccgaguacgcccacaccaaggagcagacguaccccugcuacagcggcgccuccggccugcaccccaagaaccuccugccgaaguuccccagcgaccaguccagcaaguccaccgagacccccagcgagcagguccugcaggaggacuucgccuccgcgaacgccgggagccuccagucccugcccggcaccguggucccggugcggauccagacgcacgugcccagcuacggguccgucauguacaccagcaucagccagauccugggccagaacucccccgccaucgugaucugcaagguggacgagaacaugacccagcgcacccucgucacgaacgccgcgaugcaggggaucggcuucaacaucgcccaggugcugggccagcacgccgggcuggagaaguaccccaucuggaaggccccgcagacccucccccugggccuggagagcuccaucccccucugccugccgagcaccuccgacagcguggccacccucggcggcuccaagcggaugcucagccccgcguccagccuggagcuguucauggagacgaagcagcagaagcgcgucaaggaggagaagauguacgggcagaucguggaggagcucuccgccguggagcugaccaacagcgacaucaagaaggaccugucccggccccagaagccccagcucguccgccagggcugcgccagcgagccgaaggacggccugcaguccgggagcuccagcuucuccagccugagccccuccagcucccaggacuaccccagcgugucccccagcucccgggagccguuccuccccagcaaggagaugcuguccggcagccgcgcgccccuccccgggcagaaguccagcggcccguccgagagcaaggaguccagcgacgagcucgacaucgacgagaccgccuccgacaugagcaugagcccccagagcagcucccugcccgcgggcgacgggcagcuggaggaggagggcaaggggcacaagcggcccgugggcaugcucguccgcauggccagcgccccguccgggaacguggccgacagcacccugcugcucacggacauggccgacuuccagcagauccugcaguuccccucccugcggaccaccaccacggugagcuggugcuuccucaacuacaccaagcccaacuacguccagcaggcgaccuucaaguccagcguguacgccuccuggugcaucagcuccugcaaccccaacccgagcggccugaacaccaagacgacccuggcccuccugcgcuccaagcagaagaucaccgccgagaucuacacccuggccgcgaugcaccgccccggcacggggaagcucaccagcuccagcgccuggaagcaguucacccagaugaagcccgacgccuccuuccuguucggcagcaagcuggagcggaagcucgucgggaacauccugaaggagcgcggcaagggggacauccacggcgacaaggacaucggcuccaagcagaccgagcccauccggaucaagaucuucgagggcggcuacaagagcaacgaggacuacguguacgugcgcgggcggggccgcgggaaguacaucugcgaggagugcggcauccggugcaagaagccgagcaugcugaagaagcacauccgcacccacacggacguccggcccuacgugugcaagcucugcaacuucgccuucaagaccaagggcaaccugaccaagcacaugaaguccaaggcgcacaugaagaagugccuggagcucggggugagcaugaccuccgucgacgacacggagaccgaggaggccgagaaccuggaggaccugcacaaggccgccgagaagcacagcauguccagcaucuccaccgaccaccaguucagcgacgccgaggaguccgacggcgaggacggggacgacaacgacgacgacgacgaggacgaggacgacuucgacgaccagggcgaccucacccccaagacgcgcagccgguccaccagcccccagccgccccgcuucuccagccugcccgugaacgugggggcggucccgcacggcgugcccuccgacagcucccugggccacagcucccucaucagcuaccuggugacccugcccagcauccgggucacccagcucaugacgcccuccgacagcugcgaggacacccagaugaccgaguaccagcgccuguuccaguccaagagcaccgacuccgagccggacaaggaccggcuggacauccccagcugcauggacgaggagugcaugcugcccuccgagcccagcuccagcccgcgcgacuucucccccagcucccaccacagcucccccggguacgacagcucccccugccgggacaacagcccgaagcgcuaccucauccccaagggcgaccugagcccccggcgccaccugagcccccgccgggaccucagcccgaugcgccaccugagcccccggaaggaggccgcccugcgccgggagaugagccagcgcgacgugagcccccggcgccaccucagcccccggcgcccggugucccccgggaaggacaucacggcccggcgcgaccugagcccccggcgcgagcggcgcuacaugaccaccauccgggcccccuccccgcgccgggcgcuguaccacaacccgccccucagcaugggccaguaccugcaggccgagcccaucguccugggcccgcccaaccuccgccgggggcugccccaggugccguacuucucccuguacggcgaccaggagggggccuacgagcaccccggcagcucccucuuccccgaggggcccaacgacuacguguucagccaccucccccugcacucccagcagcagguccgcgcccccauccccauggugcccgugggcggcauccagaugguccacagcaugccgcccgcccuguccagccugcaccccucccccacccugccgcuccccauggagggguucgaggagaagaagggcgcgagcggggagagcuucuccaaggaccccuacgugcugagcaagcagcacgagaagcgcggcccccacgcccugcaguccagcgggccgcccuccacgcccagcagcccccggcuccugaugaagcagagcaccuccgaggacagccugaacgccaccgagcgcgagcaggaggagaacauccagaccugcacgaaggccaucgcgucccuccggaucgccaccgaggaggccgcccugcugggcccggaccagcccgcccgcgugcaggagccccaccagaacccccucggcagcgcgcacgucuccauccggcacuucagccgcccggagcccgggcagcccugcaccuccgccacccaccccgaccugcacgacggcgagaaggacaacuucgggacgagccagaccccgcuggcccacuccaccuucuacagcaaguccugcguggacgacaagcagcucgacuuccacagcagcaaggagcuguccagcuccaccgaggagagcaaggaccccuccagcgagaagucccagcugcacuga

SEQ ID NO: 31125 - RNA, 2085 nt, Artificial Sequence
  derived and/or modified sequence opt1 from HJURP__Homo_sapiens__NP_001269891
augcugggcacccuccgcgccauggagggggaggacguggaggacgaccagcugcugcagaagcuccgggccagccgccggcgcuuccagcggcgcaugcagcggcugaucgagaaguacaaccagcccuucgaggacaccccggucgugcagauggcgacgcugaccuacgagaccccgcagggccuccgcaucuggggcgggcggcugaucaaggagcgcaacgagggggagauccagcccgccgugccccagagcccccugaagaacgagcuccggcgcaaguaccugacccaggucgacauccugcuccagggcgccgaguacuucgagugcgccggcaaccgggccgggcgcgacgugcgggugacgccccugcccagccuggcgucccccgccgucccggcccccggcuacugcagccgcaucucccgcaagagccccggggaccccgccaagccggcguccagcccccgggagugggacccccuccaccccuccagcaccgacauggcccuggugccgcggaacgacucccugagccuccaggagaccuccagcuccagcuuccuguccagccagcccuucgaggacgacgacaucugcaacgugaccaucuccgaccuguacgccggcaugcuccacagcaugagccgccugcuguccacgaagcccagcuccaucaucagcaccaagaccuucaucaugcagaacuggaacucccggcgccgccaccgguacaagagccgcaugaacaagaccuacugcaagggggcccggcgcucccagcggagcuccaaggagaacuucauccccugcagcgagccggucaagggcacgggcgcccuccgcgacugcaagaacgugcuggacguguccugccggaagaccgggcugaagcucgagaaggcguuccuggaggucaaccgcccccagauccacaagcuggaccccagcuggaaggagcggaaggugacccccuccaaguacagcucccucaucuacuucgacagcuccgccaccuacaaccuggacgaggagaaccgcuuccggacgcugaaguggcucaucagcccggugaagaucgucucccgccccaccauccggcagggccacggggagaaccgccagcgggagaucgagauccgcuucgaccagcugcaccgggaguacugccugagcccccgcaaccagccccggcgcaugugccucccggacagcugggccaugaacauguaccgcggcggccccgccucccccgggggccugcaggggcuggagacccggcgccucagccugccguccagcaaggccaaggcgaagucccugagcgaggccuucgagaaccucggcaagcggucccuggaggccgggcgcugccugcccaagagcgacuccagcuccagccuccccaagaccaaccccacgcacuccgccacccggccgcagcagaccagcgaccugcacgugcagggcaacuccagcggcaucuuccgcaaguccgugagccccagcaagacccuguccguccccgacaaggaggugcccgggcacggccggaaccgcuacgacgagaucaaggaggaguucgacaagcuccaccagaaguacugccucaagagcccggggcagaugacggugccccugugcaucggcgucuccaccgacaaggccagcauggaggugcgguaccagaccgagggguuccugggcaagcugaaccccgacccccacuuccagggcuuccagaagcugccguccagcccccuggggugccgcaagucccuccugggcagcaccgcgaucgaggcccccuccagcacgugcguggcccgggccaucacccgcgacgggacccgggaccaccaguuccccgccaagcgcccgcggcuguccgagccccagggcagcgggcgccagggcaacucccucggcgcgagcgacggggucgacaacaccgugcggcccggcgaccagggguccagcucccagcccaacagcgaggagcgcggcgagaacacguccuaccggauggaggagaaguccgacuucaugcuggagaagcuggagaccaagagcgucuga

SEQ ID NO: 31126 - RNA, 2754 nt, Artificial Sequence
  derived and/or modified sequence opt1 from HK1__Homo_sapiens__NP_000179
augaucgccgcccagcugcucgcguacuacuucaccgagcugaaggacgaccaggugaagaagaucgacaaguaccuguacgccaugcgccucagcgacgagacccugaucgacaucaugacgcgguuccgcaaggagaugaagaacggccugucccgggacuucaaccccaccgccaccgucaagaugcuccccaccuucgugcgcagcauccccgacggguccgagaagggcgacuucaucgcccuggaccucgggggcagcuccuuccggauccuccgcgugcaggucaaccacgagaagaaccagaacgugcacauggagagcgagguguacgacacgcccgagaacaucguccacggguccggcagccagcuguucgaccacguggccgagugccugggcgacuucauggagaagcggaagaucaaggacaagaagcuccccgugggguucaccuucuccuucccgugccagcagagcaagaucgacgaggcgauccugaucaccuggaccaagcgcuucaaggccuccggcgucgagggggccgacguggugaagcugcucaacaaggccaucaagaagcggggcgacuacgacgcgaacaucgucgccguggugaacgacacggucgggaccaugaugaccugcggcuacgacgaccagcacugcgaggugggccugaucaucgggaccggcacgaacgccugcuacauggaggagcugcgccacaucgaccucguggagggggacgagggccggaugugcaucaacaccgaguggggcgccuucggggacgacggcagccuggaggacauccgcaccgaguucgaccgggagaucgaccgcgggucccugaaccccggcaagcagcuguucgagaagauggucagcgggauguaccugggcgagcuggugcggcucauccuggugaagauggccaaggagggccugcuguucgaggggcgcaucacccccgagcugcugacgcggggcaaguucaacaccuccgacgucagcgcgaucgagaagaacaaggaggggcuccacaacgccaaggagauccugacccgccugggcguggagcccuccgacgacgacugcgugagcguccagcacgugugcaccaucgucuccuuccggagcgccaaccucguggccgccacgcugggggcgauccugaaccgccuccgggacaacaagggcaccccgcgccugcgcaccaccgugggcgucgacgggagccuguacaagacgcacccccaguacucccggcgcuuccacaagacccuccggcgccuggugcccgacagcgacgugcgguuccugcucuccgagagcggcuccgggaagggcgccgccauggucaccgccguggccuaccgccuggcggagcagcaccggcagaucgaggagacccuggcccacuuccaccucacgaaggacaugcugcuggaggugaagaagcgcaugcgggccgagauggagcucgggcugcgcaagcagacccacaacaacgccgucgugaagaugcugcccagcuucgugcggcgcaccccggacggcaccgagaacggcgacuuccuggcccucgaccucgggggcacgaacuuccggguccugcucgugaagauccgcuccgggaagaagcggaccguggagaugcacaacaagaucuacgcgauccccaucgagaucaugcagggcaccggcgaggagcuguucgaccacaucgucagcugcaucuccgacuuccuggacuacauggggaucaagggcccccgcaugccccucggguucaccuucagcuucccgugccagcagacgucccuggacgccggcauccugaucaccuggaccaagggguucaaggccaccgacugcgugggccacgacguggucacccuccugcgggacgccaucaagcgccgggaggaguucgaccuggacgugguggcggucgugaacgacacggugggcaccaugaugaccugcgccuacgaggagccgaccugcgaggucgggcucaucgugggcacggggagcaacgccugcuacauggaggagaugaagaacguggagauggucgagggcgaccaggggcagaugugcaucaacauggaguggggcgccuucggcgacaacgggugccuggacgacauccgcacccacuacgaccgccugguggacgaguacucccucaacgccggcaagcagcgguacgagaagaugaucagcgggauguaccugggcgagaucgugcgcaacauccugaucgacuucaccaagaagggguuccucuuccggggccagaucuccgagacccugaagacgcgcggcaucuucgagaccaaguuccugagccagaucgaguccgaccggcucgcgcugcugcagguccgcgccauccuccagcagcuggggcugaacagcacgugcgacgacuccauccucgugaagaccgugugcggcgucgugagccggcgcgccgcccagcugugcggggccggcauggcggccguggucgacaagauccgggagaaccgcgggcuggaccggcucaacgugaccgugggcgucgacggcacccuguacaagcugcacccccacuucagccgcaucaugcaccagaccgugaaggagcucucccccaagugcaacgugagcuuccugcuguccgaggacgggagcggcaagggggccgcccucaucaccgccgucggcgugcggcugcgcacggaggcguccagcuga

SEQ ID NO: 31127 - RNA, 2754 nt, Artificial Sequence
  derived and/or modified sequence opt1 from HK2__Homo_sapiens__NP_000180
augaucgccagccaccuccucgccuacuucuucaccgagcugaaccacgaccaggugcagaaggucgaccaguaccuguaccacaugcgccucuccgacgagacccugcuggagaucagcaagcgguuccgcaaggagauggagaagggccucggggcgacgacccaccccaccgccgccgugaagaugcugccgaccuucgugcgguccacgcccgacggcaccgagcacggggaguuccuggcccucgaccugggcgggaccaacuuccgcguccugugggugaaggugaccgacaacggccuccagaaggucgagauggagaaccagaucuacgccauccccgaggacaucaugcggggcagcgggacgcagcuguucgaccacaucgcggagugccuggccaacuucauggacaagcuccagaucaaggacaagaagcugccccugggcuucaccuucuccuucccgugccaccagaccaagcucgacgagagcuuccugguguccuggaccaagggguucaagagcuccggcguggaggggcgcgacgucguggcccugauccggaaggccauccagcgccggggcgacuucgacaucgacaucguggcggucgugaacgacacggugggcaccaugaugaccugcggguacgacgaccacaacugcgagaucggccucaucgucgggaccggcagcaacgccugcuacauggaggagaugcgccacaucgacaugguggagggcgacgaggggcggaugugcaucaacauggaguggggcgccuucggggacgacggcucccugaacgacauccgcacggaguucgaccaggagaucgacauggggagccugaaccccggcaagcagcuguucgagaagaugaucuccggcauguacaugggggagcuggugcggcugauccucgucaagauggccaaggaggagcugcuguucggcgggaagcucagccccgagcugcugaacaccggccgcuucgagaccaaggacaucuccgacaucgagggggagaaggacggcauccggaaggcccgcgaggugcucaugcggcugggccuggaccccacccaggaggacugcguggcgacgcaccgcaucugccagaucgucagcacccgguccgccagccucugcgccgccacccuggccgcggugcugcagcgcaucaaggagaacaagggggaggagcggcuccgcuccaccaucggcguggacgggagcgucuacaagaagcacccgcacuucgccaagcgccugcacaagacggugcggcgccugguccccggcugcgacgugcgguuccuccgcagcgaggacggguccggcaagggcgccgccauggugaccgccgucgcguaccggcuggccgaccagcaccgcgcccggcagaagacccuggagcaccuccagcugagccacgaccagcugcucgaggugaagcgccggaugaagguggagauggagcgcgggcuguccaaggagacccacgccagcgcccccgucaagaugcugcccacguacgugugcgcgaccccggacggcaccgagaagggggacuuccuggcccucgaccugggcggcaccaacuuccgggugcugcucguccgcgugcggaacgggaaguggggcgggguggagaugcacaacaagaucuacgccaucccccaggaggucaugcacggcacgggggacgagcuguucgaccacaucgugcagugcaucgccgacuuccuggaguacaugggcaugaagggcgugucccucccccugggguucaccuucagcuuccccugccagcagaacucccuggacgagagcauccuccugaaguggaccaagggcuucaaggcguccgggugcgagggcgaggacgucgugacccugcucaaggaggccauccaccgccgggaggaguucgaccuggacguggucgccguggugaacgacacggucgggaccaugaugaccugcggcuucgaggacccgcacugcgaggugggccugaucguggggaccggcagcaacgccugcuacauggaggagaugcgcaacgucgagcucguggagggggaggagggccggaugugcgugaacauggaguggggcgccuucggggacaacggcugccuggacgacuuccgcaccgaguucgacgucgcgguggacgagcugucccucaaccccgggaagcagcgguucgagaagaugaucagcggcauguaccugggggagaucgugcgcaacauccugaucgacuucacgaagcgcggccuccuguuccgggggcgcaucuccgagcggcugaagacccgcggcaucuucgagaccaaguuccucagccagaucgaguccgacugccuggcccugcuccagguccgggccauccugcagcaccugggccucgagagcacgugcgacgacuccaucaucgugaaggaggugugcaccgucguggcccgccgggccgcgcagcugugcggggccggcauggccgccguggucgaccgcauccgggagaaccgcgggcuggacgcccucaaggugaccgugggcgucgacggcacccuguacaagcugcacccccacuucgcgaaggugaugcacgagaccgugaaggaccucgcccccaagugcgacgucagcuuccugcaguccgaggacgggagcggcaagggggccgcccugaucacggcgguggccugccggauccgcgaggccggccagcgguga

SEQ ID NO: 31128 - RNA, 2772 nt, Artificial Sequence
  derived and/or modified sequence opt1 from HK3__Homo_sapiens__NP_002106
auggacagcaucggcuccagcgggcugcgccagggcgaggagacccucuccugcagcgaggaggggcugcccggcccguccgacagcuccgagcuggugcaggagugccuccagcaguucaaggucacccgggcccagcugcagcagauccaggccagccugcucggguccauggagcaggcgcugcgcggccaggccagccccgcccccgccgugcggaugcugcccacguacgugggcuccaccccgcacgggaccgagcagggcgacuucgucgugcucgagcugggggccaccggcgcgagccugcgcgugcucugggucacgcugaccgggaucgagggccaccggguggagccccgcucccaggaguucgugaucccccaggaggucaugcugggcgccgggcagcagcuguucgacuucgccgcccacugccugagcgaguuccuggacgcgcagcccgugaacaagcagggccuccagcugggguucuccuucagcuucccgugccaccagaccggccuggaccgguccacccucaucagcuggacgaagggcuuccgcugcuccgggguggagggccaggacgucgugcagcugcugcgggacgccauccgccggcagggggccuacaacaucgacguggucgccguggugaacgacaccgucggcaccaugauggggugcgagcccggcgugcgccccugcgaggugggccucgucguggacaccgggacgaacgccugcuacauggaggaggcgcggcacguggccguccuggacgaggaccgcggccgggugugcgucagcguggagugggggagcuucuccgacgacggcgcccuggggcccgugcucaccaccuucgaccacacccuggaccacgagagccugaacccgggcgcccagcgcuucgagaagaugaucggcgggcucuaccugggcgagcugguccggcucgugcuggcccaccuggcgcgcugcgggguccucuucggcgggugcacgucccccgcccugcugagccagggcuccauccuccuggagcacguggccgagauggaggaccccagcaccggcgccgcccgggugcacgcgauccugcaggaccucgggcugucccccggcgccagcgacguggagcugguccagcacgugugcgccgccgugugcacccgcgccgcgcagcucugcgccgccgcccuggcggccguccuguccugccuccagcacagccgggagcagcagacccuccagguggccguggccaccgggggccgcgucugcgagcgccacccgcgguucugcuccgugcugcagggcacggugaugcugcucgcccccgagugcgacgucagccugauccccuccguggacgggggcgggcgcggcguggcgauggucaccgccguggccgcccggcuggccgcgcaccgccggcuccuggaggagacccuggcccccuuccgccucaaccacgaccagcuggccgccgugcaggcccagaugcggaaggcgauggccaaggggcugcgcggcgaggccagcucccuccggaugcugccgacguucguccgcgccacccccgacggcagcgagcgcggggacuuccuggcgcucgaccugggcgggaccaacuuccgggugcugcucgugcgggucaccacgggcgugcagaucaccuccgagaucuacagcauccccgagaccguggcccagggguccggccagcagcuguucgaccacaucgucgacugcaucguggacuuccagcagaagcagggccugagcgggcagagccucccccugggcuucaccuucuccuucccgugccgccagcuggggcucgaccagggcauccugcugaacuggacgaagggguucaaggccagcgacugcgagggccaggacguggucucccuccugcgggaggccaucacccgccggcaggccguggagcugaacguggucgcgaucgugaacgacaccgugggcaccaugaugagcugcggguacgaggacccccgcugcgagaucggccucaucgucgggacgggcaccaacgccugcuacauggaggagcugcggaacguggccggggugcccggcgacuccggccgcaugugcaucaacauggaguggggcgccuucggggacgacgggagccuggccaugcucuccacccgcuucgacgcgagcgucgaccaggccuccaucaaccccggcaagcagcgguucgagaagaugaucagcggcauguaccugggggagaucgugcgccacauccugcuccaccugaccucccugggcguccucuuccgggggcagcagauccagcgccugcagacccgggacaucuucaagacgaaguuccugagcgagaucgaguccgacagccucgcccugcgccaggugcgggccauccuggaggaccucggccugccgcugaccuccgacgacgcccucauggugcuggaggugugccaggcggucagccagcgcgccgcccagcugugcggggccggcguggcggccguggucgagaagauccgggagaaccgcggccucgaggagcuggccguguccgucgggguggacggcacccuguacaagcuccacccccgguucagcagccugguggccgccaccguccgcgagcuggcgccccggugcguggugacguuccuccaguccgaggacgggagcggcaagggggccgcccuggucaccgccguggccugccgccuggcgcagcucacccggguguga

SEQ ID NO: 31129 - RNA, 2754 nt, Artificial Sequence
  derived and/or modified sequence opt1 from HKDC1__Homo_sapiens__NP_079406
auguucgccgugcaccugauggccuucuacuucagcaagcucaaggaggaccagaucaagaaggucgaccgcuuccuguaccacaugcggcuguccgacgacacccuccuggacaucaugcgccgguuccgcgcggagauggagaagggccuggccaaggacaccaaccccacggccgccgugaagaugcucccgaccuucgugcgggccauccccgacgggagcgagaacggcgaguuccugucccuggaccucgggggcagcaaguuccgcguccugaagguccagguggcggaggaggggaagcggcacgugcagauggagucccaguucuaccccacccccaacgagaucauccgcggcaacggcaccgagcuguucgaguacguggccgacugccucgccgacuucaugaagacgaaggaccugaagcacaagaagcugccgcucgggcugaccuucagcuuccccugccggcagaccaagcuggaggagggcgugcuccuguccuggaccaagaaguucaaggcccgcgggguccaggacacggacguggugagccggcugaccaaggcgaugcgccggcacaaggacauggacgucgacauccucgcccuggugaacgacaccgugggcaccaugaugacgugcgccuacgacgaccccuacugcgaggucggggugaucaucggcaccggcaccaacgccugcuacauggaggacauguccaacaucgaccugguggagggggacgagggccgcaugugcaucaacaccgaguggggcgccuucggggacgacggcgcgcucgaggacauccggacggaguucgaccgcgagcuggaccuggggagccucaaccccggcaagcagcuguucgagaagaugaucuccgggcuguaccucggcgagcugguccggcugauccuccugaagauggccaaggccgggcugcuguucggcggcgagaaguccagcgcccugcacaccaaggggaagaucgagacccgccacguggccgcgauggagaaguacaaggagggccuggccaacacccgggagauccucguggaccuggggcuggagccgagcgaggccgacugcaucgccguccagcacgugugcacgaucguguccuuccgcagcgccaaccucugcgcggccgcccuggccgccauccugacccggcuccgcgagaacaagaaggucgagcgccugcggaccaccgugggcauggacgggacgcuguacaagauccacccccaguaccccaagcgccuccacaaggucgugcggaagcuggugcccuccugcgacguccgcuuccugcugagcgaguccggcagcaccaagggcgcggccauggugaccgccguggccagccggguccaggcgcagcgcaagcagaucgaccgggugcucgcccuguuccagcugacccgcgagcagcucguggacguccaggccaagaugcgggccgagcuggaguacgggcugaagaagaagucccacggccucgccacggugcgcaugcugccgaccuacgugugcgggcugcccgacggcaccgagaaggggaaguuccucgcgcuggaccugggcggcaccaacuuccggguccuccuggugaagauccgcagcgggcggcgcuccgugcggauguacaacaagaucuucgccaucccccuggagaucaugcagggcacgggggaggagcuguucgaccacaucguccagugcaucgccgacuuccuggacuacaugggccugaagggcgccagccucccccugggguucaccuucuccuucccgugccgccagaugagcaucgacaagggcacccugaucggguggaccaagggcuucaaggccacggacugcgagggggaggacgugguggacaugcuccgggaggcgaucaagcgccggaacgaguucgaccuggacaucgucgccguggugaacgacaccgucggcaccaugaugaccugcggcuacgaggaccccaacugcgagaucgggcugaucgccggcaccggguccaacaugugcuacauggaggacaugcgcaacaucgagaugguggagggcggggagggcaagaugugcaucaacacggaguggggcggguucggcgacaacgggugcaucgacgacauccgcacccgguacgacaccgagguggacgagggcagccucaaccccgggaagcagcgcuacgagaagaugaccuccggcauguaccugggcgagaucguccggcagauccugaucgaccucacgaagcaggggcugcuguuccgcggccagaucagcgagcggcuccgcacccgggggaucuucgagaccaaguuccugucccagaucgagagcgaccgccuggcccuccuccaggugcggcgcauccugcagcagcucggccuggacuccacgugcgaggacagcaucguggucaaggaggugugcggggccgugucccggcgcgcggcccagcugugcggcgccggccucgccgcgaucgucgagaagcggcgcgaggaccaggggcuggagcaccuccggaucaccgugggcguggacgggacccucuacaagcugcacccccacuucagccgcauccugcaggagaccgucaaggagcucgccccgcggugcgacgugaccuucaugcuguccgaggacggcagcggcaagggggccgcccugaucacggccguggcgaagcgccuccagcaggcccagaaggagaacuga

SEQ ID NO: 31130 - RNA, 1098 nt, Artificial Sequence
  derived and/or modified sequence opt1 from HLA-A__Homo_sapiens__NP_001229687
auggccgugauggcgccccgcacccugcuccugcugcucagcggcgcccuggcccugacccagacgugggccgggucccacagcaugcgguacuucuucaccuccgucagccgcccgggccgcggggagccccgguucaucgccgugggcuacguggacgacacccaguucguccgguucgacuccgacgccgcgagccagaagauggagccccgcgcccccuggaucgagcaggaggggccggaguacugggaccaggagacccggaacaugaaggcccacucccagacggaccgcgccaaccucggcacccugcggggcuacuacaaccagagcgaggacgggucccacaccauccagaucauguacggcugcgacguggggcccgacggccgcuuccugcggggguaccgccaggacgcguacgacggcaaggacuacaucgcccucaacgaggaccugcggagcuggaccgccgccgacauggccgcgcagaucacgaagcgcaagugggaggccgugcacgccgccgagcagcggcgcgucuaccuggagggccggugcguggacgggcuccgccgguaccuggagaacggcaaggagacccugcagcgcaccgacccgcccaagacccacaugacgcaccaccccaucuccgaccacgaggccacccuccggugcugggcgcugggguucuaccccgccgagaucacccugaccuggcagcgcgacggcgaggaccagacgcaggacaccgagcucguggagacccgccccgccggcgacgggaccuuccagaagugggccgccgucguggugcccagcggcgaggagcagcgguacacgugccacguccagcacgaggggcugccgaagccccugacccuccgcugggagcuguccagccagcccaccauccccaucgugggcaucaucgcggggcuggugcuccugggcgccgucaucaccggcgccgugguggccgccgucauguggcggcgcaaguccagcgaccggaagggcggguccuacacgcaggcggccagcuccgacagcgcccaggggagcgacgugucccugaccgccugcaagguguga

SEQ ID NO: 31131 - RNA, 1089 nt, Artificial Sequence
  derived and/or modified sequence opt1 from HLA-B__Homo_sapiens__NP_005505
augcuggugauggcgccccgcaccguccuccugcugcucagcgccgcccuggcccugaccgagacgugggccggcucccacagcaugcgguacuucuacaccuccgugagccgcccggggcggggcgagccccgcuucaucuccgugggguacgucgacgacacccaguucgugcgguucgacagcgacgccgccagcccccgcgaggagccccgggcgccguggaucgagcaggagggccccgaguacugggaccgcaacacccagaucuacaaggcccaggcccagacggaccgggagucccuccgcaaccugcggggguacuacaaccaguccgaggccggcagccacacccugcaguccauguacggcugcgacguggggcccgacggccgccuccugcgggggcacgaccaguacgcguacgacggcaaggacuacaucgcccugaacgaggaccuccgcagcuggaccgccgccgacaccgccgcgcagaucacgcagcggaagugggaggccgcccgcgaggccgagcagcggcgcgccuaccuggagggggagugcgucgaguggcugcggcgcuaccucgagaacggcaaggacaagcuggagcgggcggacccgcccaagacccacgugacccaccaccccaucuccgaccacgaggccacccugcgcugcugggcccucggcuucuaccccgccgagaucacgcugaccuggcagcgcgacggggaggaccagacccaggacaccgagcugguggagacgcggcccgccggcgaccgcaccuuccagaagugggcggccgucguggugccgagcggggaggagcagcgguacacgugccacguccagcacgagggccuccccaagccccugacccugcgcugggagcccuccagccaguccaccgugccgaucgugggcaucgucgccgggcucgccgugcuggccguggucgugaucggcgcgguggucgccgccgugaugugccggcgcaagagcuccgggggcaagggcgggagcuacagccaggccgcgugcuccgacagcgcccagggcuccgacgugagccugaccgccuga

SEQ ID NO: 31132 - RNA, 1101 nt, Artificial Sequence
  derived and/or modified sequence opt1 from HLA-C__Homo_sapiens__NP_001229971
augcgcgugauggcgccccgggcccugcuccugcugcucagcggcgggcuggcccugaccgagaccugggccugcucccacagcaugcgcuacuucgacaccgccgucucccggccgggccgcggggagccccgguucaucagcgugggcuacguggacgacacccaguucguccgcuucgacuccgacgccgccagcccccgcggggagccccgggcgccguggguggagcaggagggccccgaguacugggaccgggagacccagaacuacaagcgccaggcccaggccgaccgggugucccuccgcaaccugcggggcuacuacaaccagagcgaggacgggucccacacccugcagcgcauguacggcugcgaccucgggcccgacggccggcugcugcgcggguacgaccagagcgccuacgacggcaaggacuacaucgcgcucaacgaggaccugcgguccuggacggccgccgacaccgccgcccagaucacccagcgcaagcuggaggcggcccgggccgccgagcagcuccgcgccuaccuggaggggaccugcgucgaguggcugcggcgcuaccucgagaacgggaaggagacgcugcagcgcgcggagcccccgaagacccacgugacccaccacccccugagcgaccacgaggccacccuccggugcugggcccugggcuucuaccccgccgagaucacgcugaccuggcagcgcgacggggaggaccagacccaggacaccgagcucguggagacgcggcccgccggcgacggcaccuuccagaagugggcggccgucguggugccguccgggcaggagcagcgcuacacgugccacaugcagcacgagggccugcaggagccccugacccucagcugggagcccuccagccagcccaccaucccgaucauggggaucgucgccggccuggccgugcuggugguccucgccgugcugggggcgguggucaccgccaugaugugccggcgcaaguccagcggcggcaagggcggcuccugcagccaggccgccugcagcaacuccgcgcaggggagcgacgagucccugaucacgugcaaggccuga

SEQ ID NO: 31133 - RNA, 786 nt, Artificial Sequence
  derived and/or modified sequence opt1 from HLA-DMA__Homo_sapiens__NP_006111
augggccacgagcagaaccagggggccgcccugcuccagaugcugccccugcucuggcugcugccgcacagcugggcggugcccgaggcccccacccccauguggccggacgaccuccagaaccacaccuuccugcacacggucuacugccaggacggcucccccagcguggggcuguccgaggccuacgacgaggaccagcuguucuucuucgacuucagccagaacacccgcgugccccggcuccccgaguucgccgacugggcccaggagcagggcgacgcgccggccauccuguucgacaaggaguucugcgaguggaugauccagcagaucgggcccaagcucgacggcaagauccccgucucccgcggcuuccccaucgccgagguguucacccugaagccgcuggaguucgggaagcccaacacccucgugugcuucgucagcaaccuguucccgcccaugcugacggugaacuggcagcaccacuccgugcccgucgagggcuucgggcccaccuucgugagcgccguggacggccucuccuuccaggcguucagcuaccugaacuucacccccgagcccuccgacaucuucagcugcaucgucacccacgagaucgaccgguacacggccaucgccuacugggugccgcgcaacgcccugcccuccgaccuccuggagaacgugcugugcggggucgccuucggccucggcgugcuggggaucaucgugggcaucguccugaucaucuacuuccggaagcccugcagcggggacuga

SEQ ID NO: 31134 - RNA, 792 nt, Artificial Sequence
  derived and/or modified sequence opt1 from HLA-DMB__Homo_sapiens__NP_002109
augaucaccuuccugccccuccugcugggccucagccuggggugcaccggcgccgggggcuucguggcccacgucgaguccacgugccugcucgacgacgcggggaccccgaaggacuucaccuacugcaucagcuucaacaaggaccugcugaccugcugggaccccgaggagaacaagauggcccccugcgaguucggcgugcucaacucccuggccaacgugcugagccagcaccucaaccagaaggacacgcugaugcagcgccugcggaacggccuccagaacugcgccacccacacccagcccuucugggggucccugaccaaccgcacgcggccgcccagcguccagguggccaagaccacccccuucaacacccgcgagcccgugaugcuggcgugcuacgucuggggcuucuacccggccgaggugacgaucaccuggcggaagaacgggaagcucgugaugccccacuccagcgcccacaagaccgcccagcccaacggcgacuggaccuaccagacgcugucccaccuggcgcucacccccagcuacggggacaccuacacgugcgucguggagcacaccggcgccccggagcccauccugcgcgacuggacccccggccugucccccaugcagacccucaaggugagcgucuccgccgugacccuggggcugggccucaucaucuucagccugggggugaucuccuggcggcgcgccggccacagcuccuacacgccgcugcccggcagcaacuacuccgagggguggcacaucagcuga

SEQ ID NO: 31135 - RNA, 753 nt, Artificial Sequence
  derived and/or modified sequence opt1 from HLA-DOA__Homo_sapiens__NP_002110
auggcccugcgcgccggccucgugcugggguuccacacccugaugacccuccugagcccccaggaggcgggcgccacgaaggccgaccacaugggguccuacggccccgccuucuaccagagcuacggggccuccggccaguucacccacgaguucgacgaggagcagcuguucagcgucgaccucaagaaguccgaggcgguguggcggcugcccgaguucggcgacuucgcccgcuucgacccccagggcgggcuggccgggaucgccgcgaucaaggcccaccucgacauccugguggagcggagcaaccgcucccgggccaucaacgugcccccgcgcgugaccgugcugcccaagagccgggucgagcucggccagcccaacauccugaucugcaucguggacaacaucuucccgcccgugaucaacaucaccuggcugcgcaacgggcagacggucaccgagggcguggcccagaccuccuucuacagccagcccgaccaccucuuccggaaguuccacuaccugcccuucgugcccuccgccgaggacgucuacgacugccagguggagcacuggggccuggacgcgccgcuccugcgccacugggagcugcagguccccaucccgccgcccgacgccauggagacccucgucugcgcccuggggcuggccaucggccucgugggguuccuggugggcacgguccugaucaucaugggcaccuacgugagcuccgugccccgguga

SEQ ID NO: 31136 - RNA, 822 nt, Artificial Sequence
  derived and/or modified sequence opt1 from HLA-DOB__Homo_sapiens__NP_002111
augggcagcgggugggugcccugggucguggcccugcucgugaaccugacccgccuggacuccagcaugacccagggcacggacuccccggaggacuucgucauccaggccaaggcggacugcuacuucaccaacgggaccgagaaggugcaguucgugguccgguucaucuucaaccucgaggaguacgugcgcuucgacagcgacgugggcauguucgucgcccugaccaagcuggggcagcccgacgccgagcaguggaacucccggcucgaccugcuggagcgcagccggcaggccguggacggcgugugccgccacaacuaccggcucggcgcccccuucacggucgggcgcaaggugcagcccgaggugaccgucuacccggagcggacgccccugcugcaccagcacaaccuccugcacugcuccgugaccggcuucuaccccggggacaucaagaucaagugguuccugaacggccaggaggagcgcgcgggggugaugagcaccggccccauccggaacggcgacuggaccuuccagaccgucgugaugcucgagaugaccccggagcuggggcacguguacacgugccuggucgaccacuccagccuccugucccccgugagcguggaguggcgcgcccaguccgaguacagcuggcggaagaugcuguccggcaucgccgccuuccuccuggggcugaucuuccuccuggucggcaucgugauccagcugcgcgcgcagaagggcuacguccggacccagaugagcgggaacgaggugucccgcgccgugcuccugccccagagcugcuga

SEQ ID NO: 31137 - RNA, 783 nt, Artificial Sequence
  derived and/or modified sequence opt1 from HLA-DPA1__Homo_sapiens__NP_001229454
augcgccccgaggaccggauguuccacauccgcgccgugauccugcgggcccucagccuggcguuccugcucucccugcgcggcgccggggccaucaaggccgaccacgucagcaccuacgccgcguucgugcagacccaccggccgacgggcgaguucauguucgaguucgacgaggacgagauguucuacguggaccuggacaagaaggagaccgucuggcaccucgaggaguucgggcaggccuucuccuucgaggcccagggcgggcuggccaacaucgcgauccugaacaacaaccucaacacccugauccagcgcagcaaccacacccaggccacgaacgacccgcccgaggugaccguguuccccaaggagcccgucgagcugggccagcccaacacccucaucugccacaucgacaaguucuucccgcccgugcugaacgugaccuggcugugcaacggcgagcucgucacggaggggguggccgagucccuguuccugccccggaccgacuacagcuuccacaaguuccacuaccucaccuucgugcccuccgccgaggacuucuacgacugccgcgucgagcacuggggccuggaccagccccugcucaagcacugggaggcccaggagcccauccagaugccggagaccacggagaccgugcugugcgcgcuggggcucgugcugggccuggucgggaucaucgugggcaccgugcucaucaucaagagccugcgguccggccacgacccccgcgcccaggggacccuguga

SEQ ID NO: 31138 - RNA, 777 nt, Artificial Sequence
  derived and/or modified sequence opt1 from HLA-DPB1__Homo_sapiens__NP_002112
augauggugcugcaggucagcgccgcgccccgcaccguggcccucaccgcccugcugauggugcuccugacguccgucgugcagggccgggccaccccggagaacuaccuguuccaggggcgccaggagugcuacgccuucaacggcacccagcgguuccucgagcgcuacaucuacaaccgggaggaguucgcccgcuucgacagcgacgugggggaguuccgggcggucaccgagcugggccgccccgccgccgaguacuggaacucccagaaggacauccuggaggagaagcgggccgugcccgaccgcaugugccggcacaacuacgagcucgggggccccaugacgcugcagcgccgggugcagccgcgcgucaacgugagccccuccaagaagggcccccugcagcaccacaaccuccuggugugccacgucaccgacuucuaccccgggagcauccaggugcggugguuccugaacggccaggaggagaccgcggggguggucuccaccaaccucauccgcaacggcgacuggacguuccagauccuggugaugcuggagaugaccccgcagcagggggacguguacacgugccaggucgagcacaccagccucgacucccccgugaccguggaguggaaggcccagagcgacuccgcccggagcaagacccugaccggcgccggcggguucguccugggccucaucaucugcggggugggcaucuucaugcaccgccgguccaagaaggugcagcgcggcagcgccuga

SEQ ID NO: 31139 - RNA, 768 nt, Artificial Sequence
  derived and/or modified sequence opt1 from HLA-DQA1__Homo_sapiens__NP_002113
augauccugaacaaggcccuccugcugggcgcccucgcgcugaccaccgugaugagccccugcgggggcgaggacaucgucgccgaccacguggccuccugcggggugaaccuguaccaguucuacggcccgagcgggcaguacacgcacgaguucgacggcgacgagcaguucuacgucgaccucgagcgcaaggagaccgccuggcgguggcccgaguucuccaaguucggcggguucgacccccagggcgcccugcgcaacauggcgguggccaagcacaaccugaacaucaugaucaagcgguacaacagcaccgccgccaccaacgaggugcccgaggucacgguguucuccaagagcccggugacccucgggcagcccaacacccugaucugccuggucgacaacaucuucccgcccguggugaacaucaccuggcucuccaacggccagagcgucacggaggggguguccgagaccagcuuccuguccaagagcgaccacuccuucuucaagaucagcuaccugaccuuccuccccuccgcggacgagaucuacgacugcaagguggagcacuggggccuggaccagccccugcucaagcacugggagcccgagauccccgccccgaugagcgagcugaccgagacggucgugugcgcccugggccucuccguggggcugaugggcaucgucguggggaccguguucaucauccagggccugcgcagcgucggcgccucccggcaccaggggccccucuga

SEQ ID NO: 31140 - RNA, 768 nt, Artificial Sequence
  derived and/or modified sequence opt1 from HLA-DQA2__Homo_sapiens__NP_064440
augauccugaacaaggcccuccugcugggcgcccucgcgcugaccgccgugaugagccccugcgggggcgaggacaucgucgccgaccacguggccuccuacggggugaacuucuaccagagccacggcccguccgggcaguacacccacgaguucgacggcgacgaggaguucuacgucgaccuggagacgaaggagaccguguggcagcuccccauguucagcaaguucaucuccuucgacccccagagcgcccugcgcaacauggcggugggcaagcacacccuggaguucaugaugcggcaguccaacagcaccgccgccacgaacgagguccccgaggugaccguguucuccaaguucccggucacccucgggcagcccaacacccugaucugccugguggacaacaucuucccgcccguggucaacaucacguggcucagcaacggccacuccgugaccgagggggugagcgagaccuccuuccugagcaaguccgaccacagcuucuucaagaucuccuaccugaccuuccuccccagcgccgacgagaucuacgacugcaaggucgagcacuggggccuggacgagccccugcucaagcacugggagcccgagauccccgcgccgauguccgagcugacggagacccuggugugcgcccucgggcugagcgugggccugaugggcaucgucguggggaccguguucaucauccagggccuccgcagcgucggggccucccggcaccagggccugcuguga

SEQ ID NO: 31141 - RNA, 810 nt, Artificial Sequence
  derived and/or modified sequence opt1 from HLA-DQB1__Homo_sapiens__NP_001230890
augagcuggaagaaggcccugcgcauccccggcgaccuccggguggccaccgucacccugaugcuggcgaugcucuccagccugcuggccgaggggcgcgacuccccggaggacuucguguuccaguucaagggcaugugcuacuucaccaacgggaccgagcgggugcgccucgucacccgguacaucuacaaccgcgaggaguacgcccgguucgacagcgacgugggcguguaccgcgccgucacgccccaggggcggcccgacgccgaguacuggaacucccagaaggaggugcuggagggcacccgcgcggagcuggacaccgugugccggcacaacuacgaggucgccuuccgcggcauccuccagcggcgcguggagcccaccgugaccaucagcccgucccggaccgaggcccugaaccaccacaaccugcucgucugcagcgugaccgacuucuaccccgggcagaucaaggugcgcugguuccggaacgaccaggaggagaccgccggcgucguguccacgccccugauccgcaacggggacuggaccuuccagauccuggugaugcucgagaugacgccccagcggggcgacgucuacacgugccacguggagcacccgagccugcagucccccaucaccguggaguggcgcgcgcagagcgaguccgcccagagcaagaugcuguccggggucggcggcuucgugcucgggcugaucuuccugggccucgggcugaucauccggcagcgcagccagaagggcccccaggggcccccgcccgccggccugcuccacuga

SEQ ID NO: 31142 - RNA, 684 nt, Artificial Sequence
  derived and/or modified sequence opt1 from HLA-DQB2__Homo_sapiens__NP_001185787
auggcccugcagauccccggcggguucugggccgcggccgugaccgucaugcucgugaugcugagcacccccguggccgaggcccgcgacuuccccaaggacuuccugguccaguucaagggcaugugcuacuucaccaacgggaccgagcgggugcgcggcguggcccgguacaucuacaaccgcgaggaguacgggcgguucgacuccgacgucggcgaguuccaggcggugaccgagcucggccgcagcaucgaggacuggaacaacuacaaggacuuccuggagcaggagcgggccgccguggacaaggucugccgccacaacuacgaggccgagcugcggaccacgcuccagcgccagguggagcccaccgugaccaucucccccagccggaccgaggcgcugaaccaccacaaccugcucgucugcuccgugacggacuucuacccggcccagaucaaggugcgcugguuccggaacgaccaggaggagaccgccggggucgugagcaccucccugauccgcaacggcgacuggaccuuccagauccuggugaugcucgagaucacgccccagcggggcgacaucuacacgugccaggucgagcaccccagccugcagucccccaucaccguggaguggcgcccgcgggggcccccgcccgccgggcugcuccacuga

SEQ ID NO: 31143 - RNA, 765 nt, Artificial Sequence
  derived and/or modified sequence opt1 from HLA-DRA__Homo_sapiens__NP_061984
auggccaucagcggcgugcccguccugggguucuucaucaucgccgugcucauguccgcgcaggagagcugggccaucaaggaggagcacgugaucauccaggccgaguucuaccugaacccggaccaguccggcgaguucauguucgacuucgacggggacgagaucuuccacgucgacauggccaagaaggagaccguguggcgccuggaggaguucggccgguucgccagcuucgaggcgcagggggcccucgccaacaucgccguggacaaggcgaaccuggagaucaugaccaagcgcuccaacuacacgcccaucaccaacgucccgcccgaggugaccgugcugaccaacagccccgucgagcuccgggagcccaacgugcugaucugcuucaucgacaaguucacgccgcccguggucaacgugaccuggcugcgcaacggcaagcccgugaccaccggcgucuccgagacgguguuccucccccgggaggaccaccuguuccgcaaguuccacuaccugcccuuccuccccagcaccgaggacguguacgacugccgggucgagcacugggggcuggacgagccgcugcucaagcacugggaguucgacgcccccagcccccugcccgagaccaccgagaacguggugugcgcccugggccucacggucgggcuggugggcaucaucaucgggaccaucuucaucaucaagggccugcgcaaguccaacgccgccgagcggcgcggcccgcucuga

SEQ ID NO: 31144 - RNA, 801 nt, Artificial Sequence
  derived and/or modified sequence opt1 from HLA-DRB1__Homo_sapiens__NP_001230894
auggugugccugcgccuccccggcgggagcugcauggccguccugaccgugacccugauggugcucuccagcccgcuggcccuggcgggcgacacgcggccccgcuuccucgaguacuccaccagcgagugccacuucuucaacgggaccgagcggguccgcuaccuggaccgguacuuccacaaccaggaggagaacgugcgcuucgacuccgacgugggcgaguuccgggccgucaccgagcuggggcgccccgacgccgaguacuggaacagccagaaggaccuccuggagcagaagcggggccgcguggacaacuacugccggcacaacuacggcguggucgaguccuucacggugcagcgccgggugcaccccaaggucaccguguacccgagcaagacccagccccugcagcaccacaaccuccuggugugcuccgucagcggguucuaccccggcuccaucgaggugcgcugguuccggaacgggcaggaggagaagaccggcguggucagcacggggcugauccacaacggcgacuggaccuuccagacccucgugaugcuggagaccgugccccgcuccggcgaggucuacacgugccagguggagcacccgagcgugaccagcccccugaccgucgaguggcgggcccgcuccgaguccgcccagagcaagaugcucuccggggugggcggguucguccugggccuccuguuccugggcgcggggcuguucaucuacuuccggaaccagaagggccacagcgggcuccagccccgcggcuuccugagcuga

SEQ ID NO: 31145 - RNA, 801 nt, Artificial Sequence
  derived and/or modified sequence opt1 from HLA-DRB3__Homo_sapiens__NP_072049
auggugugccugaagcuccccggcgggagcucccuggccgcccugaccgucacccucauggugcugagcucccgccuggcguucgccggcgacacgcggccgcgcuuccucgagcugcgcaagagcgagugccacuucuucaacgggaccgagcgggugcgguaccuggaccgcuacuuccacaaccaggaggaguuccuccgguucgacuccgacgucggcgaguaccgcgccgugaccgagcuggggcggcccguggccgagagcuggaacucccagaaggaccugcucgagcagaagcgcggccgggucgacaacuacugccgccacaacuacggcgugggggagagcuucaccgugcagcggcgcguccacccccaggugacgguguaccccgccaagacccagccgcugcagcaccacaaccugcucgucugcuccgugagcggcuucuaccccggguccaucgaggugcggugguuccgcaacggccaggaggagaaggcgggggucgugagcaccggccugauccagaacggcgacuggaccuuccagacgcuggugaugcucgagaccgucccccgguccggggagguguacacgugccagguggagcaccccagcgucaccuccgcccugaccguggaguggcgcgcccggagcgaguccgcccagagcaagaugcuguccggcgucgggggcuucgugcucggccugcuguuccucggggcgggccuguucaucuacuuccgcaaccagaaggggcacagcggccugcagccgaccggguuccucagcuga

SEQ ID NO: 31146 - RNA, 801 nt, Artificial Sequence
  derived and/or modified sequence opt1 from HLA-DRB4__Homo_sapiens__NP_068818
auggugugccugaagcuccccggcgggagcugcauggccgcccugaccgucacccugacggugcucuccagcccgcuggcgcuggccggcgacacccagccccgcuuccucgagcaggccaagugcgagugccacuuccugaacgggaccgagcggguguggaaccugauccgcuacaucuacaaccaggaggaguacgcccgguacaacuccgaccucggcgaguaccaggccgucaccgagcuggggcgccccgacgcggaguacuggaacagccagaaggaccugcucgagcggcgccgggccgagguggacacguacugccgcuacaacuacggcguggucgaguccuucaccgugcagcggcgcgugcagcccaaggucaccguguacccgagcaagacccagccccugcagcaccacaaccugcucgugugcuccgucaacggcuucuaccccgggagcaucgaggugcggugguuccgcaacggccaggaggagaaggccgggguggucuccacgggccugauccagaacggggacuggaccuuccagacccuggugaugcucgagaccgugccccggagcggcgaggucuacacgugccagguggagcacccguccaugaugagcccccugaccgugcagugguccgcccgcagcgaguccgcgcagagcaagaugcuguccggcgucgggggcuucgugcucgggcugcuguuccucggcaccggccuguucaucuacuuccggaaccagaaggggcacagcggccugcagcccaccgggcuccuguccuga

SEQ ID NO: 31147 - RNA, 801 nt, Artificial Sequence
  derived and/or modified sequence opt1 from HLA-DRB5__Homo_sapiens__NP_002116
auggugugccugaagcuccccggcgggagcuacauggccaagcugaccgucacccugauggugcucuccagcccgcuggcccuggcgggcgacacgcgcccccgguuccuccagcaggacaaguacgagugccacuucuucaacgggaccgagcgcgugcgguuccugcaccgcgacaucuacaaccaggaggaggaccugcgguucgacuccgacgucggcgaguaccgcgccgugaccgagcucgggcggcccgacgccgaguacuggaacagccagaaggacuuccuggaggaccgccgggccgccguggacaccuacugccgccacaacuacggcgucggcgaguccuucacggugcagcggcgcguggagcccaaggucaccguguacccggcgcggacccagacccugcagcaccacaaccuccuggugugcagcgucaacggguucuaccccggcuccaucgaggugcgcugguuccggaacagccaggaggagaaggccgggguggucuccacgggccugauccagaacggggacuggaccuuccagacccucgugaugcuggagaccgugccccgcagcggcgaggucuacacgugccagguggagcaccccuccgugaccagcccgcugaccgucgaguggcgggcccaguccgagagcgcccaguccaagaugcucagcggcgucgggggcuucgugcuggggcuccuguuccugggcgcgggccuguucaucuacuucaagaaccagaaggggcacuccggccuccaccccaccgggcuggugagcuga

SEQ ID NO: 31148 - RNA, 1077 nt, Artificial Sequence
  derived and/or modified sequence opt1 from HLA-E__Homo_sapiens__NP_005507
augguggacggcacccugcuccugcugcucagcgaggcccuggcccugacccagaccugggcggggucccacagccucaaguacuuccacaccuccgucagccgccccggccgcggggagccgcgguucaucuccgugggcuacguggacgacacccaguucguccgguucgacaacgacgccgccagcccccgcauggugccccgggcccccuggauggagcaggagggguccgaguacugggaccgcgagacccggagcgcccgcgacacggcgcagaucuuccgggugaaccugcgcacccugcggggcuacuacaaccaguccgaggccggcagccacacccuccaguggaugcacgggugcgagcugggcccggacgggcgcuuccugcggggcuacgagcaguucgccuacgacgggaaggacuaccucacccugaacgaggaccugcgcuccuggacggccgucgacaccgcggcccagaucagcgagcagaaguccaacgacgccagcgaggccgagcaccagcgggccuaccucgaggacacgugcguggaguggcugcacaaguaccuggagaagggcaaggagacccuccugcaccuggagccgcccaagacccacgugacccaccaccccaucuccgaccacgaggcgacccuccgcugcugggcccugggcuucuaccccgccgagaucacccugacguggcagcaggacggggagggccacacccaggacaccgagcucgucgagacccggcccgccggggacggcacguuccagaagugggccgcgguggugguccccagcggcgaggagcagcgcuacacgugccacgugcagcacgaggggcugcccgagccggugacccugcgguggaagcccgccucccagcccaccauccccaucgucggcaucaucgccgggcucgugcugcugggcagcguggucuccggggccgugguggccgcggucaucuggcgcaagaaguccagcggcggcaagggcgggagcuacagcaaggccgagugguccgacagcgcccagggguccgagagccacucccucuga

SEQ ID NO: 31149 - RNA, 765 nt, Artificial Sequence
  derived and/or modified sequence opt1 from HLA-F__Homo_sapiens__NP_001091948
auggcgccccgcagccugcuccugcugcucuccggcgcccuggcccugaccgacaccugggccgggagccacucccuccgguacuucagcacggccgugucccgcccgggccgcggggagccccgguacaucgccgucgaguacguggacgacacccaguuccugcgguucgacagcgacgccgcgaucccccgcauggagccccgggagccguggguggagcaggagggcccccaguacugggaguggaccaccggguacgccaaggccaacgcccagacggaccgcgucgcgcugcggaaccuccugcgccgguacaaccaguccgaggccggcagccacacccugcagggcaugaacgggugcgacaugggccccgacgggcgccuccugcggggcuaccaccagcacgccuacgacgggaaggacuacaucucccugaacgaggaccuccgcagcuggaccgccgccgacaccguggcgcagaucacgcagcgguucuacgaggccgaggaguacgccgaggaguuccgcaccuaccuggagggcgagugccuggagcuccugcggcgcuaccuggagaacggcaaggagacccuccagcgggccgagcagagcccccagccgaccauccccaucguggggaucgucgccggccugguggugcugggggcggucgugacgggcgccguggucgccgccgugauguggcgcaagaaguccuccgaccggaaccgcggcagcuacucccaggccgcgguguga

SEQ ID NO: 31150 - RNA, 1017 nt, Artificial Sequence
  derived and/or modified sequence opt1 from HLA-G__Homo_sapiens__NP_002118
augguggucauggcgccccgcacccuguuccuccugcugagcggcgcccucacccugacggagaccugggccgggucccacagcaugcgguacuucuccgccgccgugagccgcccgggccgcggggagccccgguucaucgccaugggcuacguggacgacacccaguucguccgguucgacuccgacagcgccugcccccgcauggagccccgggcgccguggguggagcaggaggggcccgaguacugggaggaggagacccgcaacacgaaggcccacgcccagaccgaccggaugaaccugcagacccuccgcggcuacuacaaccaguccgaggccagcucccacacccugcaguggaugaucggcugcgaccuggggagcgacggccggcuccugcgcggguacgagcaguacgcguacgacggcaaggacuaccuggcccucaacgaggaccugcgguccuggacggccgccgacaccgccgcgcagaucagcaagcgcaagugcgaggccgccaacguggccgagcagcggcgcgccuaccuggaggggaccugcgucgaguggcuccaccgguaccuggagaacggcaaggagaugcugcagcgcgcggacccgcccaagacccacgugacgcaccaccccguguucgacuacgaggccacccuccggugcugggcccugggcuucuaccccgccgagaucauccugaccuggcagcgcgacggggaggaccagacccaggacgucgagcucguggagacgcggcccgccggcgacgggaccuuccagaagugggcggccguggucgugcccuccggcgaggagcagcgcuacacgugccacgugcagcacgagggccugccggagccccugaugcuccgcuggaagcagagcucccugcccaccauccccaucauggggaucgucgccggccugguggugcucgccgccgucgugaccggggcggccguggccgccguccuguggcggaagaaguccagcgacuga

SEQ ID NO: 31151 - RNA, 2622 nt, Artificial Sequence
  derived and/or modified sequence opt1 from HLCS__Homo_sapiens__XP_005261010
augcugaucacccucugcuaccuguaccugugggcccgcuggggccggcgccccgccgagcucgugcgggcgaccguccgccggcugcgcgccagccggugcuccuucacguucugcggggccgccgcccagccgcccggcgcgcgcgugugccugagccgcgggggccggguguucugcgucuccgacagccaguccaucgaggaccucaacaagugggcccuguuccuggugagccccuucauccucgaggccgagcacaucgccuucgugaccgaguccaucuggguccagagcgagaaccugcagcgguccagcuccagcgagaccaucgugaagugguccgacugcugccugccccucgcgugccgcccgggggaccccuaccggcugaucgccgaggccagcguggacaacuucuccaagcugggcgucgccuucauggaggaccgccuccacauggacaacggccuggugccccagaagaucgugagcguccaccuccaggacuccacccugaaggaggugaaggaccaggugagcaacaagcaggcccagauccuggagcccaagccggagcccucccuggagaucaagcccgagcaggacgggauggagcacgucggccgggacgaccccaaggcgcucggggaggagccgaagcagcgccggggcagcgccagcggguccgagcccgccggcgacagcgaccgcggcgggggccccguggagcacuaccaccuccaccuguccagcugccacgagugccuggagcuggagaacuccacgaucgagagcgugaaguucgccuccgccgagaacauccccgaccugccguacgacuacagcuccagccucgaguccgucgcggacgagaccagccccgagcgggaggggcgccgggugaaccugaccggcaaggcccccaacauccugcucuacgugggcuccgacagccaggaggcccuggggcgcuuccacgagguccgcuccgugcuggccgacugcguggacaucgacagcuacauccucuaccaccuccuggaggacuccgcccugcgggaccccuggaccgacaacugccugcugcucgucaucgcgacgcgcgagagcaucccggaggaccuguaccagaaguucauggccuaccugucccagggcgggaaggugcucggccugagcagcuccuucaccuucgggggcuuccaggucaccagcaagggcgcccugcacaagaccgugcagaaccucguguucuccaaggccgaccagagcgaggucaagcuguccgugcugagcuccgggugccgguaccaggagggccccgugcgccucagccccgggcggcugcagggccaccuggagaacgaggacaaggaccgcaugaucguccacgugcccuucgggacgcggggcggcgaggccgugcugugccagguccaccucgagcugccgcccuccagcaacaucgugcagacccccgaggacuucaaccugcucaaguccagcaacuuccgccgguacgaggugcugcgcgagauccugaccacccucgggcuguccugcgacaugaagcagguccccgcgcugacgccgcucuaccugcugagcgccgccgaggagauccgggacccccucaugcaguggcugggcaagcacguggacuccgagggggagaucaagagcggccagcugucccuccgcuucgugagcagcuacgucuccgagguggagaucacccccagcugcaucccgguggucaccaacauggaggccuucuccagcgagcacuucaaccuggagaucuaccggcagaaccugcagaccaagcagcucgggaaggugauccuguucgcggaggugacgcccaccaccaugcgccugcucgacggccugauguuccagacgccccaggagaugggccugaucgucaucgccgcccggcagaccgaggggaagggccgcgggggcaacguguggcucucccccgugggcugcgcccugagcacccugcucaucuccaucccgcugcggagccagcuggggcagcgcauccccuucguccagcaccucauguccguggccguggucgaggcggugcggagcauccccgaguaccaggacaucaaccugcgcgugaaguggcccaacgacaucuacuacuccgaccugaugaagaucggcgggguccucgugaacagcacccugaugggcgagaccuucuacauccugaucgggugcggcuucaacgugacgaacuccaacccgaccaucugcaucaacgaccucaucaccgaguacaacaagcagcacaaggccgagcugaagccccugcgcgccgacuaccucaucgcccgggucgugaccgugcuggagaagcugaucaaggaguuccaggacaagggccccaacagcguccucccccuguacuaccgcuacugggugcacuccgggcagcagguccaccugggcagcgccgaggggccgaagguguccaucgugggccucgacgacagcggguuccuccaggugcaccaggagggcggcgaggucgugacggugcaccccgacgggaacuccuucgacaugcugcggaaccugauccugcccaagcgccgguga

SEQ ID NO: 31152 - RNA, 888 nt, Artificial Sequence
  derived and/or modified sequence opt1 from HLF__Homo_sapiens__NP_002117
auggagaagaugagccgcccccugccgcucaaccccaccuucaucccgccgcccuacggcgugcugcggucccugcucgagaacccccugaagcugccccuccaccacgaggacgccuucagcaaggacaaggacaaggagaagaagcuggacgacgaguccaacagccccaccgucccccaguccgccuuccuggggcccacgcucugggacaagacccugcccuacgacggcgacaccuuccagcuggaguacauggaccucgaggaguuccugagcgagaacgggaucccgcccucccccagccagcacgaccacagcccccacccgcccggccugcagcccgcguccuccgccgcccccagcgugauggaccucuccagccgcgccuccgcgccccugcacccggggauccccagccccaacugcaugcagucccccauccggccgggccagcugcuccccgccaaccgcaacacccccagccccaucgacccggacacgauccaggugcccgucggcuacgagcccgacccggccgaccuggcccuguccagcauccccgggcaggagauguucgacccccggaagcgcaaguucagcgaggaggagcucaagccccagccgaugaucaagaaggcccggaagguguucauccccgacgaccugaaggacgacaaguacugggcgcgccggcgcaagaacaacauggccgccaagcggucccgcgacgcccggcgccugaaggagaaccagaucgccauccgggcgagcuuccucgagaaggagaacuccgcccugcgccaggagguggccgaccugcggaaggagcucggcaagugcaagaacauccuggccaaguacgaggcccgccacgggccccuguga

SEQ ID NO: 31153 - RNA, 3030 nt, Artificial Sequence
  derived and/or modified sequence opt1 from HLTF__Homo_sapiens__NP_003062
augagcuggauguucaagcgcgaccccguguggaaguaccugcagaccguccaguacggcgugcacgggaacuucccgcggcucuccuaccccaccuucuucccccgcuucgaguuccaggacgugaucccgcccgacgacuuccugacgagcgacgaggaggucgacuccgugcuguucggcagccuccgggggcacguggucggccugcgcuacuacaccgggguggugaacaacaacgagauggucgcccugcagcgggaccccaacaaccccuacgacaagaacgccaucaaggugaacaacgugaacggcaaccaggucggccaccucaagaaggagcuggcgggggcccuggccuacaucauggacaacaagcucgcccagaucgagggcguggugcccuucggggccaacaacgcguucaccaugccgcugcacaugaccuucuggggcaaggaggagaaccgcaaggccgucuccgaccagcugaagaagcacggguucaagcucggccccgcccccaagacgcugggcuucaaccuggagagcggguggggcuccgggcgggccggccccagcuacuccaugccggugcacgcggccgugcagaugaccaccgagcagcucaagaccgaguucgacaagcuguucgaggaccugaaggaggacgacaagacgcacgagauggagcccgccgaggccaucgagacgccccuccugccccaccagaagcaggcccuggcguggauggucagccgcgagaacuccaaggagcucccgcccuucugggagcagcggaacgaccuguacuacaacaccaucaccaacuucagcgagaaggaccgccccgagaacgugcacggcgggauccuggccgacgacaugggccucgggaagacccugaccgccaucgccgugauccugaccaacuuccacgacggccggccccucccgaucgagcgcgucaagaagaaccugcugaagaaggaguacaacgugaacgacgacuccaugaagcucgggggcaacaacaccagcgagaaggccgacggccuguccaaggacgcgagccggugcuccgagcagcccagcaucuccgacaucaaggagaaguccaaguuccgcaugagcgagcugagcagcucccggcccaagcgccggaagacggccgugcaguacaucgagagcuccgacagcgaggagaucgagaccuccgagcucccccagaagaugaaggggaagcugaagaacguccagagcgagaccaagggccgcgccaaggccggguccagcaaggugaucgaggacgucgccuucgcgugcgcccugaccuccagcgugccgacgaccaagaagaagaugcucaagaagggcgccugcgccguggagggguccaagaagaccgacgucgaggagcggccccgcaccacgcugaucaucugcccccugagcgugcucuccaacuggaucgaccaguucggccagcacaucaagagcgacgugcaccugaacuucuacgucuacuacggccccgaccggauccgcgagccggcccugcucuccaagcaggacaucgugcugaccaccuacaacauccugacccacgacuacgggacgaagggcgacagcccccuccacuccauccgcuggcugcgggugauccuggacgaggggcacgcgauccgcaaccccaacgcccagcagaccaaggccguccucgaccuggagagcgagcggcgcugggugcugaccggcaccccgauccagaacagccugaaggaccucuggucccugcugagcuuccucaagcugaagcccuucaucgaccgggagugguggcaccgcacgauccagcggcccgugaccaugggggacgagggcggccugcgccggcuccagucccugaucaagaacaucacccugcgccggaccaagacgagcaagaucaaggggaagcccguccucgagcugccggagcgcaagguguucauccagcacaucacccuguccgacgaggagcggaagaucuaccagagcgugaagaacgagggccgcgccaccaucgggcgguacuucaacgagggcaccguccucgcgcacuacgccgacgugcugggccugcuccugcgccugcggcagaucugcugccacaccuaccuccugacgaacgccguguccagcaacgggcccuccggcaacgacacccccgaggagcugcgcaagaagcucauccggaagaugaagcugauccugagcuccgggagcgacgaggagugcgccaucugccucgacucccugaccguccccgugaucacccacugcgcccacguguucugcaagccgugcaucugccaggucauccagaacgagcagccccacgcgaagugcccccugugccgcaacgacauccacgaggacaaccuccuggagugcccgcccgaggagcuggcccgcgacagcgagaagaaguccgacauggaguggacgagcuccagcaagaucaacgcccucaugcacgcccugaccgaccugcggaagaagaaccccaacaucaagagccucguggugucccaguucaccaccuuccugagccugaucgagaucccccucaaggccuccggcuucgucuucacgcgccuggacgggagcauggcgcagaagaagcggguggaguccauccagugcuuccagaacaccgaggccggcagccccaccaucaugcugcucucccugaaggccggcggggugggccugaaccucagcgccgccucccgcgucuuccugauggacccggcguggaaccccgccgccgaggaccagugcuucgaccggugccaccgccuggggcagaagcaggaggugaucaucaccaaguucaucgugaaggacagcgucgaggagaacaugcucaagauccagaacaagaagcgggagcuggccgcgggcgccuucgggacgaagaagcccaacgccgacgagaugaagcaggccaagaucaacgagauccgcacccugaucgaccucuga

SEQ ID NO: 31154 - RNA, 1467 nt, Artificial Sequence
  derived and/or modified sequence opt1 from HLX__Homo_sapiens__NP_068777
auguucgccgccggccuggcgcccuucuacgccagcaacuucucccucuggagcgccgccuacugcuccagcgccgggccgggcgggugcuccuucccccuggaccccgcggccgugaagaagcccagcuucugcaucgccgacauccugcacgccggcgucggggaccucggcgcggccccggagggccuggccggggccuccgccgcggcccugaccgcccaccucggcagcgugcacccccacgccuccuuccaggccgcggcccgcagcccccugcggcccaccccgguggucgcccccuccgaggugcccgccggguucccccagcgccugagcccgcucuccgccgcguaccaccaccaccacccccagcagcagcagcagcagcagcagccccagcagcagcagcccccgcccccgccccgggccggcgcccugcagccgcccgccagcgggacgcgcgugguccccaacccccaccacuccggcagcgccccggcgcccuccagcaaggaccugaaguucggcaucgaccggauccucuccgccgaguucgaccccaaggugaaggaggggaacacccugcgcgaccugaccagccuccugaccggcgggcggcccgccggcgugcaccugagcggccuccagccguccgccgggcaguucuucgcgagccuggaccccaucaacgaggccuccgccauccugagcccccucaacuccaacccgcgcaacagcguccagcaccaguuccaggacacguuccccggccccuacgccgugcugaccaaggacaccaugccccagaccuacaagcggaagcgcuccuggagccgggccguguucuccaaccugcagcgcaaggggcucgagaagcgguucgagauccagaaguacgucacgaagccggaccgcaagcagcuggcggccaugcugggccucaccgacgcccaggugaaggugugguuccagaaccggcgcaugaaguggcggcacagcaaggaggcccaggcccagaaggacaaggacaaggaggcgggggagaagcccuccggcggcgcccccgccgccgacggggagcaggacgagcgcagccccucccggagcgagggcgaggccgaguccgagagcuccgacagcgagucccuggacauggcgccgagcgacaccgagcgcaccgaggggagcgagcggucccugcaccagacgaccgucaucaaggcccccgugaccggcgcccucaucaccgccagcuccgcggggagcggcggcuccagcgggggcgggggcaacuccuucagcuucuccagcgccuccagccuguccagcuccagcacguccgccgggugcgccagcagccugggcggcgggggcgccuccgagcuccugcccgcgacccagcccaccgccagcuccgcccccaagagccccgagcccgcccagggggcccugggcugccucuga

SEQ ID NO: 31155 - RNA, 1134 nt, Artificial Sequence
  derived and/or modified sequence opt1 from HM13__Homo_sapiens__NP_110416
auggacagcgcccuguccgacccccacaacggcagcgccgaggccgggggcccgaccaacuccaccacgcgcccgcccagcacccccgaggggaucgcgcucgccuacggcucccugcugcucauggcccugcugcccaucuucuucggggcccuccggagcgugcgcugcgcgcggggcaagaacgccuccgacaugcccgagaccaucaccagccgcgacgccgcccgguuccccaucaucgcguccugcacgcugcugggccucuaccuguucuucaagaucuucagccaggaguacaucaaccugcuccuguccauguacuucuucguccuggggauccucgcccugagccacaccaucucccccuucaugaacaaguucuucccggccagcuuccccaaccgccaguaccagcuccuguucacccagggcuccggggagaacaaggaggagaucaucaacuacgaguucgacaccaaggaccuggugugccugggccucagcuccaucgugggggucugguaccugcugcggaagcacuggaucgccaacaaccucuucggccuggccuucagccugaacggcguggagcuccugcaccugaacaacguguccacggggugcauccuccugggcgggcuguucaucuacgacgucuucuggguguucggcaccaacgugauggucaccguggccaagagcuucgaggcgcccaucaagcucguguucccccaggaccugcuggagaagggccucgaggccaacaacuucgccaugcuggggcugggcgacgucgugaucccggggaucuucaucgcccuccugcugcgcuucgacaucagccucaagaagaacacccacacguacuucuacaccuccuucgcggccuacaucuucggccuggggcugaccaucuucaucaugcacaucuucaagcacgcccagcccgcccuccuguaccuggugcccgccugcaucggcuuccccguccucguggcgcuggccaagggcgaggugaccgagauguucagcuacgaggaguccaacccgaaggaccccgccgccgucacggagagcaaggaggggaccgaggccuccgcgagcaagggccuggagaagaaggagaaguga

SEQ ID NO: 31156 - RNA, 1263 nt, Artificial Sequence
  derived and/or modified sequence opt1 from HMBOX1__Homo_sapiens__NP_001129198
augcugagcuccuuccccgugguccuccuggagaccaugagccacuacaccgacgagccgcgcuucacgaucgagcagaucgaccugcuccagcggcugcgccggaccggcaugaccaagcacgagauccugcacgcccucgagacccuggaccgccuggaccaggagcacuccgacaaguucgggcggcgcagcuccuacggcgggagcuccuacggcaacagcacgaacaacgugcccgccuccagcuccaccgcgaccgccagcacccagacgcagcacuccgggaugagccccucccccagcaacuccuacgacaccagcccgcagcccugcaccaccaaccagaacggccgggagaacaacgagcgccucuccacgagcaacggcaagaugagccccacccgguaccacgccaacuccauggggcagcgcagcuacuccuucgaggccagcgaggaggaccuggacguggacgacaaggucgaggagcugaugcggcgcgacuccagcgugaucaaggaggagaucaaggccuuccucgcgaaccggcgcaucucccaggccguggucgcccaggugaccggcaucagccagucccggaucagccacuggcugcugcagcagggguccgaccucagcgagcagaagaagcgcgccuucuaccggugguaccagcuggagaagaccaaccccggcgcgacgcuguccaugcgcccggcccccauccccaucgaggaccccgaguggcggcagaccccgccgcccgugagcgccaccuccgggaccuuccgccuccggcgcggcagccgcuucacguggcggaaggagugccuggccgucauggaguccuacuucaacgagaaccaguaccccgacgaggccaagcgcgaggagaucgcgaacgccugcaacgccgugauccagaagcccggcaagaagcugagcgaccucgagcgggugaccucccugaaggucuacaacugguucgccaaccgccggaaggagaucaagcgccgggccaacaucgaggcggccauccuggagagccacgggaucgacgugcagagccccggcgggcacuccaacagcgacgacguggacggcaacgacuacuccgagcaggacgacagcaccucccacagcgaccaccaggaccccaucucccucgccgucgagauggccgccgugaaccacaccauccuggcgcuggcccgccagggcgccaacgagaucaagacggaggcccucgacgacgacuga

SEQ ID NO: 31157 - RNA, 1086 nt, Artificial Sequence
  derived and/or modified sequence opt1 from HMBS__Homo_sapiens__NP_000181
augagcggcaacgggaacgccgccgcgaccgccgaggagaacucccccaagaugcgcgugauccgggucggcacccgcaagagccagcuggcccggauccagacggacuccgugguggccacccucaaggccagcuacccggggcugcaguucgagaucaucgcgauguccaccaccggcgacaagauccuggacacggcccucagcaagaucggggagaagucccuguucaccaaggagcuggagcacgcccucgagaagaacgaggucgaccugguggugcacagccugaaggaccuccccaccguccugccgcccggcuucaccaucggcgccaucugcaagcgcgagaacccccacgacgcggugguguuccaccccaaguucgucgggaagacgcuggagacccuccccgagaaguccguggugggcaccagcucccugcggcgcgccgcccagcugcagcggaaguucccccaccucgaguuccgcagcauccgggggaaccugaacacccgccugcggaagcucgacgagcagcaggaguucuccgccaucauccuggccacggcgggccugcagcgcaugggguggcacaaccgggucggccagauccuccacccggaggagugcauguacgccgugggccagggggcccugggcguggagguccgcgccaaggaccaggacauccuggaccucgugggggugcugcacgaccccgagacccugcuccggugcaucgccgagcgcgcguuccugcggcaccuggagggcggcugcagcguccccguggccgugcacaccgccaugaaggacgggcagcucuaccugaccggcggggucuggucccuggacggcagcgacuccauccaggagacgaugcaggccaccauccacgugcccgcccagcacgaggacgggccggaggacgacccccagcucgugggcaucaccgcgcgcaacaucccccggggcccccagcuggccgcccagaaccuggggaucagccucgccaaccugcugcucuccaagggcgccaagaacauccuggacgucgcgcgccagcugaacgacgcccacuga

SEQ ID NO: 31158 - RNA, 16908 nt, Artificial Sequence
  derived and/or modified sequence opt1 from HMCN1__Homo_sapiens__NP_114141
augaucagcugggaggugguccacaccguguuccuguucgcccuccuguacuccagccuggcccaggacgcguccccccagagcgagauccgcgccgaggagaucccggagggcgccuccacccucgccuucguguucgacgucacggggagcauguacgacgaccuggugcaggugaucgagggcgccuccaagauccuggagaccagccucaagcggcccaagcgcccccuguucaacuucgcgcugguccccuuccacgacccggagaucgggcccgugaccaucaccacggaccccaagaaguuccaguacgagcuccgggagcuguacgugcagggcgggggcgacugccccgagauguccaucggcgccaucaagaucgcccuggagaucagccucccgggguccuucaucuacgucuucaccgacgcccgcagcaaggacuaccggcugacccacgaggugcugcagcucauccagcagaagcagucccagguggucuucgugcugaccggcgacugcgacgaccgcacgcacaucggguacaagguguacgaggagaucgcgagcaccuccagcggccaggucuuccaccuggacaagaagcaggugaacgaggugcucaagugggucgaggaggccgugcaggccuccaaggugcaccugcugagcaccgaccaccucgagcaggccgucaacaccuggcggauccccuucgaccccucccugaaggaggugacggugagccugagcgggcccuccccgaugaucgagauccgcaacccccucggcaagcugaucaagaagggcuucgggcugcacgagcuccugaacauccacaacagcgccaaggucgugaacgucaaggagcccgaggcgggcauguggaccgugaagaccuccagcuccgggcggcacagcgugcgcaucaccggccuguccacgaucgacuuccgggccggcuucagccgcaagcccacccucgacuucaagaagaccgucucccggccggugcaggggauccccaccuacgugcugcugaacacgagcggcaucuccacccccgcccgcaucgaccuccuggagcugcucagcaucuccgggagcucccugaagaccauccccgucaaguacuacccgcaccggaagcccuacggcaucuggaacaucagcgacuucgugccccccaacgaggccuucuuccugaaggugaccggguacgacaaggacgacuaccucuuccagcgcgucuccagcguguccuucagcagcaucgugccggacgcccccaaggucacgaugcccgagaagacccccggcuacuaccugcagccgggccagauccccugcuccguggacagccugcuccccuucacccuguccuucgugcggaacggggucacccugggcguggaccaguaccucaaggagagcgcguccgugaaccuggacaucgccaaggucacgcugagcgacgagggguucuacgagugcaucgccguguccagcgccggcaccgggcgcgcccagaccuucuucgacguguccgagccgccccccgucauccaggugcccaacaacgugaccgucacgccgggcgagcgggcggugcucaccugccugaucaucagcgccguggacuacaaccugaccuggcagcgcaacgaccgggacguccgccuggccgagcccgcccgcauccggacccucgccaaccugucccuggagcucaagagcgugaaguucaacgacgcgggcgaguaccacugcaugguguccagcgaggggggcuccagcgccgccuccgucuuccugacggugcaggagccccccaaggugaccgucaugccgaagaaccagagcuucaccgggggcagcgagguguccaucaugugcagcgccaccggguaccccaagcccaagaucgcguggaccgugaacgacauguucaucgucggcucccaccgcuaccggaugacgagcgacggcacccuguucaucaagaacgccgcccccaaggacgccgggaucuacggcugccucgccuccaacagcgcggggaccgacaagcagaacuccacccugcgcuacaucgaggccccgaagcugaugguggugcagagcgagcuccuggucgcccugggcgacaucacggugauggagugcaagaccuccggcaucccccccccccaggugaagugguucaagggggaccucgagcugcggccgagcaccuuccugaucaucgacccccuccugggccugcucaagauccaggagacccaggaccuggacgccggggacuacacgugcgucgccaucaacgaggcgggccgcgccaccgggaagaucacccuggacgugggcuccccccccguguucauccaggagccggccgacgucagcauggagaucggcuccaacgugacccuccccugcuacgugcagggguaccccgagcccacgaucaaguggcggcgccuggacaacaugccgaucuucagccggcccuucuccgucagcuccaucagccagcugcgcaccggcgcccucuucauccugaaccugugggccuccgacaaggggaccuacaucugcgaggcggagaaccaguucggcaagauccagagcgagaccacggugaccgugaccgggcucgucgccccccugaucggcaucagcccguccguggccaacgucaucgagggccagcagcugacccuccccugcacgcugcuggccgggaaccccauccccgagcggcgcuggaucaagaacagcgcgaugcuccugcagaacccguacaucaccgugcgguccgacggcagccugcacaucgagcgcgugcagcuccaggacgggggcgaguacaccugcgucgccuccaacguggccgggaccaacaacaagacgaccagcguggucgugcacgugcugcccaccauccagcacggccagcagauccuguccaccaucgagggcauccccgucacgcuccccugcaaggccagcgggaacccgaagcccuccgugaucuggagcaagaagggcgagcugaucuccaccagcuccgccaaguucagcgcgggggccgacggcucccuguacguggucagccccgggggcgaggaguccggcgaguacgugugcaccgccaccaacacggccggguacgccaagcggaaggugcagcucaccgucuacgugcgcccccggguguucggcgaccagcgcgggcugagccaggacaagccggucgagaucuccgugcuggcgggcgaggaggugacccuccccugcgaggucaagagccugccccccccgaucaucaccugggccaaggagacgcagcugaucagccccuucuccccccggcacaccuuccuccccagcggcuccaugaagaucaccgagacccgcaccagcgacuccgggauguaccugugcguggccacgaacaucgccggcaacgugacccaggccgucaagcugaacgugcacgugccgcccaagauccagcgcgggcccaagcaccucaagguccaggugggccagcggguggacauccccugcaacgcgcaggggaccccgcugcccgucaucaccuggagcaagggcggcuccacgaugcugguggacggggagcaccacgugagcaaccccgacggcacccucuccaucgaccaggccacccccagcgacgccgggaucuacaccugcgucgccacgaacaucgcgggcaccgacgagaccgagaucacccugcacgugcaggagccgcccacgguggaggaccuggagcccccguacaacaccaccuuccaggagcgcgucgccaaccagcggaucgaguuccccugccccgccaaggggacccccaagccgacgaucaaguggcuccacaacggccgcgagcugaccggccgggagcccgggaucuccauccuggaggacggcacccuccuggugaucgccagcgugacccccuacgacaacggggaguacaucugcgucgccgugaacgaggcgggcacgaccgagcgcaaguacaaccugaaggugcacguccccccggugaucaaggacaaggagcaggugaccaacgucuccgugcuccugaaccagcugaccaaccucuucugcgagguggaggggacgcccagccccaucaucaugugguacaaggacaacguccaggugaccgaguccagcaccauccagaccgugaacaacggcaagauccugaagcuguuccgggccacgcccgaggacgccggccgcuacuccugcaaggccaucaacaucgccgggaccagccagaaguacuucaacaucgacguccucgugccgcccaccaucaucggcaccaacuuccccaacgaggucuccguggugcugaaccgggacgucgcgcuggagugccaggugaaggggacgcccuucccggacauccacugguucaaggacggcaagccccucuuccugggcgaccccaacguggagcugcucgaccgcgggcagguccugcaccugaagaacgcccggcgcaacgacaagggccgguaccagugcaccgugagcaacgccgccgggaagcaggccaaggacaucaagcucaccaucuacauccccccgagcaucaagggcgggaacgugaccacggacaucuccguccugaucaacagccugaucaagcucgagugcgagacccgcggccugcccaugcccgcgaucaccugguacaaggacggccagcccaucauguccagcucccaggcccuguacaucgacaaggggcaguaccuccacaucccgcgggcccaggugagcgacuccgccaccuacaccugccacguggccaacgucgcgggcacggccgagaagagcuuccacguggacguguacgucccccccaugaucgaggggaaccuggccaccccccugaacaagcagguggugaucgcccacucccucacccuggagugcaaggcggccggcaacccgagccccauccugaccuggcucaaggacgggguccccgugaaggccaacgacaacauccgcaucgaggccggcggcaagaagcuggagaucauguccgcccaggagaucgaccgggggcaguacaucugcguggcgacgagcgucgccggcgagaaggagaucaaguacgagguggacgugcuggucccgcccgccaucgaggggggcgacgagaccuccuacuucaucgugauggugaacaaccuccuggagcuggacugccacgucaccgggagcccccccccgaccaucauguggcugaaggacggccagcucaucgacgagcgcgacggcuucaagauccugcugaacgggcggaagcucgugaucgcccaggcccagguguccaacacgggccuguaccgcugcauggcggccaacaccgccggggaccacaagaaggaguucgaggucaccgugcacgugccccccaccaucaagagcuccggccugagcgagcgggucguggugaaguacaagcccgucgcccuccagugcaucgccaacgggaucccgaaccccuccaucacguggcugaaggacgaccagcccgugaacaccgcgcagggcaaccugaagauccagagcagcggccgcgugcuccagaucgccaagacccugcuggaggacgccgggcgcuacaccugcgucgccacgaacgcggccggcgagacccagcagcacauccagcuccacgugcacgagcccccgucccuggaggacgccgggaagaugcugaacgagaccgugcucgucagcaaccccgugcagcuggagugcaaggccgccggcaaccccgugcccgucaucaccugguacaaggacaaccggcugcucuccggcagcacguccaugaccuuccugaaccgcgggcagaucaucgacaucgagagcgcgcagaucuccgacgccggcaucuacaagugcguggccaucaacagcgccggggccaccgagcuguucuacucccuccaggugcacgucgcgccgagcaucuccggcagcaacaacaugguggccguggucgugaacaaccccguccggcuggagugcgaggcccgcgggauccccgcccccucccugaccuggcucaaggacggcagcccgguguccagcuucuccaacggccugcaggugcugagcgggggccggauccucgcccugacguccgcgcagaucagcgacaccgggcgcuacaccugcgucgccgugaacgccgccggcgagaagcagcgggacaucgaccugcgcguguacgucccccccaacaucaugggggaggagcagaacgugagcgugcucaucucccaggcggucgagcugcugugccagagcgacgccauccccccgcccacccucacguggcugaaggacggccacccccugcucaagaagccgggccuguccaucagcgagaaccgguccgugcugaagaucgaggacgcccaggugcaggacaccgggcgcuacaccugcgaggccaccaacgucgccggcaagacggagaagaacuacaacgugaacaucugggugccccccaacaucgggggcagcgacgagcucacccagcugaccgucaucgaggggaaccugaucucccuccugugcgagagcuccggcauccccccgcccaaccugaucuggaagaagaagggcagccccgugcucaccgacuccauggggcgggugcgcauccugagcggcgggcggcagcugcagaucuccaucgcggagaagagcgacgccgcccucuacuccugcgucgccagcaacguggccggcacggcgaagaaggaguacaaccugcagguguacauccgccccaccaucaccaacuccgggagccacccgaccgagaucaucgucacgcggggcaagagcaucucccuggagugcgaggugcagggcauccccccccccaccgugaccuggaugaaggacgggcacccgcucaucaaggccaagggcgucgagauccuggacgaggggcacauccugcagcucaagaacauccacgugagcgacaccggccgcuacgugugcgucgccgugaacguggccggcaugaccgacaagaaguacgaccuguccguccacgccccccccagcaucaucgggaaccaccggucccccgagaacaucagcgugguggagaagaacuccgucagccugacgugcgaggcguccggcaucccgcuccccagcaucaccugguucaaggacggguggcccgugucccugagcaacuccgugcgcauccugagcggcgggcggaugcuccgccugaugcagaccaccauggaggacgccggccaguacacgugcgucgugcgcaacgccgccggcgaggagcggaagaucuucgggcuguccgugcucguccccccgcacaucgugggcgagaacacccuggaggacgugaaggucaaggagaagcagagcgugacccugaccugcgaggugacggggaaccccguccccgagaucaccuggcacaaggacggccagccccuccaggaggacgaggcccaccacaucaucuccgggggccgcuuccugcagaucaccaacgugcaggugccgcacaccggccgguacacgugccuggcgagcucccccgccgggcacaagagccgcagcuucucccucaacgucuucgugagccccaccaucgccggcgugggguccgacggcaaccccgaggacgucaccgugauccugaacagcccgaccucccuggucugcgaggccuacagcuacccccccgcgacgaucaccugguucaaggacgggaccccgcucgaguccaaccggaacauccgcauccugcccggcggccggacccugcagauccucaacgcccaggaggacaacgccgggcgcuacagcugcguggccacgaacgaggccggcgagaugaucaagcacuacgaggugaaggucuacaucccccccaucaucaacaagggggaccuguggggcccgggccugucccccaaggaggugaagaucaaggugaacaacacccucacccuggagugcgaggcguacgccauccccagcgccucccugagcugguacaaggacgggcagccccucaaguccgacgaccacgucaacaucgccgccaacggccacacccugcagaucaaggaggcgcagaucagcgacacggggcgguacaccugcguggccuccaacaucgccggcgaggacgagcuggacuucgacgugaacauccaggucccgcccagcuuccagaagcucugggagaucgggaacaugcuggacaccggccgcaacggcgaggccaaggacgugaucaucaacaaccccaucucccuguacugcgagaccaacgccgcgcccccgcccacgcucaccugguacaaggacgggcacccccugaccagcuccgacaaggugcugauccuccccggcgggcggguccugcagaucccgcgcgccaagguggaggacgccggccgguacaccugcguggccgucaacgaggcgggggaggacagccugcaguacgacgugcgcgugcucgucccccccaucaucaagggcgccaacagcgaccugcccgaggaggugacggugcuggucaacaaguccgcccucaucgagugccugagcuccggcagcccggccccccggaacuccuggcagaaggacgggcagccccugcucgaggacgaccaccacaaguuccugagcaacggccgcauccugcagauccugaacacccagaucaccgacaucgggcgguacgugugcguggccgagaacaccgcgggcuccgccaagaaguacuucaaccucaacguccacgugcccccgagcgugaucgggcccaaguccgagaaccugacggucguggugaacaacuucaucagccugaccugcgaggucuccggcuucccccccccggaccucagcuggcugaagaacgagcagcccaucaagcugaacaccaacacccucaucgugcccggcgggcgcacccugcagaucauccgggccaagguguccgacggcggggaguacacgugcaucgccaucaaccaggccggcgagagcaagaagaaguucucccugaccgucuacgugccgcccagcaucaaggaccacgacuccgagagccucuccguggucaacgugcgcgaggggaccagcgugagccuggagugcgaguccaacgcggucccccccccggugaucaccugguacaagaacggccggaugaucacggagagcacccacguggagauccuggccgacggccagaugcuccacaucaagaaggccgaggucuccgacaccgggcaguacgugugccgcgccaucaacguggccggccgcgacgacaagaacuuccaccugaacgucuacgugccccccagcaucgaggggcccgagcgggaggugaucgucgagaccaucuccaacccggugacgcugaccugcgacgcgaccggcauccccccccccaccaucgccuggcucaagaaccacaagcgcaucgagaacagcgacucccuggaggugcggauccugagcggcggguccaagcuccagaucgcccgcagccagcacuccgacagcggcaacuacacgugcaucgccuccaacauggaggggaaggcgcagaaguacuacuuccugagcauccaggucccgcccuccguggccggcgccgagauccccagcgacgucuccgugcugcucggggagaacguggagcuggucugcaacgccaacggcauccccaccccgcugauccaguggcucaaggacggcaagcccaucgccagcggggagaccgagcggauccgcguguccgcgaacggcagcacccugaacaucuacggggcccugacgagcgacaccggcaaguacaccugcguggccaccaaccccgccggggaggaggaccggaucuucaaccucaacgucuacgugacgcccaccauccgcggcaacaaggacgaggccgagaagcugaugacccugguggacaccuccaucaacaucgagugccgggcgacgggcaccccgcccccccagaucaacuggcucaagaacgggcugccccugccgcucagcucccacauccgccugcuggccgccggccaggucauccggaucgugcgcgcccaggugagcgacgucgccguguacaccugcguggcguccaaccgggccggggucgacaacaagcacuacaaccuccagguguucgccccccccaacauggacaacagcaugggcaccgaggagaucacggugcugaagggguccagcaccuccauggccugcaucaccgacggcacccccgccccgagcauggcguggcugcgcgacggccagccccucgggcuggacgcccaccugacggucuccacccacggcauggugcuccagcugcugaaggccgagaccgaggacagcgggaaguacaccugcaucgccuccaacgaggcgggcgaggugagcaagcacuucauccucaagguccuggagcccccgcacaucaacggcuccgaggagcacgaggagaucagcgugaucgugaacaacccccuggagcucacgugcaucgccuccgggauccccgcccccaagaugaccuggaugaaggacggccggccgcugccccagaccgaccagguccagacccuggggggcggggaggugcuccgcaucagcaccgcccagguggaggacacgggccgguacaccugccuggccuccagccccgcgggcgacgacgacaaggaguaccugguccgcgugcacgugcccccgaacaucgccgggaccgacgagccccgggacaucaccguccuccgcaaccgccaggugacgcuggagugcaagagcgacgccgugccccccccggucaucaccuggcugcggaacggcgagcgccuccaggccaccccccgggugcgcauccuguccgggggccgguaccugcagaucaacaacgccgaccucggggacaccgcgaacuacacgugcguggccagcaacaucgccggcaagaccacccgcgaguucauccugaccgucaacgugccccccaacaucaagggcgggccgcagucccuggugauccuccugaacaagagcacgguccuggagugcaucgccgagggcgugcccaccccccggaucaccuggcgcaaggacggggccgugcucgcgggcaaccacgcccgguacuccauccuggagaacggguuccugcacauccagagcgcccacgucaccgacacgggccgcuaccucugcauggccaccaacgcggccggcaccgaccggcgccggaucgaccugcaggugcacgugcccccguccaucgcccccgggcccaccaacaugacggucaucgugaacgugcagaccacccuggccugcgaggccaccggcauccccaagccgagcaucaacuggcgcaagaacgggcaccuccugaacgucgaccagaaccagaacuccuaccggcugcucagcuccggcagccuggugaucaucucccccagcguggacgacacggcgaccuacgagugcaccgucaccaacggggccggcgacgacaagcgcacgguggaccugaccguccaggugcccccguccaucgccgacgagcccaccgacuuccucgugaccaagcacgcccccgccgucaucacgugcaccgcgagcggcgugcccuucccguccauccacuggaccaagaacgggauccggcugcugccccgcggcgacggguaccggauccucagcagcggcgccaucgagauccuggccacccagcugaaccacgccggccgcuacacgugcguggcccggaacgcggccggguccgcccaccgccacgucacccuccacgugcacgagccccccgugauccagccgcagcccagcgagcugcacgucauccugaacaaccccauccuccugcccugcgaggccaccggcaccccgucccccuucaucaccuggcagaaggaggggaucaacgugaacacgagcggccgcaaccacgccgugcugcccuccgggggccuccagaucagccgggcgguccgcgaggacgccggcaccuacaugugcguggcccagaaccccgccgggaccgcgcugggcaagaucaagcugaacgugcaggucccgcccgugaucuccccccaccucaaggaguacgugaucgccgucgacaagcccaucacccugagcugcgaggccgacgggcugccgccccccgacaucacguggcacaaggacggccgggccaucguggaguccauccgccagcgggugcucagcuccgggagccugcagaucgccuucguccagcccggcgacgcgggccacuacaccugcauggccgccaacguggccggguccagcuccaccagcaccaagcugacggugcacgucccgccccgcauccgguccaccgagggccacuacaccgugaacgagaacagccaggccauccugcccugcguggcggacgggauccccaccccggccaucaacuggaagaaggacaacguccuccuggccaaccugcucggcaaguacacggccgagcccuacggggagcugauccuggagaacguggugcucgaggacuccggcuucuacaccugcgucgccaacaacgcggccggcgaggacacccacaccgugagccugacggugcacguccugcccaccuucaccgagcucccgggggacgugagccugaacaagggcgagcagcugcgccucuccugcaaggccaccgggaucccccugcccaagcugacguggaccuucaacaacaacaucauccccgcccacuucgacagcgugaacggccacuccgagcucgucaucgagcgggugagcaaggaggacuccggcaccuacgugugcaccgcggagaacagcgucggguucgugaaggccaucggcuucguguacgucaaggagccgcccguguucaagggggacuaccccuccaacuggaucgagccccugggcgggaacgccauccugaacugcgaggugaagggcgacccgacgcccaccauccaguggaaccgcaagggcgucgacaucgagaucagccaccggauccgccagcucgggaacggcucccuggccaucuacgggaccgugaacgaggacgccggcgacuacaccugcguggcgacgaacgaggccggggucguggagcggagcaugucccugacccuccagagcccccccaucaucacccuggagccgguggagaccgucaucaacgccggcggcaagaucauccugaacugccaggccacgggggagccccagcccaccaucaccuggucccgccagggccacagcaucuccugggacgaccgggugaacguccucagcaacaacucccuguacaucgccgacgcgcagaaggaggacaccagcgaguucgagugcguggcccgcaaccugaugggguccgugcucguccgggugcccgugaucguccaggugcacggcggguucagccaguggagcgccuggcgcgccugcuccgugacgugcggcaagggcauccagaagcggagccgccugugcaaccagccgcugcccgccaacgggggcaagcccugccagggguccgaccucgagaugcgcaacugccagaacaagcccugcccggucgacggcagcugguccgaguggagccugugggaggagugcacccgguccugcgggcgcggcaaccagacccggacccgcaccugcaacaaccccagcgugcagcacggcgggcggcccugcgagggcaacgcgguggagaucaucaugugcaacauccgccccugcccgguccacggggccugguccgccuggcagcccuggggcacgugcagcgaguccugcggcaaggggacccagacccgggcccgccugugcaacaacccccccccggcguucggcgggagcuacugcgacggcgccgagacccagaugcaggugugcaacgagcggaacugccccauccacgggaagugggccacgugggccuccuggagcgccugcuccgugagcugcggcggcggggcgcgccagcggacccgcggcugcuccgaccccgucccgcaguacgggggccggaagugcgaggggagcgacgugcaguccgacuucugcaacagcgaccccugccccacccacggcaacuggagccccugguccggcugggggaccugcagccgcacgugcaacggcgggcagaugcggcgcuaccggaccugcgacaacccgccccccuccaacggcgggcgcgccugcggcggccccgacagccagauccagcggugcaacaccgacaugugcccgguggacggguccuggggcagcuggcacuccuggagccagugcuccgccagcugcgggggcggggagaagacccgcaagcggcucugcgaccaccccguccccgugaagggcggccgccccugcccgggggacacgacccaggugacccgcugcaacguccaggccugccccggcgggccccagcgggcccgcggcuccgugaucggcaacaucaacgacguggaguucgggaucgcguuccugaacgccaccaucacggacagccccaacuccgacacccggaucauccgcgccaagaucaccaacgucccgcggagccugggcuccgccaugcgcaagaucgugagcauccucaaccccaucuacuggaccacggccaaggagaucggggaggcggugaacggcuucacccugaccaacgccgucuucaagcgggagacccagguggaguucgccacgggggagauccugcagaugucccacaucgcccgcggccucgacagcgacggcucccugcugcucgacaucguggucagcggguacgugcugcagcugcagagccccgccgaggugaccgucaaggacuacaccgaggacuacauccagaccggccccgggcagcucuacgcguacuccacgcggcuguucaccaucgacggcaucagcaucccguacaccuggaaccacaccguguucuacgaccaggcccaggggcgcaugcccuuccugguggagacgcuccacgccuccagcgucgaguccgacuacaaccagaucgaggagacccugggcuucaagauccacgccagcaucuccaagggcgaccggagcaaccagugccccuccggguucacccuggacagcgugggccccuucugcgcggacgaggacgagugcgccgccgggaacccgugcucccacagcugccacaacgccaugggcaccuacuacugcuccugccccaaggggcucacgaucgccgcggacggccgcaccugccaggacaucgacgagugcgcccugggccggcacaccugccacgccgggcaggacugcgacaacaccaucggcagcuaccgcugcgugguccggugcggguccggcuuccgccggacgagcgacggccuguccugccaggacaucaacgagugccaggagagcucccccugccaccagcgcugcuucaacgccaucgggagcuuccacugcggcugcgagccgggguaccagcucaagggccggaagugcauggacgugaacgagugccgccagaacgugugccgccccgaccagcacugcaagaacacccgggggggcuacaagugcaucgaccugugccccaacggcaugaccaaggccgagaacgggaccugcaucgacaucgacgagugcaaggacggcacccaccagugccgcuacaaccagaucugcgagaacacgcgggggagcuaccgcugcgucugcccccggggcuaccgcucccagggggugggccggccgugcauggacaucaacgagugcgagcaggugcccaagcccugcgcgcaccagugcagcaacacccccggcuccuucaagugcaucugcccgcccgggcagcaccugcucggcgacgggaagagcugcgccggccuggagcgccugcccaacuacgggacccaguacuccagcuacaaccucgcccgguucucccccguccgcaacaacuaccagccgcagcagcacuaccggcaguacagccaccuguacuccagcuacuccgaguaccgcaacagccggaccucccugagccgcacgcggcgcaccauccggaagaccugccccgagggcuccgaggccagccacgacaccugcguggacaucgacgagugcgagaacacggacgccugccagcacgagugcaagaacaccuucggcuccuaccagugcaucugcccccccggguaccagcucacccacaacggcaagaccugccaggacaucgacgagugccuggagcagaacgugcacugcgggccgaaccgcaugugcuucaacaugcggggcagcuaccagugcaucgacacgcccugcccccccaacuaccagcgcgacccggucagcggguucugccugaagaacugcccccccaacgaccucgagugcgcgcugucccccuacgcccuggaguacaagcucgugagccugccguucggcaucgccaccaaccaggaccugauccggcucguggccuacacccaggacggcgucaugcacccccgcaccacguuccugaugguggacgaggagcagaccgugcccuucgcgcugcgcgacgagaaccucaagggggucguguacaccacccggccccugcgcgaggccgagacguaccggaugcgcguccgggccuccagcuacuccgccaacggcaccaucgaguaccagaccaccuucaucguguacaucgccgugagcgcguacccguacuga

SEQ ID NO: 31159 - RNA, 1044 nt, Artificial Sequence
  derived and/or modified sequence opt1 from HMG20A__Homo_sapiens__NP_001291433
auggagaaccugaugaccagcuccacccucccgccccuguucgccgacgaggacggcagcaaggaguccaacgaccuggccacgaccgggcucaaccaccccgaggugcccuacagcuccggcgcgaccagcuccaccaacaaccccgaguucgucgaggaccugagccaggggcagcugcuccaguccgagagcuccaacgccgccgagggcaacgagcagcgccacgaggacgagcagcggagcaagcgcgggggcugguccaagggccggaagcgcaagaagccgcugcgggacagcaacgcccccaagagcccccugacgggguacgugcgcuucaugaacgagcggcgcgagcagcuccgggccaagcgccccgaggugccguuccccgagaucacccggaugcugggcaacgaguggagcaagcugccgcccgaggagaagcagcgcuaccucgacgaggcggaccgggacaaggagcgcuacaugaaggagcuggagcaguaccagaagaccgaggccuacaaggucuucucccggaagacccaggaccgccagaaggggaagucccaccggcaggacgccgcccgccaggcgacgcacgaccacgagaaggagaccgaggugaaggagcgguccguguucgacauccccaucuucaccgaggaguuccugaaccacagcaaggcccgcgaggccgagcuccggcagcugcgcaagagcaacauggaguucgaggagcgcaacgccgcccugcagaagcacgucgaguccaugcggaccgcgguggagaagcucgagguggacgucauccaggagcgcagccggaacacggugcugcagcagcaccuggagacccuccgccaggugcugaccuccagcuucgccuccaugccccugcccggcagcggggagacccccacggucgacaccaucgacuccuacaugaaccggcuccacagcaucauccuggccaacccgcaggacaacgagaacuucaucgccaccgugcgcgagguggucaaccggcuggaccgcuga

SEQ ID NO: 31160 - RNA, 954 nt, Artificial Sequence
  derived and/or modified sequence opt1 from HMG20B__Homo_sapiens__NP_006330
augagccacggccccaagcagccgggggccgccgcggcccccgccggcgggaaggcccccggccagcacgggggcuucguggucaccgugaagcaggagcgcggcgaggggccccgggccggcgagaaggggucccacgaggaggagccggugaagaagcgcggcuggcccaaggggaagaagcggaagaagauccugcccaacggccccaaggcgccggucaccggcuacgugcgcuuccucaacgagcggcgcgagcagauccggacgcgccaccccgaccugcccuuccccgagaucaccaagaugcugggggccgaguggagcaagcuccagccgaccgagaagcagcgguaccuggacgaggccgagcgcgagaagcagcaguacaugaaggagcugcgggccuaccagcaguccgaggcguacaagaugugcaccgagaagauccaggagaagaagaucaagaaggaggacagcuccagcggccucaugaacacgcugcugaacgggcacaagggcggcgacugcgacggguucuccaccuucgacgugcccaucuucaccgaggaguuccucgaccagaacaaggcccgcgaggccgagcugcggcgccugcggaagaugaacgucgccuucgaggagcagaacgccgugcuccagcgccacacccagagcauguccagcgcgcgggagcgccuggagcaggagcuggcccucgaggagcggcgcacgcuggcccugcagcagcagcuccaggccgugcggcaggcccugaccgcguccuucgccagccugcccguccccggcaccggggagaccccgacgcucggcacccuggacuucuacauggcccgccugcacggggccaucgagcgcgaccccgcccagcacgagaagcucaucgugcggaucaaggagauccuggcccagguggcguccgagcaccuguga

SEQ ID NO: 31161 - RNA, 291 nt, Artificial Sequence
  derived and/or modified sequence opt1 from HMGA1__Homo_sapiens__NP_665912
augagcgaguccagcuccaagagcucccagccccuggccagcaagcaggagaaggacggcaccgagaagcgcgggcggggccgcccgcggaagcagccgcccaaggagcccuccgaggugcccacccccaagcgcccccgggggcgccccaagggcagcaagaacaagggggccgcgaagacgcggaagaccaccaccacgccgggccgcaagccccggggccgccccaagaagcucgagaaggaggaggaggaggggaucucccaggagagcuccgaggaggagcaguga

SEQ ID NO: 31162 - RNA, 357 nt, Artificial Sequence
  derived and/or modified sequence opt1 from HMGA2__Homo_sapiens__NP_001287847
augagcgcccgcggcgagggggccggccagcccuccaccagcgcgcaggggcagccggccgcccccgcgccccagaagcggggccgcgggcggccccgcaagcagcagcaggagccgaccggcgagcccucccccaagcggccccgcggccggccgaaggggagcaagaacaagucccccagcaaggccgcccagaagaaggccgaggccacgggcgagaagcgcccccgggggcgcccccggaaguggccgcagcaggucgugcagaagaagcccgcccaggugaacguggcgcugcccggcaaggaccaccccgggaaccucaucuaccugcuguucuccaagaacgccaccuga

SEQ ID NO: 31163 - RNA, 477 nt, Artificial Sequence
  derived and/or modified sequence opt1 from HMGB1__Homo_sapiens__XP_005266425
augggcaagggggaccccaagaagccgcgcggcaagaugagcuccuacgccuucuucgugcagaccugccgggaggagcacaagaagaagcaccccgacgccagcgucaacuucuccgaguucagcaagaagugcuccgagcgcuggaagaccaugagcgcgaaggagaaggggaaguucgaggacauggccaaggccgacaaggcccgguacgagcgcgagaugaagacguacaucccgcccaagggcgagaccaagaagaaguucaaggaccccaacgcccccaagcggccgcccuccgcguucuuccuguucugcagcgaguaccgccccaagaucaagggggagcaccccggccucuccaucggcgacguggccaagaagcugggggagauguggaacaacaccgccgccgacgacaagcagcccuacgagaagaaggcggccaagcugaaggagaaguacgagaaguucuga

SEQ ID NO: 31164 - RNA, 630 nt, Artificial Sequence
  derived and/or modified sequence opt1 from HMGB2__Homo_sapiens__NP_001124161
augggcaagggggaccccaacaagccgcgcggcaagaugagcuccuacgccuucuucgugcagaccugccgggaggagcacaagaagaagcaccccgacagcuccgucaacuucgccgaguucagcaagaagugcuccgagcgcuggaagaccaugagcgcgaaggagaaguccaaguucgaggacauggccaagagcgacaaggcccgguacgaccgcgagaugaagaacuacgugccgcccaagggggacaagaagggcaagaagaaggaccccaacgcccccaagcggccgcccuccgccuucuuccuguucugcagcgagcaccgccccaagaucaaguccgagcaccccgggcucagcaucggcgacacggcgaagaagcugggcgagaugugguccgagcagagcgccaaggacaagcagcccuacgagcagaaggccgccaagcugaaggagaaguacgagaaggacaucgcggccuaccgggccaaggggaaguccgaggccggcaagaaggggcccggccgcccgaccgggagcaagaagaagaacgagcccgaggacgaggaggaggaggaggaggaggaggacgaggacgaggaggaggaggacgaggacgaggaguga

SEQ ID NO: 31165 - RNA, 603 nt, Artificial Sequence
  derived and/or modified sequence opt1 from HMGB3__Homo_sapiens__NP_001288157
auggccaagggcgaccccaagaagccgaaggggaagaugagcgccuacgcguucuucgugcagaccugccgcgaggagcacaagaagaagaaccccgagguccccgugaacuucgccgaguucuccaagaagugcagcgagcgguggaagaccauguccggcaaggagaaguccaaguucgacgagauggccaaggccgacaaggugcgcuacgaccgggagaugaaggacuacgggcccgccaagggcgggaagaagaagaaggacccgaacgcgcccaagcgcccgcccagcggcuucuuccuguucugcagcgaguuccggcccaagaucaaguccacgaaccccggcaucagcaucggggacgucgccaagaagcucggcgagauguggaacaaccugaacgacuccgagaagcagcccuacaucaccaaggccgccaagcugaaggagaaguacgagaaggacguggcggacuacaagagcaaggggaaguucgacggcgccaaggggcccgccaagguggcccgcaagaaggucgaggaggaggacgaggaggaggaggaggaggaggaggaggaggaggaggaggaggacgaguga

SEQ ID NO: 31166 - RNA, 2667 nt, Artificial Sequence
  derived and/or modified sequence opt1 from HMGCR__Homo_sapiens__NP_000850
augcugagccgccucuuccggaugcacggccuguucguggccucccaccccugggaggugaucguggggaccgugacccugacgaucugcaugaugagcaugaacauguucaccggcaacaacaagaucugcggguggaacuacgagugcccgaaguucgaggaggacguccucuccagcgacaucaucauccugaccaucacccgcugcaucgccauccuguacaucuacuuccaguuccagaaccuccggcagcugggcuccaaguacauccuggggaucgcgggccucuucacgaucuucagcuccuucguguucagcaccguggucauccacuuccuggacaaggagcugaccggccucaacgaggcccugcccuucuuccugcuccugaucgaccugucccgcgccagcacccucgccaaguucgcccuguccagcaacucccaggacgaggugcgggagaacaucgcgcgcgggauggccauccugggccccacguucacccucgacgcccugguggagugccuggucaucggggugggcaccaugagcggggugcggcagcucgagaucaugugcugcuucggcugcauguccguccuggccaacuacuucguguucaugaccuucuuccccgcgugcgugagccugguccucgagcugucccgcgagagccgggagggccgcccgaucuggcagcugucccacuucgcccgggugcucgaggaggaggagaacaagcccaaccccgugacgcagcgcgucaagaugaucaugagccuggggcuggugcucgugcacgcccacagccgguggaucgccgaccccuccccgcagaacagcaccgccgacaccuccaaggucagccugggccuggacgagaacguguccaagcgcaucgagcccagcgugucccucuggcaguucuaccugagcaagaugaucuccauggacaucgagcaggucaucacccugagccucgcgcugcugcucgccgugaaguacaucuucuucgagcagacggagaccgaguccacccugagccugaagaaccccaucaccucccccgucgugacgcagaagaaggugccggacaacugcugccggcgcgagcccaugcucguccggaacaaccagaagugcgacagcguggaggaggagaccgggaucaaccgcgagcggaagguggaggucaucaagccccugguggccgagaccgacacccccaaccgcgccacguucguggucggcaacuccagccugcucgacaccuccagcgugcuggugacccaggagccggagaucgagcugccccgggagccccgccccaacgaggagugccugcagauccucggcaacgccgagaagggggcgaaguuccuguccgacgccgagaucauccagcuggucaacgccaagcacaucccggccuacaagcucgagacccugauggagacgcacgagcgcggcgugagcauccggcgccagcugcucagcaagaagcuguccgagcccagcucccugcaguaccuccccuaccgggacuacaacuacagccuggugaugggggccugcugcgagaacgucaucggcuacaugcccaucccgguggggguggcgggcccccugugccucgacgagaaggaguuccagguccccauggccaccaccgagggcugccugguggccuccaccaaccgcgggugccgggccaucggccucgggggcggggccagcucccgcgugcuggcggacggcaugacgcggggccccgucgugcgccugccgcgggccugcgacagcgccgaggugaaggccuggcuggagaccuccgagggguucgcggucaucaaggaggccuucgacagcaccucccgcuucgcccggcuccagaagcugcacaccagcaucgccggccgcaaccuguacauccgguuccagucccgcagcggggacgccaugggcaugaacaugaucuccaaggggacggagaaggcgcucagcaagcugcacgaguacuuccccgagaugcagauccuggccguguccggcaacuacugcaccgacaagaagcccgccgccaucaacuggaucgagggccggggcaagagcguggucugcgaggccgugaucccggcgaaggugguccgcgaggugcucaagaccaccaccgaggccaugaucgaggugaacaucaacaagaaccuggucgggagcgccauggccggguccaucggcggcuacaacgcccacgcggccaacaucgugacggccaucuacaucgccugcgggcaggacgcggcccagaacgugggcagcuccaacugcaucacccugauggaggccagcgggcccaccaacgaggaccucuacaucuccugcaccaugcccagcaucgagaucggcacggucgggggcggcaccaaccugcugccccagcaggccugccuccagaugcugggggugcagggcgccugcaaggacaacccgggggagaacgcgcggcagcuggcccgcaucgugugcggcaccgucauggccggggagcucucccugauggccgcccuggcggccggccaccucgucaagagccacaugauccacaaccgguccaagaucaaccugcaggaccugcagggcgccugcaccaagaagacggccuga

SEQ ID NO: 31167 - RNA, 1563 nt, Artificial Sequence
  derived and/or modified sequence opt1 from HMGCS1__Homo_sapiens__NP_002121
augcccggcagccugccgcucaacgccgaggccugcuggcccaaggacguggggaucgucgcgcuggagaucuacuuccccucccaguacguggaccaggccgagcuggagaaguacgacggcguggacgccgggaaguacaccaucggccucgggcaggccaagaugggcuucugcaccgaccgcgaggacaucaacagccugugcaugacggucgugcagaaccugauggagcggaacaaccucuccuacgacugcaucggccgccuggagguggggaccgagaccaucaucgacaagagcaaguccgucaagaccaaccugaugcagcuguucgaggagagcggcaacacggacaucgaggggaucgacaccaccaacgccugcuacggcgggaccgcggccguguucaacgccgugaacuggaucgaguccagcuccugggacggccgguacgcccuggucguggcgggcgacaucgccguguacgccacggggaacgcccgccccaccggcggggucggcgccguggcgcugcucaucggcccgaacgcgccccugaucuucgagcgggggcugcgcggcacccacaugcagcacgccuacgacuucuacaagcccgacaugcucagcgaguaccccaucguggacgggaagcuguccauccagugcuaccugagcgcccucgaccggugcuacuccgucuacugcaagaagauccacgcccaguggcagaaggagggcaacgacaaggacuucacccugaacgacuucggguucaugaucuuccacagcccguacugcaagcuggugcagaagucccucgcccgcaugcugcugaacgacuuccucaacgaccagaaccgggacaagaacagcaucuacuccggccuggaggccuucggcgacgugaagcuggaggacacguacuucgaccgcgacgucgagaaggccuucaugaaggccagcuccgagcuguucagccagaagaccaaggccagccuccugguguccaaccagaacgggaacauguacaccagcuccguguacggcagccucgcguccguccuggcccaguacagcccccagcagcuggccgggaagcggaucggcguguucuccuacgggagcggccucgccgccacccuguacucccugaaggugacgcaggacgcgacccccggcagcgcccucgacaagaucaccgccucccugugcgaccucaagagccgccucgacucccggaccggggucgcccccgacguguucgcggagaacaugaagcugcgcgaggacacgcaccaccuggucaacuacaucccgcagggcagcaucgacucccucuucgaggggaccugguaccuggugcggguggacgagaagcaccgccggaccuacgcccgccggcccacccccaacgacgacacgcuggacgagggcgucgggcucgugcacagcaacaucgccaccgagcacauccccuccccggccaagaaggugccccgccugcccgccaccgcggccgagcccgaggccgccgucaucagcaacggcgagcacuga

SEQ ID NO: 31168 - RNA, 303 nt, Artificial Sequence
  derived and/or modified sequence opt1 from HMGN1__Homo_sapiens__NP_004956
augcccaagcgcaaggugagcuccgcggagggcgccgcgaaggaggagccgaagcggcgcagcgcccggcuguccgccaagccgcccgccaaggucgaggccaagcccaagaaggcggccgccaaggacaagagcuccgacaagaaggugcagaccaaggggaagcgcggcgccaaggggaagcaggcggagguggccaaccaggagaccaaggaggaccuccccgccgagaacggcgagacgaagaccgaggagagccccgccuccgacgaggccggggagaaggaggccaagagcgacuga

SEQ ID NO: 31169 - RNA, 273 nt, Artificial Sequence
  derived and/or modified sequence opt1 from HMGN4__Homo_sapiens__NP_006344
augcccaagcgcaaggccaagggcgacgccaagggggacaaggcgaaggugaaggacgagccgcagcggcgcagcgcccggcuguccgccaagcccgccccgcccaagcccgagccccgccccaagaaggccagcgcgaagaagggcgagaagcuccccaaggggcggaagggcaaggccgacgccgggaaggacggcaacaacccggccaagaaccgcgacgcguccacccugcagagccagaaggccgagggcaccggggacgccaaguga

SEQ ID NO: 31170 - RNA, 849 nt, Artificial Sequence
  derived and/or modified sequence opt1 from HMGN5__Homo_sapiens__NP_110390
augcccaagcgcaaggccgccggccagggggacaugcggcaggagccgaagcgccggagcgcgcgccuguccgccaugcucgugcccgucacccccgaggugaagcccaagcggaccagcuccagccgcaagaugaagacgaaguccgacaugauggaggagaacaucgacaccagcgcccaggccguggccgagaccaagcaggaggcggucguggaggaggacuacaacgagaacgccaagaacggcgaggccaagaucaccgaggccccggcguccgagaaggagaucguggaggucaaggaggagaacaucgaggacgccacggagaagggcggggagaagaaggaggccguggccgccgaggugaagaacgaggaggaggaccagaaggaggacgaggaggaccagaacgaggagaagggggaggcgggcaaggaggacaaggacgagaagggcgaggaggacgggaaggaggacaagaacggcaacgagaagggggaggacgccaaggagaaggaggacggcaagaagggggaggacggcaagggcaacggggaggacggcaaggagaagggggaggacgagaaggaggaggaggaccggaaggagaccggcgacggcaaggagaacgaggacgggaaggagaagggcgacaagaaggaggggaaggacgucaaggugaaggaggacgagaaggagcgcgaggacggcaaggaggacgagggcgggaacgaggaggaggccggcaaggagaaggaggaccugaaggaggaggaggaggggaaggaggaggacgagaucaaggaggacgacggcaagaaggaggagccccagagcaucguguga

SEQ ID NO: 31171 - RNA, 3879 nt, Artificial Sequence
  derived and/or modified sequence opt1 from HMGXB3__Homo_sapiens__NP_055798
auggacgccagcuacgacggcaccgaggugaccgucgugauggaggagaucgaggaggccuacugcuacacgucccccgggccgcccaagaagaagaagaaguacaagauccacggcgagaagaccaagaagccccgcagcgcguaccugcucuacuacuacgacaucuaccugaaggugcagcaggagcugccccaccucccgcaguccgagaucaacaagaagaucagcgaguccuggcggcugcugagcgucgccgagcgcuccuacuaccucgagaaggccaagcuggagaaggaggggcuggaccccaacagcaagcucuccgcccugaccgccguggugcccgacauccccggcuuccggaagauccugccgcgcagcgacuacaucaucauccccaaguccagccuccaggaggaccgguccugcccccagcuggagcugugcgucgcgcagaaccagaugagccccaaggggccgccccucguguccaacaccgcccccgagacggugcccagccacgccggcauggccgagcagugccuggcggucgaggcccuggccgaggaggugggcgcccucacccaguccggggccgugcaggagaucgcgaccagcgagauccugucccaggacguccugcucgaggacgccagccuggaggugggcgagagccaccagccguaccagaccucccuggugaucgaggagacgcucgucaacgggagccccgaccugcccaccggcucccuggccgugccccacccccaggugggggagagcgucuccguggugaccgucaugcgcgacagcuccgagagcuccagcuccgcccccgccacccaguucaucaugcucccccugcccgcguacagcgugguggagaacccgacguccaucaagcugaccaccaccuacacgcggcgcggccacgggaccugcaccagccccggcugcuccuucaccuacgucacgcggcacaagccgcccaagugcccgaccugcggcaacuuccucgggggcaaguggauccccaaggagaagcccgccaaggugaaggucgagcuggccagcggcguguccagcaagggguccguggucaagcgcaaccagcagccggugaccaccgagcagaacagcagcaaggagaacgccuccaagcugacgcucgagaacagcgaggccgugucccagcugcugaacgucgcgccgccccgggaggugggcgaggagagcgagugggaggaggugaucaucuccgacgcccacguccucgugaaggaggcccccgggaacugcggcaccgccgugaccaagacccccgucgucaagagcggggugcagcccgaggugacgcugggcaccaccgacaacgacucccccggcgccgacgugcccaccccgagcgaggggacguccaccagcagcccccugcccgcgcccaagaagccgaccggcguggaccuccugacccccgggucccgcgcccccgagcugaagggccgggcccgcgggaagcccucccuccuggccgcggcccggccgaugcgcgccauccugcccgcccccgucaacgugggccggggcagcuccauggggcucccccgcgcccggcaggcguucagccuguccgacaagacgccgagcgugcggaccugcggccugaagcccagcacccucaagcagcuggggcagcccauccagcagcccuccggcccgggggaggucaagcugcccagcggccccuccaaccgcaccagccaggugaagguggucgaggugaagccggacauguucccgcccuacaaguacuccugcaccgugacgcuggaccucggccuggccaccagccgcgggcgcggcaagugcaagaaccccuccugcagcuacgucuacaccaaccggcacaagccccgcaucugccccuccugcggggugaaccuggccaaggaccggaccgagaagacgaccaaggccaucgaggugagcagcccccuccccgacguccugaacgccaccgagccgcuguccaccgcgcagcgcgagauccagcggcaguccacgcuccagcugcugcgcaaggugcuccagauccccgagaacgagagcgagcuggccgagguguucgcccugauccacgagcucaacuccagccggcugauccuguccaacgucagcgaggagaccgugaccaucgagcagaccuccuggagcaacuacuacgagagccccuccacgcagugccuccugugcagcagcccccuguucaagggcggccagaacucccucgccgggccgcaggagugcuggcugcugaccgccucccgccuccagaccgugaccgcgcaggucaagaugugccugaacccccacugccuggcccuccacagcuucaucgacaucuacacgggccuguucaacguggggaacaagcugcucgugucccuggaccuccuguucgccauccggaaccagaucaagcugggcgaggacccccgcgucagcaucaacguggugcugaaguccguccaggagcagaccgagaagacccucaccagcgaggagcugucccagcugcaggagcuccugugcaacggguacugggccuucgagugccugacggugcgggacuacaacgacaugaucugcggcaucugcggcguggcgcccaaggucgagauggcccagcgcagcgaggagaacgugcucgcccugaaguccguggaguucaccuggccggaguuccuggggagcaacgaggucaacguggaggacuucugggccaccauggagaccgaggugaucgagcaggucgccuuccccgcguccauccccaucacgaaguucgacgccagcgugaucgcccccuucuucccgccccucaugcggggcgccgucguggugaacaccgagaaggacaagaaccuggacguccagcccgugcccggguccggcagcgcccuggugcgccuccugcaggaggggaccugcaagcuggacgagaucggcuccuacagcgaggagaagcuccagcaccuccugcggcagugcggcaucccguucggggcggaggacagcaaggaccagcugugcuucucccugcuggcccucuacgagagcguccagaacggcgcccgcgccauccggccgccccgccacuucaccgggggcaagaucuacaaggugugcccccaccagguggucugcggguccaaguaccuggugcggggcgagagcgcccgcgaccacguggaccugcucgcguccagccgccacuggccgcccgucuacgugguggacauggccacguccgucgcccugugcgccgaccugugcuaccccgagcucaccaaccagauguggggccggaaccaggggugcuucagcucccccaccgagccgcccgugagcguguccugccccgagcugcuggaccagcacuacaccgucgacaugacggagaccgagcacagcauccagcaccccgugaccaagaccgcgacgcgccggaucgugcacgccggccuccagcccaaccccggggaccccuccgccggccaccacagccuggcccugugcccggagcucgcccccuacgcgaccauccuggccuccaucgucgacagcaagcccaacggggugcgccagcggcccaucgccuucgacaacgccacccacuacuaccuguacaaccgccucauggacuuccugaccucccgggagaucgugaaccgccagauccacgacaucguccagagcugccagccgggcgagguggugauccgggacacccuguaccgccucggcgucgcccagaucaagacggagaccgaggaggagggggaggaggaggagguggcggccguggccgaguga

SEQ ID NO: 31172 - RNA, 1806 nt, Artificial Sequence
  derived and/or modified sequence opt1 from HMGXB4__Homo_sapiens__NP_001003681
auggccuacgacgacagcgugaagaaggaggacugcuucgacggcgaccacaccuucgaggacaucgggcuggccgcgggccgcucccagcgggagaagaagcgcagcuacaaggacuuccuccgggaggaggaggagaucgccgcccaggugcgcaacuccagcaagaagaagcugaaggacuccgagcuguacuuccucgggaccgacacgcacaagaagaagcggaagcacagcuccgacgacuacuacuacggcgacaucagcucccuggagagcucccagaagaagaagaagaaguccagcccccagagcaccgacaccgccauggaccugcucaaggccaucaccuccccgcuggcggccgggagcaagcccuccaagaagacgggcgagaaguccuccggcagcagcucccacagcgaguccaagaaggagcaccaccgcaagaaggugagcggguccagcggcgagcugccccucgaggacgggggcucccacaagagcaagaagaugaagccccuguacgugaacaccgagacccugacccuccgggagccggacgggcugaagaugaagcugauccucucccccaaggagaagggcagcuccagcgucgacgaggaguccuuccaguaccccagccagcaggccacggugaagaaguccagcaagaaguccgcccgcgacgagcagggcgcgcugcugcucgggcacgagcugcagagcuuccugaagaccgcccggaagaagcacaaguccagcagcgacgcccacuccagccccggcccggaggggugcggcuccgacgccagccaguucgccgagucccacagcgcgaaccucgaccuguccggccuggagcccauccucguggagagcgacuccagcuccgggggcgagcuggaggccggggagcuggucaucgacgacagcuaccgcgagaucaagaagaagaagaaguccaagaaguccaagaagaagaaggacaaggagaagcacaaggagaagcggcacagcaagagcaagcgcucccucggccugagcgccgugcccgugggggaggucaccgugaccagcgggcccccgcccuccauccccuacgccggcgccgcggcgcccccgcugccccuccccggccugcacacggacggccacagcgagaagaagaagaagaaggaggagaaggacaaggagcgggagcgcggggagaagcccaagaagaagaacauguccgccuaccagguguucugcaaggaguaccgggucaccaucguggccgaccacccgggcaucgacuucggggagcugagcaagaagcucgccgagguguggaagcagcugcccgagaaggacaagcugaucuggaagcagaaggcccaguaccuccagcacaagcagaacaaggccgaggccaccaccgucaagcgcaaggccuccagcuccgagggcagcaugaaggugaaggccuccagcgugggcguccugagcccccagaagaaguccccgcccacgaccaugcugcuccccgcgagccccgccaaggcccccgagaccgagccgaucgacguggccgcgcaccuccagcugcugggggagagccugucccugaucggccaccggcuccaggagaccgaggggaugguggccgucagcggcucccugagcgugcugcucgacuccaucaucugcgcccuggggccccuggccugccugacgacccagcuccccgagcugaacggcugcccgaagcagguccugagcaacacccucgacaacaucgccuacaucaugcccggccuguga

SEQ ID NO: 31173 - RNA, 3459 nt, Artificial Sequence
  derived and/or modified sequence opt1 from HMHA1__Homo_sapiens__NP_001245257
augagccgcggccagcgggugcugaaggggcuccugggcugggucugcaccuggaccugggccuggcgcgcccggcugggggcgcgcggcugcgggcuccacgugcugugcccccgggaccugccccucccgcccgaggagcugccccgcaaggacggcgccgacgccguguucccgggccccucccuggagccgcccgccgggagcuccggcgucaaggccacggggacccucaagcggcccaccagccugucccgccacgcgagcgccgccggcuucccccuguccggggccgcgagcuggacccucggccggucccaccgcagcccccugacggccgccucccccggcgagcugccgaccgagggggccggccccgacgugguggaggacaucagccaccuccuggccgacgucgcgcgguucgccgaggggcuggagaagcucaaggagugcgugcugcgcgacgaccugcucgaggcccggcgcccccgggcccacgagugccugggcgaggcccugcgcgugaugcaccagaucaucuccaaguacccccuccugaacaccgucgagacccugacggcggccggcacccucaucgccaaggugaaggccuuccacuacgagagcaacaacgaccuggagaagcaggaguucgagaaggcccuggagaccaucgcgguggccuucuccagcaccgucuccgaguuccucaugggggagguggacagcuccacgcugcuggccgugccgcccggcgacagcagccaguccauggagagccucuacgggcccggcuccgaggggacgcccccgagccuggaggacugcgacgccggcugccugcccgccgaggaggucgacgugcuccugcagcggugcgagggcgggguggacgcggcccugcucuacgccaagaacauggccaaguacaugaaggaccugaucuccuaccuggagaagcgcaccacccucgagauggaguucgcgaagggccugcagaagaucgcccacaacugccggcagagcgucaugcaggagccccacaugccccugcucuccaucuacagccuggcccuggagcaggaccucgaguucgggcacuccauggugcaggccgugggcacccugcagacccagaccuucaugcagccgcugacccugcgccggcucgagcacgagaagcgccgcaaggagaucaaggaggccuggcaccgggcgcagcgcaagcugcaggaggccgagagcaaccugcggaaggccaagcagggguacguccagcgcugcgaggaccacgacaaggcccgguuccucguggccaaggcggaggaggagcaggccggcuccgcccccggcgccgggagcacggccaccaagacccuggacaagcgccggcgccuggaggaggaggcgaagaacaaggccgaggaggccauggccaccuaccggacgugcguggcggacgccaagacccagaagcaggagcucgaggacaccaaggucaccgcccugcgccagauccaggaggugauccggcaguccgaccagacgaucaagagcgccaccaucuccuacuaccagaugaugcacaugcagaccgcgccccugcccguccacuuccagaugcucugcgagagcuccaagcuguacgacccgggccagcaguacgccagccacgugcgccagcugcagcgggaccaggagcccgacgugcacuacgacuucgagccccacgucuccgccaacgccuggagcccggugaugcgcgcccgcaagagcuccuucaacgugagcgacgucgcccggcccgaggcggccggguccccgcccgaggagggcgggugcaccgagggcacgcccgccaaggaccaccgggccggccgcgggcaccaggugcacaagagcuggccccucuccaucagcgacuccgacagcggccuggaccccgggcccggcgccggcgacuucaagaaguucgagcggaccuccagcuccgggaccaugagcuccaccgaggagcugguggacccggacggcggggcgggcgccagcgccuucgagcaggccgaccucaacgggaugacgcccgagcugcccgucgcggugcccuccggcccguuccgccacgagggccugagcaaggccgcccgcacccaccggcuccgcaagcugcggacccccgccaagugccgcgagugcaacuccuacguguacuuccagggggccgagugcgaggagugcugccuggcgugccacaagaagugccucgagacccuggccauccagugcggccacaagaagcugcaggggcggcuccagcuguucggccaggacuucagccacgccgcccgcagcgcccccgacgggguccccuucaucgugaagaagugcgugugcgagaucgagcggcgcgcgcugcggaccaagggcaucuaccgcgucaacggcgugaagacgcggguggagaagcucugccaggccuucgagaacgggaaggagcuggucgagcugucccaggccagcccgcacgacaucuccaacgugcucaagcuguaccugcgccagcuccccgagccccugaucagcuuccggcuguaccacgagcucgugggccuggccaaggacucccugaaggccgaggcggaggccaaggccgccagccgcgggcggcaggacggcuccgagagcgaggccgucgcgguggcccucgccgggcgccugcgggagcugcuccgcgaccugcccccggagaaccgggccucccugcaguaccuccugcgccaccuccggcgcaucguggaggucgagcaggacaacaagaugacccccggcaaccugggcaucguguucgggcccacccugcugcgcccccggccgaccgaggcgacggugagccucuccagccuggucgacuacccccaccaggcccgcgugaucgagacccugaucgugcacuacggccucgucuucgaggaggagcccgaggagacccccgggggccaggacgaguccagcaaccagcgggccgagguggugguccaggugcccuaccuggaggccggggaggccguggucuacccccugcaggaggcggccgccgacggcugccgcgagucccggguggugagcaacgacuccgacagcgaccucgaggaggccuccgagcugcugagcagcuccgaggccagcgcgcucggccaccuguccuuccuggagcagcagcagagcgaggccucccucgaggucgccagcgggucccacagcggcuccgaggagcagcuggaggccaccgcccgcgaggacggggacggcgacgaggacggccccgcgcagcagcugagcggguucaacacgaaccaguccaacaacgugcuccaggccccgcugccgcccaugcggcugcgcggcgggcggaugacccucggcagcugccgcgagcggcagcccgaguucguguga

SEQ ID NO: 31174 - RNA, 2178 nt, Artificial Sequence
  derived and/or modified sequence opt1 from HMMR__Homo_sapiens__NP_001136028
augagcuuccccaaggccccgcugaagcgcuucaacgaccccuccggcugcgcccccagccccggggcguacgacgugaagacccucgagguccugaagggcccgguguccuuccagaagucccagcgguucaagcagcagaaggagagcaagcagaaccugaacguggacaaggacaccacgcuccccgccagcgcccgcaaggucaaguccagcgaguccaagaaggagagccagaagaacgacaaggaccugaagauccuggagaaggagauccgggugcuccugcaggagcgcggggcccaggaccggcgcauccaggaccuggagaccgagcucgagaagauggaggcccggcugaacgcggcccugcgcgagaagaccucccucagcgccaacaacgccacccuggagaagcagcugaucgagcucacgcggaccaacgagcugcugaaguccaaguucagcgagaacggcaaccagaagaaccuccgcauccugucccuggagcucaugaagcugcggaacaagcgcgagaccaagaugcgggggaugauggcgaagcaggagggcauggagaugaagcuccaggugacccagcgcagccuggaggagucccagggcaagaucgcccagcuggaggggaagcuggucagcaucgagaaggagaagaucgacgagaaguccgagacggagaagcuccuggaguacaucgaggagaucagcugcgccagcgaccagguggagaaguacaagcuggacaucgcccagcucgaggagaaccugaaggagaagaacgacgagauccugucccucaagcagagccuggaggagaacaucgugauccuguccaagcaggucgaggaccucaacgugaagugccagcugcuggagaaggagaaggaggaccacgugaaccggaaccgcgagcacaacgagaaccucaacgccgagaugcagaaccugaagcagaaguucauccuggagcagcaggagcgggagaagcuccagcagaaggagcugcagaucgacagccugcuccagcaggagaaggagcuguccagcucccugcaccagaagcucugcagcuuccaggaggagauggucaaggagaagaaccuguucgaggaggagcugaagcagacccuggacgagcucgacaagcugcagcagaaggaggagcaggcggagcgccuggugaagcagcucgaggaggaggccaagucccgggccgaggagcugaagcugcucgaggagaagcugaagggcaaggaggccgagcuggagaaguccagcgccgcgcacacccaggccacccuccugcugcaggagaaguacgacagcauggugcagucccucgaggacgucacggcccaguucgagagcuacaaggcccugaccgccuccgagaucgaggaccugaagcucgagaacagcucccugcaggagaaggcggccaaggccgggaagaacgccgaggacgugcagcaccagauccuggccaccgagagcuccaaccaggaguacgugcgcaugcuccuggaccugcagaccaagagcgcgcucaaggagacggagaucaaggagaucaccgucagcuuccugcagaagaucaccgaccugcagaaccagcucaagcagcaggaggaggacuuccggaagcagcuggaggacgaggagggccgcaaggccgagaaggagaacaccacggccgagcugaccgaggagaucaacaaguggcgccuccuguacgaggagcuguacaacaagaccaagcccuuccagcuccagcuggacgccuucgagguggagaagcaggcgcugcucaacgagcacggggccgcccaggagcagcugaacaagauccgggacuccuacgccaagcugcucggccaccagaaccugaagcagaagaucaagcacguggucaagcugaaggacgagaacagccagcucaaguccgaggugagcaagcugcgcugccagcuggccaagaagaagcaguccgagaccaagcuccaggaggagcugaacaaggugcugggcaucaagcacuucgaccccagcaaggcguuccaccacgaguccaaggagaacuucgcccucaagacgccgcugaaggaggggaacaccaacugcuaccgggcccccauggagugccaggagagcuggaaguga

SEQ ID NO: 31175 - RNA, 867 nt, Artificial Sequence
  derived and/or modified sequence opt1 from HMOX1__Homo_sapiens__NP_002124
auggagcgcccccagccggacagcaugccccaggaccuguccgaggcccucaaggaggccaccaaggaggugcacacccaggcggagaacgccgaguucaugcggaacuuccagaagggccaggucacgcgcgacggguucaagcuggugauggccagccuguaccacaucuacguggcccucgaggaggagaucgagcggaacaaggagucccccgucuucgcccccguguacuucccggaggagcugcaccgcaaggcggcccuggagcaggaccucgccuucugguacggcccccgguggcaggaggugauccccuacacccccgccaugcagcgcuacgucaagcggcugcacgagguggggcgcaccgagccggagcugcucguggcgcacgccuacacccgguaccugggcgaccugagcgggggccagguccucaagaagaucgcccagaaggcccuggaccugcccuccagcggcgaggggcucgccuucuucacguuccccaacaucgcguccgccaccaaguucaagcagcuguaccgcagccggaugaacucccuggagaugacccccgccgugcgccagcgggugaucgaggaggccaagaccgccuuccuccugaacauccagcuguucgaggagcuccaggagcugcugacgcacgacaccaaggaccagagcccgucccgcgcgcccggccuccggcagcgcgccagcaacaagguccaggacuccgcccccguggagacgccccgggggaagccgccccugaacacccgcagccaggcgccccugcuccggugggugcugacccuguccuuccucgucgccaccguggccgugggccuguacgccauguga

SEQ ID NO: 31176 - RNA, 951 nt, Artificial Sequence
  derived and/or modified sequence opt1 from HMOX2__Homo_sapiens__NP_001120676
augagcgccgagguggagaccuccgagggcgucgacgagagcgagaagaagaacuccggggcccuggagaaggagaaccagaugcgcauggcggaccucagcgagcugcugaaggagggcaccaaggaggcccacgaccgggccgagaacacgcaguucgugaaggacuuccucaaggggaacaucaagaaggagcuguucaagcuggccaccaccgcccucuacuucaccuacuccgcgcuggaggaggagauggagcgcaacaaggaccaccccgccuucgccccgcuguacuuccccauggagcuccaccggaaggaggcccugacgaaggacauggaguacuucuucggcgagaacugggaggagcagguccagugccccaaggcggcccagaaguacguggagcgcauccacuacaucgggcagaacgagcccgagcugcucguggcccacgccuacacccgguacaugggcgaccugagcggcggccaggugcugaagaaggucgcccagcgcgcgcucaagcugccguccaccggggaggggacccaguucuaccuguucgagaacguggacaacgcccagcaguucaagcagcucuaccgggcccgcaugaacgcccuggaccugaacaugaagacgaaggagcggaucguggaggaggccaacaaggcguucgaguacaacaugcagaucuucaacgagcucgaccaggccggcagcacccuggcccgcgagacccuggaggacggguuccccguccacgacggcaagggcgacaugcggaagugccccuucuacgccgccgagcaggacaagggggcgcucgagggcuccagcugccccuuccgcaccgccauggccgugcugcggaagccgucccugcaguucauccucgccgccgggguggcgcuggccgccggccugcucgccugguacuacauguga

SEQ ID NO: 31177 - RNA, 516 nt, Artificial Sequence
  derived and/or modified sequence opt1 from HMP19__Homo_sapiens__NP_057064
auggugaagcugaacagcaaccccuccgagaagggcaccaagccgcccagcgucgaggacggguuccagaccgugccccucaucacgccccuggaggugaaccaccuccagcugcccgcccccgagaaggucaucgugaagacccgcaccgaguaccagcccgagcagaagaacaagggcaaguuccgggugcccaagaucgccgaguucaccgucacgauccuggugucccuggcgcucgccuuccuggccugcaucguguuccuggucguguacaaggccuucaccuacgaccacagcugcccggagggguucguguacaagcacaagcgcugcauccccgccucccucgacgcguacuacagcucccaggaccccaacagccggucccgcuucuacaccgucaucagccacuacuccguggccaagcagagcaccgcccgggccaucggccccuggcuguccgcggccgccgugauccacgagccgaagccgcccaagacgcaggggcacuga

SEQ ID NO: 31178 - RNA, 420 nt, Artificial Sequence
  derived and/or modified sequence opt1 from HMSD__Homo_sapiens__NP_001116838
augagcaucuccagcgcccuggccaugguguucaugggcgcgaaggggaacaccgccgcccagaugucccaggcccucugcuucagcaagaucggcggggaggacggcgacauccaccgcggguuccagucccugcuggucgccaucaaccggaccgacacggaguacgugcuccgcaccgcgaacggccuguucggcgagaaguccuacgacuuccugaccggguucaccgacagcugcggcaaguucuaccaggccacgaucaagcagcucgacuucgugaacgacaccgagaaguccaccacccgggucaacagcuggguggccgacaagacgaagggggagaacauccugcuguucuacuucgacaacauccucaacagcuucaucguguccagccugcagaacugccagaucuga

SEQ ID NO: 31179 - RNA, 1047 nt, Artificial Sequence
  derived and/or modified sequence opt1 from HMX1__Homo_sapiens__NP_061815
augcccgacgagcugaccgagccgggccgcgccacccccgcccgggcgagcuccuuccucaucgagaaccugcuggccgccgaggccaagggggccggccgcgcgacgcagggggacggcagccgggaggacgaggaggaggacgacgacgaccccgaggacgaggacgccgagcaggcccgccggcgccggcuccagcgccggcgccagcugcuggccgggaccggccccggcggggaggcgcgggcccgcgcccuccugggcccgggggcccugggccucgggccccggcccccgcccggccccggcccgcccuucgcccuggggugcggcggggcggcccgcugguacccccgggcccacggcggcuacgggggcgggcugucccccgacaccagcgaccgcgacucccccgagaccggcgaggagauggggcgggccgagggcgccuggccccgcggcccggggcccggcgcggugcagcgggaggccgccgagcucgccgcccgcgggcccgcggccggcacggaggaggccagcgagcuggccgagguccccgccgcggccggggagacccggggcggcgugggggugggcgggggccgcaagaagaagacccgcaccgucuucucccggagccagguguuccagcuggaguccacguucgaccucaagcgcuaccugagcuccgccgagcgggccgggcuggcggccagccuccagcugaccgagacccaggugaagaucugguuccagaaccgccggaacaaguggaagcgccagcuggccgccgagcucgaggccgcgucccugagcccgcccggcgcccagcggcugguccgcgugcccgugcucuaccacgaguccccgcccgccgccgccgcggccggcccgcccgccacccugcccuucccccuggcccccgccgcgcccgccccgcccccgccccuccugggguucagcggcgcccuggccuacccccucgcggccuuccccgccgccgccuccguccccuuccugcgggcgcagaugcccgggcugguguga

SEQ ID NO: 31180 - RNA, 546 nt, Artificial Sequence
  derived and/or modified sequence opt1 from HN1__Homo_sapiens__NP_001002032
augaccaccacgaccaccuucaagggcguggaccccaacagccgcaacuccagccggguccugcgcccgcccgggggcggguccaacuucagccucggcuucgacgagcccaccgagcagcccgugcggaagaacaagauggccuccaacaucuucgggacgccggaggagaaccaggccagcugggcgaaguccgccggcgccaagagcuccggcgggcgcgaggaccuggagagcuccggccugcagcggcgcaacagcuccgaggccagcuccggggacuuccucgaccugaagaagauguggacccagaccugccaggccgcguggggccgggugaagcgcagccccugccugcuccggcugugccccgcccgcuggccccggccgcagugccaccccgaggagaucccccuggccgccucccccgcgagcuccugggucagcagcgacugcccggagcgcugccgguccgugugcuuccuccacgccugcgagcugcacaaccugagccucaccgugcaccuccuggaccuguuccacuga

SEQ ID NO: 31181 - RNA, 573 nt, Artificial Sequence
  derived and/or modified sequence opt1 from HN1L__Homo_sapiens__NP_653171
auguuccaggugcccgacagcgagggcgggcgcgccggcucccgggccaugaagccgcccgggggcgagagcuccaaccuguucgggagccccgaggaggcgacccccuccagccgccccaaccggauggccuccaacaucuucggccccaccgaggagccccagaacauccccaagcgcacgaacccgcccggcgggaagggcagcgggaucuucgacgaguccacccccguccagacccggcagcaccucaacccgcccggcgggaagaccagcgacaucuucggcucccccgugacggccaccagccgccuggcccaccccaacaagcccaaggaccacguguuccugugcgagggcgaggagccgaaguccgaccucaaggccgcgcggagcauccccgccggggccgagcccggcgagaagggguccgcccgcaaggcgggccccgccaaggagcaggagccgaugcccaccgucgacagccacgagccccggcugggcccccgcccgcggucccacaacaaggugcugaacccgcccgggggcaagagcuccaucagcuucuacuga

SEQ ID NO: 31182 - RNA, 1896 nt, Artificial Sequence
  derived and/or modified sequence opt1 from HNF1A__Homo_sapiens__NP_000536
auggugagcaagcugucccagcugcagaccgagcugcuggccgcccuccuggagagcggccuguccaaggaggcgcucauccaggcccugggggagcccggcccguaccugcucgccggggagggcccccuggacaagggggagagcugcggcggcgggcgcggcgagcuggccgagcuccccaacgggcugggcgagacccggggguccgaggacgagacggacgacgacggcgaggacuucacgcccccgauccugaaggagcucgagaaccugagccccgaggaggccgcgcaccagaaggccgucguggagacccugcuccaggaggaccccuggcgcguggccaagauggucaaguccuaccugcagcagcacaacaucccccagcgggaggugguggacaccaccggccugaaccagagccaccucucccagcaccugaacaaggggaccccgaugaagacccagaagcgcgccgcgcuguacaccugguacguccggaagcagcgcgagguggcccagcaguucacgcacgccggccagggcggccucaucgaggagcccaccggcgacgagcugcccaccaagaaggggcggcgcaaccgguucaaguggggccccgccagccagcagauccuguuccaggccuacgagcgccagaagaacccguccaaggaggagcgggagacccucguggaggagugcaaccgcgcggagugcauccagcgcggggucagccccucccaggcccagggccuggggagcaaccuggugacggaggugcgggucuacaacugguucgccaaccggcgcaaggaggaggccuuccggcacaagcucgccauggacaccuacuccgggcccccgcccggccccgggcccggccccgcgcugccggcccacagcucccccgggcugcccccgcccgcccucagccccuccaaggugcacggcgugcgcuacgggcagcccgccaccagcgagaccgccgagguccccagcuccagcggcggcccgcuggugacgguguccacgccccugcaccaggucagccccaccgggcucgagccgucccacagccugcuguccaccgaggcgaagcucgugagcgccgccggcgggccccugccgcccguguccacccugaccgcccuccacagccuggagcagaccucccccggccugaaccagcagccccagaaccucaucauggccagccugcccggggucaugaccaucggccccggcgagccggcgucccuggggcccacguucaccaacaccggcgccagcacccucgugaucgggcuggccuccacgcaggcccagagcgugcccgucaucaacuccaugggcagcucccugaccacccugcagcccgugcaguucagccagccgcuccaccccagcuaccagcagccccugaugcccccgguccagucccacgugacccagagccccuucauggcgacgauggcccagcugcagagcccccacgcccucuacucccacaagcccgagguggcccaguacacccacaccggccugcugccgcagaccaugcucaucacggacaccaccaaccuguccgcccuggcgagccucacccccaccaagcaggucuucacguccgacaccgaggccagcuccgagagcgggcugcacacccccgccucccaggccaccacgcugcacgugcccagccaggacccggccggcauccagcaccuccagcccgcgcaccggcuguccgccagccccaccguguccagcuccagccugguccucuaccagagcuccgacagcuccaacgggcagagccaccuccugccguccaaccacagcgugaucgagaccuucaucuccacccagauggccagcuccagccaguga

SEQ ID NO: 31183 - RNA, 1674 nt, Artificial Sequence
  derived and/or modified sequence opt1 from HNF1B__Homo_sapiens__NP_000449
auggugagcaagcugaccucccuccagcaggagcugcugagcgcccuccuguccagcggcgucaccaaggaggugcuggugcaggcccucgaggagcugcugcccuccccgaacuucggggucaagcucgagacgcugccccugagccccggcuccggggcggagcccgacaccaagccgguguuccacacccucaccaacggccacgccaaggggcgccugagcggcgacgagggcuccgaggacggggacgacuacgacacgccgcccauccugaaggagcuccaggcccugaacaccgaggaggccgccgagcagcgggcggagguggaccgcaugcugagcgaggaccccuggcgggccgccaagaugaucaagggcuacaugcagcagcacaacaucccccagcgcgaggucguggacgugaccgggcucaaccagucccaccugagccagcaccugaacaagggcacccccaugaagacgcagaagcgggccgcgcucuacaccugguacguccgcaagcagcgggagauccugcgccaguucaaccagaccgugcaguccagcgggaacaugaccgacaaguccagccaggaccagcuccuguuccuguuccccgaguucucccagcagagccacggccccggccaguccgacgacgccugcagcgagccgacgaacaagaagaugcggcgcaaccgguucaagugggggcccgccagccagcagauccuguaccaggccuacgaccgccagaagaaccccuccaaggaggagcgggaggcccucguggaggagugcaaccgcgcggagugccugcagcggggcgucagccccuccaaggcccacgggcugggcagcaaccucgugaccgaggugcgcgucuacaacugguucgccaaccggcgcaaggaggaggccuuccggcagaagcuggccauggacgcguacuccagcaaccagacccacucccugaacccgcuccugagccacggcagcccccaccaccagcccuccuccagcccgcccaacaagcuguccggggugcgcuacagccagcagggcaacaacgagaucaccuccagcuccacgaucagccaccacgggaacuccgccauggugaccagccagagcguccuccagcaggucucccccgccagccuggaccccggccacaaccugcucucccccgacgggaagaugaucagcguguccggcggcgggcugccgcccgugagcacccugaccaacauccacucccucagccaccacaacccccagcagucccagaaccugaucaugacgccccugagcggcgugauggccaucgcccagucccucaacaccagccaggcgcaguccgugccggucaucaacagcguggccgggucccuggccgcccugcagcccguccaguucagccagcagcuccacagcccccaccagcagccgcugaugcagcagucccccggcagccacauggcccagcagcccuucauggcggccgugacccagcugcagaacucccacauguacgcccacaagcaggagcccccgcaguacagccacaccucccgguuccccagcgccaugguggucacggacaccuccagcaucuccacccugaccaacaugagcuccagcaagcagugcccccuccaggcgugguga

SEQ ID NO: 31184 - RNA, 1425 nt, Artificial Sequence
  derived and/or modified sequence opt1 from HNF4A__Homo_sapiens__NP_000448
augcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucuga

SEQ ID NO: 31185 - RNA, 1338 nt, Artificial Sequence
  derived and/or modified sequence opt1 from HNF4G__Homo_sapiens__NP_004124
auggacauggccaacuacagcgaggugcuggaccccaccuacaccacccucgaguucgagaccaugcagauccuguacaacuccagcgacuccagcgccccggagaccuccaugaacaccacggacaacggcgucaacugccugugcgcgaucugcggggaccgcgccaccggcaagcacuacggggccagcuccugcgacggcugcaagggguucuuccggcgcagcauccggaagucccacguguacagcugccgcuucucccggcagugcguggucgacaaggacaagcgcaaccagugccgguacugccgccuccggaagugcuuccgcgccggcaugaagaaggaggccgugcagaacgagcgggaccgcaucagcacccggcgcuccaccuucgacggcagcaacauccccuccaucaacacgcuggcgcaggccgaggugcggagccgccagaucuccgucagcucccccgggagcagcaccgacaucaacgugaagaagaucgccuccaucggcgacgugugcgagagcaugaagcagcagcugcucguccugguggagugggccaaguacauccccgcguucugcgagcugccgcucgacgaccagguggcccugcugcgggcccacgccggggagcaccuccugcugggcgccaccaagcgcuccaugauguacaaggacauccuccugcuggggaacaacuacgucauccaccggaacagcugcgagguggagaucucccgcguggcgaaccggguccucgacgagcuggugcgccccuuccaggagauccagaucgacgacaacgaguacgccugccugaaggccaucguguucuucgaccccgacgccaagggccucagcgaccccgucaagaucaagaacaugcgcuuccaggugcagaucggccuggaggacuacaucaacgaccggcaguacgacucccgcgggcgguucggcgagcugcuccugcugcucccgacccugcagagcaucacguggcagaugaucgagcagauccaguucgugaagcuguucgggauggucaagaucgacaaccuccugcaggagaugcugcucggcggcgccuccaacgacgggagccaccuccaccaccccaugcacccccaccugucccaggacccccugaccggccagaccauccugcuggggccgaugagcacccucgugcacgcggaccagaucuccacgcccgagacgccccugcccagcccgccccagggcuccgggcaggagcaguacaagaucgccgccaaccaggccagcgugaucucccaccagcaccugagcaagcagaagcagcucuga

SEQ ID NO: 31186 - RNA, 156 nt, Artificial Sequence
  derived and/or modified sequence opt1 from HNMT__Homo_sapiens__NP_001019245
auggccagcuccaugcgcagccuguucuccgaccacggcaaguacguggagagcuuccggcgcuuccucaaccacuccaccgagcaccagugcaugcaggaguucauggacaagaagcugcccgggaucaucggccgguaccagaacugcugcuga

SEQ ID NO: 31187 - RNA, 918 nt, Artificial Sequence
  derived and/or modified sequence opt1 from HNRNPA0__Homo_sapiens__NP_006796
auggagaacagccagcugugcaagcuguucaucggcgggcucaacgugcagaccuccgagagcggccugcgggggcacuucgaggccuucggcacccucacggacugcgucgugguggucaacccccagaccaagcggucccgcugcuucggguucgugaccuacagcaacguggaggaggccgacgcggccauggccgccuccccgcacgccgucgacggcaacaccguggagcugaagcgggcggugagccgcgaggacuccgcccggcccggcgcccacgccaaggucaagaagcuguucgucgggggccucaagggggacguggcggagggcgaccugaucgagcacuucagccaguucgggacgguggagaaggccgagaucaucgccgacaagcaguccggcaagaagcgcggcuucggguucguguacuuccagaaccacgacgccgccgacaaggcggccguggucaaguuccaccccauccagggccaccggguggaggugaagaaggccguccccaaggaggacaucuacagcgggggcggcgggggcgggucccgcagcucccggggcgggcgcggcggccgggggcgcggcgggggccgggaccagaacgggcugagcaagggcggcgggggcggguacaacuccuacggcggguacggcggcgggggcgggggcggcuacaacgccuacgggggcgggggcgggggcagcuccuacggcgggagcgacuacggcaacggguucggcggguucggcuccuacagccagcaccagagcuccuacggcccgaugaaguccgggggcgggggcgggggcggcgggagcagcuggggcgggcgcuccaacagcggccccuaccgcgggggcuacggcgggggcgggggcuacggcggguccagcuucuga

SEQ ID NO: 31188 - RNA, 963 nt, Artificial Sequence
  derived and/or modified sequence opt1 from HNRNPA1__Homo_sapiens__NP_002127
augagcaaguccgagagccccaaggagccggagcagcugcgcaagcuguucaucggcgggcuguccuucgagaccaccgacgagagccugcggucccacuucgagcaguggggcacgcucaccgacugcguggucaugcgcgaccccaacaccaagcggagccgcggguucggcuucgugaccuacgccacgguggaggaggucgacgccgcgaugaacgcccggccccacaagguggacgggcgcguggucgagcccaagcgggccgugucccgcgaggacagccagcggccgggcgcccaccugaccgugaagaagaucuucgucggcgggaucaaggaggacaccgaggagcaccaccuccgcgacuacuucgagcaguacggcaagaucgaggugaucgagaucaugaccgaccggggguccggcaagaagcgcggguucgccuucgugacguucgacgaccacgacagcgucgacaagaucgugauccagaaguaccacaccgugaacggccacaacugcgagguccggaaggcgcucuccaagcaggagauggccagcgccuccagcucccagcgcggccggagcggguccggcaacuucgggggcggccgcgggggcggguucggcgggaacgacaacuucggccggggcgggaacuucagcggccgcgggggcuucgggggcucccggggcgggggcggguacggcgggagcggcgacggcuacaacggguucggcaacgacgggagcaacuucggcggcgggggcuccuacaacgacuucgggaacuacaacaaccagagcuccaacuucggccccaugaagggcgggaacuucggcgggcgcagcuccggccccuacgggggcgggggccaguacuucgccaagccccggaaccagggcggguacggcgggagcuccagcuccagcuccuacggcagcgggcgccgcuucuga

SEQ ID NO: 31189 - RNA, 1026 nt, Artificial Sequence
  derived and/or modified sequence opt1 from HNRNPA2B1__Homo_sapiens__NP_002128
auggagcgcgagaaggagcaguuccggaagcuguucaucggcgggcucagcuucgagaccaccgaggagucccugcgcaacuacuacgagcaguggggcaagcugacggacugcguggucaugcgggaccccgccagcaagcgcucccggggguucggcuucgugaccuucagcuccauggccgagguggacgcggccauggccgcccgcccgcacagcaucgacgggcgggucguggagcccaagcgcgccguggcgcgggaggaguccggcaagcccggcgcccacgucaccgugaagaagcuguucgucgggggcaucaaggaggacaccgaggagcaccaccuccgggacuacuucgaggaguacgggaagaucgacacgaucgagaucaucaccgaccggcagagcggcaagaagcgcggguucggcuucgugaccuucgacgaccacgaccccguggacaagaucgugcugcagaaguaccacaccaucaacggccacaacgccgagguccggaaggcccucucccgccaggagaugcaggaggugcagagcucccggagcgggcgcggcgggaacuucggcuucggcgacucccgcgggggcgggggcaacuucgggccgggccccggcagcaacuuccgcgggggcuccgacggguacggcagcgggcggggcuucggcgacggguacaacggcuacgggggcgggcccggcggcgggaacuucggcgggucccccggcuacggcgggggccgcgggggcuacgggggcggcgggccgggcuacgggaaccagggcgggggcuacggcgggggcuacgacaacuacgggggcgggaacuacggcagcggcaacuacaacgacuucgggaacuacaaccagcagcccuccaacuacggccccaugaaguccgggaacuucggcgggagccggaacaugggcggccccuacgggggcgggaacuacggcccgggcgggagcggcgggagcggcggguacggcggccgcucccgcuacuga

SEQ ID NO: 31190 - RNA, 1137 nt, Artificial Sequence
  derived and/or modified sequence opt1 from HNRNPA3__Homo_sapiens__XP_005246437
auggaggugaagcccccgcccggccgcccccagcccgacagcgggcggcgccggcgccggcgcggcgaggaggggcacgacccgaaggagcccgagcagcugcggaagcuguucaucggcgggcucuccuucgagaccaccgacgacagccugcgcgagcacuucgagaaguggggcacgcucaccgacugcgucgugaugcgggacccccagaccaagcgcucccggggcuucggguucgugaccuacagcugcgucgaggagguggacgccgccaugugcgcgcgcccccacaagguggacggccgggucguggagccgaagcgcgccgugucccgggaggacagcgucaagcccggggcccaccugacggugaagaagaucuucgugggcgggaucaaggaggacaccgaggaguacaaccugcgcgacuacuucgagaaguacggcaagaucgagaccaucgaggucauggaggaccggcaguccggcaagaagcgcggguucgccuucgugaccuucgacgaccacgacacgguggacaagaucgucgugcagaaguaccacaccaucaacggccacaacugcgaggugaagaaggcccucagcaagcaggagaugcaguccgcggggagccagcggggccgcggcgggggcuccgggaacuucaugggccgcgggggcaacuucggcgggggcgggggcaacuucgggcggggcggcaacuucgggggccgcgggggcuacgggggcggcgggggcgggagccggggcuccuacggcgggggcgacgggggcuacaacggguucggcggcgacgggggcaacuacgggggcgggcccggcuacagcucccgcggcggguacggcgggggcgggcccggcuacggcaaccagggcggcggguacgggggcgggggcggguacgacggcuacaacgagggcgggaacuucggcgggggcaacuacgggggcgggggcaacuacaacgacuucggcaacuacagcgggcagcagcaguccaacuacggcccgaugaagggcgggagcuucgggggccgguccagcggcagccccuacgggggcggguacggcuccgggggcggcagcgggggcuacgggucccgccgguucuga

SEQ ID NO: 31191 - RNA, 858 nt, Artificial Sequence
  derived and/or modified sequence opt1 from HNRNPAB__Homo_sapiens__NP_004490
augagcgaggccggcgaggagcagcccauggagaccaccggggccacggagaacggccacgaggcggugccggagggggagucccccgccggcgccgggaccggcgccgccgcgggcgccgggggcgccaccgccgcgccgcccagcgggaaccagaacggcgccgagggggaccagaucaacgccuccaagaacgaggaggacgccggcaagauguucgucggcgggcugagcugggacaccuccaagaaggaccucaaggacuacuucacgaaguucggcgaggugguggacugcaccaucaagauggaccccaacaccgggcgcagccggggcuucggcuucauccuguucaaggacgccgcguccgucgagaaggugcuggaccagaaggagcaccgccucgacgggcgggugaucgaccccaagaaggccauggccaugaagaaggaccccgucaagaagaucuucgugggcgggcugaaccccgaggccaccgaggagaagauccgcgaguacuucggcgaguucggggagaucgaggccaucgagcugccgauggaccccaagcucaacaagcggcgcggcuucguguucaucacguucaaggaggaggagcccgucaagaaggugcuggagaagaaguuccacaccgugagcggcuccaagugcgagaucaaggucgcgcagcccaaggagguguaccagcagcagcaguacgggagcggcgggcggggcaaccgcaaccgggggaaccgcggcuccggcgggggcgggggcgggggcggccaggggagcaccaacuacggcaagucccagcggcgcgggggccaccagaacaacuacaagccguacuga

SEQ ID NO: 31192 - RNA, 921 nt, Artificial Sequence
  derived and/or modified sequence opt1 from HNRNPC__Homo_sapiens__XP_011535013
auggccagcaacgugaccaacaagaccgacccccgcuccaugaacagccgggucuucaucggcaaccugaacacgcucguggugaagaaguccgacgucgaggccaucuucagcaaguacgggaagaucgugggcugcuccgugcacaagggguucgcguucguccaguacgugaacgagcgcaacgcccgggccgccguggccggcgaggacgggcgcaugaucgcgggccagguccuggacaucaaccuggccgccgagcccaaggugaaccggggcaaggccggggugaagcgcagcgcggccgagauguacggcuccgucaccgagcaccccagccccagcccccuccuguccuccagcuucgaccuggacuacgacuuccagcgggacuacuacgaccgcauguacuccuaccccgcccgggugcccccgccgccgcccaucgcccgcgccgugguccccagcaagcggcagcgcguguccgggaacaccagccggcgcggcaaguccggguucaacagcaaguccggccagcggggcagcagcaaguccgggaagcucaagggcgacgaccugcaggcgaucaagaaggagcugacccagaucaagcagaagguggacagccuccuggagaaccuggagaagaucgagaaggagcaguccaagcaggccgucgagaugaagaacgacaagagcgaggaggagcaguccagcuccagcgugaagaaggacgagacgaacgugaagauggaguccgagggcggggccgacgacagcgccgaggagggcgaccuccuggacgacgacgacaacgaggaccgcggggacgaccagcuggagcucaucaaggacgacgagaaggaggccgaggagggcgaggacgaccgggacuccgcgaacggggaggacgacagcuga

SEQ ID NO: 31193 - RNA, 864 nt, Artificial Sequence
  derived and/or modified sequence opt1 from HNRNPD__Homo_sapiens__NP_001003810
augagcgaggagcaguucggcggggacggcgccgccgcggccgccaccgccgccgucgggggcuccgcgggggagcaggagggcgccaugguggccgccacccagggcgcggccgccgccgccgggagcggcgcggggacgggcgggggcaccgccuccggcgggaccgagggcgggagcgccgaguccgagggcgccaagaucgacgccagcaagaacgaggaggacgagggcaagauguucaucgggggccuguccugggacaccacgaagaaggaccucaaggacuacuucagcaaguucggggaggugguggacugcacccugaagcuggaccccaucaccggccggucccggggguucggcuucguccucuucaaggagagcgaguccguggacaaggugauggaccagaaggagcacaagcugaacggcaaggucaucgacccgaagcgcgcgaaggccaugaagaccaaggagcccgugaagaagaucuucgucgggggccugagccccgacacgcccgaggagaagauccgggaguacuucgggggcuucggggagguggaguccaucgagcucccgauggacaacaagaccaacaagcgccggggcuucugcuucaucaccuucaaggaggaggagcccgugaagaagaucauggagaagaaguaccacaacgugggccugagcaagugcgagaucaaggucgccauguccaaggagcaguaccagcagcagcagcagugggggagccgcggcggguucgccggccgggcccgcgggcggggcggcgaccagcaguccggguacggcaaggugagccgccgcgggggccaccagaacuccuacaagcccuacuga

SEQ ID NO: 31194 - RNA, 1092 nt, Artificial Sequence
  derived and/or modified sequence opt1 from HNRNPDL__Homo_sapiens__NP_001193929
auggaggugcccccgcgccugagccacgugcccccgccccucuuccccuccgcccccgccacccuggcgagccggucccugagccacuggcgcccccggcccccgcgccagcucgcgccccugcugcccucccucgcccccagcuccgcccggcagggcgcccgccgggcccagcgccacgugaccgcccagcagccgagccggcuggccgggggcgccgcgaucaagggcgggcgccggcgccggcccgaccuguuccgccggcacuucaaguccagcuccauccagcgcagcgccgccgccgccgcggccacgcggaccgcccgccagcacccgcccgccgacuccagcgugaccauggaggacaugaacgaguacuccaacaucgaggaguucgccgaggggagcaagaucaacgcguccaagaaccagcaggacgacggcaagauguucaucggcgggcucagcugggacaccuccaagaaggaccugacggaguaccugagccgguucggcgaggucguggacugcaccaucaagaccgaccccgugaccgggcgcagccggggcuucggguucguccucuucaaggacgccgccuccguggacaaggugcuggagcugaaggagcacaagcucgacggcaagcugaucgaccccaagcgcgccaaggcccugaagggcaaggagccgcccaagaaggucuucgucgggggccucagccccgacacguccgaggagcagaucaaggaguacuucggggcguucggcgagaucgagaacaucgagcugcccauggacaccaagaccaacgagcgccggggcuucugcuucaucaccuacacggacgaggagcccgugaagaagcugcucgagagccgcuaccaccagaucggguccggcaagugcgagaucaaggucgcccagcccaaggagguguaccggcagcagcagcagcagcagaagggcgggcgcggggccgccgccggcggccgcgggggcacccgggggcggggccgcgggcagcagagcaccuacggcaaggcgucccggggcgggggcaaccaccagaacaacuaccagccguacuga

SEQ ID NO: 31195 - RNA, 1248 nt, Artificial Sequence
  derived and/or modified sequence opt1 from HNRNPF__Homo_sapiens__NP_001091676
augaugcugggccccgagggcggggagggguucguggucaagcuccgcggccugccguggagcugcuccguggaggacgugcagaacuuccugagcgacugcaccauccacgacggggccgccggcguccacuucaucuacacccgggagggccgccaguccggggaggcguucguggagcucggcagcgaggacgacgugaagauggcccugaagaaggaccgggaguccauggggcaccgcuacaucgaggucuucaagagccaccggacggagauggacugggugcugaagcacuccggccccaacagcgccgacuccgccaacgacggguucgugcgccuccggggccugcccuucggcugcaccaaggaggagaucguccaguucuucagcgggcuggagaucgugcccaacggcaucacccucccgguggaccccgaggggaagaucaccggcgaggccuucguccaguucgcgucccaggagcuggccgagaaggcccugggcaagcacaaggagcgcaucgggcaccgguacaucgagguguucaagagcucccaggaggaggugcgcagcuacuccgacccgccccucaaguucaugagcguccagcggcccggccccuacgaccgccccgggacggcccggcgcuacaucggcaucgugaagcaggcggggcuggagcggaugcgccccggcgccuacuccaccggcuacgggggcuacgaggaguacagcgggcuguccgacggcuacggguucaccaccgaccucuucggccgggaccugagcuacugccugagcggcauguacgaccaccgcuacggggacuccgaguucacggugcagagcaccaccggccacugcguccacaugcgggggcucccguacaaggccaccgagaacgacaucuacaacuucuucagcccccugaaccccgugcgcgugcacaucgagaucggccccgacgggcgggucacgggcgaggccgacguggaguucgccacccacgaggaggcgguggccgccauguccaaggaccgcgccaacaugcagcaccgcuacaucgagcuguuccucaacuccaccaccggcgccagcaacggggcguacuccagccaggucaugcagggcauggggguguccgccgcccaggccacguacagcggccuggagucccagagcgucuccggcugcuacggggccggcuacagcgggcagaacuccaugggcggguacgacuga

SEQ ID NO: 31196 - RNA, 1350 nt, Artificial Sequence
  derived and/or modified sequence opt1 from HNRNPH1__Homo_sapiens__NP_005511
augaugcugggcaccgagggcggggagggguucguggucaaggugcgcggccuccccuggagcugcuccgccgacgaggugcagcgguucuucagcgacugcaagauccagaacggggcccagggcauccgcuucaucuacacccgggagggccgcccguccggggaggcguucgucgagcuggagagcgaggacgaggugaagcuggcccucaagaaggaccgggagacgaugggccaccgcuacguggaggucuucaaguccaacaacguggagauggacugggugcugaagcacaccgggcccaacagccccgacaccgccaacgacggcuucguccggcugcgcgggcuccccuucggcugcuccaaggaggagaucgugcaguucuucagcggccuggagaucgugccgaacgggaucacccugcccgucgacuuccagggccgguccacgggggaggccuucgugcaguucgccagccaggagaucgcggagaaggcccucaagaagcacaaggagcgcaucggccaccgguacaucgagaucuucaaguccagccgcgccgaggugcggacccacuacgacccgccccgcaagcugauggccaugcagcggcccggccccuacgaccgccccggggcgggccggggguacaacuccaucggccgcggggccggcuucgagcggaugcgccggggcgccuacgggggcggguacggcggguacgacgacuacaacggcuacaacgacggcuacggguucggcagcgaccgcuucgggcgcgaccugaacuacugcuucuccggcaugagcgaccaccgguacggggacggcggcuccaccuuccagagcaccacggggcacugcguccacaugcgcggccuccccuaccgggccaccgagaacgacaucuacaacuucuucuccccgcugaaccccgugcgcgugcacaucgagaucgggcccgacggccgggucaccggcgaggccgacguggaguucgcgacccacgaggacgccguggccgccaugagcaaggacaaggccaacaugcagcaccgcuacgucgagcuguuccucaacagcacggcgggggccuccggcggggccuacgagcaccgguacguggagcuguuccugaacagcaccgccggcgccuccgggggcgcguacggcagccagaugaugggcgggauggggcucuccaaccagagcuccuacggcgggcccgccagccagcagcuguccggcggcuacgggggcggguacggcgggcagagcuccaugagcggcuacgaccaggugcugcaggagaacuccagcgacuuccaguccaacaucgccuga

SEQ ID NO: 31197 - RNA, 1350 nt, Artificial Sequence
  derived and/or modified sequence opt1 from HNRNPH2__Homo_sapiens__NP_001027565
augaugcugagcaccgagggccgcgagggguucguggucaaggugcggggccuccccugguccugcagcgccgacgaggugaugcgcuucuucuccgacugcaagauccagaacgggaccagcggcauccgguucaucuacacgcgcgaggggcggccguccggcgaggccuucgucgagcuggagagcgaggaggaggugaagcuggcgcucaagaaggaccgcgagaccaugggccaccgguacguggaggucuucaaguccaacagcguggagauggacugggugcugaagcacaccgggcccaacucccccgacaccgccaacgacggcuucguccgccugcgggggcuccccuucggcugcagcaaggaggagaucgugcaguucuucuccgggcuggagaucgugccgaacggcaugacgcugcccgucgacuuccagggccgcagcaccggggaggccuucgugcaguucgccucccaggagaucgccgagaaggcgcucaagaagcacaaggagcggaucggccaccgcuacaucgagaucuucaagagcucccgggccgaggugcgcacccacuacgacccgccccggaagcugauggccaugcagcgccccgggcccuacgaccggcccggcgccggccgcggguacaacagcaucggccgcggggcgggcuucgagcggaugcggcgcggggccuacggcggcggguacggcggguacgacgacuacggcggguacaacgacggcuacggcuucggguccgaccgcuucggccgggaccugaacuacugcuucagcgggauguccgaccaccgcuacggcgacgggggcagcagcuuccaguccaccacgggccacugcguccacaugcgggggcuccccuaccgcgccaccgagaacgacaucuacaacuucuucagcccgcugaaccccaugcgggugcacaucgagaucggccccgacgggcgcgugaccggcgaggccgacgucgaguucgccacccacgaggacgcgguggccgccauggccaaggacaaggccaacaugcagcaccgguacguggagcuguuccucaacuccacggcgggcaccagcgggggcgccuacgaccacuccuacgucgagcuguuccugaacagcaccgccggggccuccggcggggccuacggcagccagaugaugggcgggaugggccucuccaaccagagcuccuacgggggccccgcgagccagcagcuguccgggggcuacggcgggggcuacgggggccagagcuccaugagcggguacgaccaggugcugcaggagaacuccagcgacuaccaguccaaccucgccuga

SEQ ID NO: 31198 - RNA, 1395 nt, Artificial Sequence
  derived and/or modified sequence opt1 from HNRNPK__Homo_sapiens__NP_112553
auggagaccgagcagcccgaggagaccuucccgaacacggagaccaacggcgaguucgggaagcgccccgccgaggacauggaggaggagcaggccuucaagcggagccgcaacaccgacgagaugguggagcugcggauccuccugcaguccaagaacgcgggcgccgucaucgggaagggcgggaagaacaucaaggcccugcgcaccgacuacaacgccagcguguccgugcccgacagcuccggccccgagcggauccucagcaucuccgccgacaucgagacgaucggcgagauccugaagaagaucaucccgacccuggaggaggggcuccagcugcccagccccaccgcgaccucccagcugccccucgagagcgacgccgucgagugccugaacuaccagcacuacaagggcuccgacuucgacugcgagcugcgccuccugauccaccagagccuggccgggggcaucaucggggugaagggcgccaagaucaaggagcuccgggagaacacgcagaccaccaucaagcuguuccaggagugcugcccgcacuccaccgaccgcgugguccugaucggcgggaagcccgaccgggugguggagugcaucaagaucauccucgaccugaucagcgagucccccaucaagggccgcgcgcagcccuacgacccgaacuucuacgacgagacguacgacuacgggggcuucaccaugauguucgacgaccggcgcggccggcccgucggguuccccaugcgcggccgggggggcuucgaccgcaugcccccggggcggggcggccgccccaugccccccagccggcgcgacuacgacgacauguccccgcggcgcgggcccccccccccgccccccggccgcgggggccgggggggcagccgcgcccggaaccugccccucccgccccccccgcccccccgcggcggggaccugauggccuacgaccggcgcggccggcccggggaccgcuacgacggcauggugggguucuccgccgacgagaccugggacagcgccaucgacaccuggagcccguccgaguggcagauggcguacgagccccagggcggcagcggguacgacuacuccuacgccggcgggcggggcagcuacggcgaccuggggggccccaucaucacgacccaggugaccauccccaaggaccucgccggguccaucaucggcaaggggggccagcgcaucaagcagauccggcacgagagcggcgccuccaucaagaucgacgagccgcuggaggggagcgaggaccgcaucaucaccaucacgggcacccaggaccagauccagaacgcccaguaccugcuccagaacuccgucaagcaguacgcggacguggagggguucuga

SEQ ID NO: 31199 - RNA, 1770 nt, Artificial Sequence
  derived and/or modified sequence opt1 from HNRNPL__Homo_sapiens__NP_001524
augagccgccggcugcucccccgcgccgagaagcggcgccggcgccuggagcagcggcagcagcccgacgagcagcgccggcgcuccggcgccauggugaagauggccgccgccgggggcgggggcgggggcggccgguacuacgggggcgggagcgagggcgggcgcgcccccaagcggcugaagaccgacaacgccggcgaccagcacggcgggggcgggggcggcgggggcggggcgggcgccgccgggggcggcgggggcggggagaacuacgacgacccccacaagacccccgccuccccggucgugcacauccgcggccucaucgacgggguggucgaggcggaccugguggaggcccugcaggaguucggccccaucagcuacguggucgugaugcccaagaagcggcaggcccucguggaguucgaggacguccugggcgccugcaacgccgugaacuacgcggccgacaaccagaucuacaucgccgggcaccccgccuucgugaacuacuccacgagccagaagaucucccgcccgggcgacagcgacgacucccggagcgucaacuccgugcuccucuucaccauccugaaccccaucuacagcaucaccaccgacgugcuguacacgaucugcaaccccugcgggcccguccagcgcaucgugaucuuccggaagaacggcgugcaggccauggucgaguucgacuccgugcagagcgcgcagcgcgccaaggccucccugaacggggccgacaucuacagcggcugcugcacccugaagaucgaguacgccaagccgacccggcugaacguguucaagaacgaccaggacaccugggacuacacgaaccccaaccucuccggccagggggaccccggcagcaaccccaacaagcgccagcgccagccgccccugcugggggaccaccccgcggaguacggcggcccccacgggggcuaccacucccacuaccacgacgagggguacggcccgcccccgccccacuacgaggggcggcgcaugggcccgcccgucggcgggcaccggcgcggccccagccgguacgggccccaguacggccacccgccgccgcccccgccgccgcccgaguacgggccccacgccgacagccccgugcucaugguguacggccuggaccaguccaagaugaacugcgaccgcgucuucaacguguucugccuguacggcaacgucgagaaggugaaguucaugaaguccaagcccggggccgccaugguggagauggccgacggcuacgcggucgaccgggccaucacccaccucaacaacaacuucauguucgggcagaagcugaacgugugcgugagcaagcagcccgccaucaugcccggccagagcuacgggcuggaggacggcuccugcagcuacaaggacuucuccgagagccgcaacaaccgguucuccacccccgagcaggccgcgaagaaccgcauccagcaccccagcaacguccuccacuucuucaacgcgccccuggaggugaccgaggagaacuucuucgagaucugcgacgagcugggcgugaagcggcccuccagcgucaagguguucuccggcaagagcgagcgcuccagcuccgggcuccuggagugggagagcaaguccgacgcccuggagacgcucggguuccugaaccacuaccagaugaagaaccccaacggccccuaccccuacacccugaagcucugcuucagcaccgcccagcacgccagcuga

SEQ ID NO: 31200 - RNA, 2193 nt, Artificial Sequence
  derived and/or modified sequence opt1 from HNRNPM__Homo_sapiens__NP_005959
auggccgccggcguggaggcggccgccgaggucgccgccaccgagaucaagauggaggaggagagcggggcgcccggcgugccguccgggaacggcgcccccgggcccaagggcgagggcgagcgccccgcccagaacgagaagcggaaggagaagaacaucaagcgcgggggcaaccgguucgagccguacgccaaccccaccaagcgcuaccgggcguucaucacgaacauccccuucgacgugaaguggcagagccugaaggaccucgucaaggagaaggugggggaggugaccuacgucgagcugcugauggacgccgagggcaagucccgcgggugcgccgugguggaguucaagauggaggagagcaugaagaaggccgccgagguccucaacaagcacucccugagcggccggccccugaaggugaaggaggacccggacggcgagcacgcgcgccgggccaugcagaaggugauggccaccaccgggggcauggggaugggccccggcgggcccggcaugaucacgaucccgcccuccauccucaacaaccccaacauccccaacgagaucauccacgcccugcaggccgggcgccugggcagcaccgucuucguggcgaaccucgacuacaaggugggguggaagaagcugaaggaggucuucuccauggccggcguggugguccgggccgacauccuggaggacaaggacggcaagagccgcgggaucggcaccgugaccuucgagcaguccaucgaggccgugcaggccaucagcauguucaacgggcagcuccuguucgaccggcccaugcacgucaagauggacgagcgcgcgcugccgaagggcgacuucuucccgcccgagcggccccagcagcucccccacgggcugggcggcaucgggaugggccuggggcccggcgggcagcccaucgacgccaaccaccucaacaagggcaucggcauggggaacaucggccccgccgggaugggcauggagggcaucggguucggcaucaacaagaugggcgggauggaggggccguucggcggcgggauggagaacaugggccgcuucggguccggcaugaacauggggcggaucaacgagauccugagcaacgcccugaagcgcggcgagaucaucgccaagcagggcgggggcgggggcgggggcuccgugcccggcaucgagcggauggggcccggcaucgaccgccucgggggcgcggggauggagcggaugggcgccggccuggggcacggcauggaccgcguggggagcgagaucgagcgcaugggccuggucauggaccggaugggcuccguggagcgcauggggagcggcaucgagcggauggggccccucggccuggaccacauggccuccagcaucgagcgcauggggcagacgauggagcggaucggcagcggcgucgagcgcaugggggccggcaugggguucggccuggagcggauggcggccccgaucgaccgcguggggcagaccaucgagcggaugggcuccggcguggagcgcauggggcccgccaucgagcggaugggccucagcauggagcgcaugguccccgccgggaugggcgccgggcuggagcggaugggcccggugauggaccgcauggcgaccggccuggagcggaugggggccaacaaccucgagcgcaugggccuggagcggaugggggccaacucccuggagcgcaugggccucgagcggaugggcgccaacagccuggagcgcauggggcccgccaugggccccgcgcugggggccggcaucgagcgcauggggcucgccaugggcggcgggggcggggccuccuucgaccgggccaucgagauggagcgcggcaacuucgggggcagcuucgcgggcuccuucgggggcgccgggggccacgcccccgggguggcccggaaggcgugccagaucuucguccgcaaccugccguucgacuucaccuggaagaugcugaaggacaaguucaacgagugcggccacgugcucuacgccgacaucaagauggagaacggcaagagcaaggggugcggcguggucaaguucgagucccccgagguggccgagcgggccugccgcaugaugaacgggaugaagcugagcggccgggagaucgacgugcgcaucgaccggaacgccuga

SEQ ID NO: 31201 - RNA, 1788 nt, Artificial Sequence
  derived and/or modified sequence opt1 from HNRNPR__Homo_sapiens__NP_001284549
auggccaaccaggugaacggcaacgccguccagcugaaggaggaggaggagcccauggacaccagcuccgugacccacacggagcacuacaagacccucaucgaggccgggcugccccagaagguggccgagcgccuggacgagaucuuccagaccggccucgucgccuacguggaccuggacgagcgggccaucgacgcccugcgcgaguucaacgaggagggggcgcucagcgugcugcagcaguucaaggaguccgaccugagccacguccagaacaaguccgccuuccucugcggcgugaugaagaccuaccggcagcgcgagaagcaggggagcaaggugcaggaguccacgaagggccccgacgaggccaagaucaaggucuucgugggcaagaucccccgggaccuguacgaggacgagcuggugccccucuucgagaaggccgggcccaucugggaccugcgccugaugauggacccccucagcggccagaaccggggguacgcguucaucaccuucugcggcaaggaggccgcccaggaggccgucaagcugugcgacuccuacgagauccgccccgggaagcaccugggcgugugcaucagcguggccaacaaccgccucuucgucggcuccauccccaagaacaagaccaaggagaacauccuggaggaguucagcaaggugaccgaggggcugguggacgucauccucuaccaccagcccgacgacaagaagaagaaccggggcuucugcuuccuggaguacgaggaccacaaguccgcggcccaggcccggcgccggcugaugagcgggaaggugaagguguggggcaacgucgugacgguggagugggccgaccccgucgaggagcccgaccccgaggugauggccaaggucaagguccucuucgugcgcaaccuggcgaccaccgugaccgaggagauccuggagaaguccuucagcgaguucggcaagcucgagcgggugaagaagcugaaggacuacgccuucgugcacuucgaggaccgcggggccgccgucaaggccauggacgagaugaacggcaaggagaucgagggggaggagaucgagaucgugcuggcgaagccgcccgacaagaagcggaaggagcgccaggccgcccggcaggccucccgcagcacggccuacgaggacuacuacuaccacccgcccccgcggaugcccccgcccauccgcggccgcgggcggggcggcgggcgcggcggguacggcuacccgcccgacuacuacggguacgaggacuacuacgacgacuacuacggcuacgacuaccacgacuaccggggcggguacgaggaccccuacuacggcuacgacgacggguacgcggugcgcggccgcgggggcggccgcgggggccgcggggcgccgcccccgccccggggccggggcgccccgccgccccgggggcgggccggcuacucccagcgcggggcgccccucggcccgccccgggggagccgcggcggccgcgggggccccgcccagcagcagcgggggcggggcagccgcgggucccggggcaaccgcggcgggaacgucggcgggaagcgcaaggccgacggcuacaaccagcccgacagcaagcggcgccagaccaacaaccagcagaacugggggucccagcccaucgcccagcagccccugcagcagggcggcgacuacagcgggaacuacggcuacaacaacgacaaccaggaguucuaccaggacaccuacgggcagcaguggaaguga

SEQ ID NO: 31202 - RNA, 2421 nt, Artificial Sequence
  derived and/or modified sequence opt1 from HNRNPU__Homo_sapiens__NP_004492
augagcuccagccccgugaacgucaagaagcugaagguguccgagcucaaggaggagcugaagaagcgccggcugagcgacaagggccucaaggccgagcugauggagcgccugcaggccgcgcucgacgacgaggaggccgggggccggccggccauggagcccgggaacggcucccuggaccucgggggcgacagcgccggccgcuccggggccggccuggagcaggaggcggccgccgggggcgacgaggaggaggaggaggaggaggaggaggaggaggggaucagcgcccuggacggcgaccagauggagcugggcgaggagaacggggcggccggcgccgccgacuccgggcccauggaggaggaggaggccgcgagcgaggacgagaacggcgacgaccagggcuuccaggagggggaggacgagcucggcgacgaggaggagggggccggcgacgagaacgggcacggcgagcagcagccccagccgcccgccacccagcagcagcagccccagcagcagcggggcgccgccaaggaggcggccgggaaguccagcggccccaccucccuguucgccgugacggucgccccgcccggggcccgccagggccagcagcaggccgggggcgacggcaagaccgagcagaagggcggggacaagaagcgcggggugaagcggccccgggaggaccacggccgcggguacuucgaguacaucgaggagaacaaguacagccgggccaagagcccccagccgcccguggaggaggaggacgagcacuucgacgacaccgucgugugccuggacaccuacaacugcgaccuccacuucaagaucagccgcgaccggcuguccgccagcucccugacgauggagagcuucgccuuccucugggccggcggccgcgcgagcuacgggguguccaagggcaaggucugcuucgagaugaaggugaccgagaagauccccgugcggcaccuguacaccaaggacaucgacauccacgagguccgcaucggguggagccugaccacguccggcaugcuccugggcgaggaggaguucagcuacggguacucccugaagggcaucaagaccugcaacugcgagaccgaggacuacggggagaaguucgacgagaacgacgugaucacgugcuucgccaacuucgagagcgacgagguggagcucuccuacgccaagaacggccaggaccugggggucgccuucaagaucagcaaggaggugcuggcgggccggccccucuucccgcacgugcugugccacaacugcgccgucgaguucaacuucggccagaaggagaagcccuacuuccccauccccgaggaguacaccuucauccagaacgugccgcuggaggaccgcgugcgggggcccaagggccccgaggagaagaaggacugcgaggucgugaugaugaucgggcuccccggcgccgggaagaccaccugggugaccaagcacgccgccgagaacccgggcaaguacaacauccugggcacgaacaccaucauggacaagaugauggucgcgggguucaagaagcagauggccgacaccggcaagcugaacacccuccugcagcgcgcgccccagugccuggggaaguucaucgagaucgccgcccggaagaagcgcaacuucauccucgaccagacgaacguguccgcggccgcccagcgccggaagaugugccuguucgccggcuuccagcgcaaggccgucguggugugccccaaggacgaggacuacaagcagcggacccagaagaaggcggaggucgaggggaaggaccugcccgagcacgccgugcucaagaugaagggcaacuucacccugccggagguggccgagugcuucgacgagaucaccuacgucgagcugcagaaggaggaggcccagaagcuccuggagcaguacaaggaggagagcaagaaggcgcugccgcccgagaagaagcagaacacgggcuccaagaaguccaacaagaacaaguccgggaagaaccaguucaaccgcggcgggggccaccgggggcgcggcggcuucaacaugcggggcgggaacuuccgcgggggcgcccccggcaaccgcgggggcuacaaccggcgggggaacaugccccagcgcggcgggggcggcgggggcagcgggggcaucggguaccccuacccccgggccccgguguuccccggccgcggcuccuacagcaaccgggggaacuacaaccgcggcgggaugcccaaccggggcaacuacaaccagaacuuccgcgggcggggcaacaaccgcggcuacaagaaccagucccagggguacaaccaguggcagcagggccaguucugggggcagaagcccuggagccagcacuaccaccagggcuacuacuga

SEQ ID NO: 31203 - RNA, 2571 nt, Artificial Sequence
  derived and/or modified sequence opt1 from HNRNPUL1__Homo_sapiens__NP_008971
auggacgugcgccggcugaaggucaacgagcuccgcgaggagcugcagcggcgcggccuggacacccgggggcucaaggccgagcuggccgagcgccugcaggcggcccucgaggccgaggagcccgacgacgagcgggagcuggacgccgacgacgagccgggccgccccgggcacaucaacgaggagguggagaccgagggcgggagcgagcuggagggcacggcccagccccccccgcccggccuccagccccacgcggagcccgggggcuacuccgggccggacggccacuacgccauggacaacaucacccggcagaaccaguucuacgacacccaggugaucaagcaggagaacgagagcggguacgagcgccggccccuggagauggagcagcagcaggccuaccgccccgagaugaagaccgagaugaagcagggcgcccccacguccuuccugccgcccgaggcgagccagcucaagcccgaccggcagcaguuccagucccgcaagcggcccuacgaggagaaccgcggccggggguacuucgagcaccgcgaggaccggcgcggccggagcccgcagccccccgccgaggaggacgaggacgacuucgacgacacccuggucgccaucgacaccuacaacugcgaccugcacuucaagguggcccgcgaccgcuccagcggguacccccucaccaucgagggcuucgccuaccugugguccggcgcgcgggccagcuacggggugcgccggggccgcgucugcuucgagaugaagaucaacgaggagaucuccgugaagcaccugccgagcacggagcccgacccccacgugguccggaucggguggucccucgacagcugcuccacccagcugggcgaggagcccuucagcuacggguacggcggcaccgggaagaaguccaccaacagccgcuucgagaacuacggcgacaaguucgccgagaacgacgugaucgggugcuucgccgacuucgagugcggcaacgacguggagcuguccuucacgaagaacgggaaguggaugggcaucgccuuccggauccagaaggaggcgcucggcgggcaggcccuguacccgcacguccuggugaagaacugcgccguggaguucaacuucggccagcgcgccgagcccuacugcagcguccuccccggguucaccuucauccagcaccugccccugagcgagcggauccgcggcaccguggggccgaaguccaaggccgagugcgagauccucaugauggugggccugcccgcggccggcaagaccacgugggccaucaagcacgccgccagcaaccccuccaagaaguacaacauccuggggaccaacgcgaucauggacaagaugcgggucaugggccuccgccggcagcgcaacuacgccgggcggugggacgugcugauccagcaggccacccagugccugaaccgccucauccagaucgccgcgcggaagaagcgcaacuacauccuggaccagaccaacguguacggcagcgcccagcggcgcaagaugcgcccguucgagggcuuccagcggaaggccaucgucaucugccccacggacgaggaccugaaggaccgcaccaucaagcggaccgacgaggaggggaaggacgugcccgaccacgccgugcucgagaugaaggccaacuucacccugcccgacgucggcgacuuccuggacgaggugcucuucaucgagcugcagcgcgaggaggcggacaagcugguccggcaguacaacgaggaggggcgcaaggccggcccgccccccgagaagcgguucgacaaccgcgggggcggcggguuccggggccgcgggggcgggggcggcuuccagcgguacgagaaccgcgggcccccgggcgggaaccggggcggguuccagaaccgcggcggcggguccggcgggggcgggaacuaccggggcggcuucaaccgcagcgggggcgggggcuacucccagaaccgguggggcaacaacaaccgcgacaacaacaacagcaacaaccggggguccuacaaccgcgccccccagcagcagccccccccgcagcagcccccccccccgcagccccccccccagcagccgcccccccccccgagcuacucccccgcccggaaccccccgggcgccagcacguacaacaagaacuccaacauccccgggagcuccgcgaacaccagcacccccaccguguccagcuacucccccccgcagcccagcuacagccagccccccuacaaccagggcggguacucccagggcuacacggccccgcccccccccccgcccccccccccggccuacaacuacggcagcuacgggggcuacaaccccgcccccuacacccccccgcccccccccaccgcccagaccuacccgcagcccuccuacaaccaguaccagcaguacgcgcagcaguggaaccaguacuaccagaaccaggggcaguggccccccuacuacggcaacuacgacuacgggagcuacuccggcaacacgcagggcgggaccagcacccaguga

SEQ ID NO: 31204 - RNA, 495 nt, Artificial Sequence
  derived and/or modified sequence opt1 from HOGA1__Homo_sapiens__NP_001128142
augcugggcccccagguguggagcuccguccgccaggggcucagccggucccugagccgcaacgugggcgugugggccuccggggagggcaagaaggucgacaucgccgggaucuacccgcccgugaccacccccuucacggcgaccgccgagguggacuacggcaagcuggaggagaaccuccacaagcugggcaccuuccccuuccgcggggccgucggcggggugugcgcccuggccaacgugcucggcgcgcaggucugccagcuggagcggcugugcugcaccgggcagugggaggacgcccagaagcuccagcaccggcugaucgagccgaacgccgccgugacgcgccgguucggcauccccggccugaagaagaucauggacugguucggguacuacggcgggcccugccgcgcgccccuccaggagcugagcccggccgaggaggaggcccugcggauggacuucaccuccaacggcuggcucuga

SEQ ID NO: 31205 - RNA, 675 nt, Artificial Sequence
  derived and/or modified sequence opt1 from HOMER1__Homo_sapiens__NP_001264006
augggcgagcagcccaucuucagcacccgcgcccacguguuccagaucgacccgaacaccaagaagaacuggguccccacguccaagcacgccgugaccgugagcuacuucuacgacuccacccggaacgucuaccgcaucaucagccuggacggguccaaggcgaucaucaacagcaccaucacgcccaacaugaccuucaccaagaccucccagaaguucggccagugggccgacagccgggccaacacgguguacgggcucggcuucuccagcgagcaccaccuguccaaggugaccgagcuggagugcgucagcucccaggccaacgccgugcacacccacaagaccgagcucaaccagacgauccaggagcuggaggagacccugaagcucaaggaggaggagaucgagcgccugaagcaggagaucgacaacgcgcgggagcugcaggagcagcgcgacagccucacccagaagcugcaggagguggagauccggaacaaggaccuggaggggcagcucuccgaccuggagcagcgccuggagaagucccagaacgagcaggaggccuuccggaacaaccucaagacccugcuggagauccucgacggcaagaucuucgagcugacggagcugcgcgacaaccucgccaagcugcuggagugcagcuga

SEQ ID NO: 31206 - RNA, 1032 nt, Artificial Sequence
  derived and/or modified sequence opt1 from HOMER2__Homo_sapiens__NP_004830
augggcgagcagcccaucuucaccacccgcgcccacguguuccagaucgacccgaacacgaagaagaacuggaugcccgccagcaagcaggcggucaccguguccuacuucuacgacgugacccggaacagcuaccgcaucaucuccgucgacggggccaaggugaucaucaacagcaccaucacgcccaacaugaccuucaccaagaccucccagaaguucggccagugggccgacagccgggccaacacgguguucgggcugggcuucuccagcgagcagcagcucaccaaguucgccgagaaguuccaggaggucaaggaggcggccaagaucgccaaggacaagacccaggagaagaucgagaccuccagcaaccacucccaggccagcuccgugaacgggacggacgacgagaaggcgagccacgccggccccgccaacacccaccugaaguccgagaacgacaagcugaagaucgcccucacccagagcgccgcgaacgugaagaagugggagaucgagcugcagacccugcgcgaguccaacgcccggcucacgaccgcccugcaggagagcgccgccuccgucgagcaguggaagcgccaguucagcaucugccgggacgagaacgaccgccugcggaacaagaucgacgagcucgaggagcagugcagcgagaucaaccgcgagaaggagaagaacacccagcugaagcggcgcaucgaggagcuggaggcggagcuccgggagaaggagaccgagcugaaggaccugcgcaagcaguccgagaucaucccgcagcucaugagcgagugcgaguacguguccgagaagcuggaggccgccgagcgggacaaccagaaccuggaggacaaggugcgcagccucaagacggacaucgaggaguccaaguaccggcagcgccaccugaaggucgagcucaagagcuuccuggaggugcuggacggcaagaucgacgaccugcacgacuuccggcgcgggcucuccaagcugggcaccgacaacuga

SEQ ID NO: 31207 - RNA, 1077 nt, Artificial Sequence
  derived and/or modified sequence opt1 from HOMER3__Homo_sapiens__NP_001139193
augagcaccgcccgcgagcagcccaucuucuccacccgggcccacguguuccagaucgacccggcgacgaagcgcaacuggauccccgccggcaagcacgcccugaccgucagcuacuucuacgacgccacccggaacguguaccgcaucaucuccaucgggggcgccaaggcgaucaucaacagcaccgugacgcccaacaugaccuucaccaagaccucccagaaguucgggcagugggccgacagccgggccaacacggucuacggccucggguucgccuccgagcagcaccugacccaguucgcggagaaguuccaggaggugaaggaggccgcccgccuggcccgggagaagucccaggacggcggcgagcucaccucccccgcccuggggcuggcgagccaccaggugccgcccagcccccucgucagcgccaacggccccggggaggagaagcuguuccgcucccagagcgccgacgccccgggccccaccgagcgggagcgccugaagaagaugcucuccgaggggagcgugggcgaggugcagugggaggccgaguucuucgcgcugcaggacuccaacaacaagcuggccggcgcccuccgggaggccaacgccgcggccgcccaguggcgccagcagcuggaggcccagcgggccgaggcggagcgccugcggcagcgcgucgccgagcucgaggcccaggccgcgagcgaggugacgcccaccggggagaaggagggccuggggcagggccagucccuggagcagcucgaggcccuggugcagaccaaggaccaggagauccagacccucaagagccagacgggcgggccccgggaggcccuggaggccgccgagcgcgaggagacccagcagaagguccagacccggaacgcggagcuggagcaccagcugcgcgccauggagcggagccucgaggaggcccgcgccgagcgcgagcgggcccgcgcggaggugggccgggccgcccagcugcuggacgugucccucuucgagcugagcgagcugcgcgaggggcucgcccggcuggccgaggcggccccguga

SEQ ID NO: 31208 - RNA, 1653 nt, Artificial Sequence
  derived and/or modified sequence opt1 from HOMEZ__Homo_sapiens__NP_065885
auggugcgcggcugggagcccccgcccgggcuggacugcgccaucagcgagggccacaaguccgaggggaccaugccccccaacaaggaggccagcggccucuccagcuccccggcggggcugaucugccugccccccaucagcgaggagcuccagcuggucuggacccaggccgcccagacguccgagcuggacagcaacgagcaccuccugaagaccuucuccuacuuccccuacccgagccuggccgacaucgcccuccugugccugcgguacggccuccagauggagaaggugaagaccugguucauggcgcagcgccugcggugcggcaucuccuggagcuccgaggagaucgaggagacccgcgcccggguggucuaccgccgggaccagcugcacuucaagagccuccuguccuucacgcaccacgccgggcgcccccccgaggaggugcccccgccccccgugcccgccccggagcaggucggcaucgggaucggcccccccacccugagcaagcccacccagaccaaggggcucaagguggagccggaggagcccucccagaugcccccccugccgcagagccaccagaagcugaaggagucccucaugacgcccggcagcggcgcguuccccuaccagagcgacuucuggcagcaccugcaguccagcgggcuguccaaggagcaggccggccgggggcccaaccagagccacggcaucggcaccgccuccuggaaccacagcaccaccgugccgcagccccaggcccgcgacaagcccccgcccaucgcccucaucgcguccagcugcaaggaggaguccgccagcuccgucacgcccagcuccagcuccaccagcuccagcuuccaggugcuggccaacggggccaccgccgcguccaagccccugcagccgcucggcugcgugccccagagcgucagccccuccgagcaggcccugcccccgcaccuggagcccgccuggccccaggggcuccggcacaacagcgugcccggccgcguggggccgaccgaguaccugucccccgacaugcagcggcagcgcaagacgaagcggaagaccaaggagcagcuggccauccucaagagcuucuuccugcagugccagugggcccgccgggaggacuaccagaagcuggagcagaucaccggccucccccgccccgagaucauccagugguucggcgacacccgguacgcgcugaagcacgggcagcugaagugguuccgcgacaacgccgucccgggcgcccccuccuuccaggaccccgccauccccacgccgccccccagcacccggucccucaacgagcgcgccgagacccccccgcugcccauccccccgcccccccccgacauccagccgcuggagcgcuacugggcggcccaccagcagcuccgggagaccgacaucccccagcugagccaggccucccgccugagcacgcagcaggugcucgacugguucgacucccggcugccccagcccgccgagguggucgugugccuggacgaggaggaggaggaggaggaggaggagcucccggaggacgacgaggaggaggaggaggaggaggaggaggacgacgacgacgacgacgacgacgugaucauccaggacuga

SEQ ID NO: 31209 - RNA, 2154 nt, Artificial Sequence
  derived and/or modified sequence opt1 from HOOK2__Homo_sapiens__NP_001093646
augagcguggacaaggccgagcugugcggcucccuccugaccuggcugcagaccuuccacguccccagcccgugcgccagcccccaggaccucagcuccgggcuggcgguggccuacgugcugaaccagaucgaccccagcugguucaacgaggccuggcuccagggcaucuccgaggaccccgggccgaacuggaagcugaaggucagcaaccugaagauggugcuccgcucccugguggaguacagccaggacguccuggcccaccccguguccgaggagcaccuccccgacgugagccugaucggcgaguucuccgaccccgccgagcuggggaagcuccugcagcugguccucggcugcgcgaucagcugcgagaagaagcaggaccacauccagcggaucaugacgcuggaggaguccgugcagcacguggucauggaggccauccaggagcugaugaccaaggacaccccggacagccucucccccgagaccuacggcaacuucgacagccagucccgccgguacuacuuccugagcgaggaggccgaggagggggacgagcugcagcagcgcugccucgaccuggagcggcagcugaugcuccugagcgaggagaagcagucccuggcccaggagaacgcgggccuccgcgagcggauggggcgccccgagggcgaggggacgcccggccugaccgccaagaagcugcuccugcugcagagccagcucgagcagcugcaggaggagaacuuccggcuggaguccggccgcgaggacgagcggcuccgcugcgccgagcuggagcgggagguggccgagcugcagcaccgcaaccaggcccucaccagccuggcgcaggaggcccaggcccugaaggacgagauggacgagcuccggcaguccagcgagcgcgccgggcagcuggaggccacccugacguccugccggcgccggcucggcgagcugcgcgagcugcggcgccaggugcgccagcuggaggagcggaacgcggggcacgccgagcgcacccggcagcucgaggacgagcugcgccgggccggcagccugcgcgcccagcucgaggcccagcggcgccagguccaggagcugcagggccagcggcaggaggaggcgaugaaggccgagaaguggcuguucgagugccgcaaccucgaggagaaguacgaguccgugaccaaggagaaggagcggcugcuggccgagcgcgacagccuccgggaggccaacgaggagcugcgcugcgcccagcugcagccgcgggggcucacccaggcggaccccucccuggaccccacgagcacccccguggacaaccuggccgccgagauccucccggccgagcugcgcgagacccugcuccggcugcagcuggagaacaagcgccucugccggcaggaggcggccgaccgcgagcgccaggaggagcugcagcggcaccuggaggacgccaaccgcgcccggcacggccucgagacccagcaccgccugaaccagcagcagcuguccgagcuccgggcccaggucgaggaccugcagaaggcgcugcaggagcagggcgggaagacggaggacagcauccuccugaagcgcaagcuggaggagcaccuccagaagcugcacgaggccgaccuggagcuccagcggaagcgcgaguacaucgaggagcuggagccgcccaccgacuccagcaccgcccggcgcaucgaggagcugcagcacaaccuccagaagaaggacgccgaccugcgggccauggaggagcgcuaccggcgcuacguggacaaggcgcggauggugaugcagaccauggagcccaagcagcgccccgccgccggggccccgcccgagcugcacucccuccggacgcagcugcgcgagcgggacguccgcauccggcaccuggagauggacuucgagaagucccgcucccagcgcgagcaggaggagaagcuccugaucagcgccugguacaacaugggcauggcgcugcagcagcgggccggcgaggagcgcgcccccgcccacgcgcagagcuuccucgcccagcagcggcuggccaccaacucccgccgggggccccugggccgccucgccagccugaaccugcggcccaccgacaagcacuga

SEQ ID NO: 31210 - RNA, 2157 nt, Artificial Sequence
  derived and/or modified sequence opt1 from HOOK3__Homo_sapiens__NP_115786
auguucagcguggagucccuggagcgcgccgagcucugcgagagccugcugaccuggauccagaccuucaacgucgacgcccccugccagacgguggaggaccucaccaacggcguggucauggcccaggugcugcagaagaucgacccggcguacuucgacgagaacuggcugaaccggaucaagaccgaggugggggacaacuggcgccucaagaucuccaaccugaagaagauccugaagggcauccucgacuacaaccacgagauccuggggcagcagaucaacgacuucacccugcccgacgucaaccucaucggcgagcacagcgacgccgccgagcuggggcggaugcugcagcucauccugggcugcgccgugaacugcgagcagaagcaggaguacauccaggcgaucaugaugauggaggaguccgugcagcacgucgugaugacggccauccaggagcugaugagcaaggagucccccgugagcgccggcaacgacgccuacgucgaccucgaccgccagcugaagaagaccaccgaggagcugaacgaggcgcucuccgccaaggaggagaucgcccagcggugccacgagcuggacaugcaggucgccgcccugcaggaggagaaguccagccuccuggcggagaaccaggugcugauggagcgccucaaccagagcgacuccaucgaggaccccaacagcccggccgggcggcgccaccuccagcugcagacccagcuggagcagcugcaggaggagacguuccggcuggaggccgccaaggacgacuaccgcauccggugcgaggagcucgagaaggagaucuccgagcugcgccagcagaacgacgagcugaccacccucgccgacgaggcgcagagccugaaggacgagaucgacgugcugcggcacuccagcgacaagguguccaagcucgagggccagguggagagcuacaagaagaagcuggaggaccugggggaccuccgccggcaggucaagcugcuggaggagaagaacaccauguacaugcagaacacggugagccucgaggaggagcugcgcaaggccaacgccgcccggucccagcuggagaccuacaagcgccagguggucgagcuccagaaccggcugagcgaggaguccaagaaggccgacaagcuggacuucgaguacaagcgccugaaggagaagguggacagccuccagaaggagaaggaccggcugcgcaccgagcgcgacucccugaaggagaccaucgaggagcuccggugcgugcaggcgcaggagggccagcugacgacccaggggcugaugccccucggcagccaggaguccagcgacucccuggccgccgagaucgucacccccgagauccgcgagaagcugauccggcuccagcacgagaacaagaugcugaagcugaaccaggagggcagcgacaacgagaagaucgcccuccugcagucccugcucgacgacgccaaccugcgcaagaacgagcuggagaccgagaaccggcucgugaaccagcgccugcuggagguccagagccagguggaggagcuccagaagucccugcaggaccaggggagcaaggcggaggacuccgugcugcucaagaagaagcuggaggagcaccuggagaagcuccacgaggccaacaacgagcugcagaagaagcgggccaucaucgaggaccuggagccccgcuucaacaacagcucccucaagaucgaggagcugcaggaggcccugcggaagaaggaggaggagaugaagcagauggaggagcgcuacaagaaguaccucgagaaggccaagagcgucauccggacgcuggacccgaagcagaaccagggcgcggcccccgagauccaggcccugaagaaccagcuccaggagcgcgaccggcuguuccacucccuggagaaggaguacgagaagaccaagagccagcgcgagauggaggagaaguacaucgugagcgccugguacaacauggggaugacccuccacaagaaggcggccgaggaccggcuggccuccaccggcagcggccaguccuuccuggcccgccagcggcaggccacgagcucccgccggagcuaccccgggcacgugcagcccgcgaccgcccgcuga

SEQ ID NO: 31211 - RNA, 222 nt, Artificial Sequence
  derived and/or modified sequence opt1 from HOPX__Homo_sapiens__NP_001138931
augagcgccgagaccgccuccggccccaccgaggaccagguggagauccuggaguacaacuucaacaaggucgacaagcacccggacagcacgacccucugccugaucgcggccgaggccgggcuguccgaggaggagacccagaagugguucaagcagcgccucgccaaguggcggcgcagcgagggccugcccuccgagugccggagcgugaccgacuga

SEQ ID NO: 31212 - RNA, 924 nt, Artificial Sequence
  derived and/or modified sequence opt1 from HORMAD2__Homo_sapiens__NP_689723
auggccaccgcccagcugagccacugcaucaccauccacaaggcguccaaggagacgguguuccccagccagaucaccaacgagcacgagucccucaagauggucaagaagcuguucgccaccagcaucuccugcaucaccuaccugcgcggccucuucccggagagcuccuacggggagcggcaccuggacgaccugagccucaagauccugcgcgaggacaagaagugccccggcucccugcacaucauccgguggauccaggggugcuucgacgcccucgagaagcgcuaccugcggauggccgugcugacgcucuacaccgaccccaugggcagcgagaaggugaccgagauguaccaguucaaguucaaguacaccaaggagggggccacgauggacuucgacucccacagcuccagcaccuccuucgagagcggcaccaacaacgaggacaucaagaaggcguccguccugcugauccgcaagcucuacauccugaugcaggaccuggagccccucccgaacaacguggugcugaccaugaagcugcacuacuacaacgccgucacgccccacgacuaccagccccucggcuucaaggagggggugaacagccacuuccugcuguucgacaaggagcccaucaacgugcaggucggcuucguguccaccggguuccacagcaugaaggugaaggucaugaccgaggccaccaaggugaucgaccucgagaacaaccuguuccgggagaacagcacgaccgagaucgcccaccagggccuggacugcgacgaggaggaggagugcaacgaccacauccagcgcaugaacuucgugugcucccagcagagcuccgagugcagccggaagaagcgcaaggucuccgagccggugaagguguucauccccaaccggaaguga

SEQ ID NO: 31213 - RNA, 1233 nt, Artificial Sequence
  derived and/or modified sequence opt1 from HOXA10__Homo_sapiens__NP_061824
augagcgcccgcaagggcuaccugcuccccucccccaacuaccccaccaccaugagcugcuccgagagccccgccgcgaacuccuuccugguggacagccugaucuccagcgggcggggcgaggccgggggcgggggcggcggggccggcgggggcgggggcggcggguacuacgcccacggcggggucuaccucccgcccgccgcggaccugcccuacggccugcaguccugcggccucuuccccacgcucgggggcaagcgcaacgaggccgccagccccggguccggcgggggcggcgggggccuggggcccggcgcccacggguacggccccagccccaucgaccuguggcuggacgcgccccgguccugccgcauggagccgcccgacgggcccccgcccccgccccagcagcagcccccgcccccgccccagccgccccagcccgcgccccaggccaccagcugcuccuucgcccagaacaucaaggaggagagcuccuacugccuguacgacagcgccgacaagugccccaagguguccgccaccgccgccgagcucgcccccuucccccggggcccgccgcccgacggcugcgcccuggggaccagcagcggcgugcccguccccggguacuuccgccugucccaggcguacggcacggccaagggcuacgggagcggcgggggcggcgcccagcagcucggggccggccccuuccccgcccagcccccggggcggggcuucgaccugccgcccgcgcuggccuccgggagcgccgacgccgcccgcaaggagcgggcgcucgacagcccgcccccgcccacccuggccugcggcuccggcgggggcucccagggggacgaggaggcccacgccagcuccagcgcggccgaggagcugucccccgcccccagcgaguccagcaaggccucccccgagaaggacagccucggcaacuccaagggggagaacgccgcgaacuggcugaccgccaagagcggccgcaagaagcggugccccuacaccaagcaccagacgcuggagcucgagaaggaguuccuguucaacauguaccugacccgcgagcggcgccucgagaucucccggagcgugcaccugaccgaccgccaggugaagaucugguuccagaaccggcgcaugaagcugaagaagaugaaccgggagaaccgcauccgggagcucaccgccaacuucaacuucagcuga

SEQ ID NO: 31214 - RNA, 942 nt, Artificial Sequence
  derived and/or modified sequence opt1 from HOXA11__Homo_sapiens__NP_005514
auggacuucgacgagcgcggccccugcagcuccaacauguaccugccgagcugcaccuacuacguguccgggcccgacuucagcucccuccccagcuuccugccccagaccccguccagccggcccaugacguacuccuacagcuccaaccugccccagguccagcccgugcgcgaggugaccuuccgggaguacgccaucgagccggccaccaaguggcacccccgcggcaaccucgcgcacugcuacagcgccgaggagcugguccaccgggacugccugcaggcccccuccgccgccggggugcccggcgacgugcucgccaagagcuccgcgaacgucuaccaccacccgacccccgccgugagcuccaacuucuacagcacgguggggcgcaacggcguccugccccaggccuucgaccaguucuucgagaccgcguacggcacccccgagaaccuggccuccagcgacuacccgggggacaagagcgccgagaagggcccgcccgccgccaccgcgacguccgccgccgccgccgcggccgccaccggggcccccgccaccagcuccagcgacuccggcgggggcggcgggugccgggagaccgcggccgccgccgaggagaaggagcgccggcgccggcccgagagcuccagcucccccgagagcuccagcggccacacggaggacaaggccgggggcuccagcggccagcgcacccggaagaagcgcugccccuacaccaaguaccagauccgggagcucgagcgcgaguucuucuucuccguguacaucaacaaggagaagcggcugcagcugagccgcaugcucaaccugaccgaccgccaggugaagaucugguuccagaaccggcggaugaaggagaagaagaucaaccgcgaccgccugcaguacuacuccgcgaacccccuccuguga

SEQ ID NO: 31215 - RNA, 1167 nt, Artificial Sequence
  derived and/or modified sequence opt1 from HOXA13__Homo_sapiens__XP_011513646
augaccgccagcgugcugcuccacccccgcuggaucgagccgaccgucauguuccuguacgacaacggcgggggccugguggccgacgagcucaacaagaacauggagggggcggccgccgccgccgcggccgccgccgcggccgccgccgccggcgccgggggcggcggguucccccaccccgccgccgccgccgcgggcgggaacuucuccguggccgccgccgccgcggccgccgccgccgcggccgccaaccagugccggaaccugauggcccaccccgcgccgcuggcccccggcgccgccagcgccuacuccagcgcgcccggggaggcgcccccguccgccgccgccgcggccgccgccgccgcggccgccgccgcggccgccgccgccgcgagcuccagcggcggccccgggcccgccggccccgccggggccgaggccgcgaagcagugcuccccgugcagcgccgccgcccaguccagcuccggccccgccgcgcuccccuacggcuacuucgggagcggcuacuaccccugcgcccgcauggggccgcaccccaacgccaucaaguccugcgcccagcccgcgagcgccgccgccgccgcggccuucgccgacaaguacauggacacggccggccccgccgcggaggaguucuccagccgggccaaggaguucgccuucuaccaccagggguacgccgccggcccguaccaccaccaccagcccaugcccggcuaccuggacaugcccgucgugccggggcugggcgggcccggcgagucccgccacgagccccucgggcugcccauggagagcuaccagccgugggcgcugcccaacggcuggaacggccagauguacugccccaaggagcaggcccagccgccccaccucuggaaguccacccugcccgacguggucagccaccccagcgacgccuccagcuaccggcgcgggcggaagaagcgcgugccguacaccaaggugcagcugaaggagcucgagcgggaguacgccaccaacaaguucaucacgaaggacaagcgccggcgcaucuccgccaccaccaaccugagcgagcggcaggucaccaucugguuccagaaccgccgggugaaggagaagaaggugaucaacaagcugaagacgaccuccuga

SEQ ID NO: 31216 - RNA, 1008 nt, Artificial Sequence
  derived and/or modified sequence opt1 from HOXA1__Homo_sapiens__NP_005513
auggacaacgcccgcaugaacagcuuccuggaguaccccauccucuccagcggcgacuccgggaccugcagcgcccgggcguacccguccgaccaccgcaucaccacguuccagagcugcgccguguccgccaacagcugcggcggggacgaccgguuccuggucggccgcggggugcagaucggcagcccccaccaccaccaccaccaccaccaccaccacccccagcccgccaccuaccagaccagcggcaaccuggggguguccuacagccacuccagcugcggcccguccuacgggagccagaacuucuccgcccccuacagccccuacgcgcucaaccaggaggccgacgucuccggcggguacccccagugcgccccggccguguacagcggcaaccugagcucccccauggugcagcaccaccaccaccaccagggcuacgccgggggcgcggucgggagcccccaguacauccaccacuccuacggccaggagcaccagagccuggcccucgccaccuacaacaacucccugagcccccugcacgccucccaccaggaggcgugccggagcccggccuccgagacgagcucccccgcccagaccuucgacuggaugaaggugaagcgcaacccgcccaagaccggcaaggugggggaguacggcuaccucgggcagcccaacgccguccggaccaacuucacgaccaagcagcugaccgagcuggagaaggaguuccacuucaacaaguaccucacccgcgcccggcgcguggagaucgcggccagccugcagcugaacgagacccaggugaagaucugguuccagaaccggcgcaugaagcagaagaagcgggagaaggagggccuccugcccaucucccccgccacgcccccggggaacgacgagaaggccgaggagagcuccgagaaguccuccagcucccccugcguccccagccccggcagcuccaccagcgacacccugacgaccucccacuga

SEQ ID NO: 31217 - RNA, 1131 nt, Artificial Sequence
  derived and/or modified sequence opt1 from HOXA2__Homo_sapiens__NP_006726
augaacuacgaguucgagcgcgagaucggcuucaucaacagccagcccucccuggccgagugccucaccagcuucccgcccguggccgacaccuuccaguccagcuccaucaagacgagcacccugucccacagcacccugaucccgccgcccuucgagcagaccauccccucccucaaccccgggagccacccccggcacggcgccgggggccgccccaagcccucccccgcggggagccggggcucccccgucccggccggcgcccugcagccgcccgaguaccccuggaugaaggagaagaaggccgcgaagaagacggcccugcuccccgccgccgcggccgccgccaccgccgcggccaccgggcccgccugccugagccacaaggagucccuggagaucgccgacggcagcgggggcgggucccgccggcuccgcaccgccuacacgaacacccagcugcuggagcucgagaaggaguuccacuucaacaaguaccugugccggccccgccggguggagaucgcggcccugcucgaccugaccgagcgccaggugaaggucugguuccagaaccggcgcaugaagcacaagcggcagacccagugcaaggagaaccagaacagcgagggcaagugcaagucccuggaggacagcgagaagguggaggaggacgaggaggagaagacccucuucgagcaggcccugagcguguccggcgcccugcucgagcgcgagggguacacguuccagcagaacgcccugagccagcagcaggcgcccaacggccacaacggggacucccagagcuucccggucagcccccugaccuccaacgagaagaaccucaagcacuuccagcaccagucccccaccgugcccaacugccugagcacgaugggccagaacugcggcgccgggcugaacaacgacuccccggaggcccucgaggugcccagccugcaggacuucuccgucuucagcaccgacuccugccugcagcucagcgacgccgugucccccagccugcccggcucccuggacagcccgguggacaucuccgccgacagccucgacuucuucaccgacacccugacgaccaucgaccugcagcaccucaacuacuga

SEQ ID NO: 31218 - RNA, 1332 nt, Artificial Sequence
  derived and/or modified sequence opt1 from HOXA3__Homo_sapiens__XP_005249788
augcagaaggccaccuacuacgacagcuccgccaucuacggcggguaccccuaccaggcggccaacggcuucgccuacaacgccaaccagcagccguaccccgccagcgcggcccugggggccgacggcgaguaccaccgccccgccugcucccuccagagccccuccagcgcggggggccacccgaaggcccacgagcuguccgaggccugccugcggacccucagcgccccccccucccagcccccgagccugggcgagcccccccugcaccccccgcccccccaggccgcgcccccggccccccagcccccccagccggccccccagccccccgccccgacgcccgccgcgccccccccgcccuccagcgccucccccccgcagaacgccagcaacaaccccacccccgccaacgccgcgaaguccccccuccugaacagcccgaccguggccaagcagaucuuccccuggaugaaggagucccgccagaacaccaagcagaagacgagcuccagcagcuccggggagagcugcgccggcgacaaguccccccccgggcaggccagcuccaagcgggcccgcaccgcguacaccagcgcccagcuggucgagcucgagaaggaguuccacuucaaccgguaccugugccgcccgcggcgcguggagauggccaaccugcucaaccugaccgagcggcagaucaagaucugguuccagaaccgccggaugaaguacaagaaggaccagaagggcaaggggaugcugacguccagcggcggccagucccccagccgcucccccgugcccccgggggccggcggguaccucaacagcaugcacucccuggucaacagcgugcccuacgagccccagucccccccgcccuucagcaagcccccccagggcaccuacggccugccgcccgcguccuaccccgccagccuccccuccugcgccccgccccccccgccccagaagcgguacaccgccgccggggcgggcgccgggggcacccccgacuacgacccccacgcccacgggcugcagggcaacggcagcuacgggacgccgcacauccagggcagccccguguucgucgggggcuccuacguggagcccaugagcaacuccgggcccgcccuguucggccucacccaccugccgcacgccgcgagcggcgccauggacuacgggggcgccgggccccugggcuccgggcaccaccacggccccggccccggggagccgcaccccaccuacaccgaccucacgggccaccaccccagccaggggcgcauccaggaggcccccaagcugacccaccuguga

SEQ ID NO: 31219 - RNA, 963 nt, Artificial Sequence
  derived and/or modified sequence opt1 from HOXA4__Homo_sapiens__NP_002132
augaccaugagcuccuuccugaucaacagcaacuacaucgagcccaaguucccgcccuucgaggaguacgcccagcacuccggcagcgggggcgccgacgggggccccgggggcggccccggguaccagcagccgcccgcgccgcccacccagcaccucccccugcagcagccccagcugccccacgccggcgggggccgcgagcccacggccuccuacuacgccccgcggaccgcccgcgagcccgcguaccccgccgccgcccucuaccccgcgcacggggccgccgacaccgccuacccguacggcuaccggggcggggccagccccggccgcccgccccagcccgagcagccgcccgcgcaggccaaggggcccgcccacggccugcacgccucccacgugcugcagccccagcugcccccgccccugcagccccgggccgucccgcccgcggcgccccgccggugcgaggccgcccccgccacccccggcgugcccgccgggggcagcgccccggccugcccccugcuccuggccgacaagagcccccuggggcucaagggcaaggagcccguggucuacccguggaugaagaagauccacguguccgccgugaaccccuccuacaacgggggcgagcccaagcgcagccggacggcguacacccgccagcagguccuggagcuggagaaggaguuccacuucaaccgguaccucacccgccggcgccggaucgagaucgcccacacccugugccuguccgagcgccaggugaagaucugguuccagaaccggcgcaugaaguggaagaaggaccacaagcuccccaacacgaagaugcggagcuccaacagcgccuccgccagcgcgggcccgcccgggaaggcccagacccagagcccccaccuccacccccacccgcaccccuccaccagcacccccgugcccuccagcaucuga

SEQ ID NO: 31220 - RNA, 813 nt, Artificial Sequence
  derived and/or modified sequence opt1 from HOXA5__Homo_sapiens__NP_061975
augagcuccuacuucgugaacagcuucugcggccgcuaccccaacgggccggacuaccagcugcacaacuacggcgaccacuccagcgucuccgagcaguuccgggacagcgccuccaugcacagcgggcgcuacggcuacggguacaacggcauggaccucuccgugggccggagcggguccggccacuucgggagcggcgagcgcgcccgguccuacgcggccagcgccuccgccgcccccgcggagccccgcuacagccagcccgccaccuccacccacagcccgcagcccgacccccugcccugcuccgccguggccccgagccccgggagcgacucccaccacggcggcaagaacagccuguccaacagcuccggggcgagcgccgacgccggcuccacgcacaucagcucccgggagggggucggcaccgccagcggcgccgaggaggacgcgcccgccuccagcgagcaggccuccgcccagagcgagcccuccccggccccgcccgcgcagccccagaucuaccccuggaugcgcaagcuccacaucagccacgacaacaucgggggccccgaggggaagcgggcccgcaccgccuacacccgguaccagacgcuggagcuggagaaggaguuccacuucaaccgcuaccucacccggcgccggcgcaucgagaucgcccacgcccugugccuguccgagcggcagaucaagaucugguuccagaaccgccggaugaaguggaagaaggacaacaagcucaagagcauguccauggcggccgccggcggggccuuccgccccuga

SEQ ID NO: 31221 - RNA, 702 nt, Artificial Sequence
  derived and/or modified sequence opt1 from HOXA6__Homo_sapiens__NP_076919
augagcuccuacuucgugaaccccaccuucccgggcagccugcccuccgggcaggacagcuuccucggccagcugccccuguaccaggccggguacgacgcccuccgccccuucccggcguccuacggcgccagcucccugcccgacaagaccuacacgagccccugcuucuaccagcaguccaacagcguccuggccugcaaccgggccuccuacgaguacggggccagcugcuucuacuccgacaaggaccucagcggcgcgucccccagcggcuccgggaagcagcgcggcccgggggacuaccugcacuucagccccgagcagcaguacaagcccgacuccagcagcggccaggggaaggcccugcacgacgagggcgccgaccggaaguacaccucccccguguacccguggaugcagcgcaugaacagcugcgccggcgcgguguacgggucccacggccggcgcgggcggcagaccuacacccgcuaccagacgcucgagcuggagaaggaguuccacuucaaccgguaccugacccgccggcgccggaucgagaucgccaacgcccucugccugaccgagcgccagaucaagaucugguuccagaaccggcgcaugaaguggaagaaggagaacaagcugaucaacagcacccagcccuccggcgaggacagcgaggccaaggccggcgaguga

SEQ ID NO: 31222 - RNA, 693 nt, Artificial Sequence
  derived and/or modified sequence opt1 from HOXA7__Homo_sapiens__NP_008827
augagcuccagcuacuacgugaacgcccuguucuccaaguacaccgccggcgcgagccucuuccagaacgccgagcccaccuccugcagcuucgccccgaacucccagcgcagcggguacggcgccggggccggcgcguucgccuccacgguccccgggcuguacaacgugaacagcccccuguaccagucccccuucgccagcggcuacggccucggggccgacgcguacggcaaccugccgugcgccuccuacgaccagaacauccccgggcugugcagcgaccucgccaagggcgccugcgacaagaccgacgagggggcccugcacggcgcggccgaggccaacuuccggaucuaccccuggaugcgcuccagcggccccgaccggaagcgcgggcggcagaccuacacccgcuaccagacgcuggagcucgagaaggaguuccacuucaaccgguaccugacccgccggcgccggaucgagaucgcccacgcccugugccucaccgagcgccagaucaagaucugguuccagaaccggcgcaugaaguggaagaaggagcacaaggacgagggcccgaccgcggccgccgcccccgagggggccgugcccuccgcggccgccacggccgccgcggacaaggccgacgaggaggacgacgacgaggaggaggaggacgaggaggaguga

SEQ ID NO: 31223 - RNA, 819 nt, Artificial Sequence
  derived and/or modified sequence opt1 from HOXA9__Homo_sapiens__NP_689952
auggccaccaccggcgcccuggggaacuacuacguggacagcuuccuccugggcgcggacgccgccgacgagcuguccgucgggcgcuacgcccccggcacgcucgggcagccgccccggcaggccgcgacccuggccgagcaccccgacuucagccccugcuccuuccagagcaaggccaccguguucggcgccuccuggaacccggugcacgcggccggcgccaacgccguccccgccgcgguguaccaccaccaccaccaccaccccuacgugcacccccaggccccggucgccgccgccgcgcccgacgggcgcuacaugcggagcuggcuggagcccacccccggcgcccucuccuucgccgggcugccgagcucccgccccuacggcaucaagcccgagccccugagcgcccggcgcggggacugcccgacgcucgacacccacacccugucccugaccgacuacgccugcggcagcccgcccguggaccgggagaagcagcccuccgagggcgcguucagcgagaacaacgccgagaacgaguccgggggcgacaagccgcccaucgaccccaacaaccccgccgccaacuggcuccacgcccgcagcacgcggaagaagcgcugccccuacaccaagcaccagacccuggagcuggagaaggaguuccucuucaacauguaccugacccgggaccgccgguacgagguggcgcgccugcucaaccugacggagcggcaggucaagaucugguuccagaaccgccggaugaagaugaagaagaucaacaaggaccgcgccaaggacgaguga

SEQ ID NO: 31224 - RNA, 855 nt, Artificial Sequence
  derived and/or modified sequence opt1 from HOXB13__Homo_sapiens__NP_006352
auggagcccggcaacuacgccacccuggacggggccaaggacaucgagggccuccugggggcgggcgggggccgcaaccugguggcccacagcccgcucaccucccaccccgccgcccccacgcugaugcccgccgucaacuacgcgccgcuggaccuccccggcagcgccgagccgcccaagcagugccaccccugccccggggugccccagggcaccucccccgccccggugcccuacggguacuucggcgggggcuacuacagcugccgggucucccgcagcucccugaagcccugcgcccaggcggccacccuggccgccuaccccgccgagaccccgacggcgggcgaggaguaccccagccggcccaccgaguucgccuucuaccccggguacccgggcaccuaccagcccauggccuccuaccucgacgugagcgugguccagacccugggggcccccggcgagccccgccacgacucccugcucccgguggacagcuaccaguccugggcccuggcgggcggguggaacagccagaugugcugccagggcgagcagaacccgcccgggcccuucuggaaggccgccuucgccgacuccagcggccagcacccgcccgacgccugcgcguuccggcgcgggcggaagaagcgcauccccuacuccaagggccagcugcgggagcucgagcgcgaguacgccgccaacaaguucaucacgaaggacaagcggcgcaagaucagcgccgccaccucccugagcgagcggcagaucaccaucugguuccagaaccgccgggugaaggagaagaagguccuggcgaaggugaagaacagcgccacccccuga

SEQ ID NO: 31225 - RNA, 906 nt, Artificial Sequence
  derived and/or modified sequence opt1 from HOXB1__Homo_sapiens__NP_002135
auggacuacaaccgcaugaacagcuuccuggaguacccccucugcaaccggggcccguccgccuacagcgcccacuccgcgcccaccagcuucccgcccuccagcgcccaggccguggacuccuacgccagcgaggggcgcuacggcgggggccuguccagccccgccuuccagcagaacuccggguaccccgcgcagcagccgcccagcacccugggcguccccuuccccuccagcgcccccuccggcuacgcccccgccgcgugcagcccguccuacgggcccagccaguacuacccccucggccaguccgagggggacggcggguacuuccaccccagcagcuacggcgcccagcugggcgggcuguccgacggcuacggggccggcggcgccgggccgggccccuacccgccccagcacccgcccuacgggaacgagcagacggccagcuucgcgcccgccuacgccgaccuccuguccgaggacaaggagacccccugccccagcgagcccaacacccccaccgcccggacguucgacuggaugaaggugaagcgcaacccgcccaagaccgccaagguguccgagcccggccuggggagccccuccggccuccggaccaacuucaccacgcgccagcugaccgagcuggagaaggaguuccacuucaacaaguaccucagccgggcgcgccgggucgagaucgccgccacccuggagcugaacgagacccaggugaagaucugguuccagaaccgccggaugaagcagaagaagcgcgagcgggaggagggccgcgugccgcccgccccgcccgggugccccaaggaggccgcgggcgacgccuccgaccagagcacgugcaccucccccgaggccagccccuccagcgucaccuccuga

SEQ ID NO: 31226 - RNA, 1071 nt, Artificial Sequence
  derived and/or modified sequence opt1 from HOXB2__Homo_sapiens__NP_002136
augaacuucgaguucgagcgcgagaucggcuucaucaacagccagcccucccuggccgagugccucaccagcuucccggccgugcuggagaccuuccagacguccagcaucaaggaguccacccugaucccgccgcccccgcccuucgagcagaccuuccccagccuccagcccggggcguccacccugcagcggccgcgcagccagaagcgggccgaggacggccccgcccugcccccgcccccgccgccgccccuccccgccgccccgcccgcgcccgaguuccccuggaugaaggagaagaaguccgccaagaagcccagccaguccgccacgagccccucccccgccgcgagcgccguccccgccuccggggugggcagccccgccgacgggcugggccugcccgaggccggcgggggcggggcgcgccggcuccgcaccgccuacaccaacacccagcugcuggagcucgagaaggaguuccacuucaacaaguaccugugccggccccgccggguggagaucgccgcccugcucgaccugacggagcgccaggucaaggugugguuccagaaccggcgcaugaagcacaagcggcagacccagcaccgcgagccgcccgacggcgagcccgccugccccggggcgcuggaggacaucugcgaccccgccgaggagcccgccgccucccccggcggccccagcgccucccgggcggccugggaggccugcugccacccgcccgaggugguccccggggcccucagcgccgacccccgcccccuggcggugcggcuggagggcgccggggccagcucccccggcugcgcccuccgcggcgccgggggccuggagcccgggccccugcccgaggacguguucagcggccggcaggacucccccuuccucccggaccugaacuucuucgcggccgacagcugccugcagcucuccgggggccugagccccucccugcagggcagccucgacucccccguccccuucagcgaggaggagcuggacuucuucaccuccacccugugcgccaucgaccuccaguucccguga

SEQ ID NO: 31227 - RNA, 900 nt, Artificial Sequence
  derived and/or modified sequence opt1 from HOXB3__Homo_sapiens__XP_005257339
augaaggagagccgccagaccuccaagcugaagaacaacagccccggcaccgccgaggggugcggcgggggcgggggcggcgggggcgggggcggguccggcggcagcgggggcgggggcggcgggggcgggggcggggacaaguccccgcccggcagcgccgcguccaagcgggcccgcacggccuacaccagcgcccagcucguggagcuggagaaggaguuccacuucaaccgguaccugugccgcccccggcgcgucgagauggccaaccuccugaaccuguccgagcggcagaucaagaucugguuccagaaccgccggaugaaguacaagaaggaccagaaggcgaagggccucgccagcuccagcgggggccccucccccgccgggagcccgccccagcccaugcaguccaccgccggcuucaugaacgcgcugcacagcaugacccccuccuacgagagccccuccccgcccgccuucgggaaggcccaccagaacgccuacgcccugcccagcaacuaccagccgccccucaagggcugcggcgcgccccagaaguacccgcccacgcccgcccccgaguacgagccccacgugcugcaggccaacgggggcgccuacgggacccccaccaugcagggcagccccguguacgucgggggcggcggguacgccgacccccugccgccgcccgcgggccccucccucuacgggcugaaccaccugagccaccaccccuccggcaaccucgacuacaacggcgccccgcccauggcccccagccagcaccacgggcccugcgagccccaccccaccuacacggaccuguccagccaccacgccccgccgccccagggccgcauccaggaggcccccaagcugacccaccucuga

SEQ ID NO: 31228 - RNA, 756 nt, Artificial Sequence
  derived and/or modified sequence opt1 from HOXB4__Homo_sapiens__NP_076920
auggccaugagcuccuuccugaucaacagcaacuacguggaccccaaguucccgcccugcgaggaguacucccagagcgacuaccuccccuccgaccacagccccggcuacuacgccgggggccagcgccgggaguccagcuuccagccggaggcgggguucggccgccgggccgccugcaccguccagcgcuacgccgccugccgggaccccgggccccccccgcccccccccccgcccccccccccgcccccccccccgggccuguccccccgcgcgcccgcccccccgcccgccggcgcccugcuccccgagcccgggcagcggugcgaggcggugagcuccagcccgccccccccgcccugcgcccagaacccccugcaccccuccccgagccacuccgccugcaaggagcccguggucuaccccuggaugcgcaaggugcacgugagcaccgucaaccccaacuacgccggcggggagccgaagcggucccgcacggccuacacccggcagcaggugcuggagcucgagaaggaguuccacuacaaccgcuaccugacccggcgccggcgcguggagaucgcgcacgcccugugccucagcgagcggcagaucaagaucugguuccagaaccgccggaugaaguggaagaaggaccacaagcugcccaacaccaagauccgcuccggcggggccgccggcagcgccggcgggccccccggccggccgaacgggggcccccgcgcgcuguga

SEQ ID NO: 31229 - RNA, 810 nt, Artificial Sequence
  derived and/or modified sequence opt1 from HOXB5__Homo_sapiens__NP_002138
augagcuccuacuucgugaacagcuucuccggccgcuaccccaacgggccggacuaccagcugcucaacuacggcagcggguccagccuguccggcagcuaccgggaccccgccgccaugcacaccggguccuacggcuacaacuacaacggcauggaccugagcgucaaccgcuccagcgcguccagcucccacuucggggccgugggcgagagcucccgggccuuccccgcccccgcccaggagccgcgcuuccggcaggcggccagcuccugcagccucagcucccccgagagccugcccugcaccaacggggacucccacggcgccaagcccagcgccuccagcccguccgaccaggcgacgagcgccuccagcuccgccaacuucaccgagaucgacgaggccagcgccuccagcgagcccgaggaggcggccucccagcugagcucccccagccucgcccgcgcccagcccgagccgauggccaccuccaccgcggcccccgaggggcagacgccccagaucuuccccuggaugcggaagcugcacaucagccacgacaugaccggcccggacggcaagcgcgcccggaccgccuacacccgcuaccagacgcuggagcucgagaaggaguuccacuucaaccgguaccugacccgccggcgccggaucgagaucgcccacgcgcugugccucagcgagcgccagaucaagaucugguuccagaaccggcgcaugaaguggaagaaggacaacaagcugaaguccaugagccuggccaccgccggguccgccuuccagcccuga

SEQ ID NO: 31230 - RNA, 675 nt, Artificial Sequence
  derived and/or modified sequence opt1 from HOXB6__Homo_sapiens__XP_005257340
augagcuccuacuucgugaacagcaccuuccccgucacccuggccuccggccaggagagcuuccucgggcagcugccgcuguacuccagcggcuacgccgacccccuccgccacuaccccgcgcccuacgggccgggccccgggcaggacaagggcuucgccacguccagcuacuacccgcccgccggcgggggcuacgggcgggccgcccccugcgacuacggccccgcgcccgccuucuaccgcgagaaggaguccgccugcgcccugagcggggcggacgagcagcccccguuccaccccgagccccggaaguccgacugcgcccaggacaagagcguguucggcgagaccgaggagcagaagugcuccacccccguguacccguggaugcagcgcaugaacagcugcaacuccagcuccuucggccccagcgggcggcgcggccggcagaccuacacgcgcuaccagacccuggagcucgagaaggaguuccacuacaaccgguaccugacccgccggcgccggaucgagaucgcccacgcccugugccucaccgagcgccagaucaagaucugguuccagaaccggcgcaugaaguggaagaaggaguccaagcugcugagcgccagccagcucuccgcggaggaggaggaggagaagcaggccgaguga

SEQ ID NO: 31231 - RNA, 654 nt, Artificial Sequence
  derived and/or modified sequence opt1 from HOXB7__Homo_sapiens__NP_004493
augagcucccuguacuacgccaacacccucuucagcaaguaccccgccuccagcuccguguucgcgaccggcgccuucccggagcagacgagcugcgccuucgccuccaacccccagcgccccggguacggcgccgggagcggcgcguccuucgccgccagcaugcaggggcuguaccccggcggcgggggcauggccgggcaguccgcggccggcgucuacgccgccggguacggccuggagccgagcuccuucaacaugcacugcgcccccuucgagcagaaccucagcggcgugugccccggggacuccgcgaaggccgccggcgccaaggagcagcgggacagcgaccuggccgcggaguccaacuuccgcaucuaccccuggaugcggagcuccgggaccgaccgcaagcggggccgccagaccuacacccgguaccagacgcuggagcucgagaaggaguuccacuacaaccgcuaccugacccggcgccggcgcaucgagaucgcccacacccugugccucaccgagcggcagaucaagaucugguuccagaaccgccggaugaaguggaagaaggagaacaagacggccggcccggggaccaccggccaggaccgcgccgaggccgaggaggaggaggaggaguga

SEQ ID NO: 31232 - RNA, 732 nt, Artificial Sequence
  derived and/or modified sequence opt1 from HOXB8__Homo_sapiens__NP_076921
augagcuccuacuucgugaacagccuguucuccaaguacaagaccggcgagagccuccgccccaacuacuacgacugcggguucgcccaggaccugggcgggcggccgaccgucguguacggccccuccagcgggggcuccuuccagcaccccagccagauccaggaguucuaccacggccccuccagccuguccacggccccguaccagcagaaccccugcgcgguggccugccacggggaccccggcaacuucuacggguacgacccccuccagcgccagagccuguucggcgcccaggacccggaccugguccaguacgccgacugcaagcucgccgcggccuccgggcugggcgaggaggccgagggcagcgagcagucccccagccccacccagcuguuccccuggaugcggccgcaggccgcggccgggcgccggcgcggccggcagaccuacucccgcuaccagacccucgagcuggagaaggaguuccuguucaaccccuaccucacgcggaagcgccggaucgaggugagccacgcccuggggcugaccgagcgccaggugaagaucugguuccagaaccggcgcaugaaguggaagaaggagaacaacaaggacaaguuccccuccagcaagugcgagcaggaggagcucgagaagcagaagcuggagcgggcccccgaggccgcggacgagggcgacgcccagaagggcgacaagaaguga

SEQ ID NO: 31233 - RNA, 753 nt, Artificial Sequence
  derived and/or modified sequence opt1 from HOXB9__Homo_sapiens__NP_076922
augagcaucuccggcacccugagcuccuacuacguggacagcaucaucucccacgagagcgaggacgcgcccccggccaaguuccccuccgggcaguacgccagcucccgccagcccggccacgccgagcaccucgaguuccccagcugcuccuuccagccgaaggcccccgucuucggggccagcugggcgccccugagcccccacgccuccggcucccugccgagcguguaccaccccuacauccagccccagggggugcccccggccgagucccgguaccuccgcaccuggcuggagcccgcgccccggggcgaggccgcccccggccaggggcaggccgccgucaaggccgagccgcugcucggcgcccccggggagcugcugaagcagggcacgcccgaguacagccucgagaccuccgcggggcgcgaggccgugcugagcaaccagcggcccggcuacggcgacaacaagaucugcgaggggagcgaggacaaggagcgcccggaccagaccaaccccuccgccaacuggcugcacgcccggagcucccgcaagaagcggugccccuacaccaaguaccagacgcucgagcuggagaaggaguuccuguucaacauguaccucacccgcgaccggcgccacgagguggcccggcugcugaaccucagcgagcgccaggucaagaucugguuccagaaccggcgcaugaagaugaagaagaugaacaaggagcagggcaaggaguga

SEQ ID NO: 31234 - RNA, 1029 nt, Artificial Sequence
  derived and/or modified sequence opt1 from HOXC10__Homo_sapiens__NP_059105
augaccugcccccgcaacgugaccccgaacagcuacgccgagccccuggccgcgcccggcgggggcgagcgguacucccgcagcgccgggauguacaugcaguccggcagcgacuucaacugcggggucaugcggggcugcggccucgcccccucccugagcaagcgcgacgagggguccagcccgucccuggcccucaacacguaccccagcuaccugucccagcuggacagcuggggcgaccccaaggccgcguaccggcucgagcagcccguggggcgcccgcuguccagcugcuccuacccgcccagcgugaaggaggagaacgucugcugcauguacuccgccgagaagcgggccaagagcggccccgaggccgcgcuguacucccacccccuccccgagagcugccugggggagcacgaggugcccgugcccagcuacuaccgcgccuccccgagcuacuccgcccuggacaagacgccccacugcagcggcgccaacgacuucgaggcccccuucgagcagcgggcgucccucaacccccgcgccgagcaccuggagagcccgcagcugggcgggaaggucuccuuccccgagacccccaagagcgacucccagacccccagcccgaacgagaucaagaccgagcagucccucgccggccccaaggggagccccuccgagagcgagaaggagcgggccaaggccgcggacuccagccccgacaccuccgacaacgaggccaaggaggagaucaaggccgagaacaccaccggcaacuggcugacggccaagagcggccgcaagaagcggugcccguacaccaagcaccagacccuggagcucgagaaggaguuccuguucaacauguaccugacccgcgagcggcgccucgagaucuccaagacgaucaaccugaccgaccgccaggugaagaucugguuccagaaccggcggaugaagcugaagaagaugaaccgcgagaaccggauccgcgagcucaccagcaacuucaacuucaccuga

SEQ ID NO: 31235 - RNA, 915 nt, Artificial Sequence
  derived and/or modified sequence opt1 from HOXC11__Homo_sapiens__NP_055027
auguucaacagcgugaaccugggcaacuucugcucccccagccgcaaggagcgcggggccgacuucggcgagcggggguccugcgccagcaaccucuaccugccguccugcaccuacuacaugcccgaguucagcaccgucuccagcuuccugccccaggcccccucccggcagaucagcuacccguacuccgcccaggugccgcccgugcgcgaggucagcuacggccucgagcccuccgggaaguggcaccaccggaacagcuacuccagcugcuacgccgccgccgacgagcugaugcaccgcgagugccugccgcccuccacggugaccgagauccucaugaagaacgagggcagcuacggcgggcaccaccaccccuccgcgccccacgccacccccgccggcuucuacagcagcgugaacaagaacuccguccugccccaggccuucgaccgguucuucgacaacgcguacugcgggggcggggacccgcccgccgagccgcccugcagcggcaagggcgaggccaagggggagcccgaggcgccgcccgccuccggccuggccagccgcgccgaggccggggccgaggccgaggcggaggaggagaacaccaaccccuccagcuccggcagcgcccacuccguggccaaggagcccgccaagggcgccgcgcccaacgcgccccggacgcgcaagaagcggugccccuacagcaaguuccagauccgcgagcucgagcgggaguucuucuucaacguguacaucaacaaggagaagcgccugcagcugucccggaugcucaaccugaccgaccgccaggucaagaucugguuccagaaccggcgcaugaaggagaagaagcugagccgggaccgccuccaguacuucuccgggaacccccugcuguga

SEQ ID NO: 31236 - RNA, 849 nt, Artificial Sequence
  derived and/or modified sequence opt1 from HOXC12__Homo_sapiens__NP_776272
augggcgagcacaaccugcucaaccccggguucgugggcccgcuggucaacauccacaccggggacaccuucuacuuccccaacuuccgcgccagcggcgcccagcugcccgggcuccccucccugagcuacccgcggcgcgacaacgugugcucccugagcuggcccuccgcggagcccugcaacggcuacccccagccguaccucggcagccccgugucccugaacccgcccuucgggcggacgugcgagcuggcccgcgucgaggacggcaagggguacuaccgggagcccugcgccgagggcgggggcggcgggcucaagcgcgaggagcggggccgcgaccccggggccggccccggcgccgcgcugcugccccucgagccgagcgggccgcccgcccugggcuucaaguacgacuacgccgccgggggcgggggcggcgacgggggcgggggcgcggggccgccccacgacccgcccuccugccagagccuggaguccgacagcuccagcucccuccugaacgagggcaacaagggcgccggggccggcgaccccgggagccuggugagcccccucaaccccggcgggggccuguccgccuccggcgcccccugguaccccaucaacagccggagccgcaagaagcggaagcccuacuccaagcugcagcucgcggagcuggagggggaguuccuggugaacgaguucaucacccgccagcggcgccgggagcucagcgaccgccugaaccuguccgaccagcaggucaagaucugguuccagaaccggcgcaugaagaagaagcggcuccugcugcgcgagcaggcccucagcuucuucuga

SEQ ID NO: 31237 - RNA, 993 nt, Artificial Sequence
  derived and/or modified sequence opt1 from HOXC13__Homo_sapiens__NP_059106
augaccaccagccugcuccugcacccccgcuggccggagucccugauguacguguacgaggacagcgccgccgaguccggcaucgggggcgggggcgggggcggcgggggcgggacgggcggggccggcggcgggugcagcggcgccucccccgggaaggcccccagcauggacggccucggcuccagcugccccgccucccacugccgggaccugcugccgcaccccguccucgggcgcccgcccgccccgcugggcgcgccccagggggccguguacaccgacauccccgcccccgaggccgcgcggcagugcgccccgccgcccgccccgcccaccagcuccagcgccacccugggcuacggguaccccuucggcggcuccuacuacgggugccgccucagccacaacgugaaccugcagcagaagcccugcgccuaccaccccggcgacaaguaccccgagcccuccggggcgcugcccggcgacgaccucagcucccgggccaaggaguucgccuucuaccccagcuucgccuccagcuaccaggccaugcccggguaccuggacgucagcguggugcccggcaucuccggccaccccgagccccgccacgacgcgcugaucccggucgagggguaccagcacugggcccucagcaacggcugggacucccagguguacugcagcaaggagcagucccagagcgcccaccuguggaagucccccuuccccgacguggucccgcugcagcccgaggugagcuccuaccggcgcgggcggaagaagcgcgugcccuacacgaagguccagcucaaggagcuggagaaggaguacgccgccagcaaguucaucaccaaggagaagcggcgccggaucuccgcgaccaccaaccugagcgagcgccaggugacgaucugguuccagaaccggcgcgugaaggagaagaaggucguguccaagagcaaggcgccccaccuccacuccaccuga

SEQ ID NO: 31238 - RNA, 795 nt, Artificial Sequence
  derived and/or modified sequence opt1 from HOXC4__Homo_sapiens__NP_705897
augaucaugagcuccuaccugauggacagcaacuacaucgaccccaaguucccgcccugcgaggaguacucccagaacagcuacauccccgagcacucccccgaguacuacggccgcacccgggagagcggguuccagcaccaccaccaggagcucuacccgcccccgccgccccgccccuccuaccccgagcggcaguacagcugcaccucccugcagggccccgggaacagccgcggccacgggcccgcccaggccggccaccaccaccccgagaagucccagagccugugcgagcccgcgccccucuccggcgccagcgccucccccagccccgccccgcccgccugcucccagcccgcgcccgaccaccccagcuccgccgccagcaagcagcccaucguguacccguggaugaagaagauccacgucagcacggugaaccccaacuacaacgggggcgagcccaagcggucccgcaccgccuacacccggcagcagguccuggagcuggagaaggaguuccacuacaaccgcuaccucacccggcgccggcgcaucgagaucgcgcacagccugugccuguccgagcggcagaucaagaucugguuccagaaccgccggaugaaguggaagaaggaccaccgccuccccaacacgaaggugcggagcgccccgcccgccggggccgcccccuccacccugagcgcggccaccccgggcaccuccgaggaccacagccaguccgccacgccgcccgagcagcagcgcgccgaggacaucacccggcuguga

SEQ ID NO: 31239 - RNA, 669 nt, Artificial Sequence
  derived and/or modified sequence opt1 from HOXC5__Homo_sapiens__NP_061826
augagcuccuacguggccaacagcuucuacaagcagucccccaacauccccgccuacaacaugcagaccugcggcaacuacgggagcgcguccgagguccaggccagccgcuacugcuacggcgggcuggaccucuccaucaccuucccgccgcccgcccccagcaacucccugcacggcguggacauggccgccaacccccgggcgcaccccgaccgccccgccugcagcgccgccgcggcccccgggcacgcccccggccgggacgaggccgcgccccugaaccccggcauguacucccagaaggccgcccgcccggcccucgaggagcgggccaagagcuccggggagaucaaggaggagcaggcccagacgggccagcccgcggggcugagccagccgcccgccccgccccagaucuaccccuggaugaccaagcugcacaugucccacgagaccgacggcaagcgcagccggaccuccuacacgcgcuaccagacccucgagcuggagaaggaguuccacuucaaccgguaccugacccgccggcgccggaucgagaucgccaacaaccucugccugaacgagcgccagaucaagaucugguuccagaaccggcgcaugaaguggaagaaggacagcaagaugaaguccaaggaggcccuguga

SEQ ID NO: 31240 - RNA, 708 nt, Artificial Sequence
  derived and/or modified sequence opt1 from HOXC6__Homo_sapiens__NP_004494
augaacagcuacuucaccaaccccucccugagcugccaccucgccggcgggcaggacgugcugccgaacgucgcccugaacuccaccgcguacgaccccgugcgccacuucagcacguacggcgccgccguggcccagaaccggaucuacuccacccccuucuacagcccccaggagaacgucguguucuccagcucccgcgggccguacgacuacggcagcaacuccuucuaccaggagaaggacaugcucagcaacugccggcagaacacccuggggcacaacacccagacguccaucgcccaggacuucagcuccgagcagggccgcaccgcgccccaggaccagaaggccagcauccagaucuaccccuggaugcagcggaugaacucccacagcggcgugggguacggcgccgaccgccggcgcgggcggcagaucuacucccgcuaccagacccuggagcucgagaaggaguuccacuucaaccgguaccugacccgccggcgccggaucgagaucgccaacgcgcugugccucacggagcgccagaucaagaucugguuccagaaccggcgcaugaaguggaagaaggagagcaaccugaccagcacccuguccggcgggggcggcggggccaccgccgacagccucggcgggaaggaggagaagcgggaggagacggaggaggagaagcagaaggaguga

SEQ ID NO: 31241 - RNA, 729 nt, Artificial Sequence
  derived and/or modified sequence opt1 from HOXC8__Homo_sapiens__NP_073149
augagcuccuacuucgugaacccccuguucagcaaguacaaggccggcgagucccucgagccggccuacuacgacugccgcuucccccagagcgucgggcggucccacgcgcugguguacggccccgggggcagcgcccccggguuccagcacgccucccaccacgugcaggacuucuuccaccacggcaccagcggcaucuccaacagcggguaccagcagaacccgugcucccugagcugccacggcgacgccuccaaguucuacggguacgaggcccucccccgccagagccuguacggcgcgcagcaggaggccuccgucgugcaguaccccgacugcaagagcuccgccaacaccaacagcuccgaggggcagggccaccugaaccagaacagcagccccucccucauguucccguggaugcggccccacgcccccggccgccggagcgggcgccagacguacucccgguaccagacccuggagcuggagaaggaguuccucuucaaccccuaccugacccgcaagcggcgcaucgaggugagccacgcgcugggccucaccgagcggcaggucaagaucugguuccagaaccgccggaugaaguggaagaaggagaacaacaaggacaagcugccgggggcccgcgacgaggagaagguggaggaggagggcaacgaggaggaggagaaggaggaggaggagaaggaggagaacaaggacuga

SEQ ID NO: 31242 - RNA, 783 nt, Artificial Sequence
  derived and/or modified sequence opt1 from HOXC9__Homo_sapiens__NP_008828
augagcgccaccggccccaucuccaacuacuacguggacagccugaucucccacgacaacgaggaccuccuggccagccgcuucccggcgaccggggcccaccccgccgccgcccggcccuccggccugguccccgacugcagcgacuucccguccugcagcuucgcgcccaagcccgccguguucuccacgagcugggcccccgugccgucccagagcuccgucguguaccaccccuacgggccccagccccaccucggcgccgacacccgcuacaugcggaccuggcuggagccgcugagcggggcgguguccuuccccagcuuccccgccggcggccgccacuacgcccucaagcccgacgccuacccggggcggcgcgccgacugcggccccggggagggccgguccuaccccgacuacauguacgggagccccggcgagcugcgcgaccgggcgccgcagacccugcccucccccgaggccgacgcccucgccggcagcaagcacaaggaggagaaggccgaccuggaccccagcaacccggucgcgaacuggauccacgcccgcuccacgcggaagaagcgcugccccuacaccaaguaccagacccuggagcucgagaaggaguuccuguucaacauguaccugacccgggaccgccgguacgagguggcccgcgugcucaaccugacggagcggcaggucaagaucugguuccagaaccgccggaugaagaugaagaagaugaacaaggagaagaccgacaaggagcagagcuga

SEQ ID NO: 31243 - RNA, 1023 nt, Artificial Sequence
  derived and/or modified sequence opt1 from HOXD10__Homo_sapiens__NP_002139
augagcuuccccaacuccagcccggccgccaacaccuuccugguggacucccucaucagcgcgugccgcuccgacagcuucuacuccagcuccgccagcauguacaugcccccgcccuccgccgacaugggcaccuacgggaugcagacgugcggccugcugcccagccucgccaagcgggaggucaaccaccagaacauggggaugaacgugcaccccuacaucccccagguggacuccuggaccgaccccaaccgcagcugccggaucgagcagccggucacccagcaggucccgaccugcuccuucacgaccaacaucaaggaggagagcaacugcugcauguacuccgacaagcgcaacaagcugaucagcgccgaggugcccuccuaccagcggcuggugcccgagagcugccccguggagaaccccgaggugcccguccccggcuacuuccgccucagccagaccuacgcgaccgggaagacgcaggaguacaacaacuccccggagggcagcuccaccgugaugcugcagcugaacccccggggcgccgccaagccccagcucagcgccgcgcagcugcagauggagaagaagaugaacgagcccguguccgggcaggagccgaccaaggucagccagguggagucccccgaggccaagggcgggcugcccgaggagcgcagcugccucgccgagguguccgucagcucccccgaggugcaggagaaggagagcaaggaggagaucaaguccgacaccccgacgagcaacuggcugaccgccaaguccggccggaagaagcgcugccccuacaccaagcaccagacccuggagcucgagaaggaguuccuguucaacauguaccugacgcgggagcgccggcucgagaucagcaaguccgugaaccugaccgaccgccaggucaagaucugguuccagaaccggcgcaugaagcugaagaagaugagccgggagaaccgcauccgggagcucaccgccaaccugaccuucuccuga

SEQ ID NO: 31244 - RNA, 1017 nt, Artificial Sequence
  derived and/or modified sequence opt1 from HOXD11__Homo_sapiens__NP_067015
augaacgacuucgacgagugcggccagagcgccgccuccauguaccugcccgggugcgccuacuacguggccccgagcgacuucgccuccaagcccagcuuccucucccagcccagcuccugccagaugaccuuccccuacagcuccaaccuggccccgcacguccagcccgugcgcgagguggccuuccgggacuacggccuggagcgcgcgaaguggcccuaccgcgggggcgggggcggcgggagcgccggcgggggcuccagcgggggcggccccgggggcgggggcggcggggccggcggguacgccccguacuacgcggccgccgccgccgcggccgccgccgccgcggccgccgaggaggccgccaugcagcgggagcuccugccgcccgcgggccggcgccccgacguccuguucaaggcccccgagcccgugugcgccgcccccgggcccccgcacggccccgccggcgcggccuccaacuucuacagcgccguggggcggaacggcauccucccccagggguucgaccaguucuacgaggccgcgcccggcccgcccuucgccgggccccagcccccgcccccgcccgccccgccccagcccgagggcgccgccgacaagggcgacccccgcaccggggcgggcgggggcgggggcucccccugcacgaaggccacccccggcagcgagcccaagggggccgccgagggcuccgggggcgacggcgaggggccgcccggcgaggccggggcggagaaguccagcagcgccgucgcgccccagcggagccgcaagaagcggugccccuacaccaaguaccagauccgcgagcuggagcgggaguucuucuucaacguguacaucaacaaggagaagcgccugcagcucucccggaugcugaaccugaccgaccgccaggugaagaucugguuccagaaccggcgcaugaaggagaagaagcucaaccgggaccgccugcaguacuucacgggcaacccgcuguucuga

SEQ ID NO: 31245 - RNA, 813 nt, Artificial Sequence
  derived and/or modified sequence opt1 from HOXD12__Homo_sapiens__NP_067016
augugcgagcgcagccuguaccgggccggcuacguggggucccuccugaaccugcagagccccgacuccuucuacuucagcaaccuccgcccgaacggcgggcagcuggccgcgcugccgcccaucuccuacccccggggcgcccuccccugggccgccacccccgccagcugcgcgcccgcccagcccgccggggccaccgcguucggcggcuucucccagccguaccuggccgggagcggcccccuggggcuccagccgcccacggccaaggacggccccgaggagcaggccaaguucuacgcccccgaggcggccgccgggcccgaggagcgcggccggacccgccccuccuucgccccggagagcucccuggcccccgcggucgccgcccugaaggccgccaaguacgacuacgcgggcguggggcgggccacccccggcagcaccacgcuccugcagggggcccccugcgccccgggcuucaaggacgacaccaagggcccccugaaccucaacaugaccgugcaggccgcgggggucgccuccugccugcgccccagccugcccgacggccucccguggggcgccgcccccgggcgggcgcgcaagaagcggaagcccuacaccaagcagcagaucgccgagcuggagaacgaguuccuggugaacgaguucaucaaccgccagaagcggaaggagcucuccaaccgccugaaccugagcgaccagcaggucaagaucugguuccagaaccggcgcaugaagaagaagcggguggugcuccgcgagcaggcccuggcccuguacuga

SEQ ID NO: 31246 - RNA, 1032 nt, Artificial Sequence
  derived and/or modified sequence opt1 from HOXD13__Homo_sapiens__NP_000514
augagccgcgccggcuccugggacauggacgggcugcgggccgacggcgggggcgccgggggcgcgcccgccagcuccagcuccagcuccguggccgccgcggccgccagcggccagugccgcggguuccucuccgccccggucuucgcgggcacccacagcgggcgggccgccgccgccgcggccgccgccgccgcggccgccgccgccgcguccggcuucgccuaccccgggaccagcgagcgcacgggcuccagcuccagcuccagcuccagcgccgugguggccgcccggcccgaggcgcccccggccaaggagugccccgcccccacccccgccgcggccgccgccgccccgcccagcgcgcccgcccugggcuacggguaccacuucggcaacggguacuacuccugccgcaugagccacggcgucggccugcagcagaacgcccucaaguccagcccccacgccucccucgggggcuucccgguggagaaguacauggacgugagcgggcuggccuccagcuccguccccgcgaacgaggugcccgcccgggccaaggaggugagcuucuaccagggcuacaccucccccuaccagcacgucccgggguacaucgacauggugagcaccuucggcuccggcgagccccgccacgaggccuacaucagcauggagggguaccaguccuggacgcuggccaacggcuggaacagccagguguacugcaccaaggaccagccccaggggucccacuucuggaaguccagcuuccccggcgacgucgcgcugaaccagccggacaugugcguguaccggcgcgggcggaagaagcgcgugcccuacaccaagcugcagcucaaggagcuggagaacgaguacgccaucaacaaguucaucaacaaggacaagcggcgccggaucagcgccgccaccaaccugagcgagcgccaggucacgaucugguuccagaaccggcgcgugaaggacaagaagaucguguccaagcucaaggacaccgucagcuga

SEQ ID NO: 31247 - RNA, 987 nt, Artificial Sequence
  derived and/or modified sequence opt1 from HOXD1__Homo_sapiens__NP_078777
augagcuccuaccuggaguacgugagcugcuccagcuccggcggggucggcggggacgugcucagccuggcccccaaguucugccgcuccgacgcccggccgguggcccugcagcccgccuucccccucggcaacggggacggcgccuucgucagcugccugccccuggccgccgcgcgcccgucccccagcccgcccgccgccccggcccggcccuccgugcccccgcccgcggcgccccaguacgcccagugcacccucgagggcgccuacgagcccggggccgcccccgccgccgccgccggcggggcggacuacggcuuccuggggagcggcccggccuacgacuuccccggcgugcuggggcgcgccgccgacgacggcgggucccacguccacuacgccaccagcgcgguguucuccggcggcgggagcuuccuccuguccggccagguggacuacgccgccuucggggagcccggccccuucccggccugccugaaggccagcgcggacgggcaccccggcgccuuccagacggccucccccgcccccggcaccuaccccaagagcgucagccccgcguccgggcuccccgccgccuucagcaccuucgaguggaugaaggugaagcggaacgccuccaagaagggcaagcuggccgaguacggggcggccagccccuccagcgccauccgcaccaacuucuccacgaagcagcugaccgagcucgagaaggaguuccacuucaacaaguaccugacccgggcccgccggaucgagaucgccaacugccugcaccucaacgacacccaggugaagaucugguuccagaaccgccggaugaagcagaagaagcgcgagcgggagggccugcuggcgacggccaucccggucgcgccccuccagcugccccugagcgggaccaccccgaccaaguucaucaagaaccccggcucccccagccagucccaggagcccagcuga

SEQ ID NO: 31248 - RNA, 1299 nt, Artificial Sequence
  derived and/or modified sequence opt1 from HOXD3__Homo_sapiens__XP_006712540
augcuguucgagcagggccagcaggcccucgagcugcccgagugcaccaugcagaaggccgcguacuacgagaacccggggcuguucggcggguacggcuacagcaagaccacggacaccuacggguacuccaccccccaccagcccuaccccccgcccgccgccgccagcucccucgacaccgacuaccccggcagcgccugcuccauccagagcuccgcgccccugcgcgccccggcccacaagggcgccgagcugaacgggagcugcaugcggcccggcacggggaacucccagggcgggggcggcgggagccagccccccggccucaacuccgagcagcagccgccccagccccccccgcccccccccacccugccgcccagcucccccaccaaccccgggggcggcgugccggcgaagaagcccaaggggggccccaacgccagcuccagcuccgccaccaucagcaagcagaucuuccccuggaugaaggagucccgccagaacagcaagcagaagaacagcugcgccacggccggggaguccugcgaggacaagagcccgcccggccccgcguccaagcggguccgcaccgccuacaccagcgcccagcugguggagcucgagaaggaguuccacuucaaccgguaccugugccgcccgcggcgcguggagauggccaaccugcucaaccugaccgagcggcagaucaagaucugguuccagaaccgccggaugaaguacaagaaggaccagaaggccaaggggauccugcacucccccgcgagccagucccccgagcgcagccccccgcucggcggcgccgccgggcacgucgccuacuccggccagcugccccccgugcccgggcuggccuacgacgcgccgagcccccccgccuucgccaagucccagcccaacauguacggccucgccgccuacacggcgccgcugagcuccugccugccccagcagaagcgguacgccgcccccgaguucgagccccacccgauggccagcaacgggggcggcuucgcguccgccaaccuccaggggagccccguguacgucggcgggaacuucguggaguccauggcccccgccagcggccccguguucaaccuggggcaccugucccacccgagcagcgccuccgucgacuacagcugcgcggcccagauccccggcaaccaccaccacggccccugcgacccccacccgaccuacaccgaccucuccgcccaccacagcucccaggggcgccugcccgaggcccccaagcugacccaccucuga

SEQ ID NO: 31249 - RNA, 768 nt, Artificial Sequence
  derived and/or modified sequence opt1 from HOXD4__Homo_sapiens__NP_055436
auggugaugagcuccuacauggugaacagcaaguacguggaccccaaguucccgcccugcgaggaguaccugcagggcggguaccucggcgagcagggggccgacuacuacggcgggggcgcccagggcgcggacuuccagccgcccgggcuguacccccgccccgacuucggcgagcagcccuucgggggcuccgggcccggcccgggcagcgcccugcccgcccgggggcacggccaggagcccgggggccccggcgggcacuacgccgccccgggcgagcccugccccgcgcccccggcgcccccgcccgcgccccuccccggggcccgcgccuacucccagagcgaccccaagcagcccccguccggcaccgcccugaagcagcccgccguggucuaccccuggaugaagaaggugcacgugaacagcgucaaccccaacuacaccgggggcgagccgaagcggucccgcacggccuacacccggcagcagguccuggagcucgagaaggaguuccacuucaaccgcuaccugacccggcgccggcgcaucgagaucgcccacacccugugccucagcgagcggcagaucaagaucugguuccagaaccgccggaugaaguggaagaaggaccacaagcugcccaacacgaagggccgcuccagcuccagcuccagcuccagcuccugcagcagcuccguggcccccagccagcaccuccagccgauggccaaggaccaccacaccgaccugaccacccuguga

SEQ ID NO: 31250 - RNA, 870 nt, Artificial Sequence
  derived and/or modified sequence opt1 from HOXD8__Homo_sapiens__NP_001186675
augagcuccuacuucgugaacccccuguacagcaaguacaaggccgccgcggccgccgccgccgcggccggcgaggccaucaaccccaccuacuacgacugccacuucgcccccgaggucgggggccgccacgcggccgccgccgccgcgcuccagcuguacgggaacuccgccgccggcuucccccacgcgccgccccaggcccacgcccacccccaccccagcccgccgcccuccgggaccggcugcggcgggcgggagggccgcgggcaggaguacuuccaccccggcgggggcagccccgccgccgccuaccaggccgcgcccccgcccccgccccacccgcccccgcccccgcccccgccgcccugcggcgggaucgccugccacggcgagcccgccaaguucuacggguacgacaaccugcagcggcagcccaucuucacgacccagcaggaggccgagcucgugcaguaccccgacugcaaguccagcuccggcaacaucggcgaggaccccgaccaccugaaccagagcuccagccccucccagauguuccccuggaugcgcccccaggcccccgggcggcgccggggccgccagaccuacagccgguuccagacccuggagcucgagaaggaguuccuguucaaccccuaccugacgcgcaagcggcgcaucgaggugucccacgcgcucgcccugaccgagcggcaggucaagaucugguuccagaaccgccggaugaaguggaagaaggagaacaacaaggacaaguuccccgugagccgccaggaggugaaggacggggagaccaagaaggaggcccaggagcuggaggaggaccgggccgagggccucaccaacuga

SEQ ID NO: 31251 - RNA, 1059 nt, Artificial Sequence
  derived and/or modified sequence opt1 from HOXD9__Homo_sapiens__NP_055028
augcugggcgggagcgccggccgccucaagauguccagcuccgggacccugagcaacuacuacguggacucccugaucggccacgagggggacgaggucuucgccgcgcgguucgggcccccgggccccggcgcccagggccgccccgccgggguggccgacggccccgccgcgaccgccgccgaguucgccagcugcuccuucgcgccgcggagcgccguguucuccgccagcugguccgccguccccagccagccgcccgccgcggccgccauguccgggcucuaccacccguacgugcccccgccgccccuggccgccagcgcguccgagcccggccgcuacgugcggagcuggauggagccccugcccggcuuccccgggggcgccgggggcggcgggggcgggggcgggggcggccccgggcgcggccccucccccgggcccagcggccccgccaacgggcggcacuacggcaucaagcccgagacgcgcgccgcccccgcgccggccaccgccgccuccaccaccagcagcuccagcacgucccucagcuccagcuccaagcggaccgagugcagcgucgcccgcgagucccagggcagcuccgggcccgaguucagcugcaacuccuuccugcaggagaaggcggccgccgccaccggcgggaccggccccggggcgggcaucggcgccgccacggggaccggcgggagcuccgagcccagcgccugcuccgaccacccgauccccggcugcagccugaaggaggaggagaagcagcacucccagccccagcagcagcagcucgacccgaacaaccccgccgcgaacuggauccacgcccggagcacccgcaagaagcggugccccuacaccaaguaccagacgcuggagcuggagaaggaguuccucuucaacauguaccugacccgcgaccggcgcuacgagguggcccggauccugaaccucaccgagcgccaggugaagaucugguuccagaaccggcgcaugaagaugaagaagaugagcaaggagaagugccccaagggcgacuga

SEQ ID NO: 31252 - RNA, 1548 nt, Artificial Sequence
  derived and/or modified sequence opt1 from HP1BP3__Homo_sapiens__XP_011539836
augcccauccgccggaccgugaacagcacccgcgagacgccgcccaagagcaagcuggccgagggcgaggaggagaagcccgagcccgacaucagcuccgaggagagcgucuccaccguggaggagcaggagaacgagaccccgcccgccaccagcuccgaggcggagcagcccaagggggagcccgagaacgaggagaaggaggagaacaagagcuccgaggagacgaagaaggacgagaaggaccagagcaaggagaaggagaagaaggugaagaagaccaucccguccugggccacccucagcgccucccagcuggcccgggcccagaagcagacccccauggcgagcagcccccgccccaagauggacgccauccugacggaggccaucaaggccugcuuccagaaguccggcgcguccgucguggccauccggaaguacaucauccacaaguacccgagccucgagcuggagcgccggggguaccugcucaagcaggcccugaagcgcgagcugaaccggggcgugaucaagcaggucaaggggaagggcgccuccggcagcuucguggugguccagaagucccgcaagacgccccagaagucccggaaccgcaagaaccggagcagcgccguggaccccgagccccaggugaagcucgaggacguccugccgcuggcguucacccgccucugcgagcccaaggaggccagcuacucccugauccggaaguacgugagccaguacuaccccaagcugcgcguggacauccggccccagcuccugaagaacgcccugcagcgcgccgucgagcgggggcagcucgagcagaucaccggcaagggggccuccggcaccuuccagcugaagaaguccggggagaagccgcugcucggcggcagccugauggaguacgcgauccugagcgccaucgccgccaugaacgagcccaagaccugcuccaccaccgcccucaagaaguacgugcuggagaaccaccccgggacgaacagcaacuaccagaugcaccuccugaagaagacccugcagaagugcgagaagaacggcuggauggagcagaucuccgggaagggcuucagcggcaccuuccagcugugcuuccccuacuacccgucccccgggguccucuuccccaagaaggagcccgacgacagccgcgacgaggacgaggacgaggacgaguccagcgaggaggacuccgaggacgaggagccgccgcccaagcggcgccugcagaagaagacccccgccaagagccccggcaaggcggccagcgugaagcagcgcggguccaagcccgcccccaaggugagcgccgcgcagcggggcaaggcccgcccgcugcccaagaaggccccgcccaaggccaagacgcccgcgaagaagacccggcccuccagcaccgugaucaagaagcccuccgggggcagcuccaagaagcccgccaccagcgcccgcaaggaggucaagcucccgggcaaggggaaguccacgaugaagaaguccuuccgggugaagaaguga

SEQ ID NO: 31253 - RNA, 582 nt, Artificial Sequence
  derived and/or modified sequence opt1 from HPCAL1__Homo_sapiens__XP_011508650
augggcaagcagaacagcaagcugcgccccgaggugcuccaggaccugcgggagaacaccgaguucaccgaccacgagcugcaggagugguacaagggguuccucaaggacugcccgacgggccaccugaccgucgacgaguucaagaagaucuacgccaacuucuuccccuacggggacgccuccaaguucgcggagcacguguuccgcaccuucgacaccaacggcgacgggacgaucgacuuccgggaguucaucaucgcccugagcgugaccucccgcggcaagcucgagcagaagcugaagugggccuucagcauguacgaccuggacggcaacggguacaucucccggagcgagaugcucgagaucguccaggccaucuacaagaugguguccagcgugaugaagaugcccgaggacgaguccacccccgagaagcgcaccgacaagaucuuccggcagauggacacgaacaacgacggcaagcugagccuggaggaguucauccgcggggccaaguccgacccgagcaucguccggcuccugcagugcgaccccuccagcgcgucccaguucuga

SEQ ID NO: 31254 - RNA, 1065 nt, Artificial Sequence
  derived and/or modified sequence opt1 from HPD__Homo_sapiens__NP_001165464
augggcuucgagccccuggccuaccgcgggcucgagaccggcagccgggagguggucucccacgugaucaagcaggggaagaucguguucguccugagcuccgcccugaacccguggaacaaggagaugggcgaccaccucgugaagcacggggacggcgugaaggacaucgcguucgaggucgaggacugcgacuacaucgugcagaaggcccgcgagcggggcgccaagaucaugcgcgagcccuggguggagcaggacaaguucgggaaggucaaguucgccgugcugcagaccuacggcgacacgacccacacccugguggagaagaugaacuacaucgggcaguuccuccccggcuacgaggcccccgcguucauggacccgcugcugcccaagcuccccaagugcagccuggagaugaucgaccacaucgucgggaaccagcccgaccaggagaugguguccgccagcgagugguaccugaagaaccuccaguuccaccgguucugguccguggacgacacccagguccacacggaguacagcucccugcgcagcaucgugguggccaacuacgaggaguccaucaagaugccgaucaacgagcccgcccccggcaagaagaagucccagauccaggaguacgucgacuacaacggcggggcgggcgugcagcacaucgcccugaagaccgaggacaucaucaccgccauccggcaccuccgcgagcgggggcuggaguuccugagcgugcccagcaccuacuacaagcagcuccgcgagaagcugaagacggccaagaucaaggucaaggagaacaucgacgcccuggaggagcucaagauccugguggacuacgacgagaagggcuaccugcuccagaucuucaccaagccggugcaggaccggcccacccuguuccuggaggucauccagcgccacaaccaccagggcuucggggcgggcaacuucaacucccucuucaaggccuucgaggaggagcagaaccugcgggggaaccugaccaacauggagacgaacggcgugguccccgggauguga

SEQ ID NO: 31255 - RNA, 801 nt, Artificial Sequence
  derived and/or modified sequence opt1 from HPGD__Homo_sapiens__NP_000851
augcacgugaacggcaaggucgcccuggugaccggggccgcgcagggcaucgggcgcgccuucgccgaggcccuccugcugaagggcgccaagguggcgcucgucgacuggaaccuggaggccggggugcagugcaaggccgcccuggacgagcaguucgagccccagaagacccucuucauccagugcgacguggcggaccagcagcagcugcgggacacguuccgcaaggucguggaccacuucggccggcuggacauccucgugaacaacgccggcgucaacaacgagaagaacugggagaagacccugcagaucaaccuggugagcgugaucuccgggaccuaccucggccuggacuacaugagcaagcagaacgggggcgagggcgggaucaucaucaacauguccagccuggccggccucaugccggucgcccagcagcccguguacugcgccuccaagcacgggaucgugggcuucacccgcagcgcggcccuggccgccaaccugaugaacuccgggguccggcucaacgccaucugccccggcuucgugaacacggcgauccuggagagcaucgagaaggaggagaacaugggccaguacaucgaguacaaggaccacaucaaggacaugaucaaguacuacgggauccuggacccgccccucaucgccaacggccugaucacccugaucgaggacgacgcccucaacggggccaucaugaagaucaccaccuccaagggcauccacuuccaggacuacgacacgacccccuuccaggccaagacccaguga

SEQ ID NO: 31256 - RNA, 600 nt, Artificial Sequence
  derived and/or modified sequence opt1 from HPGDS__Homo_sapiens__NP_055300
augcccaacuacaagcugaccuacuucaacaugcgcggccgggccgagaucauccgcuacaucuucgccuaccucgacauccaguacgaggaccaccggaucgagcaggcggacuggccggagaucaagagcacccugcccuucgggaagauccccauccuggagguggacggccucacgcugcaccagucccuggccaucgcccgcuaccucaccaagaacaccgaccuggccgggaacaccgagauggagcagugccacgucgacgccaucguggacacgcuggacgacuucaugagcugcuuccccugggcggagaagaagcaggacgugaaggagcagauguucaacgagcuccugaccuacaacgccccgcaccugaugcaggaccucgacaccuaccugggcgggcgggaguggcugaucggcaacuccgucaccugggccgacuucuacugggagaucugcagcacgacccuccugguguucaagcccgaccugcucgacaaccacccccgccuggugacccugcggaagaagguccaggccauccccgcgguggccaacuggaucaagcgccggccgcagaccaagcucuga

SEQ ID NO: 31257 - RNA, 1044 nt, Artificial Sequence
  derived and/or modified sequence opt1 from HP__Homo_sapiens__NP_001119574
augagcgcccugggcgccgugaucgcgcuccugcugugggggcagcuguucgccgucgacuccggcaacgacgugaccgacaucgccgacgacgggugccccaagccgcccgagaucgcccacggcuacguggagcacagcguccgcuaccagugcaagaacuacuacaagcuccggaccgagggggacggcguguacacgcugaacaacgagaagcaguggaucaacaaggccgugggcgacaagcuccccgagugcgaggcggucugcgggaagcccaagaacccggccaaccccgugcagcgcauccugggcgggcaccuggacgccaagggcuccuuccccuggcaggccaagauggugagccaccacaaccucaccaccggggcgacccugaucaacgagcaguggcugcucacgaccgccaagaaccuguuccugaaccacuccgagaacgccaccgccaaggacaucgcccccacccucacgcuguacgucggcaagaagcagcugguggagaucgagaaggugguccuccacccgaacuacagccagguggacaucggccugaucaagcugaagcagaagguguccgucaacgagcgggugaugcccaucugccuccccagcaaggacuacgcggagguggggcgcgucggcuacguguccggguggggccggaacgccaacuucaaguucaccgaccaccugaaguacgugaugcugcccgucgccgaccaggaccagugcauccgccacuacgagggcagcaccgugccggagaagaagacccccaagucccccguggggguccagcccauccucaacgagcacacguucugcgccggcaugagcaaguaccaggaggacacgugcuacggggacgccggcuccgcguucgccgugcacgaccuggaggaggacaccugguacgccaccgggauccugagcuucgacaaguccugcgccgucgccgaguacggcguguacgugaaggucaccagcauccaggacugggugcagaagaccaucgcggagaacuga

SEQ ID NO: 31258 - RNA, 1254 nt, Artificial Sequence
  derived and/or modified sequence opt1 from HPN__Homo_sapiens__NP_892028
auggcccagaaggagggcgggcgcaccgugcccugcugcagccggccgaaggucgccgcgcugaccgccggcacgcuccugcugcucaccgccaucggggccgccuccugggcgaucguggccgugcugcugcgcagcgaccaggagccccucuaccccguccagguguccagcgccgacgcccggcugaugguguucgacaagaccgagggcaccuggcgccugcucugcuccagccgguccaacgcgcgcgucgccgggcugagcugcgaggagaugggcuuccugcgggcccucacgcacuccgagcuggacgugcgcaccgccggcgccaacgggaccagcggcuucuucugcguggacgaggggcggcugccccacacccagcgccuccuggaggucaucuccgugugcgacugcccgcggggccgcuuccuggcggccaucugccaggacugcgggcggcgcaagcuccccguggaccggaucgucggcggccgcgacacgagccuggggcgguggcccuggcaggucucccugcgcuacgacggcgcccaccucugcgggggcagccugcuguccggcgacugggugcucaccgccgcccacugcuuccccgagcggaaccgcgugcugagccgguggcgcguguucgcgggggccguggcccaggccuccccgcacggccugcagcucgggguccaggccgugguguaccacggcggguaccugcccuuccgcgaccccaacagcgaggagaacuccaacgacaucgcgcugguccaccucagcagcccccugccgcugaccgaguacauccagcccgugugccuccccgccgccggccaggcccugguggacggcaagaucugcaccgucacgggguggggcaacacccaguacuacgggcagcaggccggcgugcugcaggaggcgcggguccccaucaucuccaacgacgugugcaacggggccgacuucuacggcaaccagaucaagccgaagauguucugcgccggcuaccccgagggcgggaucgacgccugccagggggacagcggcgggcccuucgugugcgaggacuccaucagccgcacgccccgguggcgccucugcggcaucgucuccuggggcaccgggugcgcgcuggcccagaagccgggcguguacaccaaggugagcgacuuccgggaguggaucuuccaggccaucaagacccacuccgaggccagcgggauggucacccagcuguga

SEQ ID NO: 31259 - RNA, 1047 nt, Artificial Sequence
  derived and/or modified sequence opt1 from HPR__Homo_sapiens__NP_066275
augagcgaccugggcgccgugaucucccuccugcugugggggcgccagcuguucgcccucuacagcggcaacgacgucaccgacaucuccgacgaccgguuccccaagccgcccgagaucgcgaacggguacguggagcaccuguuccgcuaccagugcaagaacuacuaccggcuccgcaccgagggcgacgggguguacacgcugaacgacaagaagcaguggaucaacaaggccgucggcgacaagcugcccgagugcgaggccgugugcggcaagcccaagaacccggccaaccccgugcagcggauccucgggggccaccuggacgccaaggggagcuuccccuggcaggcgaagauggucucccaccacaaccugaccaccggcgccacccucaucaacgagcaguggcugcugacgaccgccaagaaccucuuccugaaccacagcgagaacgccaccgcgaaggacaucgcccccacccugacgcucuacguggggaagaagcagcugguggagaucgagaaggucgugcugcacccgaacuaccaccagguggacaucggccucaucaagcugaagcagaagguccuggugaacgagcgcgugaugcccaucugccuccccuccaagaacuacgccgaggucggccgggugggguacgugagcggcugggggcaguccgacaacuucaagcugaccgaccaccugaaguacgucaugcuccccguggccgaccaguacgacugcaucacccacuacgagggcagcacgugcccgaaguggaaggcccccaagucccccgugggcguccagcccauccugaacgagcacaccuucugcguggggaugagcaaguaccaggaggacacgugcuacggcgacgcgggguccgccuucgccgugcacgaccuggaggaggacaccugguacgccgccggcauccucagcuucgacaaguccugcgcggucgccgaguacgggguguacgucaaggugaccagcauccagcacugggugcagaagaccaucgccgagaacuga

SEQ ID NO: 31260 - RNA, 657 nt, Artificial Sequence
  derived and/or modified sequence opt1 from HPRT1__Homo_sapiens__NP_000185
auggccacccgcagccccggcguggucaucuccgacgacgagccgggguacgaccuggaccucuucugcauccccaaccacuacgccgaggaccuggagcggguguucaucccccacggccugaucauggaccgcaccgagcggcucgcgcgcgacgugaugaaggagaugggcgggcaccacaucgucgcccugugcgugcugaagggcggguacaaguucuucgccgaccuccuggacuacaucaaggcccugaaccggaacagcgaccgcuccauccccaugacgguggacuucauccggcucaagagcuacugcaacgaccaguccaccggcgacaucaaggucaucgggggcgacgaccugagcacccugaccgggaagaacgugcucaucguggaggacaucaucgacacgggcaagaccaugcagacccugcugucccucguccgccaguacaacccgaagauggugaagguggccagccugcuggucaagcggacgccccgcuccgugggguacaagcccgacuucgugggcuucgagauccccgacaaguucgucgugggcuacgcgcucgacuacaacgaguacuuccgggaccugaaccacgugugcgucaucagcgagaccgggaaggccaaguacaaggccuga

SEQ ID NO: 31261 - RNA, 2103 nt, Artificial Sequence
  derived and/or modified sequence opt1 from HPS1__Homo_sapiens__NP_000186
augaagugcgugcuggucgccaccgagggcgccgaggugcuguucuacuggaccgaccaggaguucgaggagagccugcgccugaaguucgggcaguccgagaacgaggaggaggagcuccccgcgcuggaggaccagcugagcacgcuccuggccccggugaucaucuccagcaugaccaugcuggagaagcucuccgacaccuacacgugcuucagcaccgagaacggcaacuuccuguacguccugcaccucuucggggagugccuguucaucgccaucaacggcgaccacaccgaguccgagggggaccugcggcgcaagcucuacgugcugaaguaccuguucgaggugcacuucggccucgucaccguggacggccaccugauccggaaggagcugcgcccgcccgaccucgcccagcgggugcagcugugggagcacuuccagagccugcucuggaccuacucccgccugcgggagcaggagcagugcuucgccgucgaggcgcuggagcgccucauccacccccagcugugcgagcugugcaucgaggcccucgagcggcacgugauccaggccgugaacacgagccccgagcgcgggggcgaggaggcccugcacgcguuccugcucguccacuccaagcugcuggccuucuacagcucccacagcgccuccagccuccggcccgccgaccugcuggcccucauccugcuggugcaggaccucuaccccuccgagagcaccgcggaggacgacauccagcccuccccgcgccgggcccgcagcagccagaacauccccgugcagcaggccuggagcccccacuccaccgggcccaccggcggguccagcgccgagacggagaccgacuccuucagccugccggaggaguacuucacccccgcccccucccccggcgaccagagcuccggcagcaccaucuggcuggagggcgggacgccgcccauggacgcgcuccagaucgccgaggacacccugcagacccuggucccccacugccccgugccguccgggccccggcgcaucuuccucgacgccaacgugaaggagagcuacugcccccuggucccccacaccauguacugccugccgcuguggcagggcaucaaccucgugcugcugacgcggucccccagcgcgccccucgcccuggugcugucccagcucauggacggcuucagcaugcuggagaagaagcugaaggaggggcccgagccgggcgccucccuccgcagccagccccuggucggggaccugcggcagcgcauggacaaguucgugaagaaccggggcgcccaggagauccaguccaccuggcucgaguucaaggccaaggccuucagcaagagcgagcccggguccagcugggagcugcugcaggccugcggcaagcucaagcgccagcugugcgcgaucuaccgccugaacuuccucaccaccgccccgucccggggcgggccccaccucccccagcaccuccaggaccaggugcagcgccugaugcgggagaagcugacggacuggaaggacuuccugcucgucaagagccgccggaacaucaccaugguguccuaccuggaggacuuccccggccugguccacuucaucuacguggaccgcaccaccgggcagaugguggccccgagccucaacugcucccagaagacgagcuccgagcugggcaaggggccccuggccgcguucgucaagaccaagguguggagccucauccagcuggcccggcgcuaccugcagaagggcuacaccacccuccuguuccaggagggcgacuucuacugcuccuacuuccugugguucgagaacgacaugggguacaagcuccagaugaucgaggugcccguccugagcgacgacuccgugcccaucggcaugcucgggggcgacuacuaccggaagcugcugcgcuacuacagcaagaaccggccgacggaggccgugcgcugcuacgagcugcucgcccugcaccuguccgucauccccaccgaccuccuggugcagcaggccgggcagcuggcgcggcgccucugggaggccagccggaucccccugcuguga

SEQ ID NO: 31262 - RNA, 3015 nt, Artificial Sequence
  derived and/or modified sequence opt1 from HPS3__Homo_sapiens__NP_115759
auggugcagcuguacaaccuccaccccuucggcagccagcaggucgugccgugcaagcuggagcccgaccgcuucugcgggggcgggcgggacgcccuguucguggccgcgggcugcaaggucgaggccuucgccguggccgggcaggagcucugccagccccgcugcgccuucuccacccugggccgggugcugcgccucgcguacagcgaggccggcgacuaccuggucgccaucgaggagaagaacaaggccaccuuccugcgggcguacgugaacuggcgcaacaagcggacggagaacucccgcgugugcauccggaugaucgggcacaacgucgagggccccuucagcaaggccuuccgcgaccagauguacaucaucgagaugccgcucuccgaggcgccccugugcaucagcugcugccccgugaagggggaccugcucgugggcugcaccaacaagcugguccuguucucccucaaguaccagaucaucaacgaggaguucagccugcuggacuucgagcggucccucaucauccacaucgacaacaucacccccguggaggugagcuucugcgucggguacguggccgugauguccgaccuggagguccugaucgugaagcucgagagcggcccgaagaacggcgagcgcgugcaccaccacccccacaagaccaacaaccggauccgccggacggaggaggggaucuccaacgagaucagccagcuggaguccgacgacuucgucaucugccagaagccccuggagcuccugggcgagaaguccgagcagagcgggcugagcgugacccucgaguccaccggccuggccgacgagaagcgcaaguacagccacuuccagcaccuccuguaccggcgcuucgcccccgacaucagcuccuacgugcugagcgacgacaucaagcugcacucccuccagcugcugccgaucuaccagaccggcagccucacguccgacgggaagaaccugagccaggagaaggagcugcucucccuguucugcuucuucagccugccccacgucggcuaccucuacaugguggucaaguccguggagcugaugagcguguaccaguaccccgagaagucccagcaggccguccugacgccccaguuccuccacgugaucaccagcaacaaccugcagugcuucaccgugcggugcuccgccgccgccgcgcgcgaggaggacccguacauggacaccacccugaaggccugcccgcccgucagcauggacgugugcgcccuccggauccagcuguucaucgggcugaaggccaucugccacuucaagaaccacaucauccugcucaccaaggccgagcccgaggcgauccccgagcgccgccagucccccaagcggcugcugagccgcaaggacaccuccgugaagaucaagaucccgcccgucgccgaggccggcuggaaccucuacaucgugaacacgaucagccccgugcagcuguacaaggagauggucgacuacuccaacaccuacaagaccgugaagacccagagcugcauccaccuccugagcgaggcccaccuccuggugcgggccgcgcugauggacgccucccagcuggagcccggggagaaggccgagcugcucgaggccuucaaggagagcugcggccaccugggcgacugcuacucccgccuggacagccagcacucccaccucacgcugcccuacuacaagaugagcgggcuguccauggcggagguccucgcccggaccgacuggaccguggaggacggccugcagaaguacgagcgcgggcugaucuucuacaucaaccacagccucuacgagaaccuggacgaggagcugaacgaggagcucgccgccaaggugguccagauguucuacguggccgagcccaagcaggucccgcacauccugugcucccccagcaugaagaacaucaacccccugaccgcgauguccuaccuccggaagcuggacacgagcggcuucuccagcauccuggugacccucaccaaggccgccguggcccugaagaugggggaccuggacaugcaccgcaacgagaugaagucccacagcgagaugaagcucgugugcggcuucauccuggagccgcggcugcucauccagcagcgcaagggccagaucguccccaccgagcuggcccugcaccucaaggagacgcagcccgggcugcugguggcguccgugcucggccugcagaagaacaacaagaucgggaucgaggaggccgacagcuucuucaagguccugugcgccaaggacgaggacaccaucccccagcuccugguggacuucugggaggcccagcugguggccugccucccggacgucgugcugcaggagcuguucuucaagcucaccagccaguacaucuggcggcuguccaagcgccagccgcccgacaccacgccccugcggaccagcgaggaccucaucaacgcgugcucccacuacggccugaucuaccccugggugcacgucgugaucagcuccgacagccuggccgacaagaacuacaccgaggaccucuccaagcugcagagccugaucugcgggcccuccuucgacaucgccagcaucauccccuuccucgagccccuguccgaggacaccaucgccggccugagcgugcacguccucugccgcacgcggcugaaggaguacgagcagugcaucgacauccugcucgagcgcugcccggaggcggugauccccuacgccaaccacgagcugaaggaggagaaccggacccugugguggaagaagcuccugcccgagcugugccagcgcaucaagugcggcggggagaaguaccagcucuaccuguccagccugaaggagacccucuccaucguggccgucgagcuggagcugaaggacuucaugaacgugcuccccgaggacggcaccgccaccuucuuccugccguaccugcucuacugcagccggaagaagccccugacguga

SEQ ID NO: 31263 - RNA, 2127 nt, Artificial Sequence
  derived and/or modified sequence opt1 from HPS4__Homo_sapiens__NP_071364
auggccaccagcaccuccacggaggccaagagcgcguccugguggaacuacuucuuccuguacgacggcagcaaggugaaggaggagggggaccccacccgcgccggcaucugcuacuucuacccgucccagacccuccuggaccagcaggagcugcucugcgggcagaucgccggcgucgugcggugcgugagcgacaucuccgacagcccgcccacccugguccgccugcggaagcucaaguucgccaucaagguggacggggacuaccugugggugcugggcugcgccgucgagcuccccgacguguccugcaagcgcuuccuggaccagcuggugggcuucuucaacuucuacaacgggccggucagccucgcguacgagaacugcucccaggaggagcugagcacggagugggacaccuucaucgagcagauccugaagaacaccuccgaccuccacaagaucuucaacagccuguggaaccuggaccagaccaagguggagccccuccugcugcucaaggccgcccggauccugcagacgugccagcgcagcccccacauccuggccggcugcauccucuacaaggggcugaucguguccacccagcugcccccgucccucaccgcgaagguccugcugcaccggaccgcgccccaggagcagcgccuccccacgggcgaggacgcgccccaggagcacggggccgcccugccgcccaacgugcagaucauccccguguucgucaccaaggaggaggccaucagccugcacgaguuccccguggagcagaugacccggucccucgccagcccggccggccugcaggacggcagcgcccagcaccaccccaagggcggguccaccagcgcccugaaggagaacgccacggggcacguggaguccauggccuggaccacccccgaccccaccagcccggacgaggccugccccgacggccgcaaggagaacggcugccucuccgggcacgaccuggagagcauccggcccgccggccugcacaacuccgcccgcggggagguccucggccugagcuccagccuggggaaggagcucguguuccugcaggaggagcuggaccucuccgagauccacauccccgaggcgcaggagguggagauggccagcggccacuucgccuuccugcacgucccggugcccgacggccgggcccccuacugcaaggccucccugagcgcguccagcucccucgagcccacgccgcccgaggacaccgccaucagcucccugcggcccccgagcgcccccgagaugcugacccagcacggggcccaggagcagcuggaggaccaccccggccacagcucccaggcgcccaucccgcgcgccgacccccucccccgccggacccgccggccccugcugcucccgcgccuggaccccgggcagcggggcaacaagcugcccacgggggagcagggccucgacgaggacguggacggcgucugcgagagccacgccgcccccgggcuggagugcuccagcggcuccgccaacugccagggggcgggcccgagcgccgacgggaucuccagccgccugacccccgccgaguccugcaugggccucgugcgcaugaaccuguacacccacugcgucaagggccuggugcucagccugcuggccgaggagccccuccugggggacuccgccgcgaucgaggagguguaccacagcucccuggccagccucaacggccuggagguccaccugaaggagacccucccccgggacgaggccgccuccacgagcuccaccuacaacuucacccacuacgaccgcauccagagccugcugauggccaaccucccccagguggcgacgccccaggaccggcgcuuccugcaggccgugagccugaugcacuccgaguucgcccagcuccccgcccuguacgagaugaccguccggaacgcgagcaccgccguguacgccugcugcaaccccauccaggagaccuacuuccagcagcuggccccggccgcgcgcuccagcggguuccccaacccccaggacggcgccuucucccucagcggcaaggccaagcagaagcugcugaagcacggggugaaccuccuguga

SEQ ID NO: 31264 - RNA, 3390 nt, Artificial Sequence
  derived and/or modified sequence opt1 from HPS5__Homo_sapiens__NP_852608
auggccuucgugcccgucaucccggagagcuacucccacgugcuggccgaguucgagagccucgacccccugcuguccgcgcuccgccuggacagcucccggcugaagugcaccagcaucgccgugucccgcaaguggcucgcccugggcagcuccgggggcgggcugcaccucauccagaaggagggcuggaagcaccggcuguuccugagccaccgcgagggggccaucucccaggucgccugcugccuccacgacgacgacuacguggcgguggccaccagccagggccuggucguggugugggagcugaaccaggagcggcgcggcaagcccgagcagauguacgucuccagcgagcacaaggggcggcgcgugacggcccucugcugggacaccgccauccugcggguguucgucggcgaccacgcggggaagguguccgccaucaagcugaacaccagcaagcaggccaaggccgccgcggccuucgugauguuccccguccagaccaucacgaccguggacuccugcgugguccagcucgacuaccuggacggccgccugcucaucagcucccugacccggagcuuccugugcgacaccgagcgcgagaaguucuggaagaucgggaacaaggagcgggacggcgaguacggcgccugcuucuucccggggcgcugcagcggcgggcagcagccccucaucuacugcgcccggcccggcucccgcaugugggaggugaacuucgacggcgaggugaucagcacgcaccaguucaagaagcugcugucccugcccccgcugcccgucaucacccugcggagcgagccccaguacgaccacaccgccggguccagccagucccucagcuuccccaagcugcugcaccucuccgagcacugcgugcugaccuggacggagcgcggcaucuacaucuucaucccgcagaacgugcagguccugcucuggagcgaggugaaggacauccaggacgucgcggugugccggaacgagcuguucugccugcaccucaacgggaaggugucccaccugagccugaucuccgucgagcgcugcguggagcggcuccugcgccgcggccuguggaaccucgccgcccggaccugcugccuguuccagaacagcgugaucgccucccgcgcccggaagacccugaccgcggacaagcucgagcaccucaagagccagcuggaccacgggacguacaacgaccugaucucccagcucgaggagcugauccugaaguucgagccccucgacagcgccugcuccagccgccggagcuccaucagcucccacgagagcuucuccauccuggacagcggcaucuaccgcaucaucuccagccggcgcggcucccagagcgacgaggacuccugcagccugcacucccagacccucagcgaggacgagcgguucaaggaguucaccucccagcaggaggaggaccugcccgaccagugcugcgggagccacggcaacgaggacaacgucucccacgcccccgugauguucgagaccgacaagaacgagacguuccugccguucgggaucccccuccccuuccgcagccccagcccgcuggugucccugcaggccgucaaggagagcguguccagcuucgugcggaagaccaccgagaagaucggcacccuccacacgucccccgaccugaagguccgccccgagcugcgcggggacgagcagagcugcgaggaggacguguccagcgacacgugccccaaggaggaggacaccgaggaggagaaggaggugaccuccccgccgcccgaggaggaccgguuccaggagcucaaggucgccaccgcggaggccaugaccaagcugcaggacccccuggugcuguucgagagcgagucccugcggauggugcugcaggaguggcucagccaccuggagaagaccuucgccaugaaggacuucuccggcgucagcgacaccgacaacuccagcaugaagcugaaccaggacgugcuccuggugaacgaguccaagaagggcauccuggacgaggacaacgagaaggagaagcgcgacagccucgggaacgaggaguccgucgacaagacggccugcgagugcgugcggagcccccgcgagagccuggacgaccuguuccagaucugcucccccugcgcgaucgccagcggccuccggaacgaccuggccgagcugaccacccucugccuggagcugaacgugcucaacuccaagaucaagagcaccuccgggcacgucgaccacacgcugcagcaguacagccccgagauccuggccugccaguuccucaagaaguacuucuuccugcugaaccucaagcgcgccaaggaguccaucaagcugagcuacuccaacagcccguccgugugggacaccuucaucgagggccugaaggagauggcgagcuccaaccccguguacauggagauggagaagggggaccuccccacccgccugaagcugcucgacgacgagguccccuucgacagcccgcugcuggugguguacgccacccggcucuacgagaaguucggcgaguccgcccugcgcagccugaucaaguucuuccccuccauccuccccagcgacaucauccagcugugccaccaccaccccgccgaguuccuggccuaccucgacucccuggucaagagccggccggaggaccagcgcagcuccuuccuggagagccuccugcagcccgagucccugcggcucgacuggcugcugcucgcggugagccuggacgccccgcccuccaccagcacgauggacgacgagggcuacccccgcccccacucccaccuccucagcuggggguacucccagcugauccugcaccucaucaagcugcccgccgacuucaucaccaaggagaagaugaccgacaucugccggagcugcggcuucuggcccggguaccugauccucugccuggagcuggagcgccggcgcgaggccuucaccaacaucguguaccucaacgacaugucccugauggagggcgacaacggcuggaucccggagacggucgaggaguggaagcugcuccugcaccugauccagagcaaguccacccggcccgcgccccaggagagccucaacgggucccugagcgacggccccuccccgaucaacguggagaacguggcccugcuccuggccaaggccauggggcccgaccgcgccuggagccugcuccaggagugcggccuggcgcuggagcucuccgagaaguucacccggaccugcgacauccugcgcaucgccgagaagcggcagcgcgcccugauccagagcaugcuggagaagugcgaccgguuccucuggagccagcaggccuga

SEQ ID NO: 31265 - RNA, 2328 nt, Artificial Sequence
  derived and/or modified sequence opt1 from HPS6__Homo_sapiens__NP_079023
augaagcgcagcggcacccugcggcuccuguccgaccugagcgccuucgggggcgccgcgcgccuccgggagcugguggccggggacuccgccguccgcgugcggggcagccccgacgggcgccaccugcuccugcugcggccgcccggcgccguggccccccagcuccuggucgcgucccgcggccccggggccgagcuggagcgggccuggccggccggccagcccagcccccucgacgcguucuuccugcccuggccggcccgccccgcccuggugcucgugugggaguccgggcuggccgaggucuggggcgccggggugggccccggcuggcggccccugcagagcaccgagcucugcccggggggcggggcgcgcguggucgccguggccgcccugcggggccgccugguguggugcgaggagcggcaggcccgcgcggagggccccuccgggagccccgccgccgccuucucccacugcgucugcgugcggacgcucgagcccagcggcgaggccuccaccagccuggggcgcacccacgugcugcuccaccacugcccggcguucggccugcuggccuccugccggcagcucuuccugguccccaccgccacgaccuggcccgggguggcccacgugcugcucaucuggagccccggcaagggcaaggucaugguggccgcgccgcgccuggggcuguccuacagcaagucccucaaccccggccggggggacaccugggacuuccgcacccugcugcgcggccuccccgggcugcugagcccccgggagccgcucgccgugcacacgugggcccccaccccccagggccugcugcuccuggacuucggcgggaccgucagccugcuccagucccacggcgggacccgcgccgugggcacgcugcaggaggcgcccguggggccguggggcagcgccgcccugggcaccuuccaggggacccucgccugcguccugggcuccacccuggagcugcucgacauggggagcggccagcugcuggagcggaaggugcucuccacggaccgcguccaccugcuggagccccccgccccgggcauggaggacgaggaggagcucgagacccgggggaaccugcgccugcucagcgcgcugggccuguucugcguggggugggaggccccccagggcguggagcuccccuccgccaaggaccuggucuucgaggaggccugcggguacuaccagcggcgcagccugcggggcgcccagcucacccccgaggagcugcgccacuccagcaccuuccgggcgccgcaggcccuggccuccauccuccagggccaccugccccccagcgcccugcucacgaugcugcgcaccgagcugcgggacuaccgcgggcucgagcagcugaaggcccagcugguggcgggcgacgacgaggaggccggguggaccgagcucgccgagcaggagguggcccggcugcugcgcaccgagcucaucggcgaccagcuggcgcagcugaacacggucuuccaggcccuccccaccgccgccuggggggccacccugcgggcgcugcagcuccagcuggacggcaacggcaagcugcgcucccaggccccgcccgacguguggaagaaggugcucgggggcaucaccgccgggaaggagccccccaacggcauccugccgcccuucgagcugcucugccagugccugugccagcuggagccccgguggcuccccccguucgucgagcuggcccagcagcaggggggccccggcuggggggccggcgggcccggccugccccucuaccgccgcgcgcuggccgugcugggggaggagggcacgcggccggaggcccucgagcuggagcugcuccugagcuccggccgccccaaggccgugcugcaggccgucgggcagcucgugcagaaggagcagugggaccgggcgcuggacgccggccuggcccucgggcccagcuccccccugcugcgcagcgagaucuucaagcuccugcuggccgaguucgcgcagcaccggcgccucgacgcccaccugccgcugcucugccggcugugcccccccgagcuggccccggccgagcuccugcugcuccugcgcaccuaccugcccgacgaggugggcccccccaccccguuccccgagcccggcgccgagcccccgcucaccgucgggcugcugaaggcgcuccuggagcagacgggcgcccagggguggcuguccggccccgugcucagccccuacgaggacauccugugggaccccagcaccccgccccccacccccccgcgggaccuguga

SEQ ID NO: 31266 - RNA, 1605 nt, Artificial Sequence
  derived and/or modified sequence opt1 from HPSE2__Homo_sapiens__NP_001159716
augcgcgugcugugcgccuuccccgaggccaugccgagcuccaacagccggccgcccgcgugccucgcccccggcgcccuguaccuggcccuccugcugcaccucucccugagcucccaggccggggaccgccggccccugcccgucgaccgcgcggccggccucaaggagaagacccugauccugcucgacgugagcaccaagaaccccgugcggacggucaacgagaacuuccugucccugcagcucgaccccagcaucauccacgacggguggcuggacuuccuguccagcaagcgccucgugacccuggcccggggccuguccccggccuuccuccgcuucgggggcaagcggaccgacuuccugcaguuccagaaccugcgcaaccccgccaagagccggggcgggcccggccccgacuacuaccucaagaacuacgaggacgacaucgugcgcuccgacgucgcgcuggacaagcagaaggggugcaagaucgcccagcacccggacgugaugcuggagcuccagcgggagaaggccgcccagaugcaccuggugcugcucaaggagcaguucagcaacaccuacuccaaccugauccugacggagcccaacaacuaccgcaccaugcacggccgggcggucaacgggagccagcucggcaaggacuacauccagcugaagucccugcuccagcccauccgcaucuacagccgggccucccuguacggccccaacaucgggcgcccgcggaagaacgugaucgcccugcucgacggcuucaugaagguggccgggagcaccgucgacgccgugaccuggcagcacugcuacaucgacggccgcguggucaaggugauggacuuccugaagacgcggcugcucgacacccugagcgaccagauccgcaagauccagaagguggucaacaccuacacccccggcaagaagaucuggcuggaggggguggugacgaccuccgcgggcgggaccaacaaccucagcgacuccuacgccgccggcuuccuguggcugaacacccucgggaugcuggccaaccagggcaucgacgucgugauccgccacagcuucuucgaccacggcuacaaccaccugguggaccagaacuucaacccccugcccgacuacuggcucucccugcuguacaagcggcucaucgggccgaagguccuggccgugcacgucgcgggccugcagcgcaagccccggcccgggcgcgugauccgggacaagcuccgcaucuacgcccacugcacgaaccaccacaaccacaacuacgugcggggcagcaucacccuguucaucaucaaccugcaccgcucccggaagaagaucaagcucgccgggacccugcgcgacaagcugguccaccaguaccuccugcagcccuacggccaggagggccucaagagcaaguccgugcagcugaacgggcagccgcuggugauggucgacgacggcacccugcccgagcucaagccccggccccugcgcgccgggcggacgcuggugaucccgcccgugaccaugggcuucuacgucgugaagaacgugaacgcccucgcgugccgcuaccgguga

SEQ ID NO: 31267 - RNA, 1632 nt, Artificial Sequence
  derived and/or modified sequence opt1 from HPSE__Homo_sapiens__NP_001092010
augcugcuccgcagcaagcccgcccugccgccgccccugaugcuccugcugcucggcccccuggggccccugucccccggcgcccucccccggcccgcgcaggcccaggacguggucgaccuggacuucuucacccaggagccgcugcaccucgugagccccuccuuccugagcgugaccaucgacgccaaccuggccacggacccccgcuuccucauccugcuggggucccccaagcuccggacccuggcccgcggccugagcccggcguaccuccgguucgggggcaccaagaccgacuuccugaucuucgaccccaagaaggaguccacguucgaggagcgcagcuacuggcagucccaggucaaccaggacaucugcaaguacggcagcaucccgcccgacguggaggagaagcugcggcucgaguggcccuaccaggagcagcugcugcuccgcgagcacuaccagaagaaguucaagaacuccaccuacagccgguccagcguggacguccuguacaccuucgccaacugcuccgggcuggaccucaucuucggccugaacgcccugcuccgcaccgccgaccugcaguggaacagcuccaacgcgcagcugcuccuggacuacugcagcuccaagggguacaacaucagcugggagcugggcaacgagcccaacagcuuccucaagaaggccgacaucuucaucaacgggucccagcugggcgaggacuucauccagcugcacaagcuccugcgcaagagcacguucaagaacgccaagcuguacggccccgacguggggcagccccggcggaagaccgccaagaugcucaaguccuuccugaaggccggcggggaggugaucgacagcgucaccuggcaccacuacuaccugaacggccgcaccgcgacgaaggaggacuuccucaacccggacgugcuggacaucuucaucuccagcgugcagaaggucuuccaggugguggaguccacccggcccggcaagaaggucuggcugggggagaccagcuccgccuacggcgggggcgcgccccugcucagcgacaccuucgccgccggguucauguggcuggacaagcugggccucuccgcccgcaugggcaucgagguggugaugcggcaggucuucuucggggccggcaacuaccaccugguggacgagaacuucgacccccugccggacuacuggcucagccugcuguucaagaagcucguggggacgaagguccugauggccuccgugcagggcagcaagcgccggaagcugcgcguguaccuccacugcaccaacaccgacaacccccgguacaaggagggggaccugacccuguacgccaucaaccuccacaacgucacgaaguaccugcgccugcccuaccccuucuccaacaagcaggucgacaaguaccuccugcgcccgcugggcccccacggccuccugagcaaguccgugcagcugaacgggcucacccugaagaugguggacgaccagacccugcccccgcucauggagaagccccugcggcccggcagcucccuggggcuccccgccuucagcuacagcuucuucgugauccgcaacgcgaaggucgccgccugcaucuga

SEQ ID NO: 31268 - RNA, 1389 nt, Artificial Sequence
  derived and/or modified sequence opt1 from HPX__Homo_sapiens__XP_005252940
auggcccgcgugcugggcgcccccgucgcgcucgggcuguggagccugugcuggucccucgccaucgccaccccgcugccgcccaccagcgcccacggcaacguggccgagggggagacgaagcccgaccccgacgugaccgagcggugcuccgacggcuggagcuucgacgcgaccacccuggacgacaacgggacgaugcuguucuucaagggcgaguucgucuggaagucccacaagugggaccgcgagcucaucagcgagcgguggaagaacuuccccucccccguggacgccgccuuccgccagggccacaacagcguguuccugaucaagggggacaaggucuggguguacccgcccgagaagaaggagaagggcuaccccaagcuccugcaggacgaguuccccgggauccccuccccgcuggacgccgcgguggagugccaccggggcgagugccaggccgaggggguccucuucuuccagggcgaccgcgagugguucugggaccuggccaccggcaccaugaaggagcggagcuggcccgccguggggaacugcuccagcgcccugcgcuggcucggccgguacuacugcuuccaggggaaccaguuccugcgcuucgaccccgugcggggcgaggugcccccgcgcuacccccgggacguccgcgacuacuucaugcccugccccggccgggggcacggccaccgcaacgggaccggccacgggaacuccacgcaccacggcccggaguacaugcggugcagcccccaccuggugcucuccgcgcugaccagcgacaaccacggcgccaccuacgccuucuccgggacccacuacuggcgccuggacacgagccgggacggcuggcacuccuggcccaucgcccaccaguggccccaggggccgagcgccgucgacgcggccuucagcugggaggagaagcucuaccuggugcagggcacccagguguacgucuuccugaccaagggcggguacacccucguguccggcuaccccaagcgccuggagaaggagguggggacgccccacggcaucauccuggacagcgucgacgccgccuucaucugccccggguccagccggcuccacaucauggccggccgccgccugugguggcuggaccucaaguccggggcgcaggccaccuggaccgagcugccguggccccacgagaagguggacggcgcccugugcauggagaagucccucggccccaacagcugcagcgccaacgggccgggccuguaccugauccacgggcccaaccucuacugcuacuccgacguggagaagcugaacgccgcgaaggcccugccccagccccagaacgucaccagccuccugggcugcacgcacuga

SEQ ID NO: 31269 - RNA, 570 nt, Artificial Sequence
  derived and/or modified sequence opt1 from HRAS__Homo_sapiens__NP_001123914
augaccgaguacaagcugguggucgugggcgccgggggcgugggcaagagcgcccucaccauccagcugauccagaaccacuucgucgacgaguacgaccccacgaucgaggacuccuaccgcaagcaggucgugaucgacggggagaccugccugcucgacauccuggacaccgcggggcaggaggaguacagcgccaugcgggaccaguacaugcgcaccggcgagggcuuccugugcguguucgccaucaacaacacgaaguccuucgaggacauccaccaguaccgggagcagaucaagcgcgugaaggacagcgacgacgugccgaugguccucguggggaacaagugcgaccuggccgcccggaccguggagucccgccaggcgcaggaccuggcccggagcuacggcauccccuacaucgagaccuccgccaagacccgccagggggucgaggacgccuucuacacgcucgugcgggagauccgccagcacaagcugcggaagcugaacccgcccgacgagagcggccccgggugcauguccugcaagugcgugcucagcuga

SEQ ID NO: 31270 - RNA, 822 nt, Artificial Sequence
  derived and/or modified sequence opt1 from HRASLS__Homo_sapiens__NP_065119
auggugcgcgccagcugccggcugggcuccgcccgcacccccagcccggcgcggcgcccgcccgggguccgggccucccagagccgcggcggggccgccggcaccguguccgccuggcggcgcuggugcuggcgguggcccuggcgcacggcgcccagcgacggguggcggcucccgcccggcugccugcccggcaccgacgggguggucccccgcccgcccgccgcccgguccgccgcggcccgcccccgggagacccccggccacacccagcugccgcccggggcccgccggcgcccccggcucgagagcgagauggccuucaacgacugcuucucccugaacuaccccggcaaccccugccccggggaccugaucgagguguuccgccccggcuaccagcacugggcccucuaccugggcgacggguacgugaucaacaucgcgccggucgacggcauccccgccagcuucacguccgccaagagcguguucuccagcaaggcccuggugaagaugcagcuccugaaggacgucguggggaacgacaccuaccggaucaacaacaaguacgacgagaccuacccgccccugcccguggaggagaucaucaagcgcuccgaguucgucaucggccaggagguggccuacaaccuccuggugaacaacugcgagcacuucgucacccugcuccgcuacggcgagggggugagcgagcaggcgaaccgggccaucuccacgguggaguucgucaccgccgccgugggcguguucagcuuccuggggcuguuccccaagggccagcgcgccaaguacuacuga

SEQ ID NO: 31271 - RNA, 2100 nt, Artificial Sequence
  derived and/or modified sequence opt1 from HRC__Homo_sapiens__NP_002143
augggccaccaccgccccuggcugcacgccagcgugcucugggccggggucgcgucccugcugcucccgcccgccaugacccagcagcugcggggcgacgggcugggcuuccgcaaccggaacaacagcaccgggguggccggccucuccgaggaggccagcgccgagcugcgccaccaccuccacagcccccgggaccaccccgacgagaacaaggacguguccacggagaacggccaccacuucuggucccacccggaccgcgagaaggaggacgaggacgucagcaaggaguacgggcaccuccugcccggccaccggucccaggaccacaaggugggggacgagggcgugagcggggaggaggucuucgcggagcacggcggccaggcccgcgggcaccggggccacggguccgaggacaccgaggacagcgccgagcaccgccaccaccuccccucccaccggagccacucccaccaggacgaggacgaggacgagguggugagcuccgagcaccaccaccacauccugcgccacggccaccggggccacgacggggaggacgacgagggcgaggaggaggaggaggaggaggaggaggaggaggaggccagcaccgaguacgggcaccaggcgcaccgccaccggggccacggguccgaggaggacgaggacgucagcgacggccaccaccaccacggccccagccaccgccaccaggggcacgaggaggacgacgacgacgacgacgacgacgacgacgacgacgacgacgacgacguguccaucgaguaccggcaccaggcccaccgccaccagggccacgggaucgaggaggacgaggacgugagcgacggccaccaccaccgggacccgucccaccgccaccggagccacgaggaggacgacaacgacgacgacgacgucuccaccgaguacgggcaccaggcccaccgccaccaggaccaccgcaaggaggagguggaggccgugagcggcgagcaccaccaccacguccccgaccaccggcaccagggccaccgcgacgaggaggaggacgaggacguguccacggagcgguggcaccaggggccccagcacgugcaccacggccuggucgacgaggaggaggaggaggaggagaucaccgugcaguucgggcacuacguggccagccaccagccccgcggccacaaguccgacgaggaggacuuccaggacgaguacaagaccgaggucccgcaccaccaccaccaccgggugccccgcgaggaggacgaggaggugagcgcggagcuggggcaccaggcccccucccaccggcagagccaccaggacgaggagaccggccacggccagcgcggguccaucaaggagaugagccaccacccgcccggccacacggucgugaaggaccggucccaccuccgcaaggacgacagcgaggaggagaaggagaaggaggaggaccccgggucccacgaggaggacgacgagagcuccgagcagggcgagaagggcacccaccacgggagccgggaccaggaggacgaggaggacgaggaggagggccacgggcugagccugaaccaggaggaggaggaggaggaggacaaggaggaggaggaggaggaggaggacgaggagcgccgggaggagcgcgccgaggucggcgcgccccugucccccgaccacagcgaggaggaggaggaggaggaggaggggcuggaggaggacgagccgcgguucaccaucauccccaacccccuggaccgccgggaggaggccggcggcgccuccagcgaggaggaguccggggaggacaccggcccccaggacgcccaggaguacgggaacuaccagccgggcagccucugcggguacugcuccuucugcaaccgcugcacggagugcgagagcugccacugcgacgaggagaacaugggcgagcacugcgaccagugccagcacugccaguucugcuaccugugcccccuggugugcgagaccgugugcgcccccggcuccuacgucgacuacuucagcuccagccucuaccaggcccuggccgacaugcuggagacccccgagccguga

SEQ ID NO: 31272 - RNA, 1578 nt, Artificial Sequence
  derived and/or modified sequence opt1 from HRG__Homo_sapiens__NP_000403
augaaggcccugaucgccgcgcuccugcugaucacccuccaguacagcugcgccgugucccccaccgacugcagcgccgucgagccggaggccgagaaggcccuggaccugaucaacaagcgccggcgcgacggcuaccucuuccagcugcugcggaucgcggacgcccaccucgaccgcguggagaacacgaccguguacuaccugguccuggacgugcaggaguccgacugcagcgugcucucccggaaguacuggaacgacugcgagccgcccgacagccgccggcccuccgagaucgucaucgggcagugcaaggugaucgccacccgccacagccacgagucccaggaccugcgggugaucgacuucaacugcaccacgagcuccgucagcuccgcccuggcgaacaccaaggacagccccgugcucaucgacuucuucgaggacaccgagcgcuaccggaagcaggccaacaaggcccuggagaaguacaaggaggagaacgacgacuucgccuccuuccgcguggaccggaucgagcgcgucgcccgggugcgcggcggggagggcaccggguacuucguggacuucagcguccggaacugcccccgccaccacuucccccggcaccccaacguguucggcuucugccgcgcggaccuguucuacgacguggaggcccucgaccuggaguccccgaagaaccuggucaucaacugcgagguguucgacccccaggagcacgagaacaucaacggcgugccgccccaccucgggcaccccuuccacuggggcgggcacgagcggagcuccacgaccaagccgcccuucaagccccacggcagccgcgaccaccaccacccccacaagccccacgagcacgggccgccgcccccgcccgacgagcgcgaccacagccacggcccgccccugccccagggcccgccgccccugcuccccauguccugcagcuccugccagcacgccaccuucgggaccaacggcgcccagcggcacagccacaacaacaacuccagcgaccugcacccccacaagcaccacucccacgagcagcacccccacgggcaccacccccacgcccaccacccccacgagcacgacacgcaccgccagcacccccacggccaccacccccacggccaccacccccacgggcaccacccccacggccaccacccccacgggcaccacccccacugccacgacuuccaggacuacggccccugcgacccgccgccccacaaccaggggcacugcugccacggccacggcccgccgcccgggcaccuccggcgccggggccccgggaagggcccccgccccuuccacugccggcagaucgggagcgucuaccgccugccgccccugcggaagggcgaggugcugccccuccccgaggcgaacuuccccuccuucccccugccccaccacaagcacccccugaagcccgacaaccagcccuucccccagagcguguccgagagcugccccggcaaguucaaguccggguucccgcaggucagcauguucuucacccacaccuuccccaaguga

SEQ ID NO: 31273 - RNA, 1464 nt, Artificial Sequence
  derived and/or modified sequence opt1 from HRH1__Homo_sapiens__NP_001091683
augagccugcccaacuccagcugccuccuggaggacaagaugugcgagggcaacaagaccaccauggccuccccgcagcugaugccccucguggucgugcugagcacgaucugccuggugaccgucgggcucaaccugcuggugcucuacgccgugcgcuccgagcggaagcugcacaccgucggcaaccuguacaucgugagccucuccguggcggaccugaucgucggggccguggugaugcccaugaacauccuguaccuccugaugagcaaguggucccugggccgcccccucugccuguucuggcugagcauggacuacgucgccuccaccgccagcaucuucuccguguucauccucugcaucgaccgguaccgcagcgugcagcagccgcugcgguaccugaaguaccgcacgaagacccgggccuccgcgaccauccucggggccugguuccugagcuuccugugggucauccccauccucggcuggaaccacuucaugcagcagaccuccgugcgccgggaggacaagugcgagacggacuucuacgacgugaccugguucaaggucaugaccgccaucaucaacuucuaccugcccacccugcucaugcugugguucuacgccaagaucuacaaggcggugcgccagcacugccagcaccgggagcugaucaaccgcagccuccccuccuucagcgagaucaagcugcggccggagaaccccaagggcgacgccaagaagcccgggaaggagagccccugggaggugcugaagcgcaagccgaaggacgccggcgggggcuccguccucaagagccccucccagacgcccaaggagaugaagucccccgugguguucagccaggaggacgaccgggaggucgacaagcuguacugcuucccgcuggacaucgugcacaugcaggccgccgcggaggggagcucccgcgacuacgucgccgugaaccggagccacggccagcucaagaccgacgagcagggccugaacacccacggggccuccgagaucagcgaggaccagaugcugggcgacucccagagcuucucccgcaccgacagcgacacgaccaccgagaccgcccccgggaagggcaagcuccgguccggcagcaacacggggcuggacuacaucaaguucaccuggaagcgccugcggucccacagccgccaguacguguccggccuccacaugaaccgcgagcggaaggccgcgaagcagcugggguucaucauggccgccuucauccugugcuggauccccuacuucaucuucuucauggucaucgccuucugcaagaacugcugcaacgagcaccuccacauguucaccaucuggcugggcuacaucaacagcacccugaacccccugaucuacccgcucugcaacgagaacuucaagaagacguucaagcgcauccugcacauccggagcuga

SEQ ID NO: 31274 - RNA, 1194 nt, Artificial Sequence
  derived and/or modified sequence opt1 from HRH2__Homo_sapiens__NP_001124527
auggcccccaacggcaccgccagcuccuucugccuggacagcaccgccugcaagaucaccaucaccgugguccucgccgugcugauccugaucaccguggccgggaacgucguggugugccucgccgucggccugaaccgccggcugcgcaaccucaccaacugcuucaucgugucccuggccaucacggaccugcuccuggggcugcucgugcugccguucagcgcgaucuaccagcuguccugcaaguggagcuucggcaaggucuucugcaacaucuacaccucccucgacgugaugcugugcaccgccagcauccugaaccucuucaugaucucccuggaccgguacugcgccgugauggacccccugcgcuaccccguccucgugacccccgugcgggucgccaucagccuggugcugaucugggugaucuccaucacgcucagcuuccuguccauccaccugggguggaacagccgcaacgagaccuccaagggcaaccacaccaccagcaagugcaagguccaggugaacgagguguacggccucgucgacgggcuggugacguucuaccugccgcuccugaucaugugcaucaccuacuaccggaucuucaagguggcgcgcgaccaggccaagcggaucaaccacaucuccagcuggaaggccgccaccauccgcgagcacaaggccaccgucacgcuggcggccgugaugggcgccuucaucaucugcugguuccccuacuucaccgccuucgucuaccgggggcuccgcggcgacgacgccaucaacgaggugcuggaggcgaucgugcuguggcucggguacgccaacuccgcccugaaccccauccuguacgccgcccucaaccgggacuuccgcaccggcuaccagcagcuguucugcugccggcuggcgaaccgcaacagccacaagaccagccuccgguccaacgccagccagcugucccgcacgcagagccgggagccccgccagcaggaggagaagccgcugaagcuccaggucugguccggcaccgaggugaccgcgccccagggggccaccgaccggcccuggcugugccugcccgagugcuggagcguggagcucacgcacuccuucauccaccuguucauccacagcuucgccaacauccacccgauccccacgaccugccaggagcuguga

SEQ ID NO: 31275 - RNA, 1338 nt, Artificial Sequence
  derived and/or modified sequence opt1 from HRH3__Homo_sapiens__NP_009163
auggagcgcgcgcccccggacggcccccugaacgccagcggggcgcucgccggcgaggccgccgccgccgggggcgcccggggguucuccgccgccuggaccgcggugcuggccgcccugauggcccuccugaucgucgccaccgugcugggcaacgcgcucgugaugcuggccuucgucgccgacagcucccugcgcacgcagaacaacuucuuccuccugaaccuggccaucagcgacuuccucgugggcgccuucugcaucccccuguacgugcccuacguccugaccgggcgguggaccuucggccgcgggcucugcaagcuguggcuggugguggacuaccuccugugcaccuccagcgcguucaacaucguccugaucuccuacgaccgguuccucagcgugacgcgcgccguguccuaccgggcccagcagggcgacacccgccgggccguccgcaagaugcugcuggugugggugcucgccuuccugcuguacgggccggcgauccucagcugggaguaccuguccggcggcagcuccauccccgaggggcacugcuacgccgaguucuucuacaacugguacuuccugaucaccgccagcacccucgaguucuucacgcccuuccuguccgucaccuucuucaaccugagcaucuaccucaacauccagcggcgcacccggcugcgccuggacggcgcccgggaggccgcggggcccgagccgccgcccgaggcccagcccuccccgcccccgccgcccggcugcuggggcugcuggcagaaggggcacggcgaggccaugccccuccaccgcuacggggugggcgaggccgcggugggggccgaggccggcgaggccacccugggcgggggcgggggcgggggcagcgucgccucccccacgagcagcuccggcagcuccagccgggggaccgagcgcccccggucccugaagcgcggcagcaagcccuccgcgagcuccgccagccucgagaagcggaugaagauggugucccagagcuucacccagcgcuuccgccugucccgggaccgcaagguggccaagagccuggccgucaucguguccaucuucgggcucugcugggcccccuacacccugcugaugaucauccgggcggccugccacggccacugcgugcccgacuacugguacgagacgagcuucuggcuccugugggccaacuccgccgucaaccccgugcuguacccccucugccaccacagcuuccgccgggccuucaccaagcugcugugcccccagaagcugaagauccagccccacuccagccucgagcacugcuggaaguga

SEQ ID NO: 31276 - RNA, 909 nt, Artificial Sequence
  derived and/or modified sequence opt1 from HRH4__Homo_sapiens__NP_001137300
augcccgacaccaacagcaccaucaaccugucccucagcacgcgcgugacccuggccuucuucaugucccuggucgccuucgcgaucaugcucggcaacgcccuggugauccuggccuucguggucgacaagaaccuccggcaccgcagcuccuacuucuuccugaaccuggccaucagcgacuucuucgugguguccgagagcuggaaggacgagggguccgagugcgagccgggcuucuucagcgagugguacauccucgccaucaccuccuuccuggaguucgucauccccgugauccugguggcguacuucaacaugaacaucuacuggagccucuggaagcgggaccaccugucccgcugccagagccaccccgggcugaccgccgucuccagcaacaucugcggccacuccuuccgggggcgccucagcucccggcgcagccugagcgccuccacggaggugcccgccagcuuccacuccgagcggcagcgccgcaagagcucccugauguucagcucccggaccaagaugaacagcaacaccaucgcguccaagaugggcagcuucucccagagcgacuccguggcccuccaccagcgggagcacgucgagcugcugcgcgcccggcgccucgccaagagccuggccauccugcucggcguguucgcggugugcugggccccguacucccuguucaccaucguccugagcuucuacuccagcgccacggggcccaaguccgugugguaccggaucgccuucuggcuccagugguucaacagcuucgugaacccccugcuguacccccucugccacaagcgcuuccagaaggccuuccugaagaucuucugcaucaagaagcagccgcugcccagccagcacucccggagcgucuccagcuga

SEQ ID NO: 31277 - RNA, 3570 nt, Artificial Sequence
  derived and/or modified sequence opt1 from HR__Homo_sapiens__NP_005135
auggagagcacccccuccuuccugaagggcaccccgacgugggagaagaccgcccccgagaacgggaucgugcgccaggagcccggcagccccccgcgggacgggcuccaccacggcccccugugccugggggagcccgcccccuucuggcgcggcguccucuccaccccggacagcuggcugccccccggcuucccccaggggccgaaggacaugcugccccucguggagggcgaggggccccagaacggcgagcggaaggugaacuggcugggguccaaggagggccugcgcuggaaggaggcgaugcucacccacccccuggccuucugcggcccggccugccccccccggugcgggccccugaugccggagcacagcggcgggcaccucaaguccgaccccgucgccuuccgccccuggcacugccccuuccugcuggagacgaagauccucgagcgggccccguucugggugcccaccugccugccccccuaccuggugagcggccucccgcccgagcaccccugcgacuggccgcugaccccccaccccugggucuacuccggcgggcagcccaaggugccgagcgcguucucccugggcagcaagggguucuacuacaaggaccccuccaucccccgccucgccaaggagccccuggccgccgcggagccgggccuguucgggcucaacagcggcggccaccugcagcgggccggggaggccgagcgccccucccugcaccagcgggacggcgagaugggggccggccgccagcagaaccccugcccccucuuccuggggcagccggacaccgugcccuggacgagcuggcccgccugccccccgggccugguccacacccucggcaacgugugggcggggcccggcgacgggaaccugggcuaccagcuggggccccccgccaccccgcggugccccucccccgagcccccggugacccagcgcggcugcugcagcuccuacccccccacgaagggcgggggccucgggccgugcggcaagugccaggagggccuggaggggggcgccagcggggccagcgagcccuccgaggaggucaacaaggccagcggcccccgggcgugccccccgucccaccacaccaagcugaagaagaccuggcucacccgccacagcgagcaguucgagugcccccgggggugccccgagguggaggagcgccccguggcccggcugcgcgcccugaagcgggccggcuccccggagguccagggcgccauggggagccccgcgcccaagcgccccccggaccccuuccccggcacggccgagcagggggccggcggguggcaggaggugcgcgacaccuccaucggcaacaaggacguggacagcggccagcacgacgagcagaaggggccccaggacggccaggccucccuccaggacccggggcugcaggacauccccugccuggcccuccccgcgaagcuggcccagugccagagcugcgcccaggccgcgggcgaggggggcggccacgccugccacucccagcagguccggcgcagcccccuggggggcgagcuccagcaggaggaggacaccgccaccaacuccagcuccgaggaggggccgggcagcgggcccgacucccggcugagcacgggccuggccaagcaccuccuguccggccugggggaccgccugugccggcuccugcgccgggagcgcgaggcccuggcgugggcccagcgggagggccaggggcccgccgugaccgaggacagccccggcaucccgcgcugcugcagccggugccaccacggccucuucaacacccacuggcgcugcccccggugcucccaccgccugugcguggccugcgggcgggucgccggcaccgggcgcgcgcgggagaaggccggcuuccaggagcagagcgccgaggagugcacgcaggaggccgggcacgccgcgugcucccugaugcucacccaguucgugagcucccaggcccuggccgagcugagcaccgccaugcaccaggugugggucaaguucgacauccgcggccacugccccugccaggcggacgcccgggugugggcccccggcgacgccgggcagcagaaggaguccacccagaagacgccgcccaccccccagccgagcugcaacggcgacacccaccgcaccaaguccaucaaggaggagacgcccgacagcgccgagacccccgcggaggaccgcgccgggcggggcccccucccgugccccucccugugcgagcugcucgccagcaccgccgucaagcugugccuggggcacgagcgcauccacauggccuucgcgcccgugacccccgcccucccguccgacgaccggaucacgaacauccuggacagcaucaucgcccagguggucgagcgcaagauccaggagaaggcccugggccccggccuccgggccgggcccggccugcgcaaggggcugggccucccccuguccccggugcggccccgccugccccccccgggggcgcuccuguggcugcaggagccccagcccugcccccggcgcggcuuccaccucuuccaggagcacuggcggcagggccagccggugcuggucagcgggauccagcgcacccugcagggcaaccucugggggaccgaggcccugggcgcccugggcgggcaggugcaggcccucuccccccugggccccccccagccgagcagccugggguccaccaccuucugggagggcuucagcuggcccgagcuccggcccaaguccgacgaggggagcgugcugcugcuccaccgcgcgcugggcgacgaggacacgucccgggucgagaaccuggccgccagccucccccugccggaguacugcgcccugcacggcaagcucaaccuggccuccuaccugccccccgggcucgcgcugcgcccgcuggagccccagcucugggccgccuacggcgugagcccccaccgggggcaccugggcaccaagaaccugugcguggaggucgccgaccucguguccauccuggugcacgccgacaccccccugccggcguggcaccgcgcccagaaggacuuccucagcgggcuggacggcgagggccuguggucccccgggagccaggucuccaccguguggcacguguuccgggcccaggacgcccagcgcauccggcgcuuccuccagauggucugccccgccggcgcgggggcccuggagcccggcgccccggggagcugcuaccuggacgccggccuccgccggcgccugcgggaggaguggggcguguccugcuggacgcugcuccaggcccccggggaggcggugcugguccccgccggcgccccccaccaggugcaggggcuggugagcaccgucuccgugacccagcacuuccucagcccggagaccuccgcccugagcgcgcagcugugccaccagggccccagccucccccccgacugccaccugcuguacgcccagauggacugggccguguuccaggccgucaagguggccguggggacgcuccaggaggcgaaguga

SEQ ID NO: 31278 - RNA, 276 nt, Artificial Sequence
  derived and/or modified sequence opt1 from HRK__Homo_sapiens__NP_003797
augugccccugcccgcugcaccgcggccgggggccgcccgccgugugcgccugcagcgcgggccgccucgggcugcgguccagcgccgcccagcugaccgccgcccgccucaaggcgcugggcgacgagcugcaccagcggaccauguggcgccggcgcgcccggucccgccgggcccccgcccccggggcgcuccccacguacuggcccuggcugugcgccgccgcccaggucgccgcgcuggccgccuggcuccugggccgccggaaccuguga

SEQ ID NO: 31279 - RNA, 8553 nt, Artificial Sequence
  derived and/or modified sequence opt1 from HRNR__Homo_sapiens__NP_001009931
augcccaagcugcuccagggcgugaucaccgucaucgacguguucuaccaguacgccacccagcacggggaguacgacacgcugaacaaggccgagcugaaggagcuccuggagaacgaguuccaccagauccugaagaacccgaacgaccccgacaccguggacaucauccuccagagccuggaccgcgaccacaacaagaaggucgacuucaccgaguaccugcucaugaucuucaagcuggugcaggcgcggaacaagaucaucggcaaggacuacugccagguguccgggagcaagcugcgcgacgacacccaccagcaccaggaggagcaggaggagacggagaaggaggagaacaagcggcaggaguccagcuucucccacagcuccuggagcgccggcgagaacgacuccuacagccgcaacguccgggggucccucaagcccggcaccgagagcaucucccgccggcugagcuuccagcgcgacuucuccggccagcacaacagcuacuccgggcagagcuccagcuacggcgagcagaacagcgacucccaccagagcuccgggcggggccagugcgggagcggcuccggccagagccccaacuacgggcagcacggcuccgggagcggccaguccagcuccaacgacacccacggcagcggguccggccagagcuccggguucagccagcacaaguccagcuccggccagagcagcggguacucccagcacggcagcggcuccgggcacagcuccggcuacgggcagcacggcagccgcuccgggcagagcucccggggcgagcgccaccggagcuccagcggcuccagcuccagcuacgggcagcacggcuccgggagccgccagagccugggccacgggcggcagggcuccggcagccgccaguccccgagccacgugcggcacggguccggcagcgggcacuccagcucccacggccagcacggcagcggguccagcuacuccuacagccgcggccacuacgaguccgggagcggccagaccuccggguucggccagcacgagagcggcuccgggcagagcagcggcuacuccaagcacgggagcggcuccgggcacagcuccagccagggccagcacggcuccacgagcgggcaggccuccagcuccggccagcacgggagcuccagccggcaguccagcuccuacggccagcacgagagcgccucccgccacagcagcgggcggggccagcacuccagcggcuccgggcagagccccggccacgggcagcgcggcuccgggagcggccagucccccagcuccggccagcacgggaccggcuucgggcgcagcuccagcuccggccccuacgugagcggcuccggguacagcuccggcuucgggcaccacgagagcuccagcgagcacagcuccggcuacacccagcacgggagcggcuccggccacagcuccgggcacggccagcacgggagccgguccggccagagcucccgcggggagcggcagggcagcuccgccggcagcuccagcuccuacgggcagcacggcagcgggucccgccagagccucggccacucccggcacgggagcggcagcggccaguccccgagccccucccgcgggcggcacgagagcggcucccgccagagcuccagcuacgggccccacggcuacggcuccgggcggagcuccagccgcggccccuacgaguccgggagcggccacuccagcgggcugggccaccaggagucccggagcggccaguccagcggguacggccagcacgggagcuccagcggccacuccagcacccacgggcagcacggcuccacgagcggccaguccagcuccugcgggcagcacggcgcgaccagcgggcaguccagcucccacggccagcacgggagcggcuccagccaguccagccgcuacggccagcaggggagcggcuccgggcagagcccgucccggggccgccacgggagcgacuucggccacuccagcuccuacggccagcacgggagcggcuccggguggagcuccagcaacggcccccacggcuccgucagcgggcaguccagcggcuucgggcacaaguccggcagcgggcaguccagcggcuacagccagcacggcuccgggagcucccacagcuccggcuaccggaagcacgggagccgcuccggccagagcucccggagcgagcagcacggguccagcuccggccugagcuccagcuacggccagcacggguccggcagccaccaguccagcgggcacggccgccaggggagcggcuccggccacagccccucccgggugcgccacgggagcuccagcggccacuccagcucccacgggcagcacggcagcgggaccuccugcagcuccagcugcggccacuacgaguccggcagcgggcaggccuccggcuucgggcagcacgagagcggcuccggccagggguacagccagcacggcagcgccuccgggcacuucagcucccagggccgccacgggagcaccuccggccagagcuccagcuccggccagcacgacagcuccagcgggcaguccagcuccuacggccagcacgagagcgccucccaccacgcgagcgggcggggccgccacggguccggcagcggccagagccccgggcacggccagcggggguccggcagcgggcaguccccgagcuacggccgccacggcuccgggagcggccgguccagcuccagcgggcgccacggcuccggcagcgggcaguccagcggcuucgggcacaaguccagcuccggccagagcuccggguacacgcagcacggcagcggcagcgggcacuccagcuccuacgagcagcacggcagccgguccgggcagagcucccgcagcgagcagcacggcuccagcuccgggagcuccagcuccuacggccagcacggcagcgggucccggcagagccucggccacgggcagcacggcagcggguccggccagagccccucccccagccgcggccggcacggguccggcagcgggcaguccagcuccuacggccccuaccgcagcggguccggcuggagcuccagccggggcccguacgaguccgggagcggccacuccagcgggcugggccaccgcgagucccggagcggccagagcuccggguacggccagcacgggagcuccagcggccacuccagcacccacgggcagcacggcuccaccagcggccaguccagcuccugcgggcagcacggcgccagcuccgggcagagcuccagccacggccagcacggguccggcagcucccagagcagcggcuacgggcgccagggcuccgggagcggccagucccccgggcacggccagcggggcagcgggucccgccagagccccuccuacggccggcacgggagcggcuccggccgcagcuccagcuccgggcagcacggcagcgggcugggcgaguccagcggguucggccaccacgaguccagcuccggccagagcagcuccuacagccagcacggguccggcagcgggcacuccagcggcuacgggcagcacggcucccggagcggccaguccagccgcggggagcgccacggcuccagcuccgggagcuccagccacuacggccagcacggguccggcagccggcaguccagcggccacgggcgccagggcagcggguccggccacagccccucccgggggcgccacggcagcggccucgggcacuccagcucccacggccagcacgggagcggcuccggccggagcuccagccgcgggccguacgagucccggagcggccacuccagcguguucgggcagcacgaguccggcagcgggcacuccagcgccuacagccagcacggcuccggcagcgggcacuucugcucccagggccagcacgggagcaccuccggccagagcuccacguucgaccaggaggggagcuccaccggccagagcuccagcuacggccaccgcggguccggcagcucccagagcuccggguacggccggcacggggccggcagcggccagagccccucccgcgggcggcacggcagcggguccggccacagcuccagcuacggccagcacggguccggcagcgggugguccagcuccagcggccgccacggguccggcagcggccaguccagcggguucggccaccacgaguccagcuccuggcagagcagcgggugcacccagcacggcuccgggagcggccacuccagcuccuacgagcagcacggcagccgguccgggcagagcucccgcggcgagcggcacgggagcuccagcggcuccagcuccagcuacgggcagcacggcuccggcagccgccagucccuggggcacggccagcacgggagcggcagcgggcagucccccagccccucccggggccgccacggcagcggguccggccagagcuccagcuacuccccguacgggagcggcuccggcuggagcuccagccgggggcccuacgaguccggcagcucccacagcuccgggcugggccaccgcgagagccgcagcgggcaguccagcggcuacggccagcacggguccagcuccggccacagcuccacccacgggcagcacggcagcacguccgggcagagcuccagcugcggccagcacggcgccuccagcgggcaguccagcucccacggccagcacgggagcggcuccagccagagcuccggguacggccggcagggcagcggguccggccagagccccgggcacggccagcgcggguccggcagccggcaguccccgagcuacggccgccacggguccggcagcgggcgguccagcuccagcggccagcacggcuccgggcucggcgagagcuccggguucggccaccacgagagcuccagcgggcagagcuccagcuacucccagcacggcagcggcuccgggcacagcuccggcuacgggcagcacggcagccgcuccgggcagagcucccggggcgagcgccacggcagcuccagccgguccagcucccgcuacgggcagcacggcagcgggagccggcaguccagcggccacgggcgccagggcuccggcagcgggcagucccccagccggggccgccacggguccggccugggccacagcuccagccacgggcagcacggcuccgggagcggccgguccagcucccgcgggcccuacgagagccgguccggccacagcuccgucuucggccagcacgagagcgggagcggccacuccagcgcguacucccagcacgggagcggcuccgggcacuucugcagccagggccagcacggcuccaccagcgggcaguccagcaccuucgaccaggagggcuccagcaccgggcaguccagcucccacggccagcacgggagcggcuccagccaguccagcagcuacggccagcagggguccggcagcgggcagucccccagccgcggccggcacggguccggcagcggccacuccagcuccuacgggcagcacggcagcggguccggcuggagcuccagcuccggccgccacgggagcggcuccgggcagagcuccggcuucgggcaccacgagagcagcuccuggcagagcuccggcuacacgcagcacggcagcggguccggccacagcuccagcuacgagcagcacgggucccggagcggccaguccagccgcggggagcagcacggcuccagcuccggcagcuccagcuccuacgggcagcacggcagcgggagccgccagucccugggccacgggcagcacggcagcggcuccgggcagagcccgucccccagccggggccgccacggguccggcagcggccaguccagcuccuacgggcccuacggcagcggguccggcuggagcuccagccgggggcccuacgaguccggcagcggccacuccagcgggcucggccaccgcgagagccgguccgggcagagcuccggcuacgggcagcacggcagcuccagcggccacuccagcacccacgggcagcacggcuccgccagcgggcaguccagcuccugcggccagcacggggccagcuccggccagagcuccagccacggccagcacgggagcggcuccagccaguccagcggguacggccgccagggguccggcagcggccaguccccggggcacggccagcgggggagcggcucccgccagagccccuccuacggccggcacgggagcggcuccgggcgcagcuccagcuccggccagcacgggcccggccugggcgagagcuccggguucggccaccacgagagcagcuccgggcagagcuccagcuacucccagcacggcagcggguccggccacagcuccggcuacgggcagcacggcagccgguccgggcagagcucccgcggcgagcggcacgggagcuccagcggcuccagcucccgcuacggccagcacgggagcggcagccggcaguccagcgggcacggccgccagggcuccgggagcggccacucccccagccgggggcgccacggcuccgggagcggccacuccagcucccacggccagcacgggagcggcuccgggcggagcuccagccgcggcccguacgagucccgcagcgggcacuccagcguguucggccagcacgagagcggcuccgggcacagcuccgccuacagccagcacggcuccgggagcggccacuucugcucccaggggcagcacggcagcaccuccggccagagcuccaccuucgaccaggaggggagcuccacgggccagagcuccagccacgggcagcacggcuccgggagcucccagagcagcuccuacggccagcagggcagcggguccggccagagccccucccgggggcgccacggcagcggcuccgggcacagcuccagcuacggccagcacggguccggcagcgggugguccagcuccagcggccggcacggcuccgggagcggccaguccagcggguucggccaccacgagagcuccagcuggcaguccagcggguacacccagcacggcuccggcagcgggcacuccagcuccuacgagcagcacggcagccgcuccgggcagagcucccggggcgagcgccacgggagcuccagcggcuccagcagcuccuacggccagcacgggagcggcucccggcagagccuggggcacggccagcacggcuccgggagcggccagucccccagccccucccgcgggcggcacggcagcggguccggccagagcuccagcuacuccccguacggcagcggguccggcuggagcuccagccgcgggcccuacgagagcggcuccgggcacagcuccggccucggccaccgggagagccgcuccgggcagagcuccggcuacgggcagcacggcagcuccagcgggcacuccagcacccacggccagcacggcuccaccagcgggcaguccagcuccugcggccagcacggggccagcuccggccagagcagcucccacgggcagcacggcagcggcuccagccaguccagcggguacggccggcagggguccggcagcggccagucccccgggcacggccagcgcgggagcggcucccggcagagccccuccuacgggcgccacggcagcggcuccgggcggagcuccagcuccggccagcacgggagcggccugggggagagcuccggcuucggccaccacgagagcuccagcgggcaguccagcuccuacagccagcacggcuccgggagcggccacuccagcggguacggccagcacggcucccgcagcgggcaguccagccggggcgagcgccacggguccagcuccggcagcagcucccacuacgggcagcacggcagcggcucccggcagagcuccgggcacggccgccaggggagcggcuccggccagagcccgucccgcgggcggcacggcagcgggcugggccacuccagcucccacgggcagcacggcagcggcuccgggcgcagcuccagccggggccccuacgagucccgccucgggcacagcagcguguucggccagcacgaguccgggagcggccacuccagcgcguacucccagcacggcagcggguccggccacuucugcagccaggggcagcacggcuccacgagcgggcaguccagcaccuucgaccaggagggcuccagcaccggccaguccagcuccuacgggcaccggggcagcgggagcucccagagcuccggcuacggccgccacggggccggcagcgggcagucccugagccacggccggcacggguccggcagcggccaguccagcuccuacgggcagcacggcagcggguccggccagagcuccggguacagccagcacggcuccggcagcgggcaggacggcuacuccuacugcaaggggggcagcaaccacgacgggggcagcuccggcagcuacuuccuguccuuccccagcuccaccagccccuacgaguacguccaggagcagcgcugcuacuucuaccaguga

SEQ ID NO: 31280 - RNA, 414 nt, Artificial Sequence
  derived and/or modified sequence opt1 from HRSP12__Homo_sapiens__NP_005827
augagcucccugauccgccgggugaucagcaccgccaaggcccccggcgcgaucgggccguacucccaggccguccucguggaccgcaccaucuacaucagcggccagaucgggauggaccccuccagcggccagcugguguccgggggcgucgccgaggaggccaagcaggcccugaagaacaugggcgagauccucaaggcggccgggugcgacuucacgaacguggugaagaccaccguccugcuggccgacaucaacgacuucaacaccgugaacgagaucuacaagcaguacuucaagagcaacuuccccgcccgggcggccuaccagguggccgcccuccccaagggcucccgcaucgagaucgaggccgucgcgauccaggggccgcugacgaccgccagccuguga

SEQ ID NO: 31281 - RNA, 1179 nt, Artificial Sequence
  derived and/or modified sequence opt1 from HS1BP3__Homo_sapiens__NP_071905
augcagagccccgccgugcuggucaccucccgccggcuccagaacgcccacaccggccuggaccugacggugccgcagcaccaggaggugcgcgggaagaugaugagcggccacgucgaguaccagauccucguggugacccggcuggcggccuucaaguccgccaagcaccgccccgaggacgucgugcaguuccuggugagcaagaaguacuccgagaucgaggaguucuaccagaagcucagcucccgguacgccgccgcgagccugccgccccugccccgcaagguccucuucgugggggaguccgacauccgggagcgccgggccguguucaacgagauccugcgcugcgucagcaaggacgccgagcuggccggcucccccgagcuccuggaguuccuggggacccggagccccggcgcggccggccucaccucccgcgacagcuccgugcuggacgggacggacagccagaccggcaacgacgaggaggccuucgacuucuucgaggagcaggaccagguggccgaggaggggcccccgguccagucccugaagggcgaggacgccgaggagagccucgaggaggaggaggcgcuggacccccuggggaucaugcgguccaagaagcccaagaagcaccccaagguggccgugaaggccaagccgagcccccgccucaccaucuucgacgaggaggucgaccccgacgagggccuguucggccccgggcggaagcugagcccgcaggaccccuccgaggacgugagcuccguggacccccucaagcuguucgacgaccccgaccugggcggggccaucccgcucggcgacagccugcugcuccccgccgcgugcgaguccggcgggcccacccccagccugucccaccgcgacgccagcaaggagcuguuccgggucgaggaggaccucgaccagauccugaaccugggcgccgagccgaagcccaagccccagcucaagcccaagccgcccguggccgccaagcccgugaucccgcgcaagcccgcggucccgcccaaggccgggcccgccgaggccguggccggccagcagaagccccaggagcagauccaggcgauggacgagauggacauccugcaguacauccaggaccacgacacgcccgcccaggccgcccccucccuguucuga

SEQ ID NO: 31282 - RNA, 924 nt, Artificial Sequence
  derived and/or modified sequence opt1 from HS3ST1__Homo_sapiens__NP_005105
auggccgcccugcuccugggcgcggugcugcucgucgcccagccccagcuggugccgagccgccccgccgagcuggggcagcaggagcuccugcggaaggccggcacccugcaggacgacgugcgcgacggggucgcccccaacggcuccgcgcagcagcucccccagaccaucaucaucggggugcggaagggcggcacgcgcgcccugcuggagaugcucagccugcacccggacguggccgccgcggagaacgagguccacuucuucgacugggaggagcacuacucccacgggcugggcugguaccucagccagaugcccuucuccuggccccaccagcugaccguggagaagacccccgccuacuucaccagcccgaaggugcccgagcgggucuacuccaugaaccccagcauccgccugcuccugauccugcgggaccccuccgagcgcgugcucagcgacuacacccagguguucuacaaccacaugcagaagcacaagccguaccccuccaucgaggaguuccugguccgggacgggcgccugaacguggacuacaaggcccucaaccggagccuguaccacgugcacaugcagaacuggcugcgcuucuucccccuccggcacauccacaucgucgacggcgaccgccugauccgggaccccuucccggagauccagaagguggagcgcuuccugaagcucagcccccagaucaacgccuccaacuucuacuucaacaagacgaagggguucuacugccugcgggacuccggccgcgaccggugccugcacgagagcaagggccgcgcccacccccagguggaccccaagcuccugaacaagcugcacgaguacuuccacgagccgaacaagaaguucuucgagcucgucgggcggaccuucgacuggcacuga

SEQ ID NO: 31283 - RNA, 1104 nt, Artificial Sequence
  derived and/or modified sequence opt1 from HS3ST2__Homo_sapiens__NP_006034
auggccuaccgcgugcugggccgggccgggcccccgcagccccgccgggcgcgccggcuccuguucgccuucacccugagccucuccugcaccuaccugugcuacagcuuccugugcugcugcgacgaccucggccgcucccggcugcugggggcgccccgcugccuccggggccccagcgccgggggccagaagcugcugcagaagucccgcccgugcgaccccagcggccccacgcccuccgagccgagcgcccccuccgcccccgccgccgccguccccgcgccgcggcucagcggguccaaccacagcggcucccccaagcuggggaccaagcgccugccccaggcccucaucgugggcgugaagaagggcgggacccgggccguccuggaguucauccgcgugcaccccgacgugcgggcccugggcaccgagccgcacuucuucgaccgcaacuacgggcggggccucgacugguaccgcagccugaugccccggacgcuggagucccagaucacccucgagaagacccccagcuacuucgucacccaggaggcgccccgccggaucuucaacaugucccgcgacacgaagcugaucguggugguccgcaacccggugacccgggccaucagcgacuacacccagacccuguccaagaagcccgacauccccacguucgaggggcucagcuuccgcaaccggacccugggccugguggacgucagcuggaacgccauccgcaucggcauguacgugcuccaccuggaguccuggcugcaguacuucccccucgcccagauccacuucgugagcggggagcggcugaucaccgacccggccggcgagauggggcgcguccaggacuuccugggcaucaagcgguucaucaccgacaagcacuucuacuucaacaagacgaagggguuccccugccucaagaagaccgaguccagccugcugccccgcugccucggcaaguccaagggccggacccacgugcagaucgaccccgaggugaucgaccagcugcgcgaguucuaccggccguacaacaucaaguucuacgagaccgucgggcaggacuuccgcugggaguga

SEQ ID NO: 31284 - RNA, 1221 nt, Artificial Sequence
  derived and/or modified sequence opt1 from HS3ST3A1__Homo_sapiens__NP_006033
auggcgcccccgggccccgccagcgcgcuguccaccagcgccgagccccucucccgcagcaucuuccggaaguuccugcugaugcucugcucccugcugaccagccucuacguguucuacugccuggccgagcgcugccagacgcuguccgggcccgucgugggccucagcgggggcggggaggaggccggcgccccgggcgggggcgugcuggccgggggcccccgggagcuggccgucuggcccgccgccgcgcagcgcaagcggcuccugcagcugccccaguggcgccggcgccggccgcccgcgccccgcgacgacggggaggaggccgccugggaggaggagucccccggccucagcggcgggccgggcggguccggcgccggcagcaccguggccgaggccccgcccgggacccuggcccugcuccuggacgagggcuccaagcagcugccccaggccaucaucaucggggugaagaagggcgggacccgggcccuccuggaguuccugcgcguccaccccgacgugcgggcggugggcgccgagccccacuucuucgaccgcagcuacgacaagggccucgccugguaccgggaccugaugccccgcacgcuggacgggcagaucaccauggagaagacccccuccuacuucgucacccgggaggccccggcccgcaucagcgcgauguccaaggacacgaagcucaucguggugguccgggaccccgugacccgcgccaucagcgacuacacccagacccuguccaagcggcccgacauccccacguucgagagccugaccuucaagaaccgcaccgccggccucaucgacaccagcugguccgccauccagaucgggaucuacgccaagcaccuggagcacuggcugcgccacuucccgauccggcagaugcuguucgugagcggcgagcgccucaucuccgaccccgcgggggagcugggccggguccaggacuuccucggccugaagcgcaucaucacggacaagcacuucuacuucaacaagaccaagggguuccccugccugaagaaggccgagggcagcucccggccccacugccucgggaagaccaagggccgcacccacccggagaucgaccgggagguggugcgccggcugcgcgaguucuaccggcccuucaaccugaaguucuaccagaugacggggcacgacuucggcugggacggcuga

SEQ ID NO: 31285 - RNA, 1173 nt, Artificial Sequence
  derived and/or modified sequence opt1 from HS3ST3B1__Homo_sapiens__NP_006032
augggccagcgccugagcgggggccgguccugccucgacgugcccgggcgccugcugccgcagcccccgccgcccccgccgcccguccggcgcaagcucgcccugcuguucgccaugcucugcguguggcuguacauguuccuguacagcugcgcgggcuccugcgccgccgcccccgggcuccugcugcucggcagcggcucccgggccgcgcacgacccgcccgcccuggccaccgcccccgacgggaccccgccccgccugcccuuccgggcgccgcccgccacgccccucgccagcggcaaggagauggccgagggggccgcgucccccgaggagcagagccccgaggugcccgacucccccagccccaucuccagcuucuucuccggcagcggguccaagcagcugccccaggccaucaucaucggcgucaagaagggcgggacccgcgcccugcucgaguuccugcgggugcaccccgacgugcgcgccgucggcgccgagccccacuucuucgaccggagcuacgacaaggggcuggcgugguaccgcgaccucaugccccggacccuggacggccagaucaccauggagaagacgcccuccuacuucgugacccgcgaggcccccgcccggaucagcgccauguccaaggacaccaagcugaucguggucgugcgcgaccccgugacccgggccaucagcgacuacacgcagacccucagcaagcgccccgacaucccgaccuucgagucccugaccuucaagaaccggacggcgggccugaucgacaccagcugguccgccauccagaucgggaucuacgccaagcaccucgagcacuggcugcgccacuuccccauccggcagaugcuguucgucagcggcgagcgccucaucuccgaccccgccggggagcugggccgcgugcaggacuuccuggggcucaagcggaucaucaccgacaagcacuucuacuucaacaagaccaagggcuuccccugccugaagaaggccgagggcagcucccgcccgcacugccuggggaagacgaagggccggacccaccccgagaucgaccgcgaggugguccggcgccuccgggaguucuaccgccccuucaaccugaaguucuaccagaugaccgggcacgacuucggcugggacuga

SEQ ID NO: 31286 - RNA, 1371 nt, Artificial Sequence
  derived and/or modified sequence opt1 from HS3ST4__Homo_sapiens__NP_006031
auggcccgcuggcccgcgcccccgcccccgcccccgccgccgccgccccuggccgcgcccccgccgcccggcgccagcgccaaggggccgcccgcccggaagcuccuguucaugugcacccugucccucagcgugaccuaccugugcuacucccugcucggcgggagcggcucccugcaguucccccuggcccuccaggagagccccggggccgccgccgagcccccgcccagcccgcccccgcccucccugcugcccacgcccguccgccucggcgcgcccucccagccgcccgcgcccccgccccuggacaacgccagccacggcgagccgcccgagccgcccgagcagcccgccgcccccgggaccgacggcugggggcugcccuccggcgggggcggcgcccaggacgccuggcuccggacgccccuggcccccagcgagaugaucaccgcccaguccgcccugcccgagcgcgaggcccaggagagcuccaccaccgacgaggaccucgccgggcggcgcgccgccaacggcagcuccgagcgcgggggcgccgugagcacccccgacuacggcgagaagaagcugccccaggcgcugaucaucggggugaagaagggcgggacccgggcccuccuggaggccauccggguccaccccgacgugcgcgccgugggcgucgagccccacuucuucgaccggaacuacgagaaggggcuggagugguaccgcaacgugaugcccaagacgcucgacggccagaucaccauggagaagacccccuccuacuucgugaccaacgaggcccccaagcggauccacagcauggcgaaggacaucaagcugaucgucguggugcgcaaccccgucacgcgggccaucagcgacuacacccagacccuguccaagaagcccgagauccccaccuucgaggugcucgccuucaagaaccgcacgcugggccugaucgacgccagcugguccgcgauccggaucgggaucuacgcccuccaccuggagaacuggcugcaguacuucccccucagccagauccuguucguguccggcgagcgccugaucgucgaccccgccggggagauggccaaggugcaggacuuccucggccugaagcggguggucaccgagaagcacuucuacuucaacaagaccaagggguuccccugccugaagaagcccgaggacagcuccgcgccccgcugccucggcaagagcaagggccggacccacccccgcaucgaccccgacgugauccaccgccugcggaaguucuacaagcccuucaaccugauguucuaccagaugacggggcaggacuuccagugggagcaggaggagggcgacaaguga

SEQ ID NO: 31287 - RNA, 1041 nt, Artificial Sequence
  derived and/or modified sequence opt1 from HS3ST5__Homo_sapiens__NP_705840
augcuguucaagcagcaggccuggcuccgccagaagcugcuggugcucggcagccuggccgucgggucccugcucuaccugguggcgcgggugggcagccuggaccgccuccagcccaucugcccgaucgaggggcggcugggcggggcccgcacccaggccgaguucccccugcgggcccuccaguucaagcgcggccugcugcacgaguuccggaagggcaacgccuccaaggagcagguccgccuccacgaccuggugcagcagcugcccaaggcgaucaucaucggggugcggaagggcgggacccgcgcccuccuggagaugcugaaccuccaccccgccgucgugaaggccagccaggagauccacuucuucgacaacgacgagaacuacggcaaggggaucgagugguaccggaagaagaugccguucuccuacccccagcagaucacgaucgagaagucccccgcguacuucaucaccgaggaggugcccgagcgcaucuacaagaugaacagcagcaucaagcugcugaucaucguccgggagccgaccacccgcgccaucuccgacuacacccaggugcucgagggcaaggagcggaagaacaagaccuacuacaaguucgagaagcuggccaucgaccccaacacgugcgaggugaacaccaaguacaaggccguccgcacgagcaucuacaccaagcaccuggagcgguggcucaaguacuuccccaucgagcaguuccacgugguggacggcgaccgccugaucaccgagccccugccggagcuccagcuggucgagaaguuccugaaccucccgccccggaucucccaguacaaccuguacuucaacgccacccgcggguucuacugccugcgguucaacaucaucuucaacaagugccucgcgggcagcaaggggcgcauccaccccgagguggaccccuccgugaucacgaagcugcgcaaguucuuccaccccuucaaccagaaguucuaccagaucaccggccggacccugaacuggcccuga

SEQ ID NO: 31288 - RNA, 1029 nt, Artificial Sequence
  derived and/or modified sequence opt1 from HS3ST6__Homo_sapiens__NP_001009606
auggccggcagcgggggccucgggggcggggccggcggcgggcagggcgcgggggccggccagggggccgcccugcgcgccucccgggcgcccaugcugcugguggcccucguccugggcgccuacugccugugcgcccucccgggccgcugcccgcccgcggcccgggcccccgcccccgcccccgcgcccagcgagcccuccagcuccgugcaccgcccgggggcccccggccugccccuggccagcgggcccggccggcgccgguucccgcaggcccucaucgugggcgucaagaagggcgggacccgcgcccugcuggaguuccuccggcugcaccccgacgugcgcgcgcugggguccgagccccacuucuucgaccggugcuacgagcgcggccucgccugguaccggagccugaugccccgcacccuggacgggcagaucacgauggagaagaccccguccuacuucgugacccgggaggcgccccgccggauccacgccaugagccccgacaccaagcucaucgucguggugcgcaaccccgucacgcgggccaucuccgacuacgcccagacccugagcaagaccccgggccugcccuccuuccgcgcccucgccuuccggcacggccuggggcccguggacaccgccuggagcgccgugcgcaucggccuguacgcgcagcaccucgaccacuggcugcgcuacuucccccugucccacuuccucuucgucagcggggagcggcugguguccgacccggccggcgagguggggcgcguccaggacuuccugggccucaagcggguggugacggacaagcacuucuacuucaacgccaccaagggcuuccccugccugaagaaggcccagggcgggagccgcccccggugccuggggaaguccaagggccgcccccacccgcgggucccccaggcgcucgugcgccggcugcaggaguucuaccgccccuucaaccggcgcuucuaccagaugaccgggcaggacuucggcuggggcuga

SEQ ID NO: 31289 - RNA, 1236 nt, Artificial Sequence
  derived and/or modified sequence opt1 from HS6ST1__Homo_sapiens__NP_004798
augcgccggcgccgggccggcgggcgcaccaugguggagcgggccagcaaguucguccuggugguggcgggcuccgucugcuucaugcucauccuguaccaguacgccgggcccggccugagccucggggccccgggcggccgcgccccgcccgacgaccuggaccuguuccccacccccgacccccacuacgagaagaaguacuacuuccccgugcgggagcucgagcgcucccugcgguucgacaugaagggggacgacgugaucgucuuccugcacauccagaagacgggcgggaccaccuucggccgccaccucgugcagaacgugcggcuggagguccccugcgacugccgcccggggcagaagaagugcacgugcuaccggcccaaccgccgggagaccuggcuguucagccgcuucuccaccggcuggagcugcggccuccacgccgacuggaccgagcugaccaacugcgugcccggggugcuggaccggcgcgacuccgcggcccuccggacgccccgcaaguucuacuacaucacccugcugcgggacccggucagccgcuaccucuccgaguggcgccacgugcagcggggcgccaccuggaagaccagccugcacaugugcgacgggcgcacgcccacccccgaggagcugcccccgugcuacgagggcaccgacugguccggcugcacccuccaggaguucauggacugccccuacaaccuggccaacaaccgccaggugcggaugcuggcggaccucagccuggucgggugcuacaaccuguccuucauccccgagggcaagcgggcccagcuccugcuggagagcgccaagaagaaccuccgcgggauggccuucuucggccugacggaguuccagcggaagacccaguaccuguucgagcgcaccuucaaccucaaguucauccggcccuucaugcaguacaacuccacccgcgccgggggcguggagguggacgaggacacgauccggcgcaucgaggagcugaacgaccuggacaugcagcucuacgacuacgcgaaggaccuguuccagcagcgguaccaguacaagcgccagcuggagcggcgcgagcagcggcuccgcagccgggaggagcgccugcugcaccgcgccaaggaggcccucccgcgggaggacgccgacgagcccggccgcguccccaccgaggacuacaugucccacaucaucgagaagugguga

SEQ ID NO: 31290 - RNA, 1938 nt, Artificial Sequence
  derived and/or modified sequence opt1 from HS6ST2__Homo_sapiens__NP_001070656
auggcccugcccgccugcgcggugcgcgaguucgagccgccccggcagcccgagcgcggcgcccccguccggacgaccugcccgcgccggcacagccgcguggaggccgagcucgccgccucccggcccgggagcguggcggccuccguccgcgccggcccgccccgcggggugagccacggcuuccacacccggccccugcuggacaagccccggaaggccuccagcucccucgcgggggccgccugcgcgccccuguucgcccugcucagccgcggccggcgccggcgcaugcacgugcugcggcgccggugggaccugggcucccucugccgcgcccugcugacccgggggcucgccgcccugggccacagccugaagcacguccucggggccaucuucuccaagaucuucggccccauggccagcguggggaacauggacgagaaguccaacaagcugcugcucgcgcuggugaugcuguuccucuucgccgucaucgugcugcaguacgugugcccgggcaccgagugccagcugcuccgccugcaggccuucagcucccccguccccgaccccuaccgcagcgaggacgaguccagcgcccgguucgugccgcgcuacaacuucacccggggcgaccugcuccgcaagguggacuucgacaucaagggggacgaccugaucgucuuccugcacauccagaagacgggcgggaccaccuucggccggcaccucgugcgcaacauccagcuggagcagcccugcgagugccgggugggccagaagaagugcacgugccaccgccccgggaagcgggagaccuggcuguucucccgcuucagcaccggcuggagcugcgggcuccacgccgacuggaccgagcugaccuccugcguccccagcgugguggacggcaagcgggacgcgcgccugcggccgucccgcuggcggaucuuccagauccucgacgccgccagcaaggacaagcgcgggucccccaacacgaacgccggcgccaacagccccuccagcaccaagacccggaacaccuccaagagcggcaagaacuuccacuacaucacgauccugcgcgaccccgucucccgguaccugagcgaguggcgccacgugcagcgcggggcgaccuggaaggccucccuccacgugugcgacggccggccgcccaccagcgaggagcugcccuccugcuacaccggggacgacuggagcggcugcccccugaaggaguucauggacugcccguacaaccucgccaacaaccgccagguccggaugcuguccgaccugacgcucguggggugcuacaaccugagcgucaugcccgagaagcagcgcaacaaggugcugcucgaguccgccaagagcaaccugaagcacauggcguucuucggccugaccgaguuccagcggaagacccaguaccuguucgagaagaccuucaacaugaacuucaucagccccuucacgcaguacaacaccacccgcgccuccagcguggagaucaacgaggagauccagaagcggaucgagggccucaacuuccuggacauggagcuguacuccuacgccaaggaccucuuccugcagcgcuaccaguucaugcggcagaaggagcaccaggaggcccgccggaagcgccaggagcagcggaaguuccugaaggggcgccuccugcagacccacuuccagagccagggccaggggcagucccagaacccgaaccagaaccagagccagaaccccaaccccaacgccaaccagaaccugacgcagaaccucaugcagaaccugacccagucccugagccagaaggagaaccgggagucccccaagcagaacagcggcaaggagcagaacgacaacaccuccaacgggaccaacgacuacaucggcagcgucgagaaguggcgcuga

SEQ ID NO: 31291 - RNA, 1416 nt, Artificial Sequence
  derived and/or modified sequence opt1 from HS6ST3__Homo_sapiens__NP_703157
auggacgagcgcuucaacaaguggcugcucacccccgugcugacccuccuguucgucgugaucauguaccaguacgugagcccguccugcacgagcuccugcaccaacuucggcgagcagccccgggccggggaggccggcccgcccgcgguccccgggcccgcccgccgggcccaggccccgcccgaggagugggagcgccggccccagcugcccccgccgccccgcggcccgcccgaggggccccggggcgccgcggcccccgaggaggaggacgaggagcccggcgacccccgcgagggggaggaggaggaggaggaggacgagcccgaccccgaggcccccgagaacggcagccugccccgguucgugccccgcuucaacuucucccucaaggaccugacccgguucguggacuucaacaucaaggggcgcgacgucaucguguuccugcacauccagaagaccggcgggacgaccuucggccggcaccucgugaagaacauccgccuggagcagccgugcagcugcaaggccggccagaagaagugcacgugccaccggcccgggaagaaggagaccuggcuguucucccgcuucagcaccggcugguccugcgggcuccacgcggacuggaccgagcugaccaacugcguccccgccaucauggagaagaaggacugcccccggaaccacagccacacccgcaacuucuacuacaucacgaugcugcgggacccggugucccgcuaccucagcgaguggaagcacgugcagcggggcgccaccuggaagaccucccugcacaugugcgacggccgcagccccacccccgacgagcugccgacgugcuaccccggggacgacugguccggcgucagccuccgcgaguucauggacugcaccuacaaccuggccaacaaccgccaggugcggaugcuggccgaccucucccugguggggugcuacaaccugaccuucaugaacgagagcgagcggaacaccauccuccugcaguccgcgaagaacaaccugaagaacauggccuucuucggccucacggaguuccagcgcaagacccaguuccuguucgagcggaccuucaaccugaaguucaucagccccuucacccaguucaacaucacgcgcgccagcaacgucgagaucaacgagggggcccggcagcgcaucgaggaccucaacuuccuggacaugcagcuguacgaguacgccaaggaccucuuccagcagcgguaccaccacaccaagcagcuggagcaccagcgcgaccggcagaagcgccgggaggagcgccggcugcagcgcgagcaccgggaccaccaguggcccaaggaggacggcgcggccgagggcaccgugaccgaggacuacaacucccaggugguccgcugguga

SEQ ID NO: 31292 - RNA, 231 nt, Artificial Sequence
  derived and/or modified sequence opt1 from HSBP1__Homo_sapiens__NP_001528
auggccgagaccgaccccaagaccgugcaggaccugacgagcgucgugcagacccuccugcagcagaugcaggacaaguuccagaccauguccgaccagaucaucggccgcaucgacgacaugagcucccggaucgacgaccuggagaagaacaucgccgaccucaugacccaggcggggguggaggagcuggagagcgagaacaagaucccggccacgcagaaguccuga

SEQ ID NO: 31293 - RNA, 879 nt, Artificial Sequence
  derived and/or modified sequence opt1 from HSD11B1__Homo_sapiens__NP_001193670
auggccuucaugaagaaguaccugcuccccauccugggccuguucauggccuacuacuacuacagcgcgaacgaggaguuccgcccggagaugcuccaggggaagaaggugaucgucaccggcgccuccaaggggaucggccgggagauggccuaccaccuggccaagaugggggcccacgugguggucaccgcgcgcagcaaggagacgcugcagaagguggugucccacugccucgagcugggcgccgccagcgcccacuacaucgcgggcaccauggaggacaugaccuucgccgagcaguucgucgcccaggccgggaagcugaugggcgggcucgacaugcugauccugaaccacaucaccaacacgucccucaaccuguuccacgacgacauccaccacgugcgcaagagcauggaggugaacuuccuguccuacgucgugcucaccguggccgcgcugcccaugcugaagcagagcaacggcuccaucgucguggugagcucccucgccgggaaggucgccuaccccaugguggccgccuacagcgcguccaaguucgcccuggacggcuucuucagcuccauccggaaggaguacagcgugucccgggucaacgugagcaucacccugugcgugcucggccugaucgacaccgagacggccaugaaggccgucuccgggaucgugcacaugcaggccgcgcccaaggaggagugcgcccuggagaucaucaagggcggggcccuccgccaggaggagguguacuacgacagcagccuguggaccacccugcucauccggaacccgugccgcaagauccuggaguuccuguacuccaccagcuacaacauggaccgguucaucaacaaguga

SEQ ID NO: 31294 - RNA, 1002 nt, Artificial Sequence
  derived and/or modified sequence opt1 from HSD11B1L__Homo_sapiens__NP_001254797
auggccaaccugggcacccuccagcugcugcccccgcgcuucaagcgguucagcugccucucccugcccaacaucuggaucaccgggaugcccgugcccgccacgagcgucccgugccccuccgcgggcccccaccgcaccaugaaggugcugcuccugaccgggcugggcgcccucuucuucgccuacuacugggacgacaacuucgaccccgccagccugcagggggcccgggugcugcucaccggcgcgaacgccggcgucggggaggagcuggccuaccacuacgcccgccugggcucccaccucgugcugacggcgcacaccgaggcccugcuccagaagguggucgggaacugccggaagcugggcgccccgaagguguucuacaucgccgccgacauggcgagccccgaggcccccgaguccgugguccaguucgcccuggacaagcucgggggccuggacuaccuggugcucaaccacaucggcggggcccccgccggcacccgcgcgcggagcccgcaggccacccgcuggcugaugcaggucaacuucguguccuacgugcagcugacgagccgggcccuccccucccugaccgacagcaaggggucccugguggucgugagcucccuccugggccgcgugcccaccagcuucuccacccccuacagcgccgccaaguucgcgcuggacggcuucuucgggucccuccggcgcgagcuggacguccaggacgugaacguggccaucacgaugugcguccugggccuccgggaccgcgccagcgccgccgaggcggugcgcggggugacccgggucaaggccgccccgggccccaaggccgcgcuggccgugauccgcgggggcgccacccgggccgccggcgucuucuaccccuggcgguuccgccugcucugccugcugcggcgcuggcucccccgcccgcgggcgugguucauccgccaggagcugaacgugaccgccgccgccgccuga

SEQ ID NO: 31295 - RNA, 1218 nt, Artificial Sequence
  derived and/or modified sequence opt1 from HSD11B2__Homo_sapiens__NP_000187
auggagcgcuggcccuggccgagcggcggggccuggcugcucguggccgcgcgggcccugcugcagcuccugcgcuccgaccugcggcucggccgcccccugcuggccgcccucgcccugcuggcggcccucgacuggcugugccagcggcugcucccgccgcccgccgcccuggcgguccuggccgccgccggguggaucgcccucagccgccuggcgcggccccagcgccugcccguggccacccgggccgugcucaucaccggcugcgacuccggguucggcaaggagacggccaagaagcuggacagcaugggcuucaccguccuggccaccgugcucgagcugaacucccccggggcgaucgagcugcggaccugcugcagcccccgccuccgccugcugcagauggaccucacgaagcccggcgacaucucccgggugcuggaguucaccaaggcccacaccaccagcacggggcuguggggccucgucaacaacgccgggcacaacgaggugguggccgacgccgagcugucccccgucgcgaccuuccgcagcugcauggaggugaacuucuucggcgcccuggagcucaccaagggccugcugccccuccugcgguccagccgcgggcggaucgugaccgucggcuccccggccggggacaugcccuaccccugccugggcgccuacggcacgagcaaggccgcgguggcccuccugauggacaccuucuccugcgagcugcuccccuggggcgugaaggucagcaucauccagccggggugcuucaagaccgaguccgugcgcaacguggggcagugggagaagcggaagcagcugcugcucgccaaccugccccaggagcugcugcaggccuacggcaaggacuacaucgagcaccuccacgggcaguuccugcacagccugcgccucgcgauguccgaccugacccccgucguggacgccaucacggacgcccugcucgccgcccggccccgccgccgguacuacccgggccagggccuggggcugauguacuucauccacuacuaccuccccgagggccugcgccggcgcuuccugcaggcguucuucaucagccacugccucccccgggcccugcagcccgggcagccgggcaccaccccgccccaggacgccgcccaggaccccaaccugagccccgggcccucccccgccguggcgcgcuga

SEQ ID NO: 31296 - RNA, 759 nt, Artificial Sequence
  derived and/or modified sequence opt1 from HSD17B10__Homo_sapiens__NP_001032900
auggccgccgcgugccgcagcgugaagggccuggucgccgugaucaccgggggcgccuccgggcucggccuggccaccgccgagcggcugguggggcagggcgcgagcgccguccuccuggaccugcccaacuccggcggggaggcccaggccaagaagcucggcaacaacugcguguucgcgccggccgacgugacgagcgagaaggacguccagaccgcccuggcccuggccaaggggaaguucggccgcguggacguggcggucaacugcgccgggaucgccguggccuccaagaccuacaaccucaagaagggccagacccacacgcuggaggacuuccagcgggugcuggacgucaaccucaugggcaccuucaacgugauccgccugguggccggggagaugggccagaacgagcccgaccagggcgggcagcggggcgucaucaucaacaccgcgagcguggccgccuucgagggccagguggggcaggccgccuacuccgcgagcaagggcgggaucgucgggaugacccugcccaucgcccgcgaccucgcccccaucggccuguucggcacgccgcugcucaccucccugcccgagaaggugugcaacuuccuggccagccaggugcccuuccccucccggcucggggacccggccgaguacgcgcaccugguccaggccaucaucgagaaccccuuccugaacggcgaggugauccgccucgacggggccauccggaugcagcccuga

SEQ ID NO: 31297 - RNA, 903 nt, Artificial Sequence
  derived and/or modified sequence opt1 from HSD17B11__Homo_sapiens__NP_057329
augaaguuccugcucgacauccugcugcuccugccccugcucaucgugugcagccuggaguccuucgucaagcuguucaucccgaagcgccgcaagagcgugaccggcgagaucgugcucaucaccggggccggccacgggaucggccggcugacggccuacgaguucgcgaagcugaaguccaagcucguccugugggacaucaacaagcacgggcuggaggagaccgccgccaagugcaagggccucggcgccaaggugcacaccuucguggucgacugcagcaaccgggaggacaucuacuccagcgccaagaaggugaaggcggagaucggggacguguccauccuggucaacaacgccggcgugguguacaccagcgaccuguucgccacgcaggacccccagaucgagaagaccuucgaggucaacgugcucgcccacuucuggaccaccaaggcguuccugcccgccaugacgaagaacaaccacgggcacaucgugaccgucgccuccgccgccggccacgugagcgugcccuuccugcucgcguacugcuccagcaaguucgccgccgucggguuccacaagacccugaccgacgagcuggccgcccuccagaucacgggcgugaagacgaccugccugugcccgaacuucgugaacaccggcuucaucaagaaccccuccaccagccuggggcccacccucgagcccgaggaggucgugaaccgccugaugcacggcauccugaccgagcagaagaugaucuucaucccguccagcaucgcguuccucaccacgcuggagcggauccugcccgagcgcuuccucgccgugcugaagcggaagaucuccgucaaguucgacgccgugaucggguacaagaugaaggcccaguga

SEQ ID NO: 31298 - RNA, 939 nt, Artificial Sequence
  derived and/or modified sequence opt1 from HSD17B12__Homo_sapiens__NP_057226
auggagagcgcccugcccgccgcgggcuuccucuacugggugggggccggcaccgucgccuaccuggcccugcgcaucuccuacagccucuucaccgcccugcggguguggggcguggggaacgaggcgggggucggcccgggccugggggagugggccguggugacgggcuccaccgacgggaucggcaagagcuacgccgaggagcucgccaagcacgggaugaaggucgugcugaucucccgcagcaaggacaagcuggaccagguguccagcgagaucaaggagaaguucaaggucgagacccggaccaucgcgguggacuucgccuccgaggacaucuacgacaagaucaagacgggccucgccggccuggagaucgggauccuggugaacaacgucggcaugagcuacgaguaccccgaguacuuccucgacgugcccgaccuggacaacgugaucaagaagaugaucaacaucaacauccuguccgucugcaagaugacccagcucgugcugcccgggaugguggagcgcagcaagggcgccauccugaacaucuccagcggcuccgggaugcucccggucccccugcugaccaucuacagcgccaccaagacguucguggacuucuucucccagugccuccacgaggaguaccggagcaagggcguguucguccaguccgugcugcccuacuucguggcgaccaagcuggccaagauccgcaagcccacccucgacaagccgagccccgagaccuucgucaagagcgccaucaagacgguggggcugcagucccggaccaacggcuaccugauccacgcccucauggggagcaucaucuccaaccugcccagcuggaucuaccugaagaucgucaugaacaugaacaaguccacccgcgcccacuaccucaagaagaccaagaagaacuga

SEQ ID NO: 31299 - RNA, 795 nt, Artificial Sequence
  derived and/or modified sequence opt1 from HSD17B13__Homo_sapiens__NP_001129702
augaacaucauccuggagauccuccugcugcucaucaccaucaucuacagcuaccuggagucccuggugaaguucuucaucccccagcgccgcaagagcgucgccggcgagaucgugcucaucaccggggccggccacgggaucggccggcagacgaccuacgaguucgcgaagcggcaguccauccuggugcugugggacaucaacaaggucaagaaggaggugggggacgugaccaucgucgugaacaacgccggcaccguguacccggccgaccuccugagcacgaaggacgaggagaucaccaagaccuucgaggucaacauccugggccacuucuggaucaccaaggcccuccugcccuccaugauggagcgcaaccacgggcacaucgugacgguggccagcgucugcggccacgaggggauccccuaccugauccccuacugcuccagcaaguucgcggccgugggcuuccaccgggggcucaccuccgagcugcaggcccugggcaagaccggcaucaagaccagcugccucugcccgguguucgucaacacgggguucaccaagaaccccuccacccgccuguggcccgugcuggagaccgacgaggugguccggagccucaucgacggcauccugacgaacaagaagaugaucuucgugcccuccuacaucaacaucuuccugcgccuccagaaguuccugccggagcgggccagcgcgauccugaaccgcaugcagaacauccaguucgaggccguggucgggcacaagaucaagaugaaguga

SEQ ID NO: 31300 - RNA, 813 nt, Artificial Sequence
  derived and/or modified sequence opt1 from HSD17B14__Homo_sapiens__NP_057330
auggccaccggcacccgcuacgccgggaagguggucguggugacgggcgggggccgggggaucggcgcgggcaucguccgcgccuucgugaacagcggggcccggguggucaucugcgacaaggacgaguccggcgggcgcgcccuggagcaggagcuccccggcgccguguucauccugugcgacgugacccaggaggacgacgucaagacccuggugagcgagaccauccggcgcuucgggcggcucgacugcguggucaacaacgcgggccaccacccgccgccccagcgccccgaggagacguccgcccagggcuuccggcagcugcuggagcucaaccugcuggggaccuacacccucaccaagcuggcccugcccuaccuccgcaagagccagggcaacgugaucaacaucuccagccuggugggggccaucggccaggcgcaggccguccccuacguggccacgaagggcgccgugaccgccaugaccaaggcgcuggcccucgacgagucccccuacgggguccgggugaacugcaucagccccggcaacaucuggaccccgcugugggaggagcuggccgcccucaugcccgacccccgcgccacgauccgggaggggaugcuggcgcagccccugggccgcauggggcagccggccgaggugggcgccgccgccgucuuccucgcguccgaggccaacuucugcaccggcaucgagcugcuggugaccgggggcgccgagcucggguacggcugcaaggccagccgguccacccccguggacgcccccgacauccccagcuga

SEQ ID NO: 31301 - RNA, 987 nt, Artificial Sequence
  derived and/or modified sequence opt1 from HSD17B1__Homo_sapiens__NP_000404
auggcccgcaccgugguccugaucaccggcugcagcuccgggaucggccuccaccuggccgugcggcuggcgagcgaccccucccagagcuucaagguguacgccacgcuccgcgaccugaagacccaggggcggcugugggaggccgcccgcgcccucgcgugcccgcccggcucccuggagacccugcagcucgacguccgggacagcaaguccguggccgccgcccgcgagcgggugaccgaggggcgcgucgacgugcuggugugcaacgcgggccugggccuccuggggccccuggaggcccucggcgaggacgccgucgccagcgugcuggacgugaacgucguggggacggugcggaugcugcaggccuuccuccccgacaugaagcgccggggcuccgggcgcguccuggugaccggcagcgugggcgggcugaugggccucccguucaacgacgucuacugcgcguccaaguucgcccuggaggggcugugcgagagccucgccgugcugcugcuccccuucggcgugcaccugucccugaucgagugcggccccguccacaccgccuucauggagaaggugcucgggagccccgaggaggugcuggaccggaccgacauccacacguuccaccgcuucuaccaguaccuggcccacuccaagcaggucuuccgggaggcggcccagaacccggaggagguggccgaggucuuccucaccgcccugcgcgcccccaagcccacccugcgguacuucaccacggagcgcuuccucccccugcugcggaugcgccucgacgacccgagcggcuccaacuacgugaccgcgaugcaccgggagguguucggggacguccccgccaaggccgaggccggcgccgaggccgggggcggcgccgggcccggcgccgaggacgaggccgggcgcggcgcggugggggaccccgagcugggcgacccgcccgccgcgccccaguga

SEQ ID NO: 31302 - RNA, 1164 nt, Artificial Sequence
  derived and/or modified sequence opt1 from HSD17B2__Homo_sapiens__NP_002144
augagcaccuucuucuccgacaccgccuggaucugccuggccgugcccacgguccucugcggcaccguguucugcaaguacaagaaguccuccgggcagcuguggagcuggauggugugccuggcgggccucugcgccgucugccugcugauccucuccccguucugggggcugauccuguucagcguguccugcuuccucauguacaccuaccugagcggccaggagcugcuccccguggaccagaaggccguccuggugaccgggggcgacugcggccuggggcacgcccucugcaaguaccuggacgagcugggcuucacgguguucgccgggguccucaacgagaacggccccggggcggaggagcugcgccggaccugcagcccccgccugagcgugcuccagauggacaucaccaagccggugcagaucaaggacgccuacuccaaggucgccgccaugcugcaggaccggggccugugggcggugaucaacaacgccggcgugcucggguuccccaccgacggcgagcugcugcucaugacggacuacaagcagugcauggccgucaacuucuucgggaccguggaggugaccaagaccuuccugccccugcuccgcaagagcaagggccggcuggucaacguguccagcaugggcgggggcgcccccauggagcgccuggccuccuacgggagcuccaaggcggccgugacgauguucagcuccgucaugcggcucgagcugagcaaguggggcaucaagguggccagcauccagcccgggggcuuccugaccaacaucgccggcaccuccgacaagugggagaagcucgagaaggacauccuggaccaccucccggccgaggugcaggaggacuacgggcaggacuacauccuggcgcagcgcaacuuccugcugcucaucaacagccuggccuccaaggacuucagccccguccugcgggacauccagcacgccauccucgccaagucccccuucgccuacuacaccccgggcaagggggcguaccuguggaucugccuggcccacuaccuccccaucggcaucuacgacuacuucgccaagcgccacuucgggcaggacaagcccaugccccgggcccugcgcaugccgaacuacaagaagaaggccacguga

SEQ ID NO: 31303 - RNA, 933 nt, Artificial Sequence
  derived and/or modified sequence opt1 from HSD17B3__Homo_sapiens__NP_000188
augggcgacgugcuggagcaguucuucauccucaccgggcugcuggucugccucgccugccuggccaagugcgugcgcuucagccggugcgugcugcucaacuacuggaagguccugcccaaguccuuccugcgcagcaugggccagugggcggugaucaccggggccggcgacgggaucggcaaggccuacuccuucgagcucgccaagcggggccugaacgugguccugaucagccgcacgcucgagaagcuggaggccaucgcgaccgagaucgagcggaccaccgggcgcuccgugaagaucauccaggccgacuucacgaaggacgacaucuacgagcacaucaaggagaagcuggccggccucgagaucgggauccuggugaacaacgucggcaugcugccgaaccuccugcccagccacuuccugaacgcccccgacgagauccagucccucauccacugcaacaucaccagcguggugaagaugacccagcugauccugaagcacauggagucccggcagaaggggcucauccugaacaucagcuccggcaucgcgcuguuccccuggccgcucuacagcauguacuccgccagcaaggccuucgucugcgccuucuccaaggcccugcaggaggaguacaaggcgaaggaggugaucauccaggugcugacccccuacgccgucagcacggccaugaccaaguaccucaacaccaacgugaucaccaagacggccgacgaguucgugaaggagucccugaacuacgucaccaucggcggggagaccugcggcugccuggcccacgagauccucgcgggguuccugagccugauccccgccugggccuucuacuccggcgccuuccagcgccuccugcugacccacuacguggccuaccucaagcugaacacgaaggugcgguga

SEQ ID NO: 31304 - RNA, 2211 nt, Artificial Sequence
  derived and/or modified sequence opt1 from HSD17B4__Homo_sapiens__NP_000405
augggcagcccccugcgcuucgacgggcgggugguccucgugaccggcgccggggccggccuggggcgcgcguacgcccuggccuucgccgagcggggcgcccucguggucgugaacgaccugggcggggacuucaagggcguggggaagggcucccuggcggccgacaaggucguggaggagauccgccggcgcgggggcaaggccguggccaacuacgacagcgucgaggagggcgagaagguggugaagaccgcgcucgacgccuucgggcggaucgacgucguggugaacaacgccggcauccugcgcgaccgguccuucgcccgcaucagcgacgaggacugggacaucauccaccggguccaccuccgcggguccuuccaggugacgcgggccgcgugggagcacaugaagaagcagaaguacggccgcaucaucaugaccagcuccgccagcggcaucuacgggaacuucggccaggccaacuacuccgccgccaagcuggggcugcugggccucgcgaacagccuggccaucgaggggcggaaguccaacauccacugcaacaccaucgccccgaacgccggcagccgcaugacccagacggugaugcccgaggaccuggucgaggcccucaagcccgaguacguggcgccccuggugcuguggcucugccacgaguccugcgaggagaacggcgggcuguucgaggucggcgccggguggaucggcaagcugcggugggagcgcacccucggggccaucgugcggcagaagaaccacccgaugacccccgaggccgugaaggccaacuggaagaagaucugcgacuucgagaacgcgagcaagccccaguccauccaggagagcaccggcuccaucaucgagguccugagcaagaucgacuccgagggcggggugagcgccaaccacacgagccgcgccaccuccaccgccaccagcggcuucgcgggggccaucggccagaagcugcccccguucuccuacgccuacacggagcucgaggccaucauguacgcccugggggucggcgcgagcaucaaggaccccaaggaccugaaguucaucuacgagggcuccagcgacuucuccugccuccccaccuucggggugaucaucggccagaaguccaugaugggcgggggccuggccgagauccccgggcugagcaucaacuucgccaaggugcuccacggcgagcaguaccuggagcuguacaagccgcucccccgggccgggaagcugaagugcgaggccgucguggcggacgugcuggacaagggcagcggggucgugaucaucauggacguguacuccuacagcgagaaggagcucaucugccacaaccaguucucccuguuccuggucggcagcggcggguucggcgggaagcgcaccuccgacaaggugaagguggccgucgccauccccaaccggcccccggacgccgugcucaccgacacgaccagccugaaccaggccgcgcuguaccgccucuccggcgacuggaacccccugcacaucgaccccaacuucgccagccuggccggguucgacaagcccauccuccacggccugugcaccuucggcuucuccgcccgccgggugcugcagcaguucgcggacaacgacgucagccgcuucaaggccaucaaggcccgguucgccaagccgguguaccccgggcagacccuccagacggagauguggaaggagggcaaccgcauccacuuccagaccaaggugcaggagaccggggacaucgucaucagcaacgccuacguggaccuggcgcccaccuccggcacgagcgccaagacccccuccgagggcgggaagcugcagagcaccuucguguucgaggagaucggccggcgccugaaggacaucgggccggaggucgugaagaaggugaacgccgucuucgaguggcacaucaccaagggcgggaacaucggcgccaaguggacgaucgaccucaaguccgggagcggcaagguguaccagggccccgccaagggggcggccgacaccaccaucauccuguccgacgaggacuucauggaggugguccugggcaagcucgacccccagaaggccuucuucagcgggcggcugaaggcccgcggcaacaucaugcugucccagaagcuccagaugauccugaaggacuacgccaagcuguga

SEQ ID NO: 31305 - RNA, 954 nt, Artificial Sequence
  derived and/or modified sequence opt1 from HSD17B6__Homo_sapiens__XP_006719735
auguggcuguaccucgccgccuucgugggccuguacuaccugcuccacugguaccgcgagcggcaggucgugagccaccuccaggacaaguacguguucaucaccgggugcgacuccggcuucgggaaccugcuggcgcgccagcuggacgcccggggccugcgcguccucgccgccugccugaccgagaagggggccgagcagcugcggggccagacgagcgaccgccucgagaccgugacccuggacgugaccaagauggaguccaucgcggccgccacgcagugggucaaggagcacgugggcgaccgggggcuguggggccucgugaacaacgccgggauccugacccccaucacccugugcgaguggcucaacaccgaggacagcaugaacaugcugaaggucaaccugaucggcgugauccaggugacgcucuccaugcugccgcugguccgccgggcgcgcgggcggaucgugaacgugagcuccauccucggccgcgucgccuucuucgugggcggguacugcgugagcaaguacggcgucgaggccuucuccgacauccugcggcgcgagauccagcacuucggggugaagaucagcaucguggagcccggcuacuuccggaccggcaugaccaacaugacccagucccuggagcgcaugaagcagagcuggaaggaggcccccaagcacaucaaggagacguacgggcagcaguacuucgacgcccucuacaacaucaugaaggagggccugcugaacugcuccaccaaccucaaccuggucaccgacugcauggagcacgcgcugaccagcgugcacccccggacgcgcuacuccgccgggugggacgccaaguucuucuucaucccgcucagcuaccugcccaccucccuggccgacuacauccucacccggagcuggcccaagcccgcccaggcgguguga

SEQ ID NO: 31306 - RNA, 468 nt, Artificial Sequence
  derived and/or modified sequence opt1 from HSD17B7__Homo_sapiens__NP_001291441
augcgcaaggugguccugaucaccggcgccagcuccgggaucggccucgcccugugcaagcggcugcucgcggaggacgacgagcugcaccugugccucgccugccgcaacaugagcaaggccgaggccgugugcgccgcgcugcuggccucccaccccaccgccgaggugacgaucguccagguggacgugagcaaccuccaguccgucuuccgggccagcaaggagcugaagcagcgcuuccagcggcuggacugcaucuaccucaacgcggggaucaugccgaacccccagcugaacaucaaggcccuguucuucggccucuucucccgcaaggugauccacauguucagcaccgccgaggggcugcugacccagggcgacaagaucaccgccgacggccuccaggagguguucgagacgaacgucuucgggcacuucauccuggugaagaagcugugggccuga

SEQ ID NO: 31307 - RNA, 786 nt, Artificial Sequence
  derived and/or modified sequence opt1 from HSD17B8__Homo_sapiens__NP_055049
auggccagccagcugcagaaccgccuccgguccgcccuggcgcuggugacgggcgccgggagcggcaucgggcgcgccgucuccgugcggcucgccggcgagggggccaccguggcggccugcgaccuggaccgcgccgccgcgcaggagacgguccggcugcucggcggccccgggagcaaggagggcccgccccgcgggaaccacgccgccuuccaggccgacguguccgaggcccgggcggcccgcugccugcuggagcagguccaggccugcuucagccggccgcccuccgugguggugagcugcgccggcaucacccaggacgaguuccuccugcacauguccgaggacgacugggacaaggucaucgccgugaaccugaaggggaccuuccucgugacccaggcggccgcccaggcccuggucagcaacggcugccgcggcuccaucaucaacaucagcuccaucguggggaaggugggcaacgucgggcagacgaacuacgccgcgagcaaggccggcgugaucggccugacccagaccgccgcccgggagcucgggcgccacggcauccggugcaacuccgugcugcccggguucaucgccacccccaugacgcagaaggucccccagaaggugguggacaagaucaccgagaugauccccaugggccaccugggggacccggaggacgucgcggacgugguggccuuccucgccagcgaggacuccggcuacaucaccggcaccagcgucgaggugaccgggggccuguucauguga

SEQ ID NO: 31308 - RNA, 1128 nt, Artificial Sequence
  derived and/or modified sequence opt1 from HSD3B1__Homo_sapiens__XP_011539616
auggccaugaccggcuggagcugccuggugaccggggccggcggguuccucggccagcgcaucauccggcugcuggucaaggagaaggagcucaaggagauccgcgugcuggacaaggcguucgggcccgagcugcgggaggaguucuccaagcuccagaacaagacgaagcugaccgugcuggagggcgacauccucgacgagccguuccugaagcgcgccugccaggacgucagcgugaucauccacaccgccugcaucaucgacguguucggcgucacccaccgggaguccaucaugaacgugaacgugaaggggacgcagcugcuccuggaggccugcguccaggccagcgugcccguguucaucuacaccuccagcaucgaggucgcgggccccaacuccuacaaggagaucauccagaacgggcacgaggaggagccccuggagaacaccuggccggcccccuacccccacagcaagaagcucgccgagaaggccgugcuggcggccaacggcuggaaccugaagaacgggggcacccucuacacgugcgcccugcgccccauguacaucuacggcgaggggucccgguuccugagcgccuccaucaacgaggcccucaacaacaacggcauccugagcuccguggggaaguucagcaccgucaacccgguguacgugggcaacgucgcgugggcccacauccuggcccuccgcgcccugcaggaccccaagaaggcccccuccauccggggccaguucuacuacaucagcgacgacacgccccaccaguccuacgacaaccugaacuacacccucagcaaggaguucgggcugcgccuggacucccgguggagcuucccgcucagccugauguacuggaucggcuuccugcucgagaucguguccuuccugcugcgccccaucuacaccuaccggccgcccuucaaccgccacaucgugacccucagcaacuccgucuucaccuucagcuacaagaaggcgcagcgggaccuggccuacaagccccuguacuccugggaggaggccaagcagaagaccguggaguggguggggagccucgucgaccgccacaaggagacgcugaaguccaagacccaguga

SEQ ID NO: 31309 - RNA, 591 nt, Artificial Sequence
  derived and/or modified sequence opt1 from HSD3B7__Homo_sapiens__NP_001136250
auggccgacagcgcccaggcgcagaagcugguguaccucgucaccggcgggugcggcuuccugggggagcacguggugcgcaugcugcuccagcgggagccccgccugggcgagcugcgggucuucgaccagcaccucgggccguggcuggaggagcugaagaccggccccgugcgcgugaccgccauccagggcgacgucacccaggcccacgagguggccgccgcgguggccggggcccacgucgugauccacaccgccggccucguggacgucuucgggcgggcgucccccaagaccauccacgaggugaacgugcagggcacgcgcaacgucaucgaggccugcgugcagaccgggacccgguuccugguguacaccagcuccauggaggucgugggccccaacacgaagggccacccguucuaccgcgggaacgaggacacccccuacgaggccgugcaccggcaccccuaccccugcagcaaggcccuggccgaguggcucguccuggaggcgaacggccgcaaggccaugcugccggggugcacgugcuggcagcccggcuccuggagcuccggccagcccuga

SEQ ID NO: 31310 - RNA, 828 nt, Artificial Sequence
  derived and/or modified sequence opt1 from HSDL1__Homo_sapiens__NP_001139523
auggccgccguggacagcuucuaccugcucuaccgcgagaucgcgcgguccugcaacugcuacauggaggcccuggcccuggucggcgccugguacaccgcccgcaagagcaucaccgugaucugcgacuucuacucccucauccggcugcacuucaucccccgccuggggagccgggcggaccucaucaagcaguacggccgcugggccguggucuccggggccacggacggcaucgggaaggccuacgcggaggagcuggccagccggggccugaacaucauccucaucucccgcaacgaggagaagcugcaguacuucacccagcugagcgaggacaagcucugggacaucaucaacgugaacaucgccgccgccucccugauggugcacgucgugcugccgggcaugguggagcggaagaagggggcgaucgucaccaucagcuccggcagcugcugcaagcccacgccccagcucgccgccuucuccgccagcaaggccuaccuggaccacuucucccgcgcgcugcaguacgaguacgccagcaaggggaucuucgugcagucccucauccccuucuacguggccaccagcaugaccgccccguccaacuuccugcaccggugcagcuggcugguccccagccccaagguguacgcccaccacgcgguguccacccucggcaucagcaagcgcaccacgggguacuggucccacagcauccaguuccuguucgcccaguacaugcccgaguggcugugggucuggggcgccaacauccucaaccggucccugcgcaaggaggcccugagcugcaccgccuga

SEQ ID NO: 31311 - RNA, 1038 nt, Artificial Sequence
  derived and/or modified sequence opt1 from HSDL2__Homo_sapiens__NP_001182751
augcugcccaacaccggccgccucgccgggugcaccguguucaucacgggcgccagccgggggaucggcaaggcgaucgcccugaaggccgccaaggacggggccaacaucgucaucgcggccaagaccgcccagccgcaccccaagcugcucggcaccaucuacaccgccgcggaggagaucgaggccgugggcgggaaggcccugcccugcaucguggacguccgcgacgagcagcagaucuccgccgccguggagaaggcgaucaagaaguucggcgccuacacgaucgccaaguacgggaugagcauguacgugcugggcauggccgaggaguucaagggggagaucgccgucaacgcgcucuggcccaagaccgccauccacaccgccgccauggacaugcugggcggcccggggaucgagucccagugccggaagguggacaucaucgccgacgcggccuacagcaucuuccagaagcccaaguccuucaccggcaacuucgugaucgacgagaacauccugaaggaggaggggaucgagaacuucgacgucuacgccaucaagcccggccacccccuccagccggacuucuuccuggacgaguaccccgaggccgugagcaagaagguggaguccacgggcgccguccccgaguucaaggaggagaagcugcagcuccagcccaagccgcgcagcggggcgguggaggagaccuuccggaucgugaaggacucccugagcgacgacgucgugaaggccacccaggccaucuaccuguucgagcucuccggcgaggacgggggcaccugguuccuggaccucaagagcaagggcgggaacgugggcuacggggagcccuccgaccaggccgacgucgugaugagcaugacgaccgacgacuucgugaagauguucuccggcaagcugaagcccaccauggcguucaugagcgggaagcugaagaucaagggcaacauggcccuggccaucaagcucgagaagcugaugaaccagaugaacgcccgccuguga

SEQ ID NO: 31312 - RNA, 1590 nt, Artificial Sequence
  derived and/or modified sequence opt1 from HSF1__Homo_sapiens__NP_005517
auggaccugcccgugggcccgggggccgccggccccagcaacguccccgcguuccucaccaagcuguggacccugguguccgaccccgacacggacgcccucaucugcuggagcccguccgggaacagcuuccacguguucgaccagggccaguucgccaaggagguccugcccaaguacuucaagcacaacaacauggccuccuucgugcgccagcugaacauguacggguuccggaaggugguccacaucgagcagggcggccucgugaagcccgagcgcgacgacaccgaguuccagcaccccugcuuccugcgggggcaggagcagcugcucgagaacaucaagcgcaaggugaccagcgucuccacccugaaguccgaggacaucaagauccggcaggacuccgugacgaagcugcucaccgacgugcagcugaugaagggcaagcaggagugcauggacagcaagcugcucgccaugaagcacgagaacgaggcgcuguggcgcgaggucgccucccugcggcagaagcacgcccagcagcagaagguggugaacaagcucauccaguuccugaucagccugguccaguccaaccgcauccucggggugaagcggaagaucccgcugaugcugaacgacagcggcuccgcccacagcaugcccaaguacucccgccaguucagccucgagcacgugcacggguccggccccuacagcgcgcccagcccggccuacuccagcuccagccuguacgcccccgacgccgucgccuccagcggccccaucaucuccgacaucaccgagcuggcgcccgccagcccgauggccucccccgggggcagcaucgacgagcggccccucuccagcagcccccuggugcgcgugaaggaggagccgcccuccccgccccagagcccccgggucgaggaggccagccccgggcgccccuccagcguggacacccugcucucccccacggcccugaucgacagcauccugcgggagagcgagccggcgcccgccuccgugaccgcccucaccgacgcccgcggccacaccgacacggagggccggcccccgagcccgccgcccaccuccacccccgagaagugccugagcgucgccugccuggacaagaacgagcucuccgaccaccuggacgcgauggacagcaaccuggacaaccuccagaccaugcuguccagccacggguucuccguggacacgagcgcccugcucgaccuguucucccccagcgucaccgugcccgacaugucccugcccgaccucgacagcucccuggccagcauccaggagcugcucagcccccaggagccgccccgcccgcccgaggccgagaacuccagccccgacuccggcaagcagcuggugcacuacaccgcccagccccuguuccugcucgaccccgggagcgucgacaccggcuccaacgaccugcccgugcuguucgagcucggggagggcagcuacuucuccgagggcgacggguucgcggaggaccccacgaucagccugcugaccggcuccgagccgcccaaggccaaggaccccaccgugagcuga

SEQ ID NO: 31313 - RNA, 1557 nt, Artificial Sequence
  derived and/or modified sequence opt1 from HSF2__Homo_sapiens__NP_001129036
augaagcagagcuccaacgugcccgccuuccugagcaagcucuggacccuggucgaggagacccacacgaacgaguucaucaccuggucccagaacggccagagcuuccuggugcucgacgagcagcgcuucgccaaggagauccugccgaaguacuucaagcacaacaacauggcguccuucgugcggcagcugaacauguacggguuccgcaaggucgugcacaucgacagcggcaucgugaagcaggagcgggacgggcccgucgaguuccagcaccccuacuucaagcagggccaggacgaccuccuggagaacaucaagcgcaagguguccagcuccaagcccgaggagaacaagauccggcaggaggaccugaccaagaucaucagcuccgcccagaaggugcagaucaagcaggagaccaucgagagccgccucuccgagcucaagagcgagaacgagucccuguggaaggaggucagcgagcugcgggccaagcacgcccagcagcagcaggucauccgcaagaucgugcaguucaucgugacgcuggugcagaacaaccagcuggugucccucaagcggaagcgcccgcugcugcucaacaccaacggggcccagaagaagaaccuguuccagcacaucgucaaggagcccaccgacaaccaccaccacaaggugccccacagccggaccgagggccugaagccccgcgagcggaucuccgacgacaucaucaucuacgacgugacggacgacaacgcggacgaggagaacaucccggucauccccgagaccaacgaggacgugaucagcgaccccagcaacugcucccaguaccccgacaucgugaucgucgaggacgacaacgaggacgaguacgccccggugauccagagcggcgagcagaacgagcccgcccgcgagucccucagcuccgggagcgacggcuccagcccccugauguccagcgccgugcagcugaacggguccagcucccucaccagcgaggaccccgucaccaugauggacuccauccugaacgacaacaucaaccugcucggcaagguggagcugcuggacuaccucgacagcaucgacugcucccuggaggacuuccaggcgaugcugagcgggcggcaguucuccaucgacccggaccuccuggucgacagcgagaacaagggccuggagacgaccaagaacaacguggugcagcccgucagcgaggagggccgcaaguccaagagcaagcccgacaagcagcucauccaguacaccgccuucccccugcuggccuuccucgacgggaacccggccuccagcguggagcaggccuccaccacggcgagcuccgaggugcugagcuccgucgacaagcccaucgagguggacgagcugcucgacagcucccuggaccccgagcccacccagagcaagcuggugcggcucgagccgcugaccgaggccgaggccuccgaggccacccuguucuaccucugcgagcuggcccccgcgccccuggacagcgacaugccccugcucgacuccuga

SEQ ID NO: 31314 - RNA, 1479 nt, Artificial Sequence
  derived and/or modified sequence opt1 from HSF4__Homo_sapiens__NP_001035757
augcaggaggcccccgccgcgcugccgaccgagcccggccccagccccgugccggccuuccucgggaagcugugggcccuggucggcgaccccgggaccgaccaccucauccgcuggucccccagcggcacguccuuccuggugagcgaccagucccgguucgccaaggaggugcugccccaguacuucaagcacagcaacauggccuccuucguccgccagcucaacauguacggguuccggaagguggugagcaucgagcagggcggccugcugcgcccggagcgggaccacgucgaguuccagcaccccuccuucgugcgcgggcgggagcagcuccuggagcgcgugcggcgcaagguccccgcgcugcggggcgacgacgggcgcuggcggcccgaggaccucggccgccugcugggggaggugcaggcccuccggggcgugcaggagagcaccgaggcccgccugcgggagcugcgccagcagaacgagauccucuggcgggaggucgugacccugcgccagucccacggccagcagcaccgggugaucgggaagcugauccagugccucuucggcccgcugcaggccgggcccagcaacgcgggcggcaagcgcaagcugucccucaugcuggacgaggggagcuccugccccacccccgccaaguucaacacgugcccgcugcccggcgcccuccugcaggaccccuacuucauccagagcccccugccggagaccaaccucgggcugagcccccaccgcgcccggggccccaucaucuccgacauccccgaggacuccccgagccccgaggggacccgccugagccccuccagcgacggccggcgcgagaagggccucgcccugcugaaggaggagcccgcgucccccgggggcgacggggaggccggccucgcccuggcccccaacgagugcgacuucugcgucaccgcgcccccgccccugcccguggccgugguccaggccauccucgaggggaagggcagcuucucccccgagggcccgcggaacgcccagcagcccgagcccggggacccccgcgagaucccggaccggggcccccuggggcuggagagcggcgaccgcucccccgagagccuccugcccccgaugcugcuccagccgccccaggaguccguggagcccgccgggccgcuggacgugcugggccccagccuccagggccgggaguggacgcugauggaccuggacauggagcugucccucaugcagccccugguccccgagcgcggggagccggagcuggccgugaagggccucaacagccccucccccgggaaggaccccacccugggcgcgccgcugcuccuggacgugcaggccgcccugggcgggcccgcccucggccugcccggggcccugaccaucuacagcaccccggagucccggacggcgagcuaccucggccccgaggccucccccagccccuga

SEQ ID NO: 31315 - RNA, 1791 nt, Artificial Sequence
  derived and/or modified sequence opt1 from HSF5__Homo_sapiens__NP_001073908
auggaggcccugcucagcacccccaucaacccgaacaacuuccccgccaagcuguggcgccuggugaacagcccccgguaccgcuccauccggugggacggccgcggggagggccuccugaucgaccagccccuguucgaggcggagcuccuguccccgcccgggcccggcgggggcggcgggaccgccggcgccggggccgagcccgagcuguucaagacgaccagcuucaccuccuucauccggcagcucaaccuguacggcuuccgcaaggucgugcucgggggcccgggcgggggcaagcccgccgggaacggcccccugcaccacuuccacaacccccacuuccggcgcgaccagccgcagcugcuggugcaccucaagcggcugaccagcgcgaacaaggccaagcuggccgccggccucgagguccccugccgcccgcccaaccgguuccagcgccugcugaucacguccgcgagcgccgccaccgccccgcuccagcaccagcagcccccgccgcccgccgggccccggcccgagccccacggccccguggcgguggggcaguuccaccgcuccuuccggcgcgacagccugucccccuacagcugcgucuccacccccagccacgaccacuccaccuacccccugaagggccucgaccggacgcccgugccccaccgcaucuggcagaacagccuggggaugcaccccggccagguggagaccuccccgaccuucagcgacaagggcguccccuuccccgugcugcagcgguuccccaccgaggugacguacacccuccagccguccaccaccagcguccacgugcagcaggggccccagacgauggugagcuccagccagaaguacuccaacuacacccccagcgcccaguacucccaggccuacuaccccaccgccguccugcagugcugcagcccgacccacauggacgcccuguccagcugcgugacgcccaccgcguccagcuacgcccacugcaacuacuuccagaaccccuccaugcagagcuccuaccccguggaguuccucccgagcaacuggcccugcuccaccaccgacgagaacacgaagaccgaggucaaccuggaggccguguuccagaucguggacgagcugcacagcucccccaagcucgagauggucaagguggagcccguggagaaccagugcccgaccagccccuccuaccgcggccagcacauccuggccaacagcaacaacagcaaccccugcuccgccagccaggcgucccagcuggagccccucaccccggucgggagcgacaucauguccuucguggucggcacggagcaggccguggccugcagccugccccagucccccgaguacaucuacaccauccacaccgcccagcccguggagaacagcaccauccaggaguccgccgcgauccagcaggcccacgucaagcugaaggagcaccucaaccacaacccgagccccuccagcgugguguucguccaggaggggcccccguucuccacgcaccagguggacgccaacaucaagugccagaccagcucccgggagaacauccugcccagcgagcagaugggcuuccugaucuccgagaugggccccgccagcaagcccagcgaggacaccgggcucgcgaccccggcccgcuaccgcgagcaccgguccaacagccagcagggcaagucccccgaccugcaccuccugguggacgucgccugcaagcaggagcgcuuccccaaggaggaggagcugaaggaguga

SEQ ID NO: 31316 - RNA, 612 nt, Artificial Sequence
  derived and/or modified sequence opt1 from HSFY2__Homo_sapiens__NP_001001877
auggcccacgugagcuccgagacccaggacgucagccccaaggacgagcugaccgccuccgaggcgagcacgcgcuccccgcucugcgagcacaccuuccccggcgacagcgaccugcgguccaugaucgaggagcacgccuuccaggugcugagccaggggucccuccuggagagccccuccuacaccgugugcgucagcgagcccgacaaggacgacgacuuccugucccucaacuucccgcgcaagcuguggaagaucguggagagcgaccaguucaaguccaucagcugggacgagaacgggaccugcaucgugaucaacgaggagcuguucaagaaggagauccucgagacgaaggcccccuaccggaucuuccagaccgacgccaucaaguccuucguccgccagcugaaccuguacggcuucagcaagauccagcagaacuuccagcgguccgccuuccucgcgaccuuccugagcgaggagaaggagagcuccgugcugagcaagauccgcuucaccaagaugaagcucucccggagcuccacguacgagaaccgcuaccugugcugcaaccugcaccucaaggacgagagcaacuacuccuga

SEQ ID NO: 31317 - RNA, 888 nt, Artificial Sequence
  derived and/or modified sequence opt1 from HSH2D__Homo_sapiens__NP_001278203
augcgcggcagccggaugucccagcccccgcagugccugcgccgggcccagagcuccugcugccacuucauggugaagcuccuggacgacgggaccuucaugauccccggcgagaaggucgcccacaccagccuggacgcgcucgugacguuccaccagcagaagcccaucgagccccgccgggagcugcugacccagccgugccgccagaaggaccccgccaacguggacuacgaggaccucuuccuguacuccaacgccgucgccgaggaggccgcgugccccgugagcgcccccgaggaggccuccccgaagcccgugcugugccaccagagcaaggagcggaagcccuccgccgagaugaaccgcaucaccaccaaggaggcgacgagcuccugcccgcccaagagcccccucggggagacccggcagaagcuguggcgcucccugaagaugcuccccgagcggggccagcgcguccggcagcagcucaagagccaccuggccaccgugaaccuguccagccugcuggacgugcgccgguccaccgucaucagcgggcccggcacgggcaaggggucccaggaccacagcggcgacccgaccagcggggaccgcggcuacaccgaccccugcguggccaccucccucaagagccccucccagccccaggccccgaaggaccggaaggugcccacgcgcaaggccgagcggagcgucuccugcaucgaggugacccccggggaccgcagcuggcaccagauggugguccgggcgcuguccagccaggaguccaagcccgagcaccagggccuggccgagccggagaacgaccagcuccccgaggaguaccagcagcccccgcccuucgcccccggcuacugcuga

SEQ ID NO: 31318 - RNA, 2565 nt, Artificial Sequence
  derived and/or modified sequence opt1 from HSP90AA1__Homo_sapiens__NP_001017963
augcccccgugcagcggcggggacggcuccaccccgcccgggcccagccugcgcgaccgggacugccccgcccaguccgccgaguacccccgcgaccggcucgacccccgccccggcagcccguccgaggcgagcuccccgcccuuccugcggagccgcgcccccgugaacugguaccaggagaaggcccaggucuuccuguggcaccucaugguguccgggagcaccacgcugcugugccucuggaagcagcccuuccacguguccgccuuccccgucaccgccagccuggcguuccggcagucccagggcgccggccagcaccuguacaaggaccuccagcccuucauccugcugcgccuccugaugcccgaggagacccagacccaggaccagccgauggaggaggaggagguggagacguucgccuuccaggccgagaucgcgcagcugaugagccucaucaucaacaccuucuacuccaacaaggagaucuuccugcgggagcugaucagcaacuccagcgacgcccucgacaagauccgcuacgagucccugaccgaccccagcaagcuggacagcgggaaggagcuccacaucaaccugauccccaacaagcaggaccggacccugacgaucguggacaccggcaucgggaugaccaaggccgaccucaucaacaaccugggcaccaucgccaaguccgggacgaaggccuucauggaggcgcugcaggccggcgccgacaucagcaugaucggccaguucggggucggcuucuacuccgccuaccucguggccgagaaggugaccgucaucaccaagcacaacgacgacgagcaguacgcgugggagagcuccgccgggggcagcuucaccgugcgcacggacaccggcgagcccauggggcggggcaccaaggugauccugcaccugaaggaggaccagaccgaguaccucgaggagcgccggaucaaggagaucgucaagaagcacucccaguucaucggguacccgaucacgcuguucguggagaaggagcgcgacaaggaggugagcgacgacgaggccgaggagaaggaggacaaggaggaggagaaggagaaggaggagaaggaguccgaggacaagcccgagaucgaggacgucggcagcgacgaggaggaggagaagaaggacggggacaagaagaagaagaagaagaucaaggagaaguacaucgaccaggaggagcugaacaagaccaagcccaucuggacccggaaccccgacgacaucaccaacgaggaguacggcgaguucuacaagucccucacgaacgacugggaggaccaccuggccgugaagcacuucagcguggagggccagcuggaguuccgcgcccuccuguucgucccgcggcgcgcgcccuucgaccuguucgagaaccggaagaagaagaacaacaucaagcucuacgugcgccgcguguucaucauggacaacugcgaggagcugauccccgaguaccugaacuucauccgcggggucguggacuccgaggaccucccccugaacaucagccgggagaugcugcagcaguccaagauccucaaggugauccggaagaaccuggucaagaagugccuggagcuguucaccgagcucgccgaggacaaggagaacuacaagaaguucuacgagcaguucagcaagaacaucaagcugggcauccacgaggacucccagaaccgcaagaagcugagcgagcuccugcgguacuacaccuccgccagcggggacgagauggugagccugaaggacuacugcacccgcaugaaggagaaccagaagcacaucuacuacaucacgggcgagaccaaggaccaggucgccaacuccgccuucguggagcggcuccgcaagcacgggcuggaggugaucuacaugaucgagccgaucgacgaguacugcguccagcagcugaaggaguucgagggcaagacccucgugagcgugaccaaggagggccuggagcugcccgaggacgaggaggagaagaagaagcaggaggagaagaagacgaaguucgagaaccucugcaagaucaugaaggacauccuggagaagaaggucgagaaggugguggucuccaaccggcuggugaccagccccugcugcaucgugaccuccaccuacggguggacggcgaacauggagcgcaucaugaaggcccaggcccuccgggacaacagcaccaugggcuacauggccgcgaagaagcaccuggagaucaacccggaccacuccaucaucgagacccugcgccagaaggccgaggccgacaagaacgacaagagcgucaaggaccucgugauccugcuguacgagaccgcccuccuguccagcggguucucccuggaggacccccagacccacgccaaccggaucuaccgcaugaucaagcucggccuggggaucgacgaggacgaccccacggcggacgacaccagcgccgccgugaccgaggagaugcccccgcuggagggcgacgacgacaccucccggauggaggaggucgacuga

SEQ ID NO: 31319 - RNA, 2175 nt, Artificial Sequence
  derived and/or modified sequence opt1 from HSP90AB1__Homo_sapiens__NP_001258898
augcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacuga

SEQ ID NO: 31320 - RNA, 2412 nt, Artificial Sequence
  derived and/or modified sequence opt1 from HSP90B1__Homo_sapiens__NP_003290
augcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucuga

SEQ ID NO: 31321 - RNA, 2028 nt, Artificial Sequence
  derived and/or modified sequence opt1 from HSPA12A__Homo_sapiens__NP_079291
auggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacuga

SEQ ID NO: 31322 - RNA, 2061 nt, Artificial Sequence
  derived and/or modified sequence opt1 from HSPA12B__Homo_sapiens__NP_443202
augcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacuga

SEQ ID NO: 31323 - RNA, 1416 nt, Artificial Sequence
  derived and/or modified sequence opt1 from HSPA13__Homo_sapiens__NP_008879
auggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacuga

SEQ ID NO: 31324 - RNA, 432 nt, Artificial Sequence
  derived and/or modified sequence opt1 from HSPA14__Homo_sapiens__NP_001265134
auggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgccgggugcugagccgcgacccgcagcuccagcagcugccccagcccuuccagcggugcuccugcagccuguccgagcagccccacggccagaccgggugcgugcgcggcgcgcagccgcuccaccagcaccagccccagcacagcugggggucccugcacaccgccgacagcucccuccuguucgagagcugguucugcuucugguggggcuga

SEQ ID NO: 31325 - RNA, 1926 nt, Artificial Sequence
  derived and/or modified sequence opt1 from HSPA1A__Homo_sapiens__NP_005336
auggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacuga

SEQ ID NO: 31326 - RNA, 1926 nt, Artificial Sequence
  derived and/or modified sequence opt1 from HSPA1L__Homo_sapiens__NP_005518
auggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacuga

SEQ ID NO: 31327 - RNA, 1920 nt, Artificial Sequence
  derived and/or modified sequence opt1 from HSPA2__Homo_sapiens__NP_068814
augagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacuga

SEQ ID NO: 31328 - RNA, 2523 nt, Artificial Sequence
  derived and/or modified sequence opt1 from HSPA4__Homo_sapiens__NP_002145
augagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacuga

SEQ ID NO: 31329 - RNA, 2520 nt, Artificial Sequence
  derived and/or modified sequence opt1 from HSPA4L__Homo_sapiens__NP_055093
augagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacuga

SEQ ID NO: 31330 - RNA, 1965 nt, Artificial Sequence
  derived and/or modified sequence opt1 from HSPA5__Homo_sapiens__NP_005338
augaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcuguga

SEQ ID NO: 31331 - RNA, 1932 nt, Artificial Sequence
  derived and/or modified sequence opt1 from HSPA6__Homo_sapiens__NP_002146
augcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacuga

SEQ ID NO: 31332 - RNA, 1941 nt, Artificial Sequence
  derived and/or modified sequence opt1 from HSPA8__Homo_sapiens__NP_006588
augagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacuga

SEQ ID NO: 31333 - RNA, 2040 nt, Artificial Sequence
  derived and/or modified sequence opt1 from HSPA9__Homo_sapiens__NP_004125
augaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcaguga

SEQ ID NO: 31334 - RNA, 618 nt, Artificial Sequence
  derived and/or modified sequence opt1 from HSPB1__Homo_sapiens__NP_001531
augaccgagcgccgggugcccuucagccugcuccgcggcccguccugggaccccuuccgggacugguacccccacagccgccuguucgaccaggccuucgggcugccccggcucccggaggaguggucccaguggcugggcgggagcuccuggcccggcuacguccgcccccugcccccggccgcgaucgagagccccgccguggccgcccccgccuacucccgggcgcucagccgccagcuguccagcgggguguccgagauccggcacaccgccgaccgcuggcgggucagccuggacgugaaccacuucgcccccgacgagcucacggugaagaccaaggacggcgucguggagaucaccggcaagcacgaggagcgccaggacgagcacggguacaucucccggugcuucacccgcaaguacacgcugccgcccggcguggaccccacccaggucagcuccagccugucccccgaggggacccucaccguggaggccccgaugcccaagcuggcgacgcagagcaacgagaucaccauccccgugaccuucgagucccgggcccagcugggcgggcccgaggccgccaagagcgacgagaccgccgcgaaguga

SEQ ID NO: 31335 - RNA, 549 nt, Artificial Sequence
  derived and/or modified sequence opt1 from HSPB2__Homo_sapiens__NP_001532
augagcggccgcuccgugccccacgcccacccggccaccgcggaguacgaguucgccaaccccagccggcugggggagcagcgcuucggcgaggggcuccugcccgaggagauccugacccccacgcucuaccacggcuacuacguccggccgcgcgccgcccccgccggggagggcucccgggcgggcgccagcgagcugcgccuguccgaggggaaguuccaggccuuccucgacgugagccacuucacccccgacgaggugaccguccggaccguggacaaccugcuggagguguccgcccgccacccccagcggcucgaccgccacggcuucgucagccgggaguucugccgcacguacgugcugccggcggacguggaccccuggcggguccgcgccgcccugucccacgacgggauccucaaccuggaggcgccccggggcgggcgccaccuggacaccgaggugaacgagguguacaucagccuccugcccgccccgcccgaccccgaggaggaggaggaggccgccaucgucgagcccuga

SEQ ID NO: 31336 - RNA, 453 nt, Artificial Sequence
  derived and/or modified sequence opt1 from HSPB3__Homo_sapiens__NP_006299
auggccaagaucauccugcgccaccucaucgagauccccgugcgguaccaggaggaguucgaggcccgcggccuggaggacugccggcuggaccacgcgcucuacgcccugccggggcccaccaucgucgaccugcgcaagacccgggccgcccagagcccgcccguggacuccgccgcggagacgccgccccgcgagggcaagagccacuuccagauccuccuggacgugguccaguuccugcccgaggacaucaucauccagaccuucgagggguggcuccugaucaaggcccagcacggcacccggauggacgagcacggguucaucucccgcagcuucacccggcaguacaagcugcccgacggcguggagaucaaggaccucuccgccgugcugugccacgacggcauccuggucguggaggugaaggaccccgucgggacgaaguga

SEQ ID NO: 31337 - RNA, 483 nt, Artificial Sequence
  derived and/or modified sequence opt1 from HSPB6__Homo_sapiens__NP_653218
auggagauccccgugcccguccagcccagcuggcugcgccgggccuccgcgccccuccccggccugagcgccccggggcgccuguucgaccagcgguucggcgaggggcuccuggaggccgagcuggccgcccucugccccaccacccuggcccccuacuaccugcgcgcgcccuccguggcccucccgguggcccagguccccacggaccccggccacuucagcgugcugcuggacgugaagcacuucucccccgaggagaucgccgucaagguggugggggagcacgucgaggugcacgcgcggcacgaggagcgcccggacgagcacggcuucguggcccgggaguuccaccgccgguaccgccucccgcccggcgucgaccccgccgccgugaccagcgcccugucccccgagggggugcugagcauccaggcggcccccgccuccgcccaggccccgccgcccgcggccgccaaguga

SEQ ID NO: 31338 - RNA, 792 nt, Artificial Sequence
  derived and/or modified sequence opt1 from HSPB7__Homo_sapiens__XP_011539551
augagcggcugcgagcugagcccccucgggcugcgcgugggccuguccgccgggccggcccacggccggcgcuuccccgcgcccuccgggcccuggcggggccucaaccuggccagccgccagggcgccgggccgaagccccgggacucccgccccuacaaggccgccgcggucggcgccuggcacgcccggcccgaggccugcgcgcacacccugagcugcccggcccucgcccgccuggggcgggcccgccggcgccccuggaugucccaccggaccagcuccacguuccgcgccgagcggagcuuccacuccagcuccagcuccagcuccagcuccaccagcagcuccgcgagccgcgcccugcccgcccaggacccgcccauggagaaggcccucuccauguucagcgacgacuucggcuccuucaugcggccccacagcgagccccuggccuuccccgcggcccacccgaccgcccgccccgggggcgccggcaacaucaagacccugggggacgccuacgaguucgcgguggacgugcgggacuucucccccgaggacaucaucgucacgaccagcaacaaccacaucgaggugcgcgccgagaagcucgccgccgacggcaccgugaugaacaccuucgcccacaagugccagcugcccgaggacgucgacccgacguccgugaccagcgcgcugcgggaggacgggucccucaccauccgcgcccgccggcacccccacaccgagcacgugcagcagacguuccgcaccgagaucaagaucuga

SEQ ID NO: 31339 - RNA, 591 nt, Artificial Sequence
  derived and/or modified sequence opt1 from HSPB8__Homo_sapiens__NP_055180
auggccgacggccagaugcccuucagcugccacuaccccucccgccugcggcgcgaccccuuccgggacagcccccucuccagccgccugcuggacgacggguucggcauggaccccuucccggacgaccucaccgccuccuggcccgacugggcgcugccccggcugagcuccgccuggcccgggacccuccgcagcggcauggugccgcgggggcccacggccaccgcccgcuucggcguccccgccgagggccggacgcccccgcccuuccccggggagcccuggaaggugugcgugaacguccacuccuucaagccggaggagcugauggugaagaccaaggacggcuacguggaggucagcgggaagcacgaggagaagcagcaggagggcgggaucguguccaagaacuucaccaagaagauccagcugcccgcggagguggaccccgucaccguguucgccagccucucccccgagggccugcugaucaucgaggccccgcaggucccgcccuacagcaccuucggcgaguccagcuucaacaacgagcucccccaggacucccaggaggugaccugcacguga

SEQ ID NO: 31340 - RNA, 480 nt, Artificial Sequence
  derived and/or modified sequence opt1 from HSPB9__Homo_sapiens__NP_149971
augcagcgcgugggcaacaccuucagcaacgagucccgggucgccagccgcugccccuccguggggcuggccgagcggaaccgcguggcgaccaugccgguccggcuccugcgcgacagccccgccgcccaggaggacaacgaccacgcccgggacggcuuccagaugaagcuggacgcccacggguucgcgcccgaggagcucguggugcaggucgacggccaguggcugauggugacggggcagcagcagcuggacgugcgcgaccccgagcgggucuccuaccgcaugagccagaaggugcaccggaagaugcucccguccaaccugagccccaccgccaugaccugcugccugacccccuccggccagcucugggugcgcggccagugcgucgcccuggcccugcccgaggcgcagacggggccgagcccccggcucggcucccuggggagcaaggccuccaaccugacccgcuga

SEQ ID NO: 31341 - RNA, 1467 nt, Artificial Sequence
  derived and/or modified sequence opt1 from HSPBAP1__Homo_sapiens__NP_078886
auggccgccggcagcgaggcgaccacccccgugaucgucgccgccggggccggcggggaggagggcgagcacgugaagccguucaagcccgagaaggccaaggagaucaucaugucccugcagcagcccgcgaucuucugcaacaugguguucgacuggcccgcccgccacuggaacgccaaguaccucagccagguccugcacgggaagcagauccgguuccgcaugggcaugaaguccaugagcacggugccgcaguucgagacgaccugcaacuacguggaggccacccuggaggaguuccucaccuggaacugcgaccaguccagcaucuccggccccuuccgggacuacgaccacagcaaguucugggcguacgccgacuacaaguacuucgucucccuguucgaggacaagaccgaccuguuccaggacgugaaguggagcgacuucggguuccccggccgcaacgggcaggaguccacccucuggaucggcagccugggggcccacacccccugccaccuggacuccuacggcugcaaccucguguuccagguccagggccggaagcgcuggcaccuguucccgcccgaggacacgcccuuccuguaccccacccggaucccguacgaggagagcuccguguucagcaagaucaacguggucaaccccgaccucaagcgcuucccccaguuccggaaggcccagcgccacgccgugacccugucccccggccaggugcuguucgucccgcggcacugguggcacuacguggagagcaucgaccccgugaccgucuccaucaacagcuggaucgagcucgaggaggaccaccuggcgcgcguggaggaggccaucacgcggaugcuggugugcgcccucaagaccgccgagaacccccagaacacccgcgccuggcugaaccccaccgaggucgaggagacgagccacgcggugaacugcugcuaccugaacgccgccguguccgccuucuucgaccggugccgcaccagcgaggucguggagauccaggcccuccggaccgacggggagcacaugaagaaggaggagcugaacgucugcaaccacauggagguggggcagaccggcucccagaaccugacgaccggcaccgacaagccggaggcggccagccccuucgggcccgaccucgugcccgucgcccagcgcuccgaggagccgcccagcgagcggggcgggaucuucggcuccgacgggaaggacuucguggacaaggacggcgagcacuucggcaagcugcacugcgccaagcgccagcagaucaugagcaacuccgagaacgccaucgaggagcagaucgcgagcaacaccacgaccacgccccagaccuucaucuccaccgacgaccugcucgacugccuggugaacccccaggucacccggaucguggcccagcugcucauccaggggcgcagccuguga

SEQ ID NO: 31342 - RNA, 1080 nt, Artificial Sequence
  derived and/or modified sequence opt1 from HSPBP1__Homo_sapiens__NP_001123578
augagcgacgagggcucccgcgggagccggcugccccucgcccugccgcccgccucccagggcugcagcuccgggggcgggggcggcgggagcuccgcgggcgggagcggcaacucccgcccgccccggaaccugcaggggcuccugcagauggccaucaccgccggcagcgaggagcccgacccgccgcccgagcccauguccgaggagcgccggcaguggcugcaggaggccaugagcgccgcguuccgcggccagcgggaggagguggagcagaugaaguccugccuccgcguccugagccagcccaugccgcccaccgccggggaggccgagcaggccgcggaccagcaggagcgggagggcgcccuggagcuccuggccgaccugugcgagaacauggacaacgccgccgacuucugccagcucuccgggaugcaccuccuggugggccgcuaccuggaggcgggcgccgccgggcugcgguggcgcgccgcccagcugaucggcacgugcagccagaacguggcggccauccaggagcagguccucgggcugggcgcccugcggaagcuccugcgccugcucgaccgggacgccugcgacaccgugcgcgugaaggcccuguucgcgaucuccugccugguccgggagcaggaggccgggcuccugcaguuccugcgccucgacggcuucagcgugcugaugcgggccaugcagcagcagguccagaagcugaaggugaaguccgccuuccuccugcagaaccugcucgugggccaccccgagcacaaggggacccugugcagcaugggcauggugcagcagcuggucgcccucgugcgcaccgagcacagccccuuccacgagcacgugcugggggcgcugugcucccucgucacggacuucccccagggcgugcgggagugccgcgagcccgagcuggggcuggaggagcuccugcgccaccggugccagcugcuccagcagcacgaggaguaccaggaggagcuggaguucugcgagaagcugcugcagaccugcuucagcucccccgccgacgacagcauggaccgcuga

SEQ ID NO: 31343 - RNA, 1722 nt, Artificial Sequence
  derived and/or modified sequence opt1 from HSPD1__Homo_sapiens__NP_002147
augcugcgccuccccaccguguuccggcagaugcgcccggucagccgggugcuggcgccccaccugacccgcgccuacgccaaggacgugaaguucggggccgacgcccgggcccucaugcugcagggggucgaccugcucgccgacgcgguggccgugacgaugggccccaaggggcgcaccgucaucaucgagcaguccuggggcagccccaaggugaccaaggacggggugaccgucgccaaguccaucgaccugaaggacaaguacaagaacaucggcgccaagcuggugcaggacguggcgaacaacacgaacgaggaggccggcgacgggaccaccaccgccacgguccucgcccggagcaucgccaaggagggcuucgagaagaucuccaagggggcgaacccgguggagauccgccggggcgugaugcuggccgucgacgccgugaucgccgagcugaagaagcagagcaagcccgugaccacccccgaggagaucgcccaggucgcgaccaucuccgccaacggggacaaggagaucggcaacaucaucagcgacgccaugaagaaggugggccgcaagggggugaucacggucaaggacggcaagacccucaacgacgagcuggagaucaucgaggggaugaaguucgaccggggcuacaucucccccuacuucaucaacaccagcaagggccagaagugcgaguuccaggacgccuacgugcugcucuccgagaagaagaucagcuccauccagagcaucgugccggcccuggagaucgcgaacgcccaccgcaagccccuggucaucaucgccgaggacguggacggggaggcccucuccacccugguccugaaccggcucaaggugggccuccagguggucgccgugaaggcgcccggguucggcgacaaccgcaagaaccagcugaaggacauggccaucgccaccgggggcgccguguucggcgaggaggggcugacgcugaaccuggaggacguccagccccacgaccucggcaaggugggggaggugaucgucaccaaggacgacgcgaugcugcugaagggcaagggggacaaggcccagaucgagaagcggauccaggagaucaucgagcagcucgacgugaccacgagcgaguacgagaaggagaagcugaacgagcgccuggccaagcucuccgacggcguggccguccugaaggugggcgggaccagcgacguggaggucaacgagaagaaggaccgggugaccgacgcccugaacgcgacccgcgccgccguggaggagggcaucguccucgggggcgggugcgcccugcugcggugcaucccggcccucgacucccugacgcccgcgaacgaggaccagaagaucggcaucgagaucaucaagcgcacccugaagauccccgccaugaccaucgccaagaacgccggcguggaggggagccucaucguggagaagaucaugcagagcuccagcgaggucggcuacgacgccauggcgggggacuucgugaacaugguggagaagggcaucaucgaccccaccaaggucgugcggacggcccugcuggacgccgccggcguggcgucccuccugaccaccgccgaggucguggugaccgagaucccgaaggaggagaaggaccccgggaugggcgccaugggcgggaugggcgggggcaugggcggcgggauguucuga

SEQ ID NO: 31344 - RNA, 309 nt, Artificial Sequence
  derived and/or modified sequence opt1 from HSPE1__Homo_sapiens__NP_002148
auggccggccaggccuuccgcaaguuccugccccucuucgaccgggugcuggucgagcgcagcgcggccgagaccgugaccaagggcgggaucaugcugccggagaagucccaggggaaggugcuccaggccacggucguggccgugggcagcggguccaagggcaagggcggggagauccagcccgucagcgugaaggugggcgacaagguccugcugcccgaguacgggggcaccaagguggugcucgacgacaaggacuacuuccuguuccgggacggggacauccugggcaaguacgucgacuga

SEQ ID NO: 31345 - RNA, 13179 nt, Artificial Sequence
  derived and/or modified sequence opt1 from HSPG2__Homo_sapiens__NP_001278789
augggcuggcgcgccgccggggcgcugcuccuggcccugcuccugcacggccggcugcucgccgugacccacgggcugcgcgccuacgacggccugagccuccccgaggacaucgagaccgucacggccucccagaugcgguggacccacagcuaccuguccgacgacgaggacaugcuggcggacagcaucuccggggacgaccucggcagcggcgaccugggguccggcgacuuccagaugguguacuuccgcgcccuggugaacuucacccggagcaucgaguacuccccgcagcucgaggacgccgggagccgcgaguuccgggaggucuccgaggccgugguggacacccuggagagcgaguaccugaagauccccggcgaccaggucguguccguggucuucaucaaggagcucgacggguggguguucguggagcuggacgucggcagcgagggcaacgcggacggggcccagauccaggagaugcugcuccgcgugaucuccagcggcuccguggccagcuacgucacguccccccagggguuccaguuccggcgccugggcaccgugccccaguucccgcgggccugcaccgaggccgaguucgcgugccacagcuacaacgagugcguggcccuggaguaccgcugcgaccggcgccccgacugccgggacaugagcgacgagcucaacugcgaggagcccguccugggcaucucccccaccuucagccugcucguggagacgaccucccugccgccccgccccgagaccaccaucaugcggcagcccccggugacgcacgccccccagccccugcuccccgggagcguccgcccgcugcccugcggcccccaggaggccgccugccggaacgggcacugcaucccccgcgacuaccugugcgacggccaggaggacugcgaggacggguccgacgagcucgacugcggcccgcccccccccugcgagccgaacgaguuccccugcggcaacgggcacugcgcgcugaagcuguggcggugcgacggcgacuucgacugcgaggaccgcaccgacgaggccaacugccccaccaagcgccccgaggaggugugcgggccgacccaguuccggugcgugagcacgaacaugugcauccccgccuccuuccacugcgacgaggagagcgacugccccgaccgcuccgacgaguucggcugcaugccgccccaggucgugacccccccccgggagagcauccaggccucccgcgggcagaccgucaccuucacgugcguggccaucggcgugccgacccccaucaucaacuggcggcucaacuggggccacauccccagccacccccgcgucaccgugaccuccgaggggggccgggggacgcugaucauccgcgacgugaaggagagcgaccagggcgcguacaccugcgaggccaugaacgcccgggggauggucuucggcaucccggacggcgugcuggagcucgugccccagcgcgccgggcccugccccgacggccacuucuaccuggagcacuccgccgcgugccugccgugcuucugcuucgggaucaccagcgucugccaguccacccggcgcuuccgggaccagauccgccuccgguucgaccagcccgacgacuucaagggcgugaacgugacgaugcccgcccagcccggcaccccgccccugagcuccacccagcugcagaucgaccccagccuccacgaguuccagcuggucgaccugagccgccgguuccucgugcacgacuccuucugggcccugcccgagcaguuccuggggaacaagguggacagcuacggcgggucccugcgcuacaacguccgguacgagcucgcccgcggcaugcuggagccggugcagcgccccgacgugguccugaugggggcgggcuaccggcuccugagccgcggccacacccccacgcagcccggggcccugaaccagcggcaggugcaguucuccgaggagcacugggugcacgagagcggccgcccgguccagcgggccgagcuccugcaggugcugcagucccucgaggccgugcugauccagaccgucuacaacaccaagauggccagcguggggcuguccgacaucgcgauggacaccacggugacccacgccaccagccacggccgcgcccacuccgucgaggagugccggugccccaucggguacagcggccucuccugcgagagcugcgacgcccacuucacccgcgugcccggcgggccguaccugggcaccugcuccgggugcaacugcaacggccacgccagcuccugcgaccccguguacgggcacugccugaacugccagcacaacacggagggcccccagugcaacaagugcaaggcgggcuucuucggggacgccaugaaggccaccgccaccagcugccggcccugcccgugccccuacaucgacgccagccgccgguucuccgacaccugcuuccucgacacggacggccaggcgaccugcgacgccugcgcccccggguacaccggccgccggugcgagagcugcgcccccggguacgagggcaacccgauccagcccggcgggaagugccgccccgucaaccaggagaucgugcggugcgacgagcgcggcuccauggggaccagcggcgaggcgugccggugcaagaacaacguggucggccgccugugcaacgagugcgccgacggguccuuccaccugagcacgcggaaccccgacggcugccucaagugcuucugcaugggggugucccgccacugcaccagcuccagcuggucccgggcccagcugcacggcgccagcgaggagccggggcacuucucccugaccaacgccgcgagcacccacacgaccaacgagggcaucuucucccccacccccggcgagcucggguucagcuccuuccaccgccugcugagcggccccuacuucuggucccucccgagccgcuuccugggggacaaggugaccagcuacggcggggagcugcgguucacggucacccagcgcucccagcccggcagcaccccccuccacggccagccccugguggugcugcaggggaacaacaucauccucgagcaccacgucgcccaggagccgucccccggccagcccagcaccuucaucgugcccuuccgggagcaggccuggcagcgcccggacgggcagcccgccacgcgggagcaccugcugauggcccucgcgggcaucgacacccugcugauccgcgccuccuacgcccagcagcccgccgagagccggguguccgggaucagcauggacgucgccgugcccgaggagaccggccaggacccggcgcucgagguggagcagugcuccugcccccccggcuaccgcgggccgagcugccaggacugcgacaccggcuacacgcggacccccuccgggcuguaccugggcaccugcgagcgcugcagcugccacggccacuccgaggccugcgagcccgagaccggggccugccagggcugccagcaccacacggaggggccccggugcgagcagugccagccgggcuacuacggggacgcccagcgcggcaccccccaggacugccagcucugccccugcuacggcgaccccgcggccgggcaggccgcccacaccugcuuccuggacaccgacggccacccgacgugcgacgccugcagccccgggcacuccggccggcacugcgagcgcugcgcgcccggguacuacggcaaccccagccagggccagccgugccagcgggacucccagguccccgggcccaucggcugcaacugcgacccccaggggagcguguccagccagugcgacgccgccggccagugccagugcaaggcccagguggaggggcugaccugcagccacugccgcccgcaccacuuccaccucuccgccagcaaccccgacggcugccugcccugcuucugcaugggcaucacccagcagugcgcguccagcgccuacacccggcaccugaucuccacgcacuucgcccccggggacuuccagggcuucgcccucgucaacccgcagcgcaacagccggcugaccggggaguucaccguggagcccgugcccgagggcgcccagcuguccuucgggaacuucgcgcagcucggccacgagagcuucuacuggcagcugcccgagaccuaccagggcgacaaggucgccgccuacgggggcaagcugcgcuacacccucuccuacacggccgggccgcagggcagcccccuguccgaccccgacgugcagaucaccggcaacaacaucaugcuggucgccagccagcccgcgcuccaggggccggagcgccgguccuacgagaucauguuccgcgaggaguucuggcggcgccccgacggccagcccgccacccgggagcaccugcugauggcccucgccgaccuggacgagcugcucauccgcgcgaccuucagcuccgugccgcuggccgccagcaucuccgccgugagccuggaggucgcccagcccgggcccuccaaccggccccgcgcgcucgagguggaggagugccggugcccgcccggcuacaucgggcugagcugccaggacugcgcccccggcuacacgcgcaccggcagcgggcuguaccucggccacugcgagcugugcgagugcaacgggcacuccgaccugugccaccccgagaccggcgccugcagccagugccagcacaacgccgccggggaguucugcgagcucugcgcgccgggcuacuacggcgacgccaccgccgggacgcccgaggacugccagcccugcgccugcccccugaccaacccggagaacauguucucccggaccugcgagagccugggcgccgggggcuaccgcugcaccgcgugcgagcccggguacacgggccaguacugcgagcagugcggccccggguacgugggcaaccccuccguccaggggggccagugccucccggagaccaaccaggccccccuggugguggagguccaccccgcccggagcaucgugccccaggggggcucccacagccugcgcugccagguguccggcagcccgccccacuacuucuacuggucccgggaggacgggcgccccguccccagcggcacccagcagcggcaccagggguccgagcuccacuucccgagcgugcagcccuccgacgccggcguguacaucugcaccugccgcaaccugcaccagagcaacacgucccgggcggagcugcucgucaccgaggcccccagcaagccgaucaccgugaccguggaggagcagcgcucccagagcguccggcccggcgccgacgugacguucaucugcaccgccaagagcaagucccccgccuacacccugguguggacccgccugcacaacgggaagcuccccacgcgcgcgauggacuucaacggcauccugaccauccggaacguccagcugagcgacgccgggaccuacgugugcaccggcuccaacauguucgccauggaccaggggacggccacccuccacgugcaggccagcggcacccuguccgcgccggucgugagcauccaccccccccagcugaccgugcagcccggccagcucgccgaguuccgcugcuccgccacggggagcccgacccccacccuggaguggaccggcgggcccggcgggcagcugcccgccaaggcccagauccacggcggcauccuccggcugccggcggucgagcccacggaccaggcccaguaccugugccgcgcccacuccagcgccgggcagcagguggcgcgggccgugcuccacguccacggcgggggcgggccccgcgugcaggugucccccgagcggacccagguccacgccggccgcaccgugcggcuguacugccgcgccgccggcgugccgagcgcgaccaucaccuggcggaaggaggggggcucccugcccccccaggcccgcagcgagcggacggacaucgccacccugcucauccccgccaucaccaccgccgacgcgggguucuaccugugcgucgccacguccccggccggcaccgcccaggcccgcauccagguggugguccugagcgcguccgacgccagccccccccccgugaagaucgaguccagcagcccguccgugaccgagggccagacccucgaccugaacugcgucguggccgggagcgcccacgcccaggugacgugguaccggcgcggcgggucccugcccccccacacccagguccacggcagccggcuccgccugccccagguguccccggcggacagcggggaguacgugugccgggucgagaacggcuccggccccaaggaggccagcaucaccguguccgugcugcacgggacccacagcggccccuccuacacgccgguccccgggagcacccgccccauccgcaucgagcccuccagcucccacguggccgagggccagacccucgaccugaacugcgucgugccggggcaggcccacgcgcaggugaccuggcacaagcggggcggcagccugcccgcccgccaccagacgcacgggucccuccugcggcugcaccaggucacccccgccgacagcggcgaguacgugugccacguggucgggaccagcggcccccucgaggccuccgugcuggugaccaucgaggccagcgucaucccggggcccaucccccccgugcgcaucgaguccagcuccagcacgguggcggagggccagacccuggaccucuccugcgucguggccggccaggcccacgcccaggugaccugguacaagcgggggggcagccugccggcccgccaccagguccgggggucccgccuguacaucuuccaggcgagccccgccgacgccggccaguacgugugccgggccuccaacgggauggaggccagcaucaccgugacggucaccggcacccagggcgcgaaccucgccuaccccgccggguccacccagcccauccgcaucgagccgagcuccagccagguggccgagggccagacgcuggaccugaacugcgugguccccgggcagucccacgcgcaggugaccuggcacaagcggggcggcagccuccccgugcgccaccagacccacgggucccugcugcggcucuaccaggccagccccgccgacagcggcgaguacgucugccgcgugcugggguccagcgugccgcuggaggccuccguccucgugaccaucgagcccgccggcagcgugcccgcgcugggggucacgcccaccgugcggaucgaguccagcuccagccagguggccgagggccagacccuggaccucaacugccuggucgccggccaggcccacgcccaggugaccuggcacaagcgcgggggcucccugccggcgcggcaccaggugcacgggagccgccuccggcugcugcaggucacgcccgccgacuccggcgaguacgugugccgcguggucgggagcuccggcacccaggaggccagcgugcucgugaccauccagcagcggcuguccggcagccacucccagggggucgccuaccccgugcgcaucgagagcuccagcgccagccuggcgaacggccacacccucgaccugaacugccugguggccucccaggccccccacacgaucaccugguacaagcgcgggggcagccucccgucccggcaccagaucgucgggagccgccugcggaucccccaggugacccccgccgacuccggcgaguacgugugccacgucagcaacggcgcggggucccgcgagaccagccugaucgugaccauccagggcuccgggagcucccacgugccgagcgucuccccccccauccggaucgagagcuccagccccacgguggucgagggccagacccucgaccugaacugcgugguggcccgccagccgcaggccaucaucaccugguacaagcggggcgggucccugcccagccgccaccagacccacggcucccaccuccggcugcaccagaugagcgucgccgacagcggggaguacgugugccgcgccaacaacaacaucgacgcgcuggaggccuccaucgugaucagcgucucccccagcgccggcucccccagcgccccgggguccagcaugcccauccggaucgaguccagcuccagccacguggccgagggcgagacgcucgaccugaacugcgugguccccggccaggcgcacgcccaggugaccuggcacaagcgcgggggcucccugcccagccaccaccagacccgggggucccgccuccggcugcaccacgugagcccggccgacuccggcgaguacgucugccgcgugauggggagcuccggcccccuggaggccagcgugcucgucaccaucgaggccagcggcuccagcgcggugcacgugcccgcccccgggggcgccccgcccauccggaucgagcccuccagcucccgcgucgccgaggggcagacgcuggaccugaagugcguggugcccggccaggcccacgcgcaggucaccuggcacaagcgggggggcaaccucccggcccgccaccaggugcacggcccccugcugcgccucaaccaggugagccccgccgacuccggggaguacagcugccaggucaccggcuccagcgggacccuggaggccuccgugcuggugacgaucgagcccagcuccccgggccccauccccgcgcccgggcucgcccagccgaucuacaucgaggccagcuccagccacgucaccgagggccagacccuggaccugaacugcguggugcccggccaggcccacgcccaggucaccugguacaagcgggggggcucccuccccgcgcgccaccagacgcacgggagccagcugcggcugcaccucguguccccggccgacagcggcgaguacgugugccgcgccgccagcggccccgggcccgagcaggaggccuccuucaccgucaccgugcccccgagcgagggcuccagcuaccggcugcgcucccccgugaucagcaucgacccccccuccagcaccguccagcaggggcaggacgcguccuucaagugccugauccacgacggcgccgccccgaucagccucgaguggaagacgcggaaccaggagcuggaggacaacgugcacaucucccccaacgggagcaucaucaccaucgugggcacccgccccuccaaccacggcaccuaccggugcgucgccagcaacgccuacgggguggcgcaguccguggucaaccugagcgugcacggccccccgacgguguccguccuccccgaggggcccgugugggugaaggucggcaaggccgugacccuggagugcgugagcgccggggagccccgcagcuccgcccgguggacccgcaucagcuccaccccggcgaagcuggagcagcggacguacggccucauggacagccacgccguccugcagaucuccagcgccaagcccuccgacgccggcaccuacgugugccuggcccagaacgcgcucgggaccgcccagaagcaggucgaggugaucguggacaccggcgccauggcccccggggccccccagguccaggcggaggaggccgagcugacgguggaggccggccacaccgccacccugcgcugcagcgccaccggguccccggcgcccacgauccacuggagcaagcuccgguccccccugcccuggcagcaccgccuggagggcgacacccucaucaucccgcggguggcccagcaggacagcggccaguacaucugcaacgccaccucccccgccgggcacgccgaggcgaccaucauccugcacgucgagagccccccguacgccaccacggugcccgagcacgccuccgugcaggccggcgagaccguccagcugcagugccucgcgcacgggacccccccccugaccuuccaguggagccgcgugggcuccagccugccgggccgggccacggcccgcaacgagcuccugcacuucgagcgggccgcccccgaggacuccgggcgcuaccgcugccgggugaccaacaaggucggcagcgcggaggccuucgcccagcugcuggugcaggggccccccggcagccucccggccaccuccauccccgccgggagcacccccacggugcaggucaccccccagcuggagaccaaguccaucggcgcgagcguggaguuccacugcgccgugccguccgaccgcggcacccagcugcggugguucaaggaggggggccagcucccccccgggcacagcguccaggacggcgugcugcgcauccagaaccuggaccaguccugccaggggacguacaucugccaggcccacggccccuggggcaaggcccaggccagcgcgcagcucgugauccaggcccugccguccguccugaucaacauccggaccagcgugcagaccguggucguggggcacgccguggaguucgagugccucgcccugggcgaccccaagccccaggucaccugguccaagguggggggccaccugcgccccgggaucgugcagagcggcggcgucgugcggaucgcgcacguggagcucgccgacgccgggcaguaccgcugcacggccaccaacgccgcgggcaccacccagucccacguccugcugcucgugcaggcccugccgcagaucagcaugccccaggaggugcggguccccgccggguccgccgccguguuccccugcaucgcgagcggcuacccgacgcccgacaucuccuggagcaagcuggacgggucccucccccccgacagccgccuggagaacaacaugcugaugcucccgagcgugcggccccaggacgccggcaccuacgucugcaccgccaccaaccgccagggcaaggugaaggccuucgcccaccugcaggugcccgagcgggucgugccguacuucacgcagacccccuacuccuuccugccccuccccaccaucaaggacgcguaccgcaaguucgagaucaagaucaccuuccggccggacagcgccgacgggaugcugcuguacaacggccagaagcgcgugcccgggucccccacgaaccucgccaaccggcagcccgacuucaucagcuucggccuggucggcgggcgcccggaguuccgguucgacgccggcuccgggauggcgaccauccgccaccccaccccccuggcccucggccacuuccacaccgugacgcugcugcgcagccucacccaggggucccugaucgugggcgaccuggcccccgucaacggcaccagccaggggaaguuccagggccucgaccugaacgaggagcuguaccucgggggcuacccggacuacggggccauccccaaggccggccuguccagcggcuucaucgggugcgugcgggagcugcgcauccagggcgaggagaucguguuccacgaccucaaccugaccgcgcacgggaucucccacugccccacgugccgggaccgccccugccagaacggcgggcagugccacgacagcgaguccagcuccuacgucugcgugugcccggccggcuucaccggcagccggugcgagcacucccaggcccugcacugccaccccgaggccugcgggcccgacgccaccugcgucaaccgccccgacggccggggguacaccugccgcugccaccucggccggagcgggcugcgcugcgaggagggcgugaccgugacgaccccgucccugagcggcgcggggagcuaccucgcccugcccgcccugaccaacacccaccacgagcuccggcuggacgucgaguucaagccccuggcccccgacggcgugcuccuguucuccgggggcaagagcggcccgguggaggacuucgucucccuggccaugguggggggccaccucgaguuccgcuacgagcuggggagcggccuggcggugcuccgguccgccgagccccuggcccuggggcgcuggcaccgggucagcgccgagcgccucaacaaggacggcucccugcgggugaacggcgggcgccccgugcugcggagcucccccggcaagagccaggggcucaaccugcacacgcugcucuaccugggcggggucgagccguccgugccccugagccccgccaccaacauguccgcgcacuuccgcggcugcgugggcgaggucagcgugaacgggaagcggcucgaccugaccuacuccuuccugggcagccaggggaucggccagugcuacgacuccagcccgugcgagcgccagcccugccagcacggggccaccugcaugcccgccggcgaguacgaguuccagugccucugccgcgacggcuucaagggggaccugugcgagcacgaggagaaccccugccagcugcgggagccgugccuccacggcgggacgugccagggcacccgcugccugugccugcccggcuucuccgggccccggugccagcagggcagcgggcacggcaucgccgagagcgacuggcaccucgagggguccggcggcaacgacgcgcccgggcaguacggcgccuacuuccacgacgacggguuccuggccuucccgggccacguguucagccgcucccugcccgagguccccgagaccaucgagcucgaggugcggaccagcacggccuccgggcugcugcucuggcagggcguggaggucggcgaggccgggcagggcaaggacuucaucagccuggggcugcaggacggccaccucguguuccgcuaccagcugggguccggcgaggcgcggcuggugagcgaggaccccaucaacgacggcgaguggcaccgcgucaccgcccuccgggaggggcgccggggcuccauccagguggacggggaggagcuggugagcggccgcuccccggggcccaacgucgccgugaacgccaagggcagcguguacaucggcggggcccccgacgucgcgacccugaccggcgggcgguucuccagcggcaucacgggcugcgugaagaaccucgugcugcacuccgcccgccccggggccccgcccccccagccccuggaccugcagcaccgggcccaggccggcgcgaacacccgcccgugccccagcuga

SEQ ID NO: 31346 - RNA, 2445 nt, Artificial Sequence
  derived and/or modified sequence opt1 from HSPH1__Homo_sapiens__NP_001273432
augagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgaccccuucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacgccaacgagaagaagguggaccagccgcccgaggccaagaagcccaagaucaaggucgugaacguggagcuccccaucgaggccaaccuggucuggcagcuggggaaggaccuccugaacauguacaucgagacggagggcaagaugaucaugcaggacaagcuggagaaggagcgcaacgacgccaagaacgcgguggaggaguacguguacgaguuccgcgacaagcucugcgggcccuacgagaaguucaucugcgagcaggaccaccagaacuuccugcgccugcugaccgagaccgaggacuggcucuacgaggagggcgaggaccaggccaagcaggccuacgucgacaagcuggaggagcugaugaagaucggcacccccgugaaggugcgguuccaggaggccgaggagcgcccgaagauguucgaggagcucgggcagcggcugcagcacuacgccaagaucgcggccgacuuccgcaacaaggacgagaaguacaaccacaucgacgagagcgagaugaagaaggucgagaaguccgugaacgaggugauggaguggaugaacaacgucaugaacgcccaggccaagaagucccuggaccaggaccccguggugcgggcgcaggagaucaagacgaagaucaaggagcucaacaacacgugcgagcccgucgugacccagccgaagcccaagaucgagagccccaagcuggagcgcacccccaacggcccgaacaucgacaagaaggaggaggaccuggaggacaagaacaacuucggggccgagccgccccaccagaacggcgagugcuaccccaacgagaagaacagcgugaacauggaccucgacuga

SEQ ID NO: 31347 - RNA, 831 nt, Artificial Sequence
  derived and/or modified sequence opt1 from HTATIP2__Homo_sapiens__NP_001091990
auggccggccccgccgcgcugagcgccgccgccgccgcggcccucgccgccgcgcugcugcuccugcgccgggaggacccggggcccggcgccgggcccuccauggccgagaccgaggcccugagcaagcuccgcgaggacuuccggaugcagaacaaguccguguucauccugggcgccagcggggagaccggccgcguccugcucaaggagauccuggagcagggccuguucuccaaggugacgcucaucgggcggcgcaagcugaccuucgacgaggaggcguacaagaacgugaaccaggaggucguggacuucgagaagcuggacgacuacgccagcgccuuccagggccacgacgugggguucugcugccucggcaccacccgggggaaggccggcgccgagggcuucguccgcguggaccgggacuacgugcugaaguccgcggagcuggccaaggccgggggcugcaagcacuucaaccuccugagcuccaagggggccgacaagagcuccaacuuccuguaccuccaggucaagggcgagguggaggccaagguggaggagcugaaguucgaccgcuacagcgucuuccggcccggcgugcugcucugcgaccgccaggagucccggccgggggaguggcuggugcgcaaguucuucggcagccugcccgacuccugggcgagcgggcacuccguccccguggugacggucgugcgggccaugcucaacaacgugguccgcccccgggacaagcagauggagcugcuggagaacaaggccauccacgaccucggcaaggcccacgggagccugaagccguga

SEQ ID NO: 31348 - RNA, 174 nt, Artificial Sequence
  derived and/or modified sequence opt1 from HTN1__Homo_sapiens__NP_002150
augaaguucuucguguucgcccugguccucgcccugaugaucagcaugaucuccgcggacagccacgagaagcgccaccacggcuaccggcgcaaguuccacgagaagcaccacucccaccgggaguuccccuucuacggggacuacggcagcaacuaccuguacgacaacuga

SEQ ID NO: 31349 - RNA, 156 nt, Artificial Sequence
  derived and/or modified sequence opt1 from HTN3__Homo_sapiens__NP_000191
augaaguucuucguguucgcccugauccucgcccugaugcugagcaugaccggcgcggacucccacgccaagcgccaccacggguacaagcggaaguuccacgagaagcaccacagccaccgcggcuaccgguccaacuaccucuacgacaacuga

SEQ ID NO: 31350 - RNA, 1269 nt, Artificial Sequence
  derived and/or modified sequence opt1 from HTR1A__Homo_sapiens__NP_000515
auggacgugcugagccccggccaggggaacaacaccaccuccccgcccgcccccuucgagacgggcgggaacaccaccggcaucagcgacgucaccguguccuaccaggugaucacgagccuccugcuggggacccucaucuucugcgccguccugggcaacgcgugcgugguggccgccaucgcccuggagcgcucccuccagaacgucgccaacuaccugaucggcagccuggcggugaccgaccucaugguguccguccuggugcugcccauggccgcccucuaccaggugcugaacaaguggacccuggggcaggucacgugcgaccucuucaucgcccuggacgugcugugcugcaccagcuccauccuccaccugugcgcgaucgcccuggaccgguacugggccaucaccgacccgaucgacuacgugaacaagcgcacgccccggcgcgccgccgcgcucaucagccugaccuggcugaucggcuuccucaucuccaucccgcccaugcugggguggcggacccccgaggaccgcagcgaccccgacgccugcaccaucuccaaggaccacggcuacaccaucuacagcacguucggggccuucuacaucccccugcuccugaugcugguccucuacggccggaucuuccgcgccgcccgguuccgcauccggaagaccgugaagaagguggagaagaccggcgcggacacccgccacggggccucccccgccccgcagcccaagaaguccgucaacggcgagagcgggagccggaacuggcgccugggcguggaguccaaggccggcggggcccugugcgcgaacggcgccgugcggcagggggacgacggcgccgcccucgaggucaucgaggugcaccgcguggggaacagcaaggagcaccucccccugcccagcgaggccggcccgacgcccugcgcgcccgccuccuucgagcggaagaacgagcgcaacgccgaggccaagcggaagauggcgcuggcccgcgagcggaagaccgucaagacccugggcaucaucauggggaccuucauccugugcuggcuccccuucuucaucguggcccugguccugccguucugcgagagcuccugccacaugcccacgcuccugggcgccaucaucaacuggcugggguacagcaacucccuccugaaccccgugaucuacgccuacuucaacaaggacuuccagaacgcguucaagaagaucaucaagugcaaguucugccgccaguga

SEQ ID NO: 31351 - RNA, 1173 nt, Artificial Sequence
  derived and/or modified sequence opt1 from HTR1B__Homo_sapiens__NP_000854
auggaggagcccggcgcccagugcgccccgcccccgcccgcggggagcgagaccugggugccccaggccaaccuguccagcgcccccucccagaacugcagcgccaaggacuacaucuaccaggacuccaucagccuccccuggaagguccugcuggugaugcuccuggcccugaucacccucgcgacgacccuguccaacgccuucgugaucgccaccgucuaccgcacccggaagcugcacacgcccgccaacuaccucaucgcgagccuggccgugaccgaccugcucguguccauccuggucaugccgaucagcaccauguacaccgugacgggccgcuggacccugggccagguggucugcgacuucuggcucuccagcgacaucacgugcugcaccgccuccauccugcaccugugcgugaucgcccucgaccgguacugggccaucaccgacgcgguggaguacagcgccaagcgcacccccaagcgggccgccgucaugaucgcccugguguggguguucuccaucagcaucucccugccgcccuucuucuggcgccaggcgaaggccgaggaggaggucagcgagugcguggugaacaccgaccacauccucuacaccgucuacuccacggugggggccuucuacuuccccacccugcugcucaucgcccuguacgggcggaucuacguggaggcccgcagccggauccugaagcagacccccaaccgcaccggcaagcggcucacgcgcgcgcagcugaucaccgacagccccggcuccaccagcuccgucaccagcaucaacucccgggugcccgacgugccgagcgaguccgggagccccgucuacgugaaccaggucaaggugcgcguguccgacgcccugcucgagaagaagaagcugauggccgcccgggagcgcaaggccacgaagacccugggcaucauccucggggcguucaucgucugcuggcugcccuucuucaucaucagccuggugaugcccaucugcaaggacgccugcugguuccaccucgccaucuucgacuucuucaccuggcugggcuaccugaacucccucaucaacccgaucaucuacaccaugagcaacgaggacuucaagcaggccuuccacaagcugauccgguucaagugcacguccuga

SEQ ID NO: 31352 - RNA, 1098 nt, Artificial Sequence
  derived and/or modified sequence opt1 from HTR1E__Homo_sapiens__XP_011534092
augaacaucaccaacugcaccacggaggccagcauggccauccgccccaagaccaucaccgagaagaugcugaucugcaugacccucguggucaucacgacccugaccacccugcucaaccuggcggugaucauggccaucggcacgaccaagaagcugcaccagcccgccaacuaccucaucugcucccuggccgugaccgaccugcucgucgccgugcuggugaugccccugagcaucaucuacaucgucauggaccgguggaagcucggguacuuccugugcgagguguggcuguccguggacaugaccugcugcacgugcagcauccuccaccugugcgucaucgcgcuggaccgcuacugggccaucaccaacgccaucgaguacgcccggaagcgcaccgcgaagcgggccgcccucaugauccugaccguguggacgaucuccaucuucaucagcaugccgccccuguucuggcgcucccaccggcgccucagcccgccgcccucccagugcaccauccagcacgaccacgugaucuacaccaucuacagcacccugggcgccuucuacaucccccugacgcucauccugauccuguacuaccggaucuaccacgccgcgaagucccucuaccagaagcgcgggagcucccggcaccugagcaaccgcuccaccgacagccagaacuccuucgccagcugcaagcugacccagaccuucugcgucuccgacuucagcacgagcgaccccaccaccgaguucgagaaguuccacgccuccauccggaucccgcccuucgacaacgaccucgaccaccccggcgagcgccagcagaucagcuccacccgggagcgcaaggccgcccggauccuggggcugauccucggcgcguucauccugagcuggcugcccuucuucaucaaggagcucaucgugggccuguccaucuacacggugagcuccgaggucgccgacuuccugaccuggcucggguacgugaacagccugaucaacccccugcucuacaccuccuucaacgaggacuucaagcuggccuucaagaagcugauccgcugccgggagcacaccuga

SEQ ID NO: 31353 - RNA, 1101 nt, Artificial Sequence
  derived and/or modified sequence opt1 from HTR1F__Homo_sapiens__NP_000857
auggacuuccugaacagcuccgaccagaaccucaccagcgaggagcugcugaaccgcaugcccuccaagauccucgugagccugacccuguccggccucgcccugaugacgaccaccaucaacagccuggucaucgccgcgaucaucgugacccggaagcuccaccacccggccaacuaccugaucugcucccuggccgugacggacuuccucgucgccgugcuggugaugcccuucagcaucgucuacaucgugcgcgaguccuggaucaugggccagguggucugcgacaucuggcugagcguggacaucacgugcugcacgugcuccauccuccaccugagcgccaucgcgcuggaccgguaccgcgccaucaccgacgccguggaguacgcccggaagcgcacccccaagcacgcggggaucaugaucaccaucgucuggaucaucuccguguucaucagcaugcccccgcuguucuggcggcaccaggggaccucccgcgacgacgagugcaucaucaagcacgaccacaucgugagcaccaucuacuccaccuucggcgccuucuacaucccccucgcccugauccucauccuguacuacaagaucuaccgggccgccaagacccuguaccacaagcgccaggcgagccggaucgccaaggaggaggucaacggccaggugcuccuggaguccggggagaaguccaccaagagcgugagcaccagcuacguccuggagaagucccucagcgaccccuccacggacuucgacaagauccacagcaccgugcgcucccugcggagcgaguucaagcacgagaaguccuggcgccggcagaagaucagcggcacccgcgagcggaaggccgccaccacgcuggggcucauccugggcgccuucgugaucugcuggcugcccuucuucgucaaggagcucguggugaacgucugcgacaagugcaagaucuccgaggagaugagcaacuuccuggcguggcugggguaccucaacucccugaucaacccgcugaucuacaccaucuucaacgaggacuucaagaaggccuuccagaagcucgugcgcugccggugcuga

SEQ ID NO: 31354 - RNA, 1416 nt, Artificial Sequence
  derived and/or modified sequence opt1 from HTR2A__Homo_sapiens__NP_000612
auggacauccugugcgaggagaacaccagccucuccagcaccacgaacucccugaugcagcugaacgacgacacccgccucuacagcaacgacuucaacuccggcgaggccaacaccagcgacgccuucaacuggaccguggacuccgagaaccggacgaaccugagcugcgaggggugccugucccccagcugccucucccugcugcaccuccaggagaagaacuggagcgcgcugcugaccgccgucgugaucauccucaccaucgccggcaacauccuggugaucauggccgucucccuggagaagaagcuccagaacgccaccaacuacuuccugaugagccuggcgaucgccgacaugcuccugggguuccuggugaugccgguguccaugcucacgauccuguacggcuaccgcuggccccugcccagcaagcucugcgccgucuggaucuaccuggacgugcuguucuccaccgccagcaucaugcaccucugcgcgaucucccuggaccgguacguggccauccagaaccccauccaccacagccgcuucaacagccggaccaaggccuuccugaagaucaucgccgucuggaccaucuccguggggaucagcaugccgauccccguguucggccuccaggacgacuccaaggucuucaaggagggcagcugccugcuggccgacgacaacuucgugcucaucggguccuucgugagcuucuucaucccccugacgaucauggucaucaccuacuuccugaccaucaagucccuccagaaggaggcgacccugugcgugagcgaccugggcacgcgcgccaagcucgccuccuucagcuuccugccccaguccagccuguccagcgagaagcuguuccagcgguccauccaccgcgagccggggagcuacaccggccggcgcaccaugcaguccaucagcaacgagcagaaggccugcaaggugcucgggaucgucuucuuccuguucguggugauguggugccccuucuucaucaccaacaucauggccgucaucugcaaggaguccugcaacgaggacgugaucggcgcgcuccugaacguguucgucuggaucggcuaccugagcagcgccgugaacccccucgucuacacgcuguucaacaagaccuaccgguccgccuucagccgcuacauccagugccaguacaaggagaacaagaagccccugcagcugauccucgugaacaccaucccggcccuggccuacaaguccagccagcugcagauggggcagaagaagaacuccaagcaggacgcgaagaccacggacaacgacugcagcaugguggcccucggcaagcagcacuccgaggaggccagcaaggacaacuccgacggggucaacgagaaggugagcugcguguga

SEQ ID NO: 31355 - RNA, 1446 nt, Artificial Sequence
  derived and/or modified sequence opt1 from HTR2B__Homo_sapiens__NP_000858
auggcccugagcuaccgcguguccgagcuccagagcaccauccccgagcacauccugcaguccaccuucguccacgugaucagcuccaacuggagcggccugcagacggaguccaucccggaggagaugaagcagaucguggaggagcaggggaacaagcuccacugggccgcgcugcugauccucauggucaucauccccaccaucggcgggaacacccuggugauccuggccgugagccucgagaagaagcugcaguacgccaccaacuacuuccugaugucccucgccgucgccgaccugcuggugggccucuucgugaugcccaucgcgcugcugacgaucauguucgaggccauguggccccucccgcugguccugugccccgccuggcuguuccucgacgugcuguucagcaccgccuccaucaugcaccucugcgcgaucagcguggaccgguacaucgccaucaagaagcccauccaggccaaccaguacaacucccgcgccaccgccuucaucaagaucaccgucguguggcugaucagcaucgggaucgcgauccccgugccgaucaagggcaucgagacggacgucgacaaccccaacaacaucacgugcgugcugaccaaggagcgguucggcgacuucaugcuguucgggucccucgccgccuucuucacgccccuggccaucaugaucgugaccuacuuccucaccauccacgcccugcagaagaaggcguaccuggucaagaacaagcccccgcagcgccucaccuggcugaccgugagcaccguguuccagcgggacgagacccccugcuccagccccgagaaggucgccaugcuggacggcucccgcaaggacaaggcccuccccaacagcggggacgagacccugaugcggcgcaccagcacgaucggcaagaaguccgugcagaccaucagcaacgagcagcgggccuccaaggugcuggggaucgucuucuuccucuuccugcugauguggugcccguucuucaucaccaacaucacccucgugcugugcgacagcugcaaccagacgacccugcagaugcuccuggagaucuucgucuggaucggcuacguguccagcggcgugaacccccuggucuacacccucuucaacaagaccuuccgcgacgccuucgggcgguacaucacgugcaacuaccgcgcgaccaaguccgugaagacccugcggaagcgcagcuccaagaucuacuuccggaaccccauggccgagaacagcaaguucuucaagaagcacggcauccgcaacgggaucaaccccgccauguaccaguccccgaugcggcugcgcagcuccaccauccagagcuccagcaucauccugcucgacacgcugcugcucaccgagaacgagggcgacaagaccgaggagcaggucuccuacguguga

SEQ ID NO: 31356 - RNA, 1377 nt, Artificial Sequence
  derived and/or modified sequence opt1 from HTR2C__Homo_sapiens__NP_001243689
auggugaaccugcgcaacgccguccacagcuuccucgugcaccugaucggccugcucguguggcagugcgacaucuccgucagccccguggccgcgaucgugaccgacaucuucaacaccuccgacgggggccgguucaaguucccggacgggguccagaacuggcccgcccugagcaucgugaucaucaucaucaugacgaucggcgggaacauccuggugaucauggccgucuccauggagaagaagcuccacaacgccaccaacuacuuccugaugagccuggccaucgcggacaugcucgugggccugcuggugaugccccucucccugcuggccauccucuacgacuacgucuggccccugccgcgcuaccugugccccguguggaucagccucgacgugcuguucuccaccgccagcaucaugcaccugugcgccaucucccucgaccgguacgucgcgauccgcaaccccaucgagcacagccgguucaacucccgcaccaaggccaucaugaagaucgccaucgugugggccaucagcaucggcguguccguccccaucccggugaucgggcugcgggacgaggagaagguguucgucaacaacacgaccugcgugcugaacgaccccaacuucgugcucaucggcagcuucgucgccuucuucaucccccugaccaucauggugaucaccuacugccugacgaucuacguccuccgccggcaggcgcugaugcugcuccacgggcacaccgaggagcccccgggccugucccuggacuuccucaagugcugcaagcgcaacaccgccgaggaggagaacagcgccaaccccaaccaggaccagaacgcccggcgccggaagaagaaggagcgccggccccgcgggaccaugcaggccaucaacaacgagcggaaggcguccaaggugcugggcaucguguucuucgucuuccugaucauguggugccccuucuucaucacgaacauccucagcgugcugugcgagaaguccugcaaccagaagcugauggagaagcuccugaacguguucgucuggaucggcuacgugugcagcgggaucaacccgcugguguacacccucuucaacaagaucuaccgccgggccuucagcaacuaccugcgcugcaacuacaaggucgagaagaagccgcccgugcggcagaucccccgcguggccgccaccgcccuguccggccgcgagcucaacgucaacaucuaccggcacaccaacgagcccgugaucgagaaggcgagcgacaacgagcccgggaucgagaugcaggucgagaaccuggagcugcccgugaaccccuccagcgugguguccgagcgcaucagcuccgucuga

SEQ ID NO: 31357 - RNA, 1455 nt, Artificial Sequence
  derived and/or modified sequence opt1 from HTR3A__Homo_sapiens__NP_000860
augcugggcaagcucgccaugcugcugugggugcagcaggcccuccuggcgcugcuccugcccacccugcucgcccagggggaggcccgccggagccgcaacaccacgcggccggcccugcugcgccucuccgacuaccugcugaccaacuaccggaagggcguccgccccgugcgggacuggcgcaagcccaccaccgugagcaucgacgucaucguguacgccauccucaacguggacgagaagaaccagguccugacgaccuacaucugguaccggcaguacuggaccgacgaguuccugcaguggaaccccgaggacuucgacaacaucaccaagcucuccaucccgacggacagcaucugggugcccgacauccugaucaacgaguucguggacgucgggaagucccccaacauccccuacguguacauccgccaccagggcgaggugcagaacuacaagccgcugcaggucgugaccgcgugcagccucgacaucuacaacuuccccuucgacgugcagaacugcucccugaccuucaccagcuggcugcacacgauccaggacaucaacaucucccucuggcggcugcccgagaaggucaagagcgaccgcuccguguucaugaaccagggggagugggagcugcucggcgugcugcccuacuuccgggaguucagcauggaguccagcaacuacuacgccgagaugaaguucuacgucgugauccgccggcgcccgcuguucuacguggucucccuccugcugcccagcaucuuccucauggugauggacaucgugggcuucuaccugccccccaacuccggggagcgggucagcuucaagaucacccugcuccugggcuacuccguguuccugaucaucgucagcgacacccucccggccaccgccaucgggacgccccugaucggcguguacuucguggucugcauggcgcugcucgugaucagccuggccgagaccaucuucaucgugcgccugguccacaagcaggaccuccagcagcccgugcccgccuggcugcggcaccuggugcucgagcgcaucgccuggcugcugugccugcgggagcaguccaccagccagcgcccgcccgccaccucccaggcgacgaagaccgacgacugcagcgccauggggaaccacugcucccacaugggcggcccccaggacuucgagaagagcccccgcgaccggugcuccccgcccccccccccgcgcgaggccagccucgccgucugcgggcugcugcaggagcucuccagcauccggcaguuccuggagaagcgcgacgagauccgggagguggcccgcgacuggcugcgggugggcuccguccucgacaagcugcuguuccacaucuaccuccuggcggugcuggccuacagcaucacccucgugaugcugugguccaucuggcaguacgccuga

SEQ ID NO: 31358 - RNA, 1326 nt, Artificial Sequence
  derived and/or modified sequence opt1 from HTR3B__Homo_sapiens__NP_006019
augcugagcuccgugauggcgccccucugggccugcauccuggucgccgccggcauccuggccaccgacacccaccacccgcaggacagcgcccucuaccaccuguccaagcagcugcuccagaaguaccacaaggaggugcgccccguguacaacuggacgaaggccaccaccgucuaccuggaccuguucgugcacgcgauccucgacguggacgccgagaaccagauccugaagaccagcgucugguaccaggagguguggaacgacgaguuccuguccuggaacagcuccauguucgacgagauccgggagaucagccucccccuguccgccaucugggcccccgacaucaucaucaacgaguucguggacaucgagcgcuacccggaccugcccuacgucuacgugaacagcuccgggacgaucgagaacuacaagcccauccagguggucagcgcgugcucccucgagaccuacgccuuccccuucgacgugcagaacugcagccugaccuucaaguccauccugcacaccguggaggacgucgaccucgccuuccugcggagcccggaggacauccagcacgacaagaaggccuuccugaacgacuccgagugggagcuccugagcguguccagcacguacagcauccugcaguccagcgccggcggguucgcgcagauccaguucaacguggucaugcgccggcacccccucguguacguggucucccugcugauccccagcaucuuccucaugcugguggaccugggcuccuucuaccugcccccgaacugccgcgcccggaucguguucaagaccagcguccucgugggguacaccgucuuccgcgugaacauguccaaccaggugccccggagcgucggcuccacgccccugaucggccacuucuucaccaucugcauggccuuccucgugcugagccuggccaaguccaucgugcucgucaaguuccugcacgacgagcagcgcgggggccaggagcagcccuuccugugccuccgcggggacaccgacgccgaccggccgcggguggagccccgcgcgcagcgggccguggucaccgagagcucccuguacggcgagcaccuggcccagcccgggacccucaaggagguguggagccagcugcaguccaucagcaacuaccugcagacgcaggaccagaccgaccagcaggaggccgaguggcucgugcugcugucccgcuucgaccggcuccuguuccagagcuaccuguucaugcugggcaucuacaccaucacccucugcucccugugggcccuguggggcggggucuga

SEQ ID NO: 31359 - RNA, 1344 nt, Artificial Sequence
  derived and/or modified sequence opt1 from HTR3C__Homo_sapiens__NP_570126
auggagggcggguggcccgcccgccagagcgcccugcucugccugaccgugucccugcuccugcagggccgcggggacgcguucaccaucaacugcagcggcuucgaccagcacggggucgacccggccguguuccaggccguguucgaccggaaggccuuccggcccuucacgaacuacuccauccccacccgcgucaacaucagcuucacccuguccgccauccucggcguggacgcgcagcugcagcugcucaccagcuuccuguggauggaccuggugugggacaaccccuucaucaacuggaacccgaaggagugcgucggcaucaacaagcucacggugcuggccgagaaccuguggcuccccgacaucuucaucguggaguccauggacgucgaccagacccccagcgggcugaccgccuacaucuccagcgagggccggaucaaguacgacaagcccaugcgcgugaccuccaucugcaaccuggacaucuucuacuucccguucgaccagcagaacugcacguucaccuucagcuccuuccucuacaccguggacagcaugcugcuggggauggacaaggaggucugggagaucaccgacacgucccggaaggugauccagacccagggcgagugggagcuccuggggaucaacaaggccacccccaagaugagcaugggcaacaaccuguacgaccagaucauguucuacguggcgauccgccggcgccccucccucuacaucaucaaccugcugguccccagcuccuuccucguggccaucgacgcccugagcuucuaccugccggccgagagcgagaaccgggcccccuucaagaucacccuccugcugggcuacaacguguuccuccugaugaugaacgaccugcuccccgcguccgggacgccccugaucagcgucuacuucgcccugugccucucccugaugguggugagccugcucgagaccgucuucaucaccuaccugcugcacguggccaccacgcagccgccgcccaugccccgcuggcuccacucccugcugcuccacugcaccagccccggccggugcugccccaccgcgccccagaaggggaacaagggccugggccugacccugacgcaccuccccgggccgaaggagcccggcgagcuggccgggaagaagcugggcccccgcgagaccgagcccgacgggggcuccggcuggaccaagacccagcucauggagcugugggugcaguucagccacgccauggacacgcugcuguuccggcuguaccuccucuucauggccuccagcauccugaccgucaucgugcuguggaacaccuga

SEQ ID NO: 31360 - RNA, 1215 nt, Artificial Sequence
  derived and/or modified sequence opt1 from HTR3D__Homo_sapiens__NP_001138615
auggagcgcggcugguuccacgggaagggcuuccugcucggguucauccugcaccuccuccugcaggacagccaccuccagcucgugaccuccuuccuguggcugaacauguggaaccccgacgagugcggcgggaucaagaaguccggcauggccaccgagaaccucuggcugagcgacgucuucaucgaggagagcguggaccagacgccggccggccugauggcguccaugagcaucgugaaggccaccuccaacaccaucagccagugcgggugguccgccagcgccaacuggacccccuccaucagccccuccauggaccggggcgagcgcagccccuccgcccucagcccgacgcaggucacccgggcguggcgccggaugucccgcagcuuccagauccaccaccggaccuccuuccgcacccggcgcgagugggugcugcuggggauccagaagcggacgaucaaggugaccgucgccaccaaccaguacgagcaggccaucuuccacguggccauccgccggcgcugccggcccagccccuacguggucaacuuccucgugcccagcggcauccugaucgcgaucgacgcccuguccuucuaccucccgcuggagagcgggaacugcgcccccuucaagaugaccgugcugcucggcuacuccgucuuccugcugaugaugaacgaccuccugcccgccacgagcaccuccagccacgccucccuggugcgcccccacccgagccgggaccagaagcgcggcguguacuucgcgcucugccugucccugauggucgggagccuccuggagaccaucuucaucacccaccuccugcacguggccacgacccagccccugccccugccccgguggcuccacucccugcugcuccacugcaccggccaggggcgcugcugcccgaccgcgccccagaagggcaacaagggccccgggcugacgcccacccaccucccgggcgugaaggagcccgaggucagcgccgggcagaugcccggccccggggaggccgagcugaccggcggcuccgaguggacccgggcccagcgcgagcacgaggcccagaagcagcacagcguggagcugugggugcaguucucccacgccauggacgcccugcuguuccgccuguaccugcuguucauggccagcuccaucaucacggucaucugccuguggaacaccuga

SEQ ID NO: 31361 - RNA, 1371 nt, Artificial Sequence
  derived and/or modified sequence opt1 from HTR3E__Homo_sapiens__NP_001243542
auggagggcagcugguuccaccgcaagcgguucuccuucuaccugcuccugggguuccugcuccagggccgcggggugaccuucaccaucaacugcagcggcuucgggcagcacggcgccgaccccacggcccugaacuccgucuucaaccggaagccguuccgccccgugaccaacaucagcgugcccacccaggucaacaucuccuucgcgaugagcgccauccuggacgugaacgagcagcuccaccuccuguccagcuuccuguggcuggagauggugugggacaaccccuucaucuccuggaacccggaggagugcgagggcaucaccaagaugagcauggccgccaagaaccuguggcuccccgacaucuucaucaucgagcugauggacgucgacaagacgcccaaggggcugaccgccuacguguccaacgagggccggauccgcuacaagaagcccaugaagguggacagcaucugcaaccucgacaucuucuacuucccguucgaccagcagaacugcacccugaccuucuccagcuuccuguacacggucgacuccaugcuccuggacauggagaaggaggugugggagaucaccgacgcgagccggaacauccugcagacccacggggagugggagcuccugggccuguccaaggccaccgccaagcucagccgcgggggcaaccuguacgaccagaucguguucuacgucgccauccggcgccggcccucccuguacgugaucaaccuccuggugcccagcggcuuccuggucgcgaucgacgcccucagcuucuaccugcccgugaaguccgggaaccgcgugccguucaagaucacgcugcuccugggcuacaacgucuuccugcucaugaugagcgaccugcugcccaccuccgggacgccccucaucggcguguacuucgcccugugccugagccucauggugggcucccugcuggagaccaucuucaucacccaccuccugcacgucgccaccacccagcccccgccccugccccgguggcuccacagccugcugcugcacugcaacucccccgggcgcugcugcccgaccgcgccccagaaggagaacaagggccccgggcucacgcccacccaccucccgggcgugaaggagcccgaggugagcgccgggcagaugcccggccccgccgaggccgagcugaccggcggguccgaguggacccgggcccagcgcgagcacgaggcccagaagcagcacagcgucgagcuguggcugcaguucucccacgcgauggacgccaugcuguuccggcucuaccugcuguucauggccagcuccaucaucacggugaucugccucuggaacaccuga

SEQ ID NO: 31362 - RNA, 1167 nt, Artificial Sequence
  derived and/or modified sequence opt1 from HTR4__Homo_sapiens__NP_000861
auggacaagcuggacgccaacgugagcuccgaggagggcuucgggagcgucgagaagguggugcuccugaccuuccuguccaccgucauccucauggccauccugggcaaccugcucgugaugguggcggucugcugggaccgccagcugcggaagaucaagacgaacuacuucaucgugagccuggccuucgccgaccuccugguguccguccuggugaugcccuucggggccaucgagcucgugcaggacaucuggaucuacggcgaggucuucugccuggugcgcaccagccuggacgugcuccugaccaccgccuccaucuuccaccugugcugcaucagccucgaccgguacuacgcgaucugcugccagccgcuggucuaccgcaacaagaugacgccccugcggaucgcccucaugcucgggggcugcugggugauccccaccuucaucuccuuccugcccaucaugcagggcuggaacaacaucgggaucaucgaccugaucgagaagcgcaaguucaaccagaacagcaacuccaccuacugcguguucauggucaacaagccguacgccaucacgugcagcgugguggccuucuacauccccuuccugcugaugguccucgcguacuaccggaucuacgugaccgccaaggagcacgcccaccagauccagaugcugcagcgcgccggcgccuccagcgagucccggccccagagcgcggaccagcacuccacccaccgcaugcggaccgagaccaaggccgccaagacgcugugcaucaucauggggugcuucugccucugcugggcccccuucuucgugaccaacaucgucgacccguucaucgacuacaccgugcccggccaggucuggaccgccuuccuguggcugggguacaucaacagcggccucaaccccuuccuguacgcguuccugaacaaguccuuccgccgggccuuccucaucauccugugcugcgacgacgagcgcuaccggcgccccagcauccugggccagacggugccgugcagcaccaccaccaucaacggguccacgcacgugcuccgggacgccgucgagugcggcgggcagugggagagccagugccacccgcccgccaccagcccccugguggccgcgcagcccuccgacaccuga

SEQ ID NO: 31363 - RNA, 1074 nt, Artificial Sequence
  derived and/or modified sequence opt1 from HTR5A__Homo_sapiens__NP_076917
auggaccugcccgugaaccucaccagcuucucccugagcaccccgagcccccuggagacgaaccacagccucggcaaggacgaccugcgccccuccagcccccugcucuccgucuucggggugcugauccugacccuccugggcuuccugguggccgccaccuucgcguggaaccuccugguccuggccaccauccuccgggugcgcacguuccaccgggugccgcacaaccuggucgccagcauggccguguccgacgugcuggucgccgcgcucgugaugccccugagccuggugcacgagcucuccgggcgccgguggcagcugggccgccggcugugccagcucuggaucgccugcgacguccugugcugcaccgccagcaucuggaacgugaccgccaucgcgcuggaccgcuacugguccaucacccggcacauggaguacacgcuccgcacccggaagugcgugagcaacgucaugaucgcccugaccugggcccuguccgccgugaucagccucgcgccccugcuguucggguggggcgagaccuacuccgagggcagcgaggagugccaggugucccgcgagcccagcuacgccgucuucagcacggugggggccuucuaccucccgcugugcgugguccuguucguguacuggaagaucuacaaggccgccaaguuccgggugggcucccgcaagaccaacagcgucucccccaucagcgaggccguggaggucaaggacuccgcgaagcagccccagaugguguucaccgugcggcacgccaccgucacguuccagcccgagggggacaccuggcgcgagcagaaggagcagcgggccgcccucauggugggcauccugaucgggguguucguccugugcuggaucccguucuuccucaccgagcugaucagcccccugugcuccugcgacauccccgccaucuggaaguccaucuuccucuggcugggcuacuccaacagcuucuucaacccccugaucuacaccgcguucaacaagaacuacaacuccgccuucaagaacuucuucagccgccagcacuga

SEQ ID NO: 31364 - RNA, 1338 nt, Artificial Sequence
  derived and/or modified sequence opt1 from HTR7__Homo_sapiens__NP_000863
augauggacgugaacagcuccggccgccccgaccuguacgggcaccuccggagcuuccugcugccggaggucggccgcgggcuccccgaccugucccccgacggcggggccgaccccguggccggcagcugggcgccgcaccuccucuccgaggugaccgccagccccgcccccaccugggacgcgcccccggacaacgccuccggcugcggggagcagaucaacuacggccgggucgagaagguggugaucgggagcauccugacgcugaucacccuccugaccaucgccggcaacugccuggucgugaucuccgugugcuucgucaagaagcuccgccagcccagcaacuaccugaucgugucccuggcccucgccgaccugagcguggccgucgcggugaugcccuucguguccgucaccgaccugaucgggggcaaguggaucuucggccacuucuucugcaacguguucaucgccauggacgugaugugcugcacggccagcaucaugacccucugcgucaucuccaucgaccgguaccuggggaucacccgcccccugaccuacccggugcggcagaacggcaagugcauggccaagaugauccucagcguguggcugcuguccgccagcaucacgcucccgccccuguucgggugggcgcagaacgucaacgacgacaaggugugccugaucucccaggacuucggcuacaccaucuacagcaccgccguggccuucuacauccccaugagcgucaugcuguucauguacuaccagaucuacaaggccgcccgcaaguccgcggccaagcacaaguuccccggcuucccccggguggagcccgacagcgucaucgcccugaacgggaucgugaagcugcagaaggagguggaggagugcgccaaccucucccgccugcugaagcacgagcggaagaacaucagcaucuucaagcgcgagcagaaggccgcgaccacgcucggcaucaucgucggggccuucaccgugugcuggcugcccuucuuccugcucuccaccgcccggccguucaucugcggcaccagcugcuccugcaucccccuguggguggagcgcacguuccuguggcucggguacgccaacagccugaucaaccccuucaucuacgccuucuucaaccgggaccugcgcaccaccuaccggucccuccugcagugccaguaccgcaacaucaaccggaagcugagcgcggccggcaugcacgaggcccucaagcuggccgagcgccccgagcggccggaguucguccugcagaacgcggacuacugccgcaagaagggccacgacuccuga

SEQ ID NO: 31365 - RNA, 1443 nt, Artificial Sequence
  derived and/or modified sequence opt1 from HTRA1__Homo_sapiens__NP_002766
augcagaucccccgcgccgcccugcucccgcugcugcuccugcugcucgcggcccccgccagcgcccagcugucccgggccggccgcagcgcgccccuggccgccgggugccccgaccggugcgagccggcccgcugcccgccccagcccgagcacugcgagggcgggcgggcgcgcgacgccugcggcugcugcgaggugugcggggcccccgagggcgccgccugcggccuccaggaggggcccugcggcgaggggcugcagugcgucgugcccuucggcgugcccgcguccgccaccguccggcgccgggcccaggccgggcugugcgugugcgccagcuccgagccggugugcggcagcgacgcgaacaccuacgccaaccucugccagcugcgcgccgccucccggcgcagcgagcggcugcaccgcccgcccgucaucgugcuccagcggggcgccugcgggcagggccaggaggaccccaacucccugcgccacaaguacaacuucaucgcggacguggucgagaagaucgcccccgccguggugcacaucgagcuguuccggaagcuccccuucagcaagcgcgagguccccguggccuccgggagcggcuucaucguguccgaggacggccugaucgucacgaacgcccacguggugaccaacaagcaccgggucaagguggagcugaagaacggggcgaccuacgaggccaagaucaaggacguggacgagaaggccgacaucgcccucaucaagaucgaccaccagggcaagcugcccguccugcuccuggggcgcagcuccgagcugcggccgggcgaguucgugguggcgaucgggagccccuucucccuccagaacaccgucacgaccggcaucgugagcaccacccagcgcggcgggaaggagcugggccugcgcaacuccgacauggacuacauccagacggacgccaucaucaacuacgggaacagcggcgggccccucgucaaccuggacggcgaggugaucggcaucaacacccugaaggugaccgccgggaucagcuucgccauccccuccgacaagaucaagaaguuccucaccgagagccacgaccggcaggccaagggcaaggcgaucacgaagaagaaguacaucgggauccgcaugaugucccugaccagcuccaaggccaaggagcugaaggaccggcaccgcgacuucccggacgucaucagcggcgccuacaucaucgaggugauccccgacacccccgccgaggccgggggccucaaggagaacgacgugaucaucuccaucaacggccagagcgucguguccgcgaacgacgugagcgacgucaucaagcgggaguccacccugaacaugguggugcgccgggggaacgaggacaucaugaucacggucauccccgaggagaucgacccguga

SEQ ID NO: 31366 - RNA, 1377 nt, Artificial Sequence
  derived and/or modified sequence opt1 from HTRA2__Homo_sapiens__NP_037379
auggccgcgccccgcgccggccgcggggccggcuggagccugcgggccuggcgggcccucgggggcauccgcugggggcggcgcccgcggcugacccccgaccugcgcgcccuccugaccuccggcacgagcgacccccgggcgcgcgugaccuacggcacccccucccugugggcccggcucagcgucggggugaccgagccgcgcgccugccugacguccggcacccccgggccccgggcccagcugaccgcggugacccccgacacgcgcacccgggaggccagcgagaacuccggcacccgcagccgggccuggcucgccgucgcccugggggcgggcggcgccgugcugcuccugcuguggggcggcgggcgcgggccgcccgccgugcucgccgccguccccuccccgccgcccgcgagcccccggucccaguacaacuucaucgccgacgugguggagaagaccgcccccgccgucguguacaucgagauccuggaccgccaccccuuccugggccgggaggugcccaucagcaacggguccggcuucgucguggccgcggacgggcucaucgugacgaacgcccacgucguggccgaccgccgccgggugcgcguccggcugcugagcggcgacaccuacgaggccguggugaccgccgucgaccccguggcggacaucgccacccuccgcauccagacgaaggagccccugccgacccugccccucgggcgguccgccgacgugcgccagggcgaguucgucguggccaugggcagccccuucgcgcugcagaacaccaucaccuccgggaucgucagcuccgcccagcggcccgcccgcgaccugggccucccgcagacgaacguggaguacauccagaccgacgccgccaucgacuucgggaacagcggcgggccccuggugaaccuggacggcgaggucaucggcgugaacaccaugaaggugaccgcggggaucagcuucgccauccccuccgaccggcuccgcgaguuccugcaccggggcgagaagaagaacagcuccagcgggaucuccggcagccagcgccgguacaucggggucaugaugcugacgcucucccccagcauccuggccgagcugcagcuccgcgagccguccuuccccgacgugcagcacggcgugcugauccacaaggucauccugggcagccccgcccaccgggccgggcuccgcccgggcgacgugauccuggcgaucggggagcagauggugcagaacgccgaggacgucuacgaggccgugcggacccagucccagcuggccgugcagauccgccggggccgcgagacccucacccuguacgucacgcccgaggugaccgaguga

SEQ ID NO: 31367 - RNA, 1074 nt, Artificial Sequence
  derived and/or modified sequence opt1 from HTRA3__Homo_sapiens__NP_001284488
augcaggcccgcgcccugcuccuggcggcccuggccgcccucgcccuggcgcgggagcccccggccgcccccugccccgcccgcugcgacgugagccggugccccuccccgcgcugccccggcggguacguccccgaccugugcaacugcugccucgugugcgcggccagcgagggcgagcccugcgggggcccgcuggacucccccugcggggagagccuggagugcgugcggggccucugccgcugccgguggucccacgccgucugcggcaccgacgggcacaccuacgccaacgugugcgcccugcaggcggccagccgccgggcccugcagcucuccggcacgcccgugcgccagcugcagaagggggccugcccccugggccuccaccagcugagcuccccgcgguacaaguucaacuucaucgccgacgucguggagaagaucgcgcccgccgugguccacaucgagcuguuccuccgccacccccuguucgggcggaacgugccccugagcuccggcagcggcuucaucauguccgaggccgggcucaucaucaccaacgcccacguggucagcuccaacagcgccgcgccgggccgccagcagcugaaggugcagcugcagaacggggacuccuacgaggccaccaucaaggacaucgacaagaaguccgacaucgccaccaucaagauccaccccaagaagaagcuccccgugcugcugcucggccacagcgccgaccugcggcccggcgaguucgucguggccaucgggagcccguucgcgcugcagaacacggugaccaccggcaucgucagcaccgcccagcgcgaggggcgggagcucggccugcgcgacuccgacauggacuacauccagacggacgccaucaucaacuacgggaacagcggcggcccccuggugaaccucgacggggaggugaucggcaucaacacccugaaggucaccgccgggaucuccuucgcgauccccagcgaccggaucacccgcuuccugacggaguuccaggacaagcagaucaaggcccccucccucgccgugcacuga

SEQ ID NO: 31368 - RNA, 1431 nt, Artificial Sequence
  derived and/or modified sequence opt1 from HTRA4__Homo_sapiens__NP_710159
augauccgcccccagcugcggaccgccggccucgggcgcugccugcugccgggccuccugcugcuccuggugcccguccugugggccggggcggagaagcuccacacccagcccagcugccccgccgugugccagccgacgcggugccccgcccugccgaccugcgcccugggcaccacccccguguucgaccucugccgcugcugccgggucugccccgccgcggagcgcgaggugugcgggggcgcccagggccagcccugcgcccccgggcugcagugccugcagccccuccggccgggcuuccccuccacgugcgggugccccacccugggcggggccgugugcggcagcgaccgccggaccuaccccuccaugugcgcgcugcgcgccgagaaccgggccgcccgccggcucggcaaggucccggccgugcccgugcagugggggaacugcggcgacaccgggacgcgcagcgcgggcccccugcggcgcaacuacaacuucaucgccgccgucguggagaagguggcccccuccgucgugcacgugcagcuguggggccggcuccugcacgggagccgccuggucccgguguacuccggcagcggguucaucguguccgaggacggccucaucaucaccaacgcccacgucgugcggaaccagcaguggaucgaggugguccugcagaacggggcgcgcuacgaggccguggugaaggacaucgaccugaagcucgaccuggccgucaucaagaucgagagcaacgccgagcugcccgugcucaugcugggccgguccagcgaccugcgcgccggcgaguucgucguggcgcucgggucccccuucagccugcagaacaccgccaccgccggcaucguguccacgaagcagcgcgggggcaaggagcuggggaugaaggacagcgacauggacuacguccagaucgacgccaccaucaacuacggcaacuccggcgggccccucgugaaccuggacggcgacgugaucggggucaacagccugcgggugaccgacggcaucuccuucgccaucccgagcgaccgcgugcggcaguuccucgcggaguaccacgagcaccagaugaaggggaaggccuucagcaacaagaaguaccugggccugcagaugcucucccugaccgucccccugagcgaggagcucaagaugcacuaccccgacuuccccgacguguccagcggcguguacgucugcaaggugguggaggggacggccgcccaguccagcggccugcgcgaccacgacgucaucgugaacaucaacgggaagccgaucaccaccaccacggacguggucaaggcgcuggacuccgacagccucuccauggccgugcugcggggcaaggacaaccugcugcucaccgugauccccgagaccaucaacuga

SEQ ID NO: 31369 - RNA, 9435 nt, Artificial Sequence
  derived and/or modified sequence opt1 from HTT__Homo_sapiens__NP_002102
auggccacccuggagaagcugaugaaggccuucgagucccugaaguccuuccagcagcagcagcagcagcagcagcagcagcagcagcagcagcagcagcagcagcagcagcagcagcagcccccgcccccgcccccgcccccgcccccgccccagcugccccagcccccgccccaggcgcagccccuccugccccagccccagcccccgcccccgcccccgcccccgccgcccggccccgccguggccgaggagccccugcaccgccccaagaaggagcucagcgccaccaagaaggaccgggugaaccacugccugaccaucugcgagaacaucguggcccaguccgugcgcaacagccccgaguuccagaagcugcucgggaucgcgauggagcuguuccugcucugcuccgacgacgccgagagcgacguccggaugguggccgacgagugccugaacaaggugaucaaggcccugauggacuccaaccucccccgccugcagcuggagcucuacaaggagaucaagaagaacggcgcgccccggagccugcgcgccgcccuguggcgguucgccgagcucgcccaccugguccgcccccagaagugccggcccuaccuggugaaccuccugcccugccugacccgcaccuccaagcggcccgaggagagcgugcaggagacccucgcggccgccguccccaagaucauggccuccuucgggaacuucgccaacgacaacgagaucaaggugcugcugaaggcguucaucgccaaccucaagagcuccagccccaccauccgccggaccgccgccggcuccgccgugagcaucugccagcacucccgccggacccaguacuucuacagcuggcugcugaacgugcuccuggggcugcucgugcccguggaggacgagcacuccacccugcugauccucggcgugcugcugacccuccgcuaccuggugccccugcuccagcagcaggucaaggacaccagccugaagggcagcuucggggugacccggaaggagauggaggugucccccagcgcggagcagcuggugcaggucuacgagcucacccugcaccacacgcagcaccaggaccacaacguggugaccggcgcccuggagcugcuccagcagcuguuccgcacgcccccgcccgagcugcuccagacccugacggccgucgggggcaucgggcagcugaccgccgccaaggaggaguccggcggccggagccgcuccgggagcaucguggagcucaucgcgggcgggggcuccagcugcucccccguccugagccggaagcagaagggcaaggugcugcucggggaggaggaggcccuggaggacgacuccgagagccgcuccgacgugagcuccagcgcccugaccgccuccgucaaggacgagaucagcggcgagcucgcggccuccagcggggugagcacccccggcuccgccgggcacgacaucaucacggagcagccccgcagccagcacacccugcaggccgacuccguggaccuggccagcugcgaccucaccuccagcgcgaccgacggcgacgaggaggacauccugucccacagcuccagccaggucuccgccgugcccagcgaccccgccauggaccugaacgacggcacgcaggccuccagccccaucuccgacagcucccagaccaccaccgaggggcccgacagcgccgugacgcccagcgacuccagcgagaucguccucgacggcaccgacaaccaguaccuggggcugcagaucggccagccccaggacgaggacgaggaggcgaccgggauccuccccgacgaggccuccgaggccuuccggaacagcuccauggcccugcagcaggcccaccuccugaagaacaugagccacugccgccagcccuccgacagcuccguggacaaguucgugcugcgggacgaggcgaccgagcccggcgaccaggagaacaagcccugccgcaucaagggcgacaucgggcagagcacggacgacgacuccgcgccccugguccacugcgugcggcuccugagcgccuccuuccugcucaccggcgggaagaacgugcugguccccgaccgcgacgugcgggugagcgucaaggcccuggcccucuccugcgugggcgccgccguggcccugcaccccgagagcuucuucuccaagcuguacaaggucccccucgacaccaccgaguaccccgaggagcaguacgugagcgacauccugaacuacaucgaccacggggacccccaggugcgcggcgccacggcgauccugugcggcacccucaucugcuccauccugagccggagccgcuuccacgucggggacuggaugggcaccauccggacccugaccgggaacacguucucccucgccgacugcaucccccugcugcgcaagacccucaaggacgagagcuccgugaccugcaagcuggccugcaccgccgugcggaacugcgucaugagccugugcuccagcuccuacagcgagcucggccugcagcugaucaucgacgugcucacgcugcgcaacuccagcuacuggcuggugcggaccgagcuccuggagacccuggccgagaucgacuuccgccucgucuccuuccuggaggcgaaggccgagaaccugcaccggggcgcccaccacuacaccgggcuccugaagcugcaggagcgcgugcucaacaacguggucauccaccuccugggcgacgaggacccccgggugcgccacguggccgccgcgagccucauccgccuggucccgaagcuguucuacaagugcgaccaggggcaggccgaccccgugguggccgucgcccgggaccaguccagcguguaccucaagcugcugaugcacgagacgcagccgcccucccacuucagcguguccaccaucacccgcaucuaccggggcuacaaccuccugccgagcaucaccgacgucacgauggagaacaaccugucccgcgugaucgcggccgugagccacgagcucaucaccagcaccacccgggcccugacguucgggugcugcgaggcccugugccuccuguccaccgccuuccccgucugcaucuggagccugggcuggcacugcggcgugccgccccuguccgcgagcgacgagucccgcaagagcugcaccguggggauggccaccaugauccugacgcugcucuccagcgccugguucccgcuggaccuguccgcccaccaggacgcccucauccuggcgggcaaccugcucgccgccagcgcccccaagucccugcggagcuccugggccagcgaggaggaggcgaaccccgccgccaccaagcaggaggaggucuggcccgcccugggggaccgcgcccucgugccgaugguggagcagcuguucucccaccuccugaaggucaucaacaucugcgcgcacgugcucgacgacgucgcccccggccccgccaucaaggccgcgcugcccagccugaccaacccgcccucccucagccccauccggcgcaaggggaaggagaaggagcccggcgagcaggccuccgugccgcugagccccaagaagggcagcgaggccuccgccgccagccggcaguccgacaccagcgggcccgugacgaccuccaagagcuccagccugggcuccuucuaccaccucccgagcuaccugaagcugcacgacguccucaaggcgacccacgccaacuacaaggugacccuggaccugcagaacuccacggagaaguucgggggcuuccuccgcagcgcccuggacgugcugucccagauccucgagcuggccacccugcaggacaucgggaagugcgucgaggagauccucggcuaccugaaguccugcuucucccgggagcccaugauggccaccgugugcgugcagcagcugcucaagacccuguucggcacgaaccuggcgagccaguucgacgggcucuccagcaaccccuccaagagccagggccgcgcccagcggcuggggagcuccagcguccgccccggccuguaccacuacugcuucauggccccguacacccacuucacccaggcccucgccgacgcgucccugcggaacauggugcaggccgagcaggagaacgacaccagcgggugguucgacgugcugcagaaggucuccacgcagcucaagaccaaccugaccagcgugaccaagaaccgcgccgacaagaacgccauccacaaccacauccggcuguucgagccccucgugaucaaggcgcugaagcaguacaccacgacgaccugcguccagcugcagaagcagguccucgaccugcuggcccagcucgugcagcugcgcgucaacuacugccugcucgacuccgaccagguguucaucggcuucgugcugaagcaguucgaguacaucgaggucggccaguuccgggagagcgaggccaucauccccaacaucuucuucuuccuggugcuccuguccuacgagcgcuaccacagcaagcagaucaucgggauccccaagaucauccagcugugcgacggcaucauggccuccgggcgcaaggccgugacccacgcgaucccggcccuccagcccaucguccacgaccuguucgugcugcggggcacgaacaaggccgacgccggcaaggagcucgagacccagaaggagguggucgugagcaugcugcugcgccucauccaguaccaccaggugcuggagauguucauccugguccuccagcagugccacaaggagaacgaggacaaguggaagcggcugucccgccagaucgccgacaucauccugcccaugcucgcgaagcagcagaugcacaucgacagccacgaggcccugggggugcugaacacccucuucgagauccuggcccccuccagccugcggccgguggacaugcuccugcgcuccauguucgucacccccaacacgauggccagcguguccaccgugcagcuguggaucagcggcauccucgccauccugcggguccugaucagccaguccaccgaggacaucgugcucagccgcauccaggagcuguccuucagccccuaccugaucuccugcaccgugaucaaccggcuccgcgacggggacagcacguccacccuggaggagcacagcgagggcaagcagaucaagaaccugcccgaggagaccuucucccgguuccuccugcagcuggucgggauccuccuggaggacaucgugaccaagcagcugaagguggagaugagcgagcagcagcacacguucuacugccaggagcucggcacccugcugaugugccucauccacaucuucaaguccggcauguuccgccggaucaccgcggccgccacccgccuguuccggagcgacgggugcggcggguccuucuacacgcuggacagccucaaccugcgcgcccgguccaugaucaccacccacccggcgcugguccuccuguggugccagauccugcuccuggugaaccacaccgacuaccgcuggugggccgaggugcagcagacgcccaagcggcacagccuguccagcaccaagcuccugagcccccagauguccggcgaggaggaggacagcgaccuggccgccaagcuggggaugugcaaccgcgagaucguccgccggggcgcccucauccuguucugcgacuacgugugccagaaccugcacgacuccgagcaccucaccuggcugaucgugaaccacauccaggaccugaucagccucucccacgagcccccgguccaggacuucaucagcgcggugcaccgcaacuccgccgccagcggccuguucauccaggccauccagucccggugcgagaaccugagcacccccacgaugcucaagaagacccugcagugccuggaggggauccaccucucccagagcggcgccgugcugacccuguacgucgaccgccuccugugcacccccuuccgggugcuggcgcgcauggucgacauccucgccugccggcgcguggagaugcugcuggccgccaaccuccaguccagcauggcccagcugcccauggaggagcugaaccggauccaggaguaccuccaguccagcgggcuggcgcagcgccaccagcggcuguacucccuccuggaccgcuuccggcugagcacgaugcaggacucccucagcccguccccgcccguguccagccacccccuggacggcgacgggcacgucucccuggagaccgugagcccggacaaggacugguacgugcaccucgucaagucccagugcuggacccgcagcgacuccgcccugcuggagggcgccgagcucgugaaccggauccccgccgaggacaugaacgccuucaugaugaacagcgaguucaaccugucccugcucgcgcccugccugagccugggcauguccgagaucagcgggggccagaaguccgcccucuucgaggccgcccgcgaggugacccuggcgcgggucagcgggacggugcagcagcugccggccgugcaccacgucuuccagcccgagcuccccgccgagcccgccgccuacugguccaagcugaacgaccuguucggcgacgcggcccucuaccagagccugccgacccuggcccgcgcccucgcccaguaccuggugguggucuccaagcugcccagccaccuccaccucccgcccgagaaggagaaggacaucgugaaguucguggucgcgacccuggaggcccucuccuggcaccugauccacgagcagaucccgcugagccucgaccugcaggccggccuggacugcugcugccucgcccugcagcugcccgggcucuggagcgugguguccagcaccgaguucgucacccacgccugcucccugaucuacugcgugcacuucauccuggaggcgguggccguccagcccggcgagcagcuccugagccccgagcggcgcacgaacaccccgaaggccaucuccgaggaggaggaggagguggaccccaacacccagaaccccaaguacaucaccgccgcgugcgagaugguggccgagauggucgagagccugcaguccgugcucgcccuggggcacaagcggaacagcggcgugcccgccuuccugacgccgcuccugcgcaacaucaucaucucccuggcccgccucccccuggucaacagcuacacccgggugccgccccugguguggaagcucgggugguccccgaagcccggcggcgacuucgggaccgcguuccccgagauccccgucgaguuccugcaggagaaggagguguucaaggaguucaucuaccgcaucaacacccugggcuggacgagccggacccaguucgaggagaccugggccacccuccugggggugcuggucacgcagccgcucgugauggagcaggaggagagcccgcccgaggaggacaccgagcgcacccagaucaacgugcuggccguccaggccaucaccagccuggugcucuccgccaugacggugccggucgcgggcaaccccgccgugagcugccuggagcagcagccccggaacaagccccugaaggcccucgacacccgcuucgggcggaagcuguccaucauccgcggcaucguggagcaggagauccaggccauggucagcaagcgggagaacaucgccacccaccaccuguaccaggcgugggacccggugcccucccucagccccgccaccacgggcgcccugaucagccacgagaagcugcugcuccagaucaaccccgagcgcgagcugggguccaugagcuacaagcugggccagguguccauccacagcgucuggcucgggaacuccaucaccccgcugcgggaggaggagugggacgaggaggaggaggaggaggccgacgcgcccgcccccagcagcccgcccaccagccccgugaacucccgcaagcaccgggccggcguggacauccacagcugcucccaguuccugcucgagcuguacagccgcuggauccugcccuccagcuccgcccggcgcacccccgccauccucaucagcgaggucgugcggucccugcuggucgugagcgaccucuucacggagcgcaaccaguucgagcugauguacgugacccugaccgagcuccggcgcguccaccccuccgaggacgagauccuggcgcaguaccuggugcccgcgaccugcaaggccgccgccgugcucgggauggacaaggccgucgccgagcccgugagccgccugcuggagagcacgcuccgguccagccaccuccccucccgcgugggcgcccugcacggcguccucuacgugcuggagugcgaccugcucgacgacaccgccaagcagcugaucccggugaucagcgacuaccugcucuccaaccugaaggggaucgcccacugcgucaacauccacagccagcagcacgugcuggugaugugcgcgaccgccuucuaccucaucgagaacuacccccuggacgucggccccgaguucuccgccagcaucauccagaugugcggggugaugcuguccggcagcgaggaguccacccccagcaucaucuaccacugcgcccuccgggggcuggagcgccugcuccuguccgagcagcugagccggcucgacgccgagucccuggugaagcugagcgucgaccgcgugaacgugcacuccccgcaccgggcgauggccgcccucggccugaugcugacgugcauguacaccggcaaggagaaggucagccccgggcgcaccuccgaccccaaccccgccgcgccggacagcgagagcgugaucguggccauggagcgggucuccguccuguucgaccgcauccggaagggcuuccccugcgaggcccgcguggucgcccggauccugccccaguuccuggacgacuucuucccgccccaggacaucaugaacaaggugaucggggaguuccucagcaaccagcagcccuacccccaguucauggccaccguggucuacaagguguuccagacgcugcacuccaccggccagagcuccauggugcgcgacugggucaugcugagccucuccaacuucacccagcgggcgccgguggccauggccaccuggagccuguccugcuucuucgugagcgccuccacgagccccugggucgccgcgauccugccccacgugaucucccgcaugggcaagcucgagcaggucgacgucaaccuguucugccugguggccaccgacuucuaccggcaccagaucgaggaggagcucgaccgccgggccuuccagagcgugcuggaggucguggccgcccccggguccccguaccaccgccugcugaccugccugcggaacgugcacaaggucacgaccugcuga

SEQ ID NO: 31370 - RNA, 2145 nt, Artificial Sequence
  derived and/or modified sequence opt1 from HUNK__Homo_sapiens__NP_055401
augcccgccgccgcgggcgacgggcugcucggcgagccggccgcccccgggggcgggggcggcgccgaggacgccgcgcgccccgccgccgccugcgaggggagcuuccugcccgcguggguguccggcgucccgcgggagcgccugcgggacuuccagcaccacaagcgcguggggaacuaccucaucggcagccggaagcugggggagggcuccuucgccaaggugcgcgagggccugcacguccucaccggggagaagguggccaucaaggugaucgacaagaagcgggccaagaaggacaccuacgucacgaagaaccugcgccgggagggccagauccagcagaugauccgccaccccaacaucacccagcugcucgacauccuggagaccgagaacagcuacuaccuggugauggagcucugccccgggggcaaccugaugcacaagaucuacgagaagaagcggcuggaggaguccgaggcccgccgguacauccgccagcucaucagcgcgguggagcaccuccaccgggccggcgucgugcaccgcgaccugaagaucgagaaccugcugcuggacgaggacaacaacaucaagcucaucgacuucgggcuguccaacugcgccggcauccugggguacagcgaccccuucuccacccagugcggcagcccggccuacgccgcgcccgagcuccuggcccggaagaaguacgggcccaagaucgacgugugguccaucggcgucaacauguacgccaugcugacgggcacccuccccuucaccguggagccguucagccugcgcgcccuguaccagaagaugguggacaaggagaugaacccccuccccacccagcuguccacgggggccaucagcuuccugcggucccuccuggagcccgacccggucaagcgccccaacauccagcaggcgcuggccaaccgguggcucaacgagaacuacaccggcaaggugcccugcaacgugaccuaccccaaccgcaucagccuggaggaccuguccccgagcgucgugcuccacaugaccgagaagcugggguacaagaacuccgacgugaucaacacgguccugagcaaccgcgccugccacauccucgccaucuacuuccugcugaacaagaagcucgagcgguaccugagcggcaaguccgacauccaggacagccugugcuacaagacccgccucuaccagaucgagaaguaccgggcccccaaggaguccuacgaggcgagccuggacaccuggacccgcgaccuggaguuccacgccgugcaggacaagaagcccaaggagcaggagaagcgcggggacuuccugcaccggcccuucuccaagaagcucgacaagaaccugccgagccacaagcagcccuccggcagccugaugacgcagauccagaacaccaaggcccuccugaaggaccggaaggccuccaagagcuccuuccccgacaaggacagcuucggcugccgcaacaucuuccggaagaccuccgacagcaacugcguggcguccagcuccauggaguucauccccgucccgccgccccgcacgccccggaucgugaagaagcccgagccccaccagcccgggccgggcagcaccgggaucccccacaaggaggacccccugaugcucgacaugguccgcuccuucgagagcguggaccgggacgaccacguggagguccugagccccucccaccacuaccgcauccugaacagcccggugucccucgcccggcgcaacagcuccgagcggacccugagccccggccugcccuccgggagcaugagcccccuccacaccccgcugcaccccacccugguguccuucgcccacgaggacaagaacuccccgcccaaggaggagggccucugcugcccgccgcccguccccagcaacggccccaugcagccccuggggucccccaacugcgucaagagccgcggccgguuccccaugauggggaucggccagaugcugcgcaagcgccaccagucccuccagcccagcgccgaccggccccuggaggccucccugcccccgcuccagccccuggcgcccgugaaccuggccuucgacauggccgacggcgugaagacgcagugcuga

SEQ ID NO: 31371 - RNA, 837 nt, Artificial Sequence
  derived and/or modified sequence opt1 from HUS1B__Homo_sapiens__NP_683762
augaaguuccgcgccaagaucaccggcaaggggugccuggagcuguucauccacgugagcggcaccgucgcccggcucgcgaaggugugcgugcugcgcguccggcccgacucccucugcuucgggccggccggcagcgggggccugcacgaggcccgccuguggugcgaggugcggcagggcgccuuccagcaguuccgcauggaggggguguccgaggaccucgacgagauccaccuggagcugacggccgagcaccucagccgggcggcccgcuccgccgccggcgcgagcucccugaagcugcagcucacccacaagcggcgccccagccugaccgucgccguggagcugguguccagccucgggcgggcccgcuccgucgugcacgaccugcccgugcggguccugccccgccggguguggcgcgacugccucccgcccagccugcgggccuccgacgccagcauccgccugccccgguggcgcacccuccgguccaucguggagcgcauggcgaacgucggcagccacgugcugguggaggccaaccuguccgggcgcaugacgcucagcaucgagaccgaggucguguccauccagagcuacuucaagaaccugggcaacccgccccagagcgccgugggcguccccgagaaccgggaccuggaguccaugguccaggugcgcguggacaaccggaagcuccugcaguuccuggaggggcagcagauccaccccaccaccgcccucugcaacaucugggacaacacgcugcugcagcucgugcugguccaggaggacgugagccugcaguacuucauccccgcccucuga

SEQ ID NO: 31372 - RNA, 843 nt, Artificial Sequence
  derived and/or modified sequence opt1 from HUS1__Homo_sapiens__NP_004498
augaaguuccgcgccaagaucguggacggcgccugccugaaccacuucacccggaucagcaacaugaucgcgaagcucgccaagaccugcacgcugcgcaucucccccgacaagcugaacuucauccucugcgacaagcuggccaacgggggcgucagcauguggugcgagcuggagcaggagaacuucuucaacgaguuccagauggaggggguguccgccgagaacaacgagaucuaccucgagcugaccagcgagaaccugucccgggcccucaagaccgcgcagaacgcccgcgcccugaagaucaagcugaccaacaagcacuucccgugccucacggugagcgucgagcugcuguccaugagcuccagcucccggaucgugacccacgacauccccaucaaggugaucccccgcaagcucuggaaggaccugcaggagcccgucgugccggaccccgacgugagcaucuaccugcccguccucaagaccaugaaguccgugguggagaagaugaagaacaucagcaaccaccuggucaucgaggccaaccuggacggcgagcucaaccugaagaucgagaccgagcuggugugcgugacgacccacuucaaggaccucgggaacccgccccuggcguccgagagcacccacgaggaccggaacgucgagcacauggccgaggugcacaucgacauccgcaagcugcuccaguuccuggccggccagcaggucaaccccaccaaggcccugugcaacaucgugaacaacaagauggugcacuucgaccuccugcacgaggacgugucccugcaguacuucauccccgcccucagcuga

SEQ ID NO: 31373 - RNA, 13125 nt, Artificial Sequence
  derived and/or modified sequence opt1 from HUWE1__Homo_sapiens__XP_005262022
augaagguggaccggaccaagcugaagaagacccccaccgaggcccccgccgacugccgggcccucaucgacaagcugaaggugugcaacgacgagcagcugcuccuggagcugcagcagaucaagaccuggaacaucggcaagugcgagcucuaccacuggguggaccugcuggaccgguucgacgggauccucgccgacgccggccagaccguggagaacaugagcuggaugcuggugugcgaccggcccgagcgcgagcagcugaagaugcuccugcuggccgugcucaacuucaccgcccugcugaucgaguacagcuucagccggcaccucuacuccagcaucgagcaccugaccacccugcucgcguccagcgacaugcaggucgugcuggccgugcugaaccuccuguacguguucuccaagcgcagcaacuacaucacccggcugggguccgacaagcgcacgccccugcugacccggcugcagcaccucgccgagagcuggggcgggaaggagaacggcuucggccuggccgagugcugccgcgaccugcacaugaugaaguacccgcccuccgcgaccacccuccacuucgaguucuacgccgaccccggggccgaggugaagaucgagaagcggaccaccagcaacacccugcacuacauccacaucgagcagcuggacaagaucuccgagagccccuccgagaucauggagagccucaccaagauguacuccauccccaaggacaagcagaugcugcuguucacccacauccgccucgcccacggcuucagcaaccaccggaagcgccugcaggccgugcaggcgcggcugcacgccaucuccauccucguguacagcaacgcccugcaggagagcgccaacuccauccuguacaacgggcucaucgaggagcuggucgacgugcugcagaucaccgacaagcagcucauggagaucaaggccgcgagccugcgcacccugaccuccaucgugcaccuggagcggacccccaagcucagcuccaucaucgacugcaccggcaccgccagcuaccacggguuccugcccguccuggugcgcaacugcauccaggccaugaucgaccccuccauggaccccuacccgcaccaguucgccaccgcccucuucagcuuccuguaccaccuggcguccuacgacgccggcggcgaggcccucgugagcugcgggaugauggaggcccugcugaaggucaucaaguuccucggcgacgagcaggaccagaucaccuucgugacccgggccgugcgcgucguggaccugaucaccaaccuggacauggcggccuuccagucccacagcgggcucuccaucuucaucuaccggcuggagcacgagguggaccugugccgcaaggagugccccuucgucaucaagcccaagauccagcgccccaacaccacccaggagggcgaggagauggagaccgacauggacggcgugcagugcaucccccagcgggccgcccuccucaaguccaugcugaacuuccucaagaaggcgauccaggaccccgccuucuccgacgggauccgccacgucauggacggcagccugcccaccucccugaagcacaucaucagcaacgccgaguacuacgggcccucccucuuccugcuggccaccgagguggugaccgucuucguguuccaggagccgagccuccugagcucccugcaggacaacggccucaccgacgugaugcugcacgcccugcucaucaaggacguccccgcgacccgggaggugcuggggagccugcccaacguguucuccgcccucugccugaacgcccgcggccugcagagcuucguccagugccagcccuucgagcgccuguucaaggugcugcugucccccgacuaccuccccgccaugcgccggcgccggagcuccgacccccugggcgacaccgccagcaaccugggguccgcgguggacgagcucaugcgccaccagcccacccugaagaccgacgccaccaccgccaucaucaagcugcucgaggagaucugcaaccugggccgggaccccaaguacaucugccagaagcccagcauccagaaggccgacgggaccgccaccgcgcccccgccccgcuccaaccacgccgccgaggaggccagcuccgaggacgaggaggaggaggagguccaggcgaugcagagcuucaacuccacgcagcagaacgagaccgagcccaaccagcaggucgugggcaccgaggagcggauccccaucccccugauggacuacauccucaacgucaugaaguucguggagagcauccuguccaacaacaccacggacgaccacugccaggaguucgugaaccagaaggggcugcucccccuggucaccauccugggccuccccaaccugcccaucgacuuccccaccagcgccgccugccaggccguggccggcgugugcaagagcauccugacccucucccacgagcccaagguccugcaggaggggcugcuccagcuggacagcauccuguccagccucgagccccugcaccgccccaucgaguccccgggcgggagcgugcugcuccgggagcuggcgugcgccggcaacguggccgacgccacgcuguccgcccaggcgacgccccugcugcacgcccugaccgccgcccacgccuacaucaugauguucguccacacgugccgcguggggcagagcgagauccgguccaucagcgugaaccaguggggcucccagcucggccugagcguccuguccaagcucagccagcuguacugcucccuggugugggagagcacggugcuccugucccugugcacccccaacagccuccccuccgggugcgaguucggccaggcggacaugcagaagcuggucccgaaggacgagaaggccgggaccacccagggcggcaagcgcagcgacggggagcaggacggcgccgccgggagcauggacgcguccacgcagggccugcucgaggggaucggccuggacggcgacacccuggcccccauggagaccgacgagcccaccgccagcgacuccaaggggaaguccaagaucacgcccgccauggccgcgcggaucaagcagaucaagccgcuccuguccgccagcucccgccugggccgcgcccucgccgagcuguucgggcugcucgugaagcugugcgugggcagccccguccggcagcgccggucccaccacgccgcgagcaccaccaccgcccccacgcccgccgcccgcuccaccgccagcgcgcugaccaagcugcucaccaaggggcuguccuggcagccgccgcccuacacgccgacgccccgguuccgccugaccuucuucaucugcagcgugggcuucaccucccccaugcuguucgacgagcggaaguaccccuaccaccugaugcugcagaaguuccucugcagcggcgggcacaacgcccuguucgagacguucaacugggcccuguccaugggcgggaaggugccggucagcgagggccucgagcacuccgaccugcccgacgggaccggcgaguuccuggacgccuggcucaugcugguggagaagauggugaaccccaccaccguccuggagagcccccacagccucccggccaagcugcccggcggggugcagaacuucccccaguucuccgcgcugcgcuuccucguggucacgcagaaggccgccuucacgugcaucaagaaccuguggaaccggaagccccugaagguguacggcgggcgcauggccgagagcaugcucgcgauccugugccacauccugcggggcgagccggugauccgcgagcggcucuccaaggagaaggaggggagccgcggcgaggaggacaccggccaggaggagggcgggucccggcgcgagccccaggucaaccagcagcagcugcagcagcugauggacaugggguucacccgggagcacgccauggaggcccuccugaacaccagcacgauggagcaggccaccgaguaccugcucacccacccgccgcccaucaugggcggcguggugcgcgaccuguccaugagcgaggaggaccagaugaugcgggccaucgcgaugucccuggggcaggacauccccauggaccagcgcgccgagagccccgaggaggucgccugccggaaggaggaggaggagcgcaaggcccgcgagaagcaggaggaggaggaggccaagugccucgagaaguuccaggacgcggacccccuggagcaggacgagcugcacaccuucacggacaccaugcuccccggcugcuuccaccuccuggacgagcuccccgacaccguguaccgggugugcgaccugaucaugaccgccaucaagcgcaacggggccgacuaccgggacaugauccugaagcaggucgugaaccaggucugggaggccgccgacgugcucaucaaggcggcccugccccugacgaccuccgacaccaagaccgugagcgaguggaucucccagauggccacgcucccccaggccagcaaccuggcgacccgcauccugcuccugacccuccuguucgaggagcugaagcugccgugcgccugggucguggaguccagcggcauccucaacgugcugaucaagcugcucgaggucgugcagcccugccugcaggccgccaaggagcagaaggaggugcagacccccaaguggaucacgcccguccugcuccugaucgacuucuacgagaagaccgccaucuccagcaagcggcgcgcgcagaugaccaaguaccugcaguccaacagcaacaacuggcggugguucgacgaccgcagcgggcgguggugcuccuacagcgccuccaacaacagcaccaucgacuccgccuggaaguccggcgagacguccgugcgcuucaccgccggccggcgccgguacaccgugcaguucaccacgaugguccaggugaacgaggagaccgggaaccgccggccggugaugcucacccugcugcgcgucccccggcucaacaagaacagcaagaacuccaacggccaggagcuggagaagacccuggaggagagcaaggagauggacaucaagcgcaaggagaacaaggggaacgacacgccccucgcccuggaguccaccaacaccgagaaggagaccagccuggaggagacgaagaucggcgagauccucauccaggggcugaccgaggacauggugaccgugcugauccgggcgugcgucuccaugcucggcgugccgguggaccccgacacccugcacgccacgcugcgccucugccugcgccugacccgggaccacaaguacgccaugauguucgccgagcucaagagcacccgcaugauccugaaccugacccaguccagcggcuucaacggguucacgccccuggucacgcugcugcuccggcacaucaucgaggaccccugcacccugcgccacaccauggagaagguggugcgguccgccgcgaccagcggcgccggguccacgaccagcggcgucgugagcgggucccugggcagccgcgagaucaacuacauccuccgggugcugggcccggccgccugccgcaaccccgacaucuucaccgaggucgcgaacugcugcauccggaucgcccugcccgcgccccggggguccggcaccgccagcgacgacgaguucgagaaccuccggaucaaggggccgaacgccgugcagcuggugaagacgacgccccugaagcccagcccccucccggucauccccgacaccaucaaggaggugaucuacgacaugcugaacgcgcuggccgccuaccacgcccccgaggaggccgacaagagcgaccccaagccgggcgugaugacccaggaggucggccagcuccugcaggacaugggggacgacguguaccagcaguaccgcucccugacgcggcagagcuccgacuucgacacccagagcggcuucuccaucaacagccagguguucgcggccgacggggccuccaccgagaccagcgccuccggcacgagccagggggaggccuccacccccgaggagagccgcgacggcaagaaggacaaggagggcgaccgggcguccgaggaggggaagcagaagggcaaggggagcaagccccugaugcccaccagcaccauccuccgccugcuggccgagcucguccgguccuacgugggcaucgccacgcugaucgccaacuacagcuacaccguggggcaguccgagcugaucaaggaggacugcagcguccucgccuucgugcuggaccaccuccucccgcacacccagaacgcggaggacaaggacacccccgcccuggcccgccuguuccucgccucccuggcggccgccggcagcggcacggacgcccagguggcccuggucaacgaggugaaggcggcccucgggcgggcccuggccauggccgaguccaccgagaagcacgcgcgccugcaggccgugaugugcaucaucagcaccaucauggaguccugccccagcaccuccagcuucuacuccagcgccacggccaagacccagcacaacggcaugaacaacaucauccgccucuuccugaagaaggggcuggucaacgaccucgcccgcgugccccacucccuggaccugagcuccccgaacauggcgaacaccgugaacgccgcccucaagccccuggagacccugagccgcaucgucaaccagcccagcucccucuucggcagcaaguccgccagcuccaagaacaagagcgagcaggacgcgcagggggccucccaggacagcuccagcaaccagcaggaccccggcgagccgggcgaggccgaggugcaggaggaggaccacgacgugacgcagaccgaggucgccgacggggacaucauggacggcgaggccgagaccgacuccguggucaucgcggggcagcccgaggugcugagcucccaggagaugcaggucgagaacgagcuggaggaccucaucgacgagcugcuggagcgggacggcgggagcggcaacuccaccaucaucgucagccgcuccggcgaggacgagagccaggaggacgugcucauggacgaggcccccuccaaccugagccaggccagcacgcugcaggccaaccgggaggacuccaugaacauccucgacccggaggacgaggaggagcacacccaggaggaggacagcuccgggagcaacgaggacgaggacgacucccaggacgaggaggaggaggaggaggaggacgaggaggacgaccaggaggacgacgagggcgaggagggggacgaggacgacgacgacgacggcagcgagauggagcuggacgaggacuaccccgacaugaacgccagcccccuggugcgcuucgagcgguucgaccgcgaggacgaccucaucaucgaguucgacaacauguucagcuccgcgaccgacaucccgcccagccccggcaacauccccaccacgcacccccugaugguccggcacgccgaccacuccagccugacccucggguccggcagcuccaccacccgccugacccaggggaucggccggagccagcgcacgcugcggcagcucaccgccaacaccgggcacaccauccacgugcacuaccccggcaaccgccagcccaacccgccccugauccugcagcggcuccugggcccguccgccgccgcggacauccugcagcucagcuccagccugccccugcagagccgcgggcgggcccgccuccuggugggcaacgacgacguccacaucaucgcccgguccgacgacgagcugcucgacgacuucuuccacgaccagagcacggccaccucccaggcggggacccugagcuccauccccaccgcccugacgcgcuggaccgaggagugcaaggugcucgacgccgagagcaugcacgacugcguguccgucgugaaggugagcaucgucaaccaccuggaguuccugcgggacgaggagcucgaggagcgccgcgagaagcggcgcaagcagcuggccgaggaggagaccaagaucaccgacaagggcaaggaggacaaggagaaccgggaccaguccgcccagugcacggcgagcaaguccaacgacagcaccgagcagaaccuguccgacgggacccccaugccggacagcuaccccaccacgcccuccagcaccgacgccgccaccuccgagagcaaggagacccucggcacgcugcaguccagccagcagcagcccacccugccgacgccgcccgcccucggcgaggugccccaggagcugcagagcccggccggggagggcggguccagcacccagcugcucaugcccguggagcccgaggagcugggcccgacgcgccccuccggggaggcggagaccacccagauggagcugagccccgcccccaccaucacgucccucagcccggagcgggccgaggacuccgacgcccugaccgccgucagcucccagcuggagggcagccccauggacaccuccagccucgcguccugcacccuggaggaggccgugggcgacacgagcgccgccggguccagcgagcagccccgcgccggcuccagcacccccggggacgcgccgcccgccguggccgagguccagggccgguccgacgggagcggcgagagcgcccagccgcccgaggacuccagcccgcccgcguccagcgaguccagcuccacccgcgacagcgccguggccaucuccggcgccgacagccgggggauccuggaggagccccuccccuccaccagcuccgaggaggaggacccgcuggccggcaucagccugcccgaggggguggaccccuccuuccucgcggcccugcccgacgacauccgccgggagguccugcagaaccagcucggcauccgcccgcccacgcggaccgcccccagcaccaacuccagcgcccccgccguggugggcaacccgggggucaccgaggugucccccgaguuccuggcggcccugccgcccgccauccaggaggaggugcucgcccagcagcgcgccgagcagcagcggcgcgagcuggcgcagaacgccagcagcgacaccccgauggaccccgucacguucauccagacccugcccuccgaccuccggcgcagcgugcuggaggacauggaggacuccgugcuggccgucaugccgcccgacaucgccgcggaggcccaggcccuccggcgcgagcaggaggcccggcagcgccagcugaugcacgagcgccuguucggccacagcuccaccagcgcccuguccgcgauccuccggagccccgccuucaccucccgccugagcgggaaccggggcgugcaguacacgcgccuggccgugcagcgcggcgggaccuuccagaugggcggguccagcucccacaaccgccccagcggguccaacgucgacacccuccugcggcugcgcgggcggcuccugcuggaccacgaggcccucagcugccugcuggugcuccuguucguggacgagccgaagcugaacaccucccgccuccaccggguccugcgcaaccugugcuaccacgcccagacgcggcacugggugauccgcagccuccugagcauccugcagcgguccagcgaguccgagcucugcaucgagacccccaagcugaccaccagcgaggagaagggcaagaaguccagcaaguccugcgggagcuccagccacgagaaccgcccccuggaccuccugcacaagauggaguccaagagcuccaaccagcugagcuggcucuccgugagcauggacgcggcccugggcugccggacgaacaucuuccagauccagcgcuccggcgggcggaagcacaccgagaagcacgccagcggcggguccaccguccacauccacccccaggccgccccgguggugugccgccacguccuggacacccucauccagcuggcgaagguguuccccagccacuucacgcagcagcgcaccaaggagaccaacugcgagagcgaccgggagcgcggcaacaaggccugcucccccugcagcucccagagcuccagcuccgggaucugcaccgacuucugggaccugcucgugaagcuggacaacaugaacgucagccggaagggcaagaacuccgucaagagcgugcccgucuccgccggcggggagggcgagacgagcccguacucccuggaggccagcccccucgggcagcugaugaacaugcugucccaccccgugauccgccggagcucccuccugaccgagaagcugcuccgccugcugagccucaucuccaucgcccugcccgagaacaaggucagcgaggcgcaggccaacagcggcuccggcgccagcuccaccaccacggccaccagcaccaccuccacgaccaccaccacggcggccagcaccaccccgacgccgcccacggcccccaccccggugaccuccgcccccgcccugguggcggccaccgccaucagcaccaucgucguggccgccuccacgaccgugaccacccccacgaccgcgaccaccacggucagcaucucccccaccaccaaggggagcaaguccccggccaaggugagcgacggcggguccagcuccaccgacuucaagauggugagcuccggccucacggagaaccagcugcagcugagcgucgaggugcucaccagccacuccugcagcgaggaggggcuggaggacgccgccaacgugcugcuccagcugucccggggcgacagcggcacccgcgacaccguccugaagcuccugcugaacggggcccggcaccucggcuacacgcugugcaagcagaucgggacccugcucgcggagcugcgcgaguacaaccuggagcagcagcggcgcgcccagugcgagacccucucccccgacggccugcccgaggagcagccccagaccacgaagcugaaggggaagaugcagagccgguucgacauggccgagaacguggugaucgucgccucccagaagcgcccgcucggcggccgggagcugcagcugcccagcauguccaugcucaccagcaagaccuccacccagaaguucuuccugcgcgugcuccaggugaucauccagcuccgggacgacacgcgccgggcgaacaagaaggccaagcagaccgggcgccugggcagcuccgggcugggcagcgccuccagcauccaggccgccguccggcagcucgaggcggaggccgacgccaucauccagauggugcgcgaggggcagcgcgcccggcgccagcagcaggccgcgaccuccgagagcucccagagcgaggccagcgugcggcgcgaggagucccccauggacgucgaccagccgagccccuccgcccaggacacccagagcaucgccuccgacggcacgccccagggcgagaaggagaaggaggagcggcccccggagcugccccugcucagcgagcagcugucccuggacgagcucugggacaugcugggggagugccugaaggagcucgaggagagccacgaccagcacgccgugcuggugcugcagcccgcggucgaggccuucuuccucgugcacgccaccgagcgcgaguccaagcccccggugcgggacacccgcgagagccagcuggcccacaucaaggacgagccgccgccccugucccccgcgccccucacccccgccacgcccagcucccuggacccguucuucagccgggagcccuccagcaugcacaucuccagcucccugccgcccgacacccagaaguuccugcgcuucgccgagacccaccggaccguccucaaccagauccugcgccagagcacgacccaccuggccgacggcccguucgccgugcucguggacuacauccggguccuggacuucgacgugaagcgcaaguacuuccggcaggagcuggagcgccucgacgaggggcugcggaaggaggacauggcggugcacguccgccgggaccacguguucgaggacagcuaccgcgagcugcaccgcaagucccccgaggagaugaagaaccggcucuacaucguguucgagggcgaggaggggcaggacgccggcggccugcugcgcgagugguacaugaucaucagccgggagauguucaaccccauguacgcccucuuccgcaccucccccggggaccgggucaccuacaccaucaacccgagcucccacugcaaccccaaccaccugagcuacuucaaguucgugggccgcaucguggccaaggccgucuacgacaaccggcugcucgagugcuacuucacgcgcuccuucuacaagcacauccugggcaagagcgugcgguacaccgacauggaguccgaggacuaccacuucuaccagggccugguguaccuccuggagaacgacgucagcacccugggcuacgaccucaccuucuccacggaggugcaggaguucggggugugcgagguccgcgaccugaagcccaacggcgcgaacauccuggugaccgaggagaacaagaaggaguacgugcaccucgucugccagaugcggaugaccggggccauccgcaagcagcuggccgccuuccuggagggcuucuacgagaucauccccaagcggcucaucagcaucuucaccgagcaggagcuggagcugcucaucuccgggcugccgacgaucgacaucgacgaccucaagagcaacaccgaguaccacaaguaccaguccaacagcauccagauccagugguucuggcgcgcccuccgguccuucgaccaggcggaccgcgccaaguuccugcaguucgugaccggcaccagcaaggugccccugcagggcuucgccgcccucgaggggaugaacggcauccagaaguuccagauccaccgggacgaccgcagcacggaccggcugcccuccgcccacacgugcuucaaccagcuggaccucccggcguacgagagcuucgagaagcugcgccacaugcugcuccuggccauccaggagugcuccgagggguucggccuggccuga

SEQ ID NO: 31374 - RNA, 822 nt, Artificial Sequence
  derived and/or modified sequence opt1 from HVCN1__Homo_sapiens__XP_011537150
auggccaccugggacgagaaggccgugacccgccgggcgaaggucgcccccgccgagcgcaugagcaaguuccugcggcacuucacgguggugggcgacgacuaccacgccuggaacaucaacuacaagaagugggagaacgaggaggaggaggaggaggaggagcagccgccgcccacccccgucuccggggaggagggccgcgccgcggcccccgacguggcccccgcccccgggcccgcgccgcgggcgccccucgacuuccgcggcaugcugcggaagcuguucagcucccaccgcuuccaggugaucaucaucugccucgucgugcuggacgcccugcucgugcuggccgagcugauccucgaccugaagaucauccagcccgacaagaacaacuacgccgccauggucuuccacuacaugagcaucaccauccugguguucuucaugauggagaucaucuucaagcuguucguguuccggcucgaguucuuccaccacaaguucgagauccuggacgccgucgugguggucguguccuucauccucgacaucgugcugcuguuccaggagcaccaguucgaggcccucgggcugcugauccuccugcgccuguggcgggucgcccgcaucaucaacggcaucaucaucagcgugaagacccgguccgagcgccagcuccugcggcugaagcagaugaacgugcagcucgccgcgaagauccagcaccuggaguucagcugcuccgagaaggagcaggagaucgagcgccugaacaagcuccugcggcagcacggccugcucggggaggucaacuga

SEQ ID NO: 31375 - RNA, 1308 nt, Artificial Sequence
  derived and/or modified sequence opt1 from HYAL1__Homo_sapiens__NP_149349
auggccgcccaccuccugcccaucugcgcgcuguuccugacccuccuggacauggcccagggcuuccgggggccgcugcuccccaaccggcccuucaccacgguguggaacgccaacacccaguggugccuggagcgccacggcgucgacguggacgugagcgucuucgacgugguggccaaccccgggcagaccuuccggggcccggacaugaccaucuucuacuccagccagcuggggacguaccccuacuacacccccaccggcgagcccgucuucggcgggcucccgcagaacgccucccugaucgcgcaccuggcccgcaccuuccaggacauccucgccgccauccccgcgcccgacuucagcggccuggccgugaucgacugggaggccuggcggccccgcugggccuucaacugggacacgaaggacaucuaccggcagcgcucccgggcccuggugcaggcgcagcacccggacuggcccgcgccccaggucgaggccguggcccaggaccaguuccagggggccgcccgcgccuggauggccggcacccuccagcuggggcgggcccugcgcccccggggccucuggggcuucuacggguucccggacugcuacaacuacgacuuccugagccccaacuacaccggccagugccccuccgggauccgcgcccagaacgaccagcugggcuggcucuggggccagagccgggcgcuguaccccuccaucuacaugccggccgugcuggaggggaccggcaagagccagauguacguccagcaccgcguggccgaggccuuccggguggccgucgcggccggggaccccaaccuccccgugcugcccuacgugcagaucuucuacgacacgaccaaccacuuccugccgcucgacgagcuggagcacucccugggcgagagcgccgcccagggggcggccggcgucgugcucuggguguccugggagaacacccgcaccaaggagagcugccaggccaucaaggaguacauggacacgacccugggccccuucauccugaacgucaccuccggggcccuccugugcagccaggcccugugcuccggccacgggcggugcgugcgccggaccagccaccccaaggcgcuccugcugcucaaccccgccuccuucagcauccagcugacgccgggcgggggcccccugagccuccgcggcgcccugucccuggaggaccaggcccagauggccguggaguucaagugccgcugcuaccccggguggcaggcgccguggugcgagcgcaagagcaugugguga

SEQ ID NO: 31376 - RNA, 1422 nt, Artificial Sequence
  derived and/or modified sequence opt1 from HYAL2__Homo_sapiens__XP_005265582
augcgcgccggccccgggccgaccgugacccuggcccucguccuggcggugagcugggccauggagcugaagcccacggccccgcccaucuucaccggccggcccuucguggucgccugggacgugcccacccaggacugcgggccccgccucaaggugccccuggaccugaacgccuucgacguccaggcguccccgaacgagggcuucgugaaccagaacaucaccaucuucuaccgggaccgccucgggcuguacccccgguucgacagcgccggccgcuccgugcacggcggggucccccagaacgugagccugugggcccaccggaagaugcuccagaagcgcguggagcacuacauccggacgcaggaguccgccggccuggcggucaucgacugggaggacuggcgccccgugugggugcggaacuggcaggacaaggacgucuaccgccggcugagccgccagcucguggccucccggcacccggacuggccgcccgaccgcaucgugaagcaggcccaguacgaguucgaguucgccgcccagcaguucaugcuggagacccugcgguacgucaaggcggugcgcccccggcaccucuggggguucuaccuguuccccgacugcuacaaccacgacuacgugcagaacugggagagcuacaccggccgcugccccgacgucgagguggcccggaacgaccagcuggccuggcucugggccgaguccaccgcccuguuccccagcguguaccuggacgagacgcucgcguccagccgccacgggcgcaacuucgucuccuuccgggugcaggaggcccugcgcgucgcccggacccaccacgccaaccacgcccugcccguguacguguucacccgcccgaccuacagccggcgccucacgggccuguccgagauggaccugaucagcaccaucggcgaguccgcggcccucggggccgccggcgucauccuguggggcgacgccggguacaccaccagcacggagaccugccaguaccugaaggacuaccucacccggcugcuggugcccuacguggucaacguguccugggcgacccaguacugcagccgcgcccagugccacggccacgggcggugcgugcgccggaaccccagcgccuccacguuccuccaccugagcaccaacuccuuccgccugguccccggccacgccccgggggagccccagcuccggcccgugggcgagcugagcugggcggacaucgaccaccuccagacccacuuccgcugccagugcuaccuggggugguccggcgagcagugccagugggaccaccggcaggccgccggcggggccagcgaggccugggcgggcucccaccugaccagccugcucgcccuggccgcccuggccuucacguggacccucuga

SEQ ID NO: 31377 - RNA, 1164 nt, Artificial Sequence
  derived and/or modified sequence opt1 from HYAL3__Homo_sapiens__NP_001186959
augaccacccagcugggccccgcccucgugcugggggucgcccugugccucggcugcgggcagccgcugccccaggugcccgagcgccccuucagcgugcuguggaacgucccguccgcgcacugcgaggcccgguucggcgugcaccucccccugaacgcccuggggaucaucgccaaccgcggccagcacuuccacggccagaacaugacgaucuucuacaagaaccagcucgggcuguaccccuacuucggcccccgggggaccgcccacaacggcgggaucccgcaggcgcugccccucgaccgccaccuggcccuggccgccuaccagauccaccacagccuccggcccggcuucgcgggccccgccgugcuggacugggaggaguggugcccgcugugggccgggaacuggggccgccggcgcgccuaccaggccgcguccugggccugggcccagcaggucuuccccgaccucgacccccaggagcagcuguacaaggccuacaccggguucgagcaggccgcgcgggcccugauggaggacacccuccgcguggcccaggcccugcggccccacggccuguggggcuucuaccacuacccggccugcgggaacggcuggcacagcauggcguccaacuacacggggcgcugccacgccgccacccucgcccggaacacccagcugcacuggcugugggccgcgagcuccgcccucuuccccagcaucuaccugccgccccgccugccgcccgcccaccaccaggccuucgugcggcaccgccucgaggaggcguuccgggucgcccuggugggccaccgccacccccugcccgugcucgccuacguccggcugacccaccgccgguccgggcgcuuccugagccaggaggagugcuggcaccuccacgacuaccugguggacacgcugggccccuacgugaucaacgucacccgcgccgccauggcgugcucccaccagcggugccacggccacgggcgcugcgcccggcgcgaccccggccagauggaggccuuccuccaccuguggcccgacgggagccugggcgacuggaaguccuucagcugccacugcuacugggggugggccggcccgaccugccaggagccccggcccggccccaaggaggccguguga

SEQ ID NO: 31378 - RNA, 1446 nt, Artificial Sequence
  derived and/or modified sequence opt1 from HYAL4__Homo_sapiens__XP_011514292
augaaggugcugagcgagggccagcucaagcugugcgucgugcagcccgugcaccugaccuccuggcuccugaucuucuucauccucaagagcaucuccugccugaagccggcccgccugcccaucuaccagcggaagcccuucaucgccgcguggaacgcccccaccgaccagugccugaucaaguacaaccuccgccugaaccugaagauguucccggucaucgggagcccccucgccaaggcccggggccagaacgugacgaucuucuacgugaaccgccugggguacuaccccugguacaccucccagggcguccccaucaacgggggccugccgcagaacaucagccuccaggugcaccuggagaaggccgaccaggacaucaacuacuacauccccgcggaggacuucuccggccuggccgugaucgacugggaguacuggcggccccagugggcccgcaacuggaacagcaaggacgucuaccggcagaagucccgcaagcucaucagcgacauggggaagaacguguccgccaccgacaucgaguaccuggcgaaggugaccuucgaggagagcgccaaggccuucaugaaggagacgaucaagcugggcaucaagucccggcccaaggggcucuggggcuacuaccuguacccggacugccacaacuacaacgucuacgcccccaacuacagcggguccugccccgaggacgaggugcugcgcaacaacgagcucagcuggcuguggaacuccagcgccgcgcuguaccccuccaucggcguguggaagucccucggcgacagcgagaacauccugcgguucagcaaguuccgcguccacgagagcaugcggaucuccaccaugaccagccacgacuacgcccugccgguguucguguacacccgccucggguaccgggacgagccccuguucuuccuguccaagcaggaccucgucagcacgaucggcgaguccgccgcccugggggccgcgggcaucgugaucuggggcgacaugaaccugaccgccagcaaggccaacugcaccaaggugaagcaguucgucuccagcgaccucggguccuacaucgccaacgugacccgcgccgcggaggugugcagccugcaccugugccggaacaacggccgcugcauccggaagauguggaacgcccccuccuaccuccaccugaaccccgccagcuaccacaucgaggccuccgaggacggggaguucacggucaagggcaaggccagcgacaccgaccuggcggugauggccgacaccuucuccugccacugcuaccagggguacgagggcgccgacugccgcgagaucaagaccgccgacggcugcagcggggucuccccgagccccggcagccucaugacgcugugccugcuccugcuggcguccuaccggagcauccagcucuga

SEQ ID NO: 31379 - RNA, 2853 nt, Artificial Sequence
  derived and/or modified sequence opt1 from HYDIN__Homo_sapiens__NP_001185471
auggagagcgccggcggguucaagcugggcauggagccccucuccgggggcggggugugcgagaagaagaagcugcugaagaugaccagccgccggcucgaggaguccaugggcgccguccagaugggccuggugaacauguucaagggguuccagagcaaggugcugccgccccucucccccaaggucgugaccgaggaggaggugaaccgcaugcugacgcccagcgaguuccugaaggagaugucccucaccaccgagcagcggcuggcgaagacccgccugaugugccggccgcagaucaucgagcuccuggacaugggcgagacgacccaccagaaguucagcgggaucgaccuggaccaggcccucuuccagcccuuccccuccgagaucaucuuccagaacuacacccccugcgaggucuacgaggugccgcugauccugcgcaacaacgacaagaucccccggcucgugaaggucguggaggagagcucccccuacuucaaggugaucagccccaaggacaucggccacaaggucgccccgggggugcccuccaucuuccgcauccuguucacccccgaggagaacaaggacuacgcccacacgcugaccugcgugaccgagcgggagaaguucaucguccccaucaaggcccgcggcgcgcgggccauccucgacuucccggacaagcugaacuucagcacgugccccgugaaguacuccacccagaagauccugcucgugcgcaacaucggcaacaagaacgccgucuuccacaucaagaccugccggcccuucagcaucgagcccgccaucgggacccugaacgugggcgaguccaugcagcuggagguggaguucgagccgcagagcgucggggaccacuccggccgccucaucgugugcuacgacaccggcgagaagguguucgucagccuguacggggcggccaucgacaugaacauccggcuggacaagaacagccucacgaucgagaagaccuacaucucccuggccaaccagcgcaccaucaccauccacaaccggagcaacaucaucgcccacuuccuguggaagguguucgccacgcagcaggaggaggaccgcgagaaguaccgggcgugcgacgaccucaucaaggaggagaaggacgagaccgacgaguucuucgaggagugcaucaccgacccccugcugcgcgagcaccucuccguccugagccggaccuucgccaaccagcgccgccuggugcagggcgacuccaagcuguucuucaacaacguguucacggucgagccccucgagggggacguguggcccaacagcuccgccgagaucaccguguacuucaacccgcuggaggccaagcucuaccagcagaccaucuacugcgacauccugggccgggagauccgccugccccuccggaucaagggggagggcaugggccccaagauccacuucaacuucgagcugcuggacaucgggaaggucuucaccggcagcgcccacugcuacgaggcgauccucuacaacaagggguccaucgacgcccuguucaacaugacgcccccgaccagcgcccugggcgccugcuucguguucucccccaaggaggggaucaucgagcccagcggcgugcaggccauccagaucuccuucagcuccaccauccugggcaacuucgaggaggaguuccucgucaacgugaacgggagcccggagcccgugaagcugaccauccgcggcugcgucaucgggcccacguuccacuucaacgugcccgcgcugcacuucggcgacguguccuucggguucccgcacacccucaucugcagccugaacaacaccucccugauccccaugaccuacaagcuccggauccccggcgacggccuggggcacaagagcaucagcuacugcgagcagcacgucgacuacaagcgccccuccuggacgaaggaggagaucagcuccaugaagccgaaggaguucaccaucagccccgacugcggcaccauccggccccagggguucgccgccauccgcgugacccugugcuccaacaccgugcagaaguacgagcucgcccuggucguggacguggagggcaucggcgaggagguccuggcccuccugaucacggcgcggugcguggugcccgcccugcaccucgucaacaccgagguggacuucgggcacugcuuccugaaguacccguacgagaagacccugcagcucgccaaccaggacgaccugcccggcuucuacgaggugcagccccaggucugcgaggaggugcccaccgugcuguucagcuccccgacgcccagcggggucaucucccccagcuccaccauccacaucccccucgugcuggagacccaggugaccggcgagcaccgcagcacggucuacaucuccaucuucgggagccaggacccgccccuggugugccaccucaaguccgccggcgagggccccgugaucuacguccaccccaaccagguggacuucgggaacaucuacgugcugaaggacagcucccggauccugaaccucugcaaccagagcuucaucccggcguucuuccaggcccacauggcccacaagaagucccuguggaccaucgagcccaacgagggcauggugcccccggagaccgacguccagcuggcccucaccgccaaccugaacgacacgcugaccuucaaggacugcgugauccucgacaucgagaacagcagcaccuaccgcauccccguccaggcguccgggaccggcagcacgaucguguccgacaagcccuucgcccccgagcugaaccugggggcccacuuccgguga

SEQ ID NO: 31380 - RNA, 1122 nt, Artificial Sequence
  derived and/or modified sequence opt1 from HYKK__Homo_sapiens__NP_001013641
augagcuccggcaacuaccagcagagcgaggcccuguccaagcccaccuucagcgaggagcaggccuccgcgcugguggagagcgucuucgggcugaagguguccaaggugcgcccgcugcccagcuacgacgaccagaacuuccacgucuacguguccaagaccaaggacggccccacggaguacgugcucaagaucagcaacaccaaggccuccaagaaccccgaccugaucgagguccagaaccacaucaucauguuccugaaggccgccggguucccgaccgccagcgugugccacaccaagggcgacaacacggcgucccucgugagcgucgacuccgggagcgagaucaaguccuaccuggugcggcugcucaccuaccugcccggccgccccaucgccgagcugcccgugagcccgcagcuccuguacgagaucggcaagcuggccgccaagcucgacaagacccugcagcgguuccaccaccccaagcuguccagccuccaccgcgagaacuucaucuggaaccugaagaacgucccccugcucgagaaguaccuguacgcgcuggggcagaaccggaaccgcgagaucguggagcacgugauccaccucuucaaggaggaggucaugaccaagcugagccacuuccgggagugcaucaaccacggcgaccugaacgaccacaacauccucaucgaguccagcaaguccgccagcgggaacgccgaguaccagguguccggcauccuggacuucggggacaugagcuacggcuacuacguguucgaggucgccaucacgaucauguacaugaugaucgaguccaagagccccauccaggugggcgggcacgugcuggccggcuucgaguccaucaccccgcucaccgcggucgagaagggggcccuguuccugcucgugugcagccgcuucugccagucccuggugauggccgccuacagcugccagcuguaccccgagaacaaggacuaccucauggucaccgccaagacgggcuggaagcaccuccagcagauguucgacaugggccagaaggcgguggaggagaucugguucgagaccgccaaguccuacgagagcgggaucuccauguga

SEQ ID NO: 31381 - RNA, 900 nt, Artificial Sequence
  derived and/or modified sequence opt1 from HYLS1__Homo_sapiens__NP_659451
auggaggagcugcuccccgacggccagaucugggccaacauggacccggaggagcgcaugcuggccgcggccaccgccuucacccacaucugcgccgggcagggcgagggggacgugcggcgcgaggcccagagcauccaguacgaccccuacuccaaggcgagcgucgcccccggcaagcggcccgcccugccggugcagcuccaguacccccacguggaguccaacguccccagcgagacgguguccgaggccagccagcgccugcggaagcccgugaugaagcgcaagguccugcggcgcaagccggacggggaggugcucgugaccgacgaguccaucaucagcgaguccgagagcggcaccgagaacgaccaggaccugugggaccugcggcagcgccucaugaacguccaguuccaggaggacaaggaguccagcuucgacgugucccagaaguucaaccugccccacgaguaccagggcaucagccaggaccagcugaucugcucccuccagcgggaggggaugggcagccccgcguacgagcaggaccugaucguggccucccgccccaagagcuucauccugccgaagcucgaccagcugucccggaaccgcgggaagaccgaccgggucgcccgcuacuucgaguacaagcgggacugggacagcauccgccugcccggcgaggaccaccggaaggagcuccgcuggggcgugcgggagcagaugcugugccgcgccgagccccagagcaagccccagcacaucuacgugccgaacaacuaccugguccccacggagaagaagcgcuccgcccuccgguggggcgugcgcugcgaccuggcgaacggggugaucccccggaagcugcccuucccgcucagccccuccuga

SEQ ID NO: 31382 - RNA, 3000 nt, Artificial Sequence
  derived and/or modified sequence opt1 from HYOU1__Homo_sapiens__NP_001124463
auggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcuguga

SEQ ID NO: 31383 - RNA, 354 nt, Artificial Sequence
  derived and/or modified sequence opt1 from HYPM__Homo_sapiens__NP_036406
augagcgagaagaagaacugcaagaacuccagcaccaacaacaaccagacccaggaccccucccgcaacgagcuccaggugccgcggagcuucgucgaccgcguggugcaggacgagcgggacguccagucccagagcuccagcacgaucaacacccugcugacccugcucgacugccuggccgacuacaucauggagcgcgugggccuggaggccuccaacaacgggagcaugcggaacaccucccaggaccgcgagcgggagguggacaacaaccgcgagccccacagcgcggaguccgacgucacgcgguuccucuucgacgagaugcccaagagccgcaagaacgacuga

SEQ ID NO: 31384 - RNA, 270 nt, Artificial Sequence
  derived and/or modified sequence opt1 from IAPP__Homo_sapiens__NP_000406
augggcauccugaagcuccagguguuccugaucguccugagcguggcccucaaccaccugaaggccacccccaucgagucccaccagguggagaagcgcaagugcaacaccgcgacgugcgccacccagcggcuggccaacuuccucguccacagcuccaacaacuucggggccauccugagcuccaccaacgugggcagcaacaccuacgggaagcgcaacgccguggagguccugaagcgggagccgcucaacuaccugccccuguga

SEQ ID NO: 31385 - RNA, 3039 nt, Artificial Sequence
  derived and/or modified sequence opt1 from IARS2__Homo_sapiens__NP_060530
augcgcuggggccugcggccccgcgggccgggcgccgccgcgcucgccaccgcccggagccugugggggacgccccgccugcccugcucccccggcuggcagggggccaccaagcggcuccuggugcgcagcgucuccggcgccagcaaccaccagccgaacuccaacagcggccgguaccgcgacaccgugcugcucccccagaccuccuuccccaugaagcugcuggggcggcagcagcccgacaccgagcucgagauccagcagaagugcggcuucagcgagcuguacuccuggcagcgcgagcggaaggugaagacggaguucugccugcacgacgggccgcccuacgcgaacggcgacccccacgucgggcacgcccucaacaagauccugaaggacaucgccaaccgcuuccacaugaugaacggcagcaagauccacuucgugcccggcugggacugccacgggcugccgaucgagaucaaggugcucuccgagcugggccgggaggcccagaaccugagcgcgauggagauccgcaagaaggcccgguccuucgccaaggccgccaucgagaagcagaaguccgcguucauccgcugggggaucauggccgacuggaacaacugcuacuacaccuucgacggcaaguacgaggccaagcagcuccggaccuucuaccagauguacgacaagggccuggucuaccgcuccuacaagcccguguucuggagccccuccagccggaccgcccuggccgaggcggagcucgaguacaaccccgagcacgugucccgcagcaucuacgucaaguucccgcugcugaagcccagccccaagcucgccucccugaucgacgggagcucccccgugagcauccugguguggacgacccagccguggaccauccccgccaacgaggccgucugcuacaugcccgaguccaaguacgccguggugaagugcagcaaguccggcgaccucuacguccuggcggccgacaagguggccagcguggccuccacccuggagacgaccuucgagaccaucagcacccucuccggggucgaccuggagaacggcacgugcagccacccccugaucccggacaaggccagcccccuccugcccgcgaaccacgugaccauggccaaggggaccggccuggugcacaccgcccccgcccacggcauggaggacuacggggucgcgagccagcacaaccucccgauggacugccugguggacgaggacggcguguucacggacgucgccgggcccgagcugcagaacaaggccgugcucgaggagggcaccgacgucgugaucaagaugcugcagaccgccaagaaccugcucaaggaggagaagcuggugcacuccuaccccuacgacuggcggaccaagaagccggucgugauccgcgccagcaagcagugguucaucaacaucacggacaucaagaccgcggccaaggagcugcucaagaaggugaaguucauccccggguccgcccugaacggcauggucgagaugauggaccgccggcccuacuggugcaucagccgccagcggguguggggcgugcccaucccggucuuccaccacaagaccaaggacgaguaccugaucaacucccagaccacggagcacaucgugaagcucguggagcagcacgggagcgacaucugguggacccugccgcccgagcagcugcugcccaaggagguccucagcgaggugggcgggcccgacgcccuggaguacgugcccggccaggacauccuggacaucugguucgacuccgggaccagcugguccuacguccuccccggccccgaccagcgcgccgaccuguaccuggagggcaaggaccagcucgggggcugguuccagagcucccugcugaccagcguggcggcccggaagcgcgccccguacaagacggugaucguccacggguucacccucggcgagaagggcgagaagauguccaagagccuggggaacgugauccaccccgacguggucgugaacggcgggcaggaccaguccaaggagccgcccuacggcgccgacgugcugcgguggugggucgccgacagcaacguguucaccgagguggcgaucgggcccuccguccucaacgccgcccgcgacgacaucagcaagcugcggaacacccugcgcuuccuccugggcaacguggccgacuucaaccccgagacggacuccauccccgugaacgacauguacgucaucgaccaguacaugcugcaccuccugcaggaccuggcgaacaagaucaccgagcucuacaagcaguacgacuucggcaagguggugcggcugcugcgcaccuucuacacccgggagcucagcaacuucuacuucuccaucaucaaggaccgccuguacugcgagaaggagaacgaccccaagcggcgcagcugccagaccgcccuggucgagauccucgacgugaucgugcgguccuucgccccgauccugccccaccuggccgaggaggucuuccagcacauccccuacaucaaggagcccaagagcguguuccgcacgggguggaucagcaccuccagcaucuggaagaagccgggccucgaggaggccguggaguccgcgugcgccaugcgggacagcuuccugggguccauccccggcaagaacgccgccgaguacaaggucaucaccgugaucgagcccgggcuccuguucgagaucaucgagaugcugcagagcgaggagaccuccagcacgucccagcugaacgagcucaugauggccagcgaguccacccugcuggcgcaggagccgcgcgagaugaccgccgacgugaucgagcucaagggcaaguuccugaucaaccuggagggcggggacauccgcgaggagagcuccuacaaggucaucgugaugcccaccacgaaggagaagugcccccggugcuggaaguacaccgccgagagcuccgacacccucugcccccgcugcgccgagguggucagcggcaaguga

SEQ ID NO: 31386 - RNA, 3789 nt, Artificial Sequence
  derived and/or modified sequence opt1 from IARS__Homo_sapiens__NP_038203
augcugcagcagguccccgagaacaucaacuucccggccgaggaggagaagauccucgaguucuggaccgaguucaacugcuuccaggagugccugaagcagagcaagcacaagcccaaguucaccuucuacgacggcccgcccuucgccacggggcugccccacuacggccacauccucgcggggaccaucaaggacaucgugacccgcuacgcccaccaguccggcuuccacguggaccggcgcuucgggugggacugccacggccugcccguggaguacgagaucgacaagacccugggcauccgggggcccgaggacgucgccaagaugggcaucacggaguacaacaaccagugccgcgccaucgugaugcgguacagcgccgaguggaaguccaccgugagccgccucgggcgguggaucgacuucgacaacgacuacaagacccuguacccccaguucauggaguccgucugguggguguucaagcagcuguacgacaagggccucguguaccgcggggucaaggugaugccguucagcaccgcgugcaacacgccccuguccaacuucgagagccaccagaacuacaaggacgugcaggaccccuccgucuucgugaccuucccccuggaggaggacgagaccgugagccucgucgccuggaccacgaccccguggacccugcccuccaaccuggccgugugcgugaaccccgagaugcaguacgucaagaucaaggacguggcccggggccgccuccugauccugauggaggcgcggcucagcgcccuguacaagcuggaguccgacuacgagauccucgagcgcuuccccggcgccuaccugaaggggaagaaguaccggccgcuguucgacuacuuccucaagugcaaggagaacggcgccuucaccgugcuggucgacaacuacgugaaggaggaggaggggacgggcgugguccaccaggcccccuacuucggcgcggaggacuaccgcgugugcauggacuucaacaucauccggaaggacagccugcccgucugccccguggacgccuccgggugcuucaccaccgaggugaccgacuucgccggccaguacgucaaggacgccgacaagagcaucauccgcacgcucaaggagcaggggcggcugcugguggccaccaccuucacccacuccuacccguucugcuggcgcagcgacacgccccucaucuacaaggcggugcccuccugguucguccggguggagaacaugguggaccagcugcugcgcaacaacgaccucugcuacuggguccccgagcuggugcgggagaagcgcuucggcaacuggcugaaggacgcccgcgacuggaccaucagccggaaccgcuacugggggaccccgaucccccucugggugagcgacgacuucgaggaggucgugugcaucggcuccguggccgagcuggaggagcugagcggcgccaagaucuccgaccuccaccgggagagcgucgaccaccugaccauccccucccgcugcgggaagggcagccugcaccggaucuccgagguguucgacugcugguucgagagcggguccaugcccuacgcccaggugcacuacccguucgagaacaagcgcgaguucgaggacgcguuccccgccgacuucaucgccgagggcaucgaccagacgcgggggugguucuacacccuccugguccuggccaccgcccucuucggccagcccccguucaagaacgugaucgugaacggccugguccuggcgagcgacgggcagaagauguccaagcgcaagaagaacuaccccgaccccgugagcaucauccagaaguacggcgccgacgcccuccggcuguaccugaucaacucccccgugguccgcgccgagaaccugcgguucaaggaggagggggugcgcgacgugcucaaggacguccugcugccgugguacaacgcguaccgguuccucauccagaacgugcugcgccugcagaaggaggaggagaucgaguuccucuacaacgagaacaccgugcgggagagccccaacaucacggaccgcuggauccuguccuucaugcagagccugaucggcuucuucgagaccgagauggccgccuaccggcucuacaccgucgugccccgccuggugaaguucgucgacauccugaccaacugguacgugcggaugaaccgccgccggcucaagggggagaacggcauggaggacugcgugauggcccuggagacgcuguucuccguccuccugagccugugccgccucauggcccccuacaccccguuccugaccgagcugauguaccagaaccucaaggugcugaucgaccccguguccguccaggacaaggacacccugagcauccacuaccucaugcugccccgggugcgcgaggagcugaucgacaagaagaccgagagcgcggugucccagaugcagagcgucaucgagcucggccgggugauccgcgaccggaagacgauccccaucaaguacccgcugaaggagaucguggucauccaccaggaccccgaggcccugaaggacaucaagucccucgagaaguacaucaucgaggagcugaacgugcgcaaggugacccugagcaccgacaagaacaaguacgggauccggcuccgcgccgagcccgaccacaugguccugggcaagcggcugaagggggccuucaaggccgugaugaccuccaucaagcagcucagcuccgaggagcuggagcaguuccagaagacgggcaccaucguggucgagggccacgagcugcacgacgaggacauccgccucauguacaccuucgaccaggcgaccgggggcacggcccaguucgaggcccacagcgacgcccaggcccuggugcugcucgacgucacccccgaccaguccaugguggacgaggggauggcgcgggaggugaucaaccgcauccagaagcugcggaagaagugcaaccuggucccgaccgacgagaucaccguguacuacaaggccaagagcgagggcacguaccucaacuccgugaucgagagccacaccgaguucaucuucaccaccaucaaggcgccccugaagcccuaccccgucuccccgagcgacaaggugcugauccaggagaagacgcagcucaagggguccgagcuggagaucacccugacccgcggcagcucccuccccggccccgccugcgccuacgugaaccugaacaucugcgccaacgggagcgagcagggcgggguccugcuccuggagaaccccaagggcgacaaccggcuggaccuccugaagcucaagagcguggugaccuccaucuucggggucaagaacacggagcucgccguguuccacgacgagaccgagauccagaaccagaccgaccugcugagccucuccggcaagacccugugcgugacggccggcagcgccccgucccugaucaacagcuccagcacccuccugugccaguacaucaaccugcagcuccugaacgcgaagccccaggagugccugauggggaccgucggcacccuccugcuggagaacccccucgggcagaacggccugacgcaccaggggcugcucuacgaggccgccaagguguucggccugcgcucccggaagcugaagcuguuccugaacgagacccagacccaggagaucaccgaggacaucccggugaagacgcugaacaugaagaccgucuacgugagcgugcuccccaccaccgccgacuucuga

SEQ ID NO: 31387 - RNA, 1071 nt, Artificial Sequence
  derived and/or modified sequence opt1 from IBA57__Homo_sapiens__NP_001010867
auggccaccgccgcgcugcuccgcggcgccacccccgggcggggcgggccgguguggcgcuggcggcugcgcgccgcgccccggugccgccuggcccacagcuccugcagccccggcggggaccccacggccggcgccgccugggccugcuuccggcucgacggccgcacccugcugcggguccgcgggccggacgcggcccccuuccuccugggccugcucaccaacgagcugccccugcccuccccggccgccgccggggcgccgcccgccgcccgggccggcuacgcccacuuccucaacgugcaggggcgcacccuguacgacgugauccuguacggccuccaggagcacagcgaggucuccggcuuccugcuggagugcgacagcuccgugcagggggcgcuccagaagcaccuggcccuguaccggauccgccggaaggugacggucgagccccaccccgagcuccgcgugugggccgugcugcccagcucccccgaggccugcggcgccgcgagccugcaggagcgggccggggccgccgccauccucauccgcgacccccggaccgcgcgcaugggcuggcggcugcugacccaggacgagggcccggcccucguccccgggggccgccugggggaccugugggacuaccaccagcaccgcuaccuccagggcgugcccgagggggugcgggaccugcccccgggcgucgcccugccccucgaguccaaccuggccuucaugaacggcgugagcuucaccaaggggugcuacaucggccaggagcugacggcgcgcacccaccacaugggggugauccggaagcgccucuuccccguccgguuccuggacccccugccgaccuccggcaucacccccggggccacggugcucaccgccagcggccagaccgugggcaaguuccgcgccgggcagggcaacgucgggcuggcccugcucugguccgagaagaucaagggcccccugcacauccgggcgagcgagggggcccagguggcccuggccgccuccgugcccgacugguggccgaccgucagcaaguga

SEQ ID NO: 31388 - RNA, 954 nt, Artificial Sequence
  derived and/or modified sequence opt1 from IBSP__Homo_sapiens__NP_004958
augaagaccgcccugauccuccugagcauccugggcauggccugcgcguucuccaugaagaaccuccaccgccgggugaagaucgaggacagcgaggagaacggggucuucaaguaccgcccccgguacuaccuguacaagcacgccuacuucuacccccaccugaagcgcuuccccgugcagggcuccagcgacuccagcgaggagaacggggacgacuccagcgaggaggaggaggaggaggaggagaccuccaacgagggcgagaacaacgaggagagcaacgaggacgaggacuccgaggccgagaacacgacccucagcgccaccacccugggguacggcgaggacgccacgcccggcaccggguacaccggccuggcggccauccagcuccccaagaaggccggggacaucaccaacaaggccacgaaggagaaggaguccgacgaggaggaggaggaggaggaggagggcaacgagaacgaggagagcgaggcggagguggacgagaacgagcaggggaucaacggcaccuccaccaacagcaccgaggccgagaacggcaacggguccagcggcggggacaacggcgaggagggcgaggaggaguccgucacgggggccaacgccgaggacaccaccgagaccggccggcaggggaagggcacgagcaagaccaccaccagcccgaacgggggcuucgagcccacgaccccgccccagguguaccgcaccaccuccccgcccuucggcaagacgaccaccguggaguacgagggggaguacgaguacaccggcgccaacgaguacgacaacggguacgagaucuacgagagcgagaacggcgagccccgcggggacaacuaccgggcguacgaggacgaguacuccuacuucaagggccagggcuacgacggguacgacggccagaacuacuaccaccaccaguga

SEQ ID NO: 31389 - RNA, 4062 nt, Artificial Sequence
  derived and/or modified sequence opt1 from IBTK__Homo_sapiens__NP_056340
augagcucccccaugccggacugcaccagcaagugccgcucccugaagcacgcccucgacgugcugagcgucgugaccaagggcuccgagaaccagaucaaggccuuccugagcucccacugcuacaacgcggccaccaucaaggacguguucgggcggaacgcccuccaccuggucagcuccugcggcaagaagggggugcuggacuggcucauccagaagggcguggaccugcuggucaaggacaaggagagcggguggaccgcccuccaccgcuccaucuucuacggccacaucgacugcguguggagccugcugaagcacggcgugucccucuacauccaggacaaggaggggcugagcgcccuggaccucgucaugaaggaccggcccacccacgugguguucaagaacaccgaccccacggacgucuacaccuggggcgacaacaccaacuucacccuggggcacggcucccagaacagcaagcaccaccccgagcugguggaccucuucucccgcagcgggaucuacaucaagcaggucguccugugcaaguuccacuccguguuccugagccagaagggccagguguacacgugcggccacgggccgggcgggcggcucggccacggcgacgagcagaccugccuggucccccgccugguggaggggcucaacggccacaacugcagccagguggcggccgccaaggaccacaccgucgugcugaccgaggacgggugcguguacacguucggccugaacaucuuccaccagcucgggaucaucccgccgcccuccagcugcaacgucccccggcagauccaggccaaguaccugaagggccgcaccaucaucggcguggcggccgggcgguuccacaccguccuguggacccgcgaggccguguacacgaugggccucaacgggggccagcuggggugccugcucgaccccaacggcgagaagugcgugaccgcgccccggcaggucuccgcccugcaccacaaggacaucgcccugagccucguggccgccuccgacggcgccaccgugugcgucaccacgcgcggggacaucuaccugcuggccgacuaccagugcaagaagauggcgagcaagcagcucaaccugaagaaggugcugguguccggcgggcacauggaguacaaggucgaccccgagcaccucaaggagaacggcgggcagaagaucugcauccuggccauggacggcgccggccggguguucugcuggcgcagcgugaacuccagccugaagcagugccggugggccuacccccgccaggucuucaucuccgacaucgcccucaaccggaacgagauccuguucgugacccaggacggggagggcuuccgcgggcggugguucgaggagaagcgcaagagcuccgagaagaaggagauccugagcaaccuccacaacuccagcuccgacgugagcuacguguccgacaucaacagcguguacgagcggauccgccuggagaagcugaccuucgcgcaccgcgccgugagcgucuccaccgaccccagcggcugcaacuucgccauccugcaguccgaccccaagacgagccucuacgagaucccggccguguccagcuccagcuucuucgaggaguucggcaagcugcugcgggaggccgacgagauggacuccauccacgacgugaccuuccaggucgggaaccgccucuuccccgcgcacaaguacauccuggccgugcacagcgacuucuuccagaagcuguuccucuccgacggcaacaccagcgaguucaccgacaucuaccagaaggacgaggacuccgccgggugccaccuguucguggucgagaaggugcaccccgacauguucgaguaccugcuccaguucaucuacacggacacgugcgacuuccugacccacggcuucaagccccggauccaccugaacaagaacccggaggaguaccaggggacccucaacagccaccugaacaaggugaacuuccacgaggacgacaaccagaaguccgccuucgaggucuacaagagcaaccaggcgcagaccguguccgagcgccagaaguccaagcccaagagcugcaagaagggcaagaacauccgggaggacgaccccgugcgcaugcugcagaccgucgccaagaaguucgacuucagcaaccucagcucccggcuggacggcgugcgcuucgagaacgagaagaucaacgugaucgccaagaacaccgggaacaagcugaagcucagccagaagaagugcuccuuccugugcgacgucaccaugaaguccguggacggcaaggaguuccccugccacaagugcgugcugugcgcccggcucgaguacuuccacagcaugcugagcuccagcuggaucgaggccuccagcugcgcggcccuggagaugccgauccacuccgacauccucaaggucauccuggacuaccuguacacggacgaggccguggugaucaaggagagccagaacgucgacuucaucugcuccgugcucguggucgccgaccagcugcugaucacccgccucaaggagaucugcgagguggcccugaccgagaagcugacccucaagaacgcggccaugcugcuggaguucgccgccauguacagcgccaagcagcucaagcuguccugccugcaguucaucgggcucaacauggcggcccugcuggaggcccggagccucgacgugcuguccgacggcguccugaaggaccucagcgaguucuaccgcaagaugauccccgccauggaccggcgcgugaucacccccuaccaggacgggcccgacaucagcuaccuggagguggaggacggcgacaucuuccugaaggaggagaucaacauggagcagaaccacuccgagacgauguucaagaaggcgaagaccaaggccaagaagaagccgcggaagcgcagcgacuccagcggcggguacaaccucuccgacaucauccagagccccuccagcaccggccugcugaaguccgggaagaccaacagcgucgagucccuccccgagcugcugacgagcgacuccgagggcagcuacgccggggugggcuccccgcgggaccuccagagccccgacuucaccaccggcuuccacuccgacaagaucgaggccaaggugaagcccuacgucaacgggaccagccccguguacucccgcgaggaccugaagccgugggagaagucccccauccugaagaucagcgcgccccagcccaucccgagcaaccggaucgacacgaccagcuccgccagcugggucgccggcuccuucagccccguguccccgcccguggucgaccuccgcaccaucauggagaucgaggagagccgccagaagugcggggccacccccaagucccaccugggcaagacggugagccacggggugaagcugucccagaagcagcggaagaugaucgcccucaccaccaaggagaacaacagcggcaugaacuccauggagaccguccuguucacgcccagcaaggcccccaagcccgugaacgcgugggccuccagccugcacuccgugagcuccaagagcuuccgcgacuuccuccuggaggagaagaaguccgucaccagccacagcuccggcgaccacgugaagaaggugagcuucaaggggaucgagaacucccaggccccgaagaucguccggugcagcacccacggcacccccgggcccgagggcaaccacaucuccgaccugccccuccuggacagcccgaaccccuggcuguccagcuccgugacggcccccagcaugguggcccccgucaccuucgcguccaucguggaggaggagcuccagcaggaggccgcccugauccgcagccgggagaagccgcuggcccucauccagaucgaggagcacgcgauccaggaccugcugguguucuacgaggccuucggcaaccccgaggaguucgucaucguggagcgcacgccccaggggccgcucgccgugcccauguggaacaagcacggcugcuga

SEQ ID NO: 31390 - RNA, 1449 nt, Artificial Sequence
  derived and/or modified sequence opt1 from ICA1__Homo_sapiens__NP_001263407
augagcggccacaagugcuaccccugggaccugcaggaccgcuacgcccaggacaaguccguggucaacaagaugcagcagaaguacugggagaccaagcaggccuucaucaaggcgaccgggaagaaggaggacgagcacgugguggccagcgacgccgaccucgacgccaagcuggagcuguuccacuccauccagcggacgugccucgaccugagcaaggccaucguccuguaccagaagcgcaucugcuuccucucccaggaggagaacgagcugggcaaguuccugcggagccagggguuccaggacaagacccgcgcgggcaagaugaugcaggccaccgggaaggcccucugcuucuccagccagcagcggcuggcccugcgcaacccgcucugccgguuccaccaggagguggagaccuuccgccaccgggcgaucuccgacacguggcugaccgugaaccgcauggagcagugccggaccgaguaccgcggcgcccugcucuggaugaaggacgucagccaggagcuggaccccgaccuguacaagcagauggagaaguuccggaaggugcagacccaggugcgccucgccaagaagaacuucgacaagcugaagauggacgucugccagaagguggaccugcucggcgccucccggugcaaccugcugagccacaugcucgccacguaccagaccacccugcugcacuucugggagaagaccucccacacgauggcggccauccacgagagcuucaagggguaccagcccuacgaguucaccacccucaagucccugcaggaccccaugaagaagcugguggagaaggaggagaagaagaagaucaaccagcaggagagcaccgacgccgccguccaggagccgucccagcucaucagccuggaggaggagaaccagcgcaaggaguccagcagcuucaagacggaggacggcaaguccauccugagcgcccucgacaagggguccacccacaccgcgugcagcggccccaucgacgagcugcuggacaugaaguccgaggagggggccugccucggccccguggccggcacccccgagccggagggggccgacaaggacgaccugcugcuccugagcgagaucuucaacgccuccagccuggaggagggcgaguucuccaaggagugggcggccguguucggggacggccaggucaaggagcccgugcccacgauggcccucggcgagcccgacccgaaggcccagaccgggagcggcuuccugcccucccagcugcucgaccagaacaugaaggaccugcaggccagccugcaggagcccgcgaaggccgccuccgaccucaccgccugguucagccuguucgcggaccuggacccccuguccaacccggacgccguggggaagaccgacaaggagcacgagcuccugaacgccuga

SEQ ID NO: 31391 - RNA, 1599 nt, Artificial Sequence
  derived and/or modified sequence opt1 from ICAM1__Homo_sapiens__NP_000192
auggcccccagcuccccgcgccccgcccugcccgcgcuccuggugcugcucggcgcccuguuccccgggccgggcaacgcccagaccagcgucucccccagcaaggugauccugccccgcgggggcuccgugcucgugaccugcagcacguccugcgaccagcccaagcugcuggggaucgagaccccgcuccccaagaaggagcugcugcuccccggcaacaaccggaaggucuacgagcugagcaacgugcaggaggacucccagcccaugugcuacagcaacugcccggacggccaguccaccgccaagaccuuccugacggucuacuggacccccgagcggguggagcucgccccgcugcccagcuggcagcccguggggaagaaccugacccuccgcugccaggucgagggcggggcgccccgggccaaccugaccguggugcugcuccgcggcgagaaggagcugaagcgggagcccgccgucggggagcccgccgaggugacgaccaccgugcugguccgccgggaccaccacggcgcgaacuucuccugccgcaccgagcucgaccugcggccgcagggccuggagcuguucgagaacacgagcgcccccuaccagcuccagaccuucgugcugcccgccacgcccccgcagcucgugagcccccgcguccuggagguggacacccaggggaccguggucugcucccuggacggccucuuccccguguccgaggcccaggugcaccuggcccugggggaccagcggcucaaccccaccgucaccuacggcaacgacagcuucuccgcgaaggccagcgugagcgucaccgccgaggacgagggcacgcagcgccugaccugcgccgugauccuggggaaccagucccaggagacccuccagaccgugacgaucuacagcuucccggcccccaacgucauccugaccaagcccgagguguccgagggcaccgaggugaccgucaagugcgaggcgcacccgcgggccaaggugacgcugaacggggugcccgcccagccccucggcccccgcgcccagcugcugcucaaggccaccccggaggacaacgggcggagcuucuccugcagcgcgacccuggaggucgccggccagcugauccacaagaaccagacccgcgagcuccgggugcuguacggcccccgccuggacgagcgggacugccccgggaacuggacguggcccgagaacucccagcagaccccgaugugccaggccuggggcaacccccugcccgagcucaagugccugaaggacgggaccuucccccugccgaucggcgagagcgugaccgucacgcgcgaccucgaggggaccuaccugugccgcgcccgguccacccagggcgaggugacccgcaaggugaccgucaacgugcugagcccccgguacgagaucgugaucaucacggucguggccgcggccgugaucaugggcaccgccgggcucuccaccuaccuguacaaccgccagcggaagaucaagaaguaccgccugcagcaggcccagaagggcacccccaugaagcccaacacgcaggcgaccccgcccuga

SEQ ID NO: 31392 - RNA, 828 nt, Artificial Sequence
  derived and/or modified sequence opt1 from ICAM2__Homo_sapiens__NP_001093259
augagcuccuucggcuaccgcacccugaccguggcccucuucacgcugaucugcugccccgggagcgacgagaaggucuucgaggugcacgugcggccgaagaagcuggccgucgagcccaagggcucccucgaggugaacugcagcacgaccugcaaccagcccgaggucgggggccuggagaccucccuggacaagauccuccuggacgagcaggcgcaguggaagcacuaccuggugagcaacaucucccacgacaccgugcuccagugccacuucacgugcagcgggaagcaggaguccaugaacagcaacguguccgucuaccagcccccgcgccaggugauccugacccugcagcccacccucguggccgucggcaagagcuucaccaucgagugccgggugcccaccguggagccccuggacucccugacccucuuccuguuccgcggcaacgagacccugcacuacgagacguucgggaaggccgccccggcgccccaggaggccaccgccaccuucaacagcaccgccgaccgggaggacggccaccgcaacuucuccugccucgccguccuggaccugaugagccgcgggggcaacaucuuccacaagcacuccgcgcccaagaugcucgagaucuacgagcccgugagcgacucccagauggugaucaucgucacgguggugagcguccugcugagccucuucgugaccuccgugcugcugugcuucaucuucgggcagcaccuccggcagcagcggaugggcaccuacggcguccgcgccgccuggcggcgccugccgcaggccuuccggcccuga

SEQ ID NO: 31393 - RNA, 1644 nt, Artificial Sequence
  derived and/or modified sequence opt1 from ICAM3__Homo_sapiens__NP_002153
auggccaccauggugcccagcguccuguggccgcgcgccugcuggacccuccuggugugcugccugcucacgcccggcgugcaggggcaggaguuccugcugcgggucgagccccagaaccccgugcucuccgcgggcgggagccuguucgugaacugcuccaccgacugcccgagcuccgagaagaucgcccuggagaccagccucuccaaggagcuggucgccagcggcauggggugggccgccuucaaccuguccaacgugaccggcaacagccgcauccucugcuccguguacugcaacggcagccagaucacgggguccagcaacaucaccgucuaccggcugcccgagcgcguggagcuggcgccccugcccccguggcagcccgugggccagaacuucacccuccggugccaggucgaggacgggagcccccgcaccucccugacgguggugcuccugcggugggaggaggagcugucccgccagcccgccgucgaggagccggccgaggugaccgccaccgugcucgcgagccgggacgaccacggcgcccccuucuccugccgcaccgagcuggacaugcagccccaggggcugggccucuucgucaacacgagcgcgccccggcagcugcgcaccuucgugcugccggugaccccgccccggcucgucgcgccccgcuuccuggagguggagaccagcuggcccguggacugcacgcuggacggccucuuccccgccuccgaggcccaggucuaccuggcccugggggaccagaugcucaacgccaccgugaugaaccacggcgacacccugaccgccacggccaccgccaccgcccgggccgaccaggagggggcccgcgagaucgucugcaacgugacccugggcggcgagcggcgcgaggcccgggagaaccucacgguguucagcuuccuggggcccaucgucaaccuguccgagcccaccgcgcacgagggcagcaccgugaccguguccugcauggccggggcccgcguccaggugacgcucgacggcgugccggccgccgcgcccgggcagcccgcccagcugcagcugaacgccaccgagagcgacgacggccgguccuucuucugcagcgccacccucgaggucgacggcgaguuccugcaccgcaacuccagcgugcagcugcgcgugcucuacgggcccaagaucgaccgggcgaccugcccgcagcaccugaaguggaaggacaagacgcgccacguccugcagugccaggcccggggcaaccccuaccccgagcuccgcugccugaaggagggguccagccgggaggugccggugggcauccccuucuucgucaacgugacccacaacgggaccuaccagugccaggccuccagcucccgcggcaaguacacccugguggucgugauggacaucgaggccggcagcucccacuucgugcccgucuucguggccgugcugcucacgcugggggucgugaccaucgugcuggcgcucauguacgucuuccgggagcaccagcgcagcggcuccuaccacgugcgggaggagagcaccuaccugccccugaccagcaugcagccgaccgaggccaugggggaggagcccucccgcgccgaguga

SEQ ID NO: 31394 - RNA, 819 nt, Artificial Sequence
  derived and/or modified sequence opt1 from ICAM4__Homo_sapiens__NP_001034221
augggcagccuguucccccucucccugcuguucuuccucgccgccgcguacccgggggugggcagcgcccuggggcgccggaccaagcgcgcccagucccccaagggcagcccccuggcccccuccgggaccagcgucccguucugggugcggaugucccccgaguucguggccguccagcccggcaagagcgugcagcucaacugcuccaacagcugcccccagccgcagaacuccagccugcgcacgccccugcggcagggcaagacccuccgcgggcccggcuggguguccuaccagcugcuggacguccgggcguggagcucccucgcccacugccuggugaccugcgccgggaagacccgcugggccacgagccggaucaccgcguacuccgugcccggcgggcugcucggcggcgacccggaggccuggaagcccgggcaccuguuccgcaagcccggcgcccugcaccggcccgggagcggccagcgcgaccucgaccugcgggucugcugcuggaccccgcgccugcucgccgcccgggaccugccccgcgcgccccagucccggcgccccggcgggccgcagcagcugggcacccacuacacggacgcccggcucgagccccgcgcccacagcuucgggcugcgguuccaccgcugccccugccgcgacccgccccacugcggccggugcgugcccaugcagguccccagcuacgaggugcccggggugaagggcgacgugcugugccgccucuccgagaagaagcggaacaugaagcagagcggcgagauggccauccacgggggcuga

SEQ ID NO: 31395 - RNA, 2775 nt, Artificial Sequence
  derived and/or modified sequence opt1 from ICAM5__Homo_sapiens__NP_003250
augcccggccccagccccgggcugcgccgggcccuccugggccugugggccgcgcucgggcugggccuguucgggcucuccgccgugagccaggagcccuucugggccgaccugcagccccgcgucgccuucguggagcggggcggcucccuguggcucaacugcagcaccaacugcccgcgccccgagcgcgggggccuggagaccucccugcggcggaacgggacgcagcgcggccuccgguggcuggcccgccagcugguggacauccgggagcccgagacccagcccgucugcuucuuccgcugcgcgcggcgcacccuccaggcccgggggcugauccgcaccuuccagcggccggaccgcguggagcugaugccccucccgcccuggcagccggugggcgagaacuucacgcugagcugccggguccccggcgccgggccccgcgccucccugacccucacccugcugcggggcgcgcaggagcucauccgccgcagcuucgccggggagcccccgcgggcccgcggcgccgugcugaccgccacggugcuggcgcggcgcgaggaccacggcgccaacuucuccugccgggccgagcucgaccugcgcccccacgggcugggccucuucgagaacagcuccgcgccccgggagcugcgcaccuucagccugucccccgacgccccgcggcucgcggcgccccgccugcuggaggucgggagcgagcggcccguguccugcacccucgacggccuguuccccgccagcgaggcccgcguguaccuggcccucggggaccagaaccuguccccggacgucacccuggagggcgacgcguucguggccacggccaccgccaccgccagcgcggagcaggagggcgcccggcagcucgugugcaacgucacccucgggggcgagaaccgcgagacgcgggagaacgugaccaucuacuccuuccccgcgccccugcugacccugagcgagcccagcguguccgaggggcagauggucaccgugacgugcgccgccggcgcccaggcccuggugacccucgagggggucccggccgccgugcccggccagcccgcgcagcugcagcugaacgccaccgagaacgacgaccgccggagcuucuucugcgacgccacccuggacguggacggcgagacgcucaucaagaaccgcuccgccgagcugcggguccuguacgccccgcgccucgacgacagcgacugcccccgcuccuggaccuggcccgaggggcccgagcagacccugcggugcgaggcgcgcggcaacccggagcccagcgugcacugcgcccgguccgacgggggcgccguccuggcccucgggcugcugggccccgugacccgcgcccucagcggcacguaccggugcaaggcggccaacgaccagggggaggccgugaaggacgucacccugaccguggaguacgcccccgcgcuggacuccgugggcugcccggagcgcaucaccuggcucgaggggacggaggccagccuguccugcgucgcccacggcgugcccccgcccgacgugaucugcguccggagcggcgagcugggggccgugaucgagggccuccugcgcguggcccgggagcacgcggggaccuaccgcugcgaggccaccaacccccggggcuccgccgccaagaacgucgccgugaccguggaguacgggccccgcuucgaggagcccagcugccccuccaacuggacgugggucgagggcagcggccggcuguucuccugcgagguggacgggaagccgcagcccagcgugaagugcgucggcuccgggggcgcgaccgagggggugcuccugccccuggcgcccccggaccccagcccccgcgcgccccggaucccgcgcgugcucgcccccggcaucuacgucugcaacgccaccaaccggcacggcagcguggccaagaccguggucguguccgccgagagcccgcccgagauggacgagagcacgugccccucccaccagaccuggcuggagggggccgaggccuccgcccuggccugcgccgcccgcggccggcccagccccggggugcgcugcucccgggagggcaucccguggcccgagcagcagcgcgucagccgcgaggacgccgggaccuaccacugcguggcgaccaacgcccacggcaccgacucccggacggugaccgucggcguggaguaccgccccguggucgccgagcucgccgccagcccgcccgggggcgugcggcccgggggcaacuucacccugaccugccgcgcggaggccuggccgcccgcccagaucuccuggcgggccccgcccggggcccugaacaucggccucagcuccaacaacagcacgcuguccguggcgggcgccauggggagccacggcggggaguacgagugcgccgccaccaacgcccacggccgccacgcgcggcgcaucaccguccggguggccggccccuggcuguggguggccgucgggggcgccgccgggggcgccgcccuccuggccgccggggcgggccuggccuucuacgugcaguccaccgccugcaagaagggcgaguacaacgugcaggaggccgagagcagcggggaggccgucugccucaacggcgccgggggcggggccggcggcgccgccggggccgagggcgggcccgaggcggccggcggggccgccgagucccccgcggagggcgagguguucgccauccagcugacgagcgccuga

SEQ ID NO: 31396 - RNA, 6801 nt, Artificial Sequence
  derived and/or modified sequence opt1 from ICE1__Homo_sapiens__NP_056140
augaugcccggcgagacccacagcgccgcccccgggaccgccgccgaccugucccggugccagggcugcgccagccuccagcagaaccugaacgaguacguggaggcccugaucacgcucaagcagaagaucaucaacaccgacaaccugcugaccgaguaccagaagaagugcgacgagcuccaguucgcccggcgcgagaacuccaaccugcaccaccaggucgaggagaugcugcagaagaucagcccccuccagaagugccaggaggagcuggggucccugaaggcggagcucgaggagaagaaguccucccugaagcuguaccaggacacccaccaggaguacgcccgggugaaggaggagugccucaagagcgacgcccagaagaagaagcuggaggccaaggugaagaagcugcaggaggcggccgucaagcagacgcaggacuucaagcagcuccgcaacgagaagaagauccuggagaaggaguucaagaagacccaggagcggcuggacgaguucuccaagcagaagaacgagaaggagcuccgccacaucggcacccagaucagcuccgacagcuacggguccaucgacaagcggaaggugaagcugcugcucaaggagcuguggcugugcgugaacaccacgcaccgccuccccggcgagggcagccggugcguccccgagaagcccgccaaggccaucaccuccagccgcgugcccggggaggacggcacccugccgcccacccaggggagcccccugcggacgagcaacgugcagaccugccucaccaagcuguccauggagaucaaggaggacuuccugugccagaacgucgagaagcagagcagcuccggcaccaacugcagcuccgaccacguguucaacgagaacgggaaccucgaggugcugguccagagccaccgcgacggcggcuccacggaguucguggaccacgaccacuucuucgacgaggaccugcaggccgcgaucgacuucuucaagcugccgccgccccuccugagccccgugcccagcccgccgcccaugagcagcccccaccccgggagccuccccuccagcuucgcccccgagaccuacuucggcgaguacaccgacuccagcgacaacgacuccguccagcugcggaacagcgccgagugcguguccgaggacgacaccacggagagccagaacuacuucgggucccugcgcaagaacaagggcagcggcaccugggaggagaagcccaagagccacgaggccauccaggcccucaacaccugggaggugaacaaggucaccacguccgggcuggagaccuucaccgcgacccugcgggagagcuccgccacgcacagccucgugggcgagaagcacuggaccaccgccucccgcagcauguccgaccggaagcgcgacauccugcacgagaccaagacgcagauggaggugcgggagauggacaagagcguccagaccgagaagaccauccacaagcugacccgcgggcucugcaucgagcggcuguccgccagccccgcccaggagaaggaggcggcccccggcaaguccgagcugugcagcagcccccuggggaagcgcccccucaacgagcugauggaguccgagggcaagacggugcuguccaagaugaugggcagccccaaguccgaguucaccaaguggacccgcaucaacgagaucaccagcgagcccgaccggaucaccgugagcgggcacuuccaccgccucucccgggagcuggagaaggagaaggaggacacgcagggcuucacccugggggagagccccgaguccgaggacgacgacagcggcgacgggauggacgucgccggccucgacaucgagaccuccuucagcuccagcuccacccugguggcccugagcgucggcuccaacccccagagcuccagcgggcucgacugcggcaacgacacggacaucaccaccaagguguucuccaccgagccccaccacagcgagcacaagcugcagacgaagacccugaacacccuccaccuccaguccgagccgcccgagugcagcaucgggggcaacaaccuggagaacucccucugcgcccugagccccgagcugggggcgagcaacuucaacgaccagaaguccagcggcaucgaguacaccaagguggucaagggccucacgaagauccacucccugccccgcagcguguucaugaaggccaccaaggacgggcagugcgagucccaggacccgcggaucgagcugacccucaacaagcccgacuucaccagccugaucggcucccaggccgcccugaucaagagcgggcucggcuucgugaaguccacgagcuggcaccacuccgaccugcugcgcaagggcggggaggagagccuccgggcgaaguccgagcacgagcagaagaccagccaccagcugcagaaggccaugcccuuccugcagaaccgcggccccaccccgaagcccgaccuccugcgggagaacaacaaccccgucgaguucaagaccacggccuccgugcugcccaaccaggugagcgucaucaccaagcagacccgcccggagaaggugcaguccgccaagcucgagcaccuccggccccaccgcguggagcccacccuggucacggagaacagcgggaacaagaccggcauguccaccguggccaagugcgacggggagcgggacgacaccacgcagaacaucaccgagguggcggccgucaagagcaucagccccgagguguccgccagccgccggaagcucgacuucaacuccccgggcggcagcucccccguggagaacagcgacugcuccaccaacagccgccuguccuucagccccgagaacauccugauccagaaccaggacaucguccgggaggccgccgugcagggggacggccagaagcagcgccagccccaggcgaccgaccucgacuccagcgggacgcacggcuccgagaugcugccggccaccgaggugaccgucagcgggggcuucuccguggaggagaccagcugcggcgacacggggcgguccggcggggaggcccuggccguggccaacgacagcaccuccacgccccagaacgcgaacggccucuggaagcugaaguccaccacccccgggggcgcccugcccgagugcuucggcaccaccgacaccaccuucagcuccgccuucugccgcaagcacggggagacgcaggacaccagccaguccagccucccgggcacccugcacugcuacaccgggauccgcgagggcggggacgacacggaggucgaguccgaggccuucagcugcuccgagggcagcgagcagcaggacgcgcccgacgacucccagaagaaccugggcgacaccgacgccgccguggccgaggugcggcccagccucgaggucggguaccugaccuccgcccugcaggacuucaacaucagcaccuucuccgagcucgaccgccugagcacguccgagguggugauguuccuggagagcugccagcucggcgacuacuccagcggggacuccgucagcgagugcagcuccaagggcacccugagcaaggagaugaacaaggagcugaaggcguccgagaucggcgagaaguaccggaagcagccgugcgaggaggagacccucgggaccugcgaggaguggaucgagagcgaggaggacgacuacucccugaagaacacgagccagcugacccagugcucccucgagacccugagcgaggugcugaccaagauccgccaggagcuccagacgaacuccgaggacugcaacggcaaggacaccgggagccugcugcuccugaacgugaacaacaacaugaccaccgagaaccugaaggagaagucccccuuccgggagacgaccggcagcuccagccacgccuccgagcccacgccccaggccgccgcccucgacaccgaggggagcuccccgaucagcggcaugccccagaacgagaacccccagucccgccccgaggcgcggagcgacgccggccgccagacggacgggggcgaggaggaccugccggagcccgucgagcccagcgcccugugcuccgacagcgugauggagcccuccaucgagcagagcuccaacugcgaggccgagaccaccuuccagugccagaucgccaccgugacgagcgaggucaucaacgugcucaucaacaaggaccagaaccuggugaucgagaagggggacaacuggaccaucaucuccggcgucgcggugcugccgcacguggaccaggucacccucugcgacauccccggggacauccccaucagccaggaccagggcgagcuggaggccggcugcauccccgugaccuccgccgagaaguccccggaggccucccacacggggcccgcguuccaggaggcccccugcggcaacaaccugagcugcccccaggaggacguguccagcuccgggcagagcaccaacuucgacaagucccggcuccgcaaccggccggucaagcccagcaucuggaucagcucccagaucuacgaccagaacuucgagacccagaucguggccagcgaccacaccuacuacaacuccaagcuggagcccagcggcaagaacaagaaccgcuccaagaucagcaacaaggaccaguccaacaagcccgugaagaccagcgccuccagccgggucgagacgcaccaguccgagguggcccagagcuucuccggggagaaggcgaacaccaagacccagcgcagccagacccagacgauccuggccaacgccgacaccuccaccccgaccgacugcagccccgacacgcucuccaagauccggcaggagguggggccgccccugccgccccugcucgcgccccugaucgccaccccgccccgcaccagccagccccugagcccccugaucagcagcuccagcccguccagccccgcgucccccgucggccaggugagccccuuccgggagaccccggugccgcccgccaugucccccuggccggaggacccccgccgggccuccccgcccgacccgucccccagccccuccgccgccagcgcguccgagcgcguggugcccagcccgcugcaguucugcgccgccacgcccaagcacgcccugcccguccccgggcggcucccgcccugcgccuccggccacgcggccgucggcggcccccaggagaacagcgugaagauccuggacaccauguaccccgagcuguccgcccgcgcccgcacccucaacauccugaagggcaacauccagcugacccgggggccgcccgcggacugcaagaaccugcccggcccggccagcgccaugaucggguucaagacgaucaccuccgccgccaccgcguucgucaagaccggcagcagcuccgggggcgacugcaaccaggacaagagccgcgaccucggcacgcagcaggacuccagcgggaagcggacccuguccaccagcacccugcgcuccgccaagcggcuccgccuggacacgggcagccccgagcccgagacccgcggggugaccgccgagggcauccacaagaaccugcccgggaaccucccgcccgccgagguggccaccacgaacgaggagcgcuccugcagcucccccgcggucagcgccgugucccagcugccccugagcccgaaggagaccguggagucccacgacaaggccaucgccaacgcccucaagaagaucgcggaguucagcuucgaccugcugcccgucauccggucccacguguacgugggcaacaucagcaagaagcccgucaugcgcgaccaggagaaggaggugguguacgaguucuccaccaccaagaagcaccucgccgagugccugcugcacagcauccucagcgagcugaagauccagaagaucuccauggaccacaacuacauccacgcccugugccgggucuacgugggcaucugccgccagcucggggaccuggagcgggcccgccuguucugcuacagccuccugaaggaggacuuccccgaguccgagaagcugacccuguucaucgcgaacauguggcacgacaucuuccugagccaguccgugaucaacaaggccaugcagcuggucgcccggcagcgcgccaagggcgaggugcucaacugccugcgggccuuccugaacugggagaagaacgcgccgguggacgucggguucauggugagcaagcuccugcugaccauccagcucugccccaagaccgaguuccagcccuccgagaaguucggcgaggaccugagcgacaacaccugggaguacaucuucgccaucgaccugcucugcugccaccagaaguggaucuggacgcacgacaacaucaucuccaaggagcuguggcccgugauggacaaguggaucaaguaccgcaaggggcacgccaacaucgccuacaccccggacaucaucaucgccagcauccugcggcucaucggccgccugggccagcuggggcucaaggagggcuuccccuccgcggucaagaacaucagcuccgugaucgggauguucauccagcacgcccacgacgaggacauccccuggggcauccagcuggccgccguguacgcccugugcgaccucagccccuccaacccggcggagaucagcaagauccuggaggccuggcgccgggaggccuccaagagcguccccuccgccaucgugagcugccuggaggaggugagcgcgcucuccaccgaggagcugggguga

SEQ ID NO: 31397 - RNA, 1152 nt, Artificial Sequence
  derived and/or modified sequence opt1 from ICE2__Homo_sapiens__NP_001263314
augagcuccaagauggugaucagcgagcccggccugaacugggacaucuccccgaagaacgggcucaagaccuucuucagccgcgagaacuacaaggaccacuccauggcccccagccugaaggagcugcggguccucuccaaccgccggaucggcgagaaccugaacgccagcgcguccagcguggagaacgagcccgccguguccagcgccacccaggccaaggagaaggucaagacgaccaucgggauggugcugcuccccaagccgcgcgugcccuacccccgguucucccgcuucagccagcgggagcagcgcuccuacgucgaccugcuggugaaguacgccaagauccccgcgaacagcaaggccgugggcaucaacaagaacgacuaccuccaguaccuggacaugaagaagcacgucaacgaggaggugaccgaguuccugaaguuccuccagaacuccgccaagaagugcgcccaggacuacaacaugcugagcgacgacgcgcggcuguucaccgagaagauccuccgcgccugcaucgagcaggucaagaaguacuccgaguucuacacgcugcacgaggugaccagccugaugggguucuucccguuccggguggagaugggccucaagcuggagaagacccugcucgcccugggcagcgugaaguacgucaagaccguguuccccuccaugcccaucaagcugcagcucagcaaggacgacaucgccacgaucgagaccuccgagcagaccgccgaggcgaugcacuacgacaucagcaaggaccccaacgccgagaagcuggugucccgcuaccacccgcagaucgcccugaccagccagucccucuucacgcugcugaacaaccacgggcccaccuacaaggagcagugggagauccccgucugcauccaggugauccccguggccggcagcaagccggucaaggugaucuacaucaacagcccccucccccagaagaagaugaccaugcgggagcgcaaccagaucuuccacgaggugccccugaaguucaugauguccaagaacaccuccgucccggugagcgccgucuucauggacaagcccgaggaguucaucuccgagauggacgugugcaacgcguucuucuuccccuga

SEQ ID NO: 31398 - RNA, 1899 nt, Artificial Sequence
  derived and/or modified sequence opt1 from ICK__Homo_sapiens__NP_057597
augaaccgcuacaccaccauccggcagcugggcgacgggacguacggcagcgugcuccuggggcgcuccaucgagagcggcgagcugaucgccaucaagaagaugaagcggaaguucuacuccugggaggagugcaugaaccuccgcgaggucaagagccugaagaagcugaaccacgccaacguggugaagcucaaggaggucauccgggagaacgaccaccuguacuucaucuucgaguacaugaaggagaaccuguaccagcucaucaaggagcgcaacaagcuguuccccgaguccgcgauccggaacaucauguaccagauccugcaggggcucgccuucauccacaagcacggcuucuuccaccgcgaccugaagccggagaaccugcucugcaugggccccgagcuggugaagaucgccgacuucgggcuggcccgggagauccgcagcaagccgcccuacaccgacuacguguccacccggugguaccgcgccccggagguccuccugcggagcaccaacuacuccagccccaucgacgugugggcggugggcugcaucauggccgaggucuacacgcugcgcccccucuuccccggggccuccgagaucgacaccaucuucaagaucugccaggugcugggcaccccgaagaagaccgacuggcccgagggguaccagcugagcuccgccaugaacuuccgguggccccagugcgugcccaacaaccucaagacgcugaucccgaacgcgagcuccgaggccguccagcugcuccgcgacaugcugcagugggaccccaagaagcggcccaccgccagccaggcccugcgcuaccccuacuuccaggugggccacccgcucggcuccaccacccagaaccugcaggacagcgagaagccccagaaggggauccuggagaaggccgggcccccgcccuacaucaagcccgugccgcccgcgcagccgcccgccaagccccacacgcggaucuccagccgccagcaccaggccagccagccgccccuccaccugaccuaccccuacaaggccgaggucucccggaccgaccaccccagccaccuccaggaggacaagcccagcccccugcuguuccccucccugcacaacaagcacccccaguccaagaucaccgccggccucgagcacaagaacggcgagaucaagcccaagagccgccgccgguggggccugaucucccgcagcacgaaggacuccgacgacugggcggaccuggacgaccucgacuucagccccucccugagccggaucgaccugaagaacaagaagcgccaguccgacgacacccucugccgguucgagagcgugcuggaccugaagcccuccgagcccguggggaccggcaacagcgccccgacccagacguccuaccagcgccgggacacccccacccuccgcagcgccgccaagcagcacuaccugaagcacucccgguaccugcccgggaucagcauccgcaacggcauccugagcaaccccgggaaggaguucaucccgcccaaccccugguccagcuccggccucagcggcaaguccagcgggaccauguccgucaucagcaaggugaacuccgugggcagcuccagcacguccagcuccgggcugaccggcaacuacguccccagcuuccugaagaaggagaucggguccgccaugcagcgggugcaccucgcgccgauccccgaccccagccccggcuacagcucccugaaggccaugcgcccgcaccccggccggcccuucuuccacacccagccccgcagcaccccggggcugaucccccggcccccggccgcccagcccgugcacggccgcacggacugggccuccaaguacgcgagccggcgcuga

SEQ ID NO: 31399 - RNA, 567 nt, Artificial Sequence
  derived and/or modified sequence opt1 from ICMT__Homo_sapiens__XP_011539442
augugcagccugucccucuuccacuacagcgaguaccuggugaccgccgucaacaaccccaagucccugagccucgacuccuuccugcugaaccacagccucgaguacaccguggccgcgcuguccagcuggcuggaguucacgcucgagaacaucuucuggccggagcugaagcagaucaccuggcuguccgugaccggccuccugauggucguguucggggagugccugcgcaaggccgccauguucaccgccggcagcaacuucaaccacgugguccagaacgagaaguccgacacgcacacccucgugaccagcgggguguacgccugguuccggcaccccuccuacgucggcugguucuacuggagcaucgggacccaggugaugcugugcaaccccaucugcggcguguccuacgcgcugacggucuggcgcuucuuccgggaccgcaccgaggaggaggagaucagccucauccacuucuucggcgaggaguaccuggaguacaagaagcgggugcccaccgggcugccguucaucaagggcgugaaggucgaccucuga

SEQ ID NO: 31400 - RNA, 600 nt, Artificial Sequence
  derived and/or modified sequence opt1 from ICOS__Homo_sapiens__NP_036224
augaaguccggccugugguacuucuuccucuucugccugcgcaucaaggugcugaccggggagaucaacggcagcgccaacuacgagauguucaucuuccacaacgggggcguccagauccucugcaaguaccccgacaucgugcagcaguucaagaugcagcugcugaagggcgggcagauccucugcgaccugaccaagacgaagggcagcgggaacaccguguccaucaagagccugaaguucugccacucccagcucagcaacaacuccgucagcuucuuccuguacaaccuggaccacucccacgccaacuacuacuucugcaaccucagcaucuucgacccgccgcccuucaaggugacccugaccggcggguaccugcacaucuacgagucccagcucugcugccagcugaaguucuggcugcccaucggcugcgcggccuucguggucgugugcauccucgggugcauccugaucugcuggcugacgaagaagaaguacagcuccagcgugcacgaccccaacggcgaguacauguucaugcgggccgucaacaccgccaagaagucccgccucaccgacgugacccuguga

SEQ ID NO: 31401 - RNA, 930 nt, Artificial Sequence
  derived and/or modified sequence opt1 from ICOSLG__Homo_sapiens__NP_001269979
augcgccugggcagccccgggcuccuguuccuccuguucuccagccugcgggccgacacccaggagaaggaggugcgcgccauggucggcuccgacguggagcugagcugcgcgugcccggaggggucccgguucgaccucaacgacguguacgucuacuggcagaccagcgaguccaagacgguggugaccuaccacaucccccagaacagcucccuggagaacgucgacagccgcuaccggaaccgcgcccugaugucccccgccggcaugcuccgcggggacuucagccugcggcuguucaacgugacgccccaggacgagcagaaguuccacugccucgugcugucccagagccugggcuuccaggagguccucuccguggaggugacccugcacgucgccgccaacuucagcgugccgguggucuccgcgccccacagccccucccaggacgagcugaccuucacgugcaccagcaucaacggcuacccccggccgaacguguacuggaucaacaagaccgacaacagccuccuggaccaggcccugcagaacgacaccguguuccucaacaugcgcgggcuguacgacgucguguccgugcugcggaucgcccgcacccccagcgucaacaucggcugcugcaucgagaacgugcuccugcagcagaaccugaccguggggucccagaccggcaacgacaucggggagcgggacaagaucacggagaaccccgucagcaccggcgagaagaacgccgcgaccugguccauccucgccgugcugugccugcucgucgugguggccgucgccaucggcugggugugccgcgaccggugccugcagcacagcuacgccggggcgugggccgugucccccgagaccgagcugacggagagcuggaaccuccugcugcuccuguccuga

SEQ ID NO: 31402 - RNA, 468 nt, Artificial Sequence
  derived and/or modified sequence opt1 from ID1__Homo_sapiens__NP_002156
augaagguggccagcggcuccaccgccaccgcggccgccgggcccagcugcgcccugaaggccggcaagacggcguccggggccggcgaggucgugcgcugccucagcgagcaguccguggccaucagccggugcgccgggggcgcgggcgcccgccugccggcccugcucgacgagcagcaggucaacgugcugcuguacgacaugaacgggugcuacucccggcucaaggagcuggugcccacccugccccagaaccgcaaggucagcaagguggagauccuccagcacgugaucgacuacauccgggaccugcagcuggagcucaacuccgagagcgaggucggcacccccgggggccgcgggcugccggugcgggcgccccuguccacccucaacggcgagaucagcgcccugacggccgaggccgccugcgugcccgccgacgaccgcauccugugccgguga

SEQ ID NO: 31403 - RNA, 405 nt, Artificial Sequence
  derived and/or modified sequence opt1 from ID2__Homo_sapiens__NP_002157
augaaggccuucagccccgugcgcuccguccggaagaacagccuguccgaccacagccucggcaucucccgcagcaagaccccgguggacgaccccaugucccugcuguacaacaugaacgacugcuacagcaagcucaaggagcuggugcccuccaucccccagaacaagaaggucagcaagauggagauccugcagcacgugaucgacuacauccucgaccugcagaucgcccuggacucccacccgaccaucgugagccuccaccaccagcggcccgggcagaaccaggcgucccgcacgccccugaccacccugaacaccgacaucagcauccucucccugcaggccagcgaguuccccuccgagcugaugagcaacgacuccaaggcccucugcggcuga

SEQ ID NO: 31404 - RNA, 486 nt, Artificial Sequence
  derived and/or modified sequence opt1 from ID4__Homo_sapiens__NP_001537
augaaggccgugagccccguccgccccuccggccggaaggcccccagcgggugcggcgggggcgagcuggcgcuccgcugccuggccgagcacgggcacucccugggcggcagcgccgccgccgcggccgccgccgcggccgcccggugcaaggccgccgaggcggccgccgacgagcccgcccucugccugcagugcgacaugaacgacugcuacucccgccugcggcgccucgugcccaccaucccgcccaacaagaaggugagcaaggucgagauccugcagcacgugaucgacuacauccuggaccuccagcuggcccuggagacccaccccgcgcuccugcggcagcccccgccgcccgccccgccccaccaccccgccgggaccugccccgccgccccgccccgcacgccccugaccgcgcucaacaccgaccccgccggcgccgugaacaagcagggggacuccauccugugccgguga

SEQ ID NO: 31405 - RNA, 1395 nt, Artificial Sequence
  derived and/or modified sequence opt1 from IDE__Homo_sapiens__NP_001159418
augagcaagcugugguucaagcaggacgacaaguucuuccuccccaaggccugccugaacuucgaguucuucuccccguucgccuacguggacccccugcacugcaacauggcguaccucuaccuggagcugcucaaggacagccugaacgaguacgccuacgccgccgagcuggccggccucuccuacgaccugcagaacaccaucuacgggauguaccugagcgucaagggcuacaacgacaagcagcccauccuccugaagaagaucaucgagaagauggcgaccuucgagaucgacgagaagcgcuucgagaucaucaaggaggccuacaugcggucccugaacaacuuccgcgccgagcagccccaccagcacgccauguacuaccuccggcugcugaugacggagguggcguggaccaaggacgagcucaaggaggcccuggacgacgugacccugccgcgccucaaggccuucaucccccagcugcugagccggcuccacaucgaggcccugcugcacgggaacaucaccaagcaggccgcgcucggcaucaugcagauggucgaggacacgcugaucgagcacgcccacaccaagccccugcuccccucccagcuggugcgcuaccgggaggugcagcugccggaccgcgggugguucgucuaccagcagcggaacgaggugcacaacaacugcggcaucgagaucuacuaccagaccgacaugcagagcaccuccgagaacauguuccucgagcuguucugccagaucaucagcgagcccugcuucaacacgcugcgcaccaaggagcagcucggcuacaucguguucuccgggccccggcgcgccaacggcauccaggggcugcgguucaucauccagagcgagaagcccccgcacuaccuggagucccgcgucgaggccuuccucaucaccauggagaaguccaucgaggacaugaccgaggaggccuuccagaagcacauccaggcgcuggccauccggcgccuggacaagcccaagaagcucagcgccgagugcgccaaguacuggggcgagaucaucagccagcaguacaacuucgaccgggacaacacggagguggccuaccugaagacccugaccaaggaggacaucaucaaguucuacaaggagaugcucgcgguggacgcgccccgccggcacaaggucuccgugcacgugcuggcccgcgagauggacagcugccccgucgugggggaguucccgugccagaacgacaucaaccugucccaggcccccgcccucccccagcccgaggugauccagaacaugaccgaguucaagcggggccugccgcuguucccccuggucaagccccacaucaacuucauggccgccaagcucuga

SEQ ID NO: 31406 - RNA, 1245 nt, Artificial Sequence
  derived and/or modified sequence opt1 from IDH1__Homo_sapiens__NP_001269315
augagcaagaagaucuccggcgggagcguggucgagaugcagggcgacgagaugacccgcaucaucugggagcugaucaaggagaagcucaucuuccccuacguggagcuggaccugcacuccuacgaccucgggaucgagaaccgggacgccaccaacgaccaggugacgaaggacgccgcggaggccaucaagaagcacaacgucggcgugaagugcgccaccaucaccccggacgagaagcgcguggaggaguucaagcugaagcagauguggaagucccccaacgggaccauccggaacauccugggcggcacggucuuccgcgaggccaucaucugcaagaacaucccccggcucgugagcgggugggugaagcccaucaucaucggccgccacgccuacggggaccaguaccgggcgaccgacuucgucgugccgggccccgggaagguggagaucaccuacacccccagcgacggcacgcagaaggucaccuaccuggugcacaacuucgaggagggcgggggcguggccauggggauguacaaccaggacaaguccaucgaggacuucgcccacagcuccuuccagauggcccugagcaagggcuggccccucuaccuguccaccaagaacaccauccugaagaaguacgacggccgcuucaaggacaucuuccaggagaucuacgacaagcaguacaagagccaguucgaggcgcagaagaucugguacgagcaccggcucaucgacgacauggucgcccaggccaugaaguccgagggcggguucaucugggccugcaagaacuacgacggggacgugcagagcgacuccguggcccagggcuacgggagccugggcaugaugacguccguccuggugugcccggacggcaagaccguggaggcggaggccgcccacgggaccgucacccgccacuaccggauguaccagaagggccaggagacgagcaccaaccccaucgccuccaucuucgccuggacccgcgggcucgcgcaccgggccaagcuggacaacaacaaggagcuggccuucuucgccaacgcccucgaggaggugagcaucgagaccaucgaggcgggcuucaugacgaaggaccuggccgccugcaucaaggggcugcccaacgugcagcgcagcgacuaccucaacaccuucgaguucauggacaagcugggcgagaaccugaagaucaagcucgcccaggccaagcuguga

SEQ ID NO: 31407 - RNA, 1203 nt, Artificial Sequence
  derived and/or modified sequence opt1 from IDH2__Homo_sapiens__NP_001276839
auggacggcgacgagaugacccgcaucaucuggcaguucaucaaggagaagcugauccucccccacguggacauccagcugaaguacuucgaccuggggcucccgaaccgggaccagaccgacgaccaggucacgaucgacagcgcccuggccacccagaaguacuccguggcggugaagugcgccaccaucacccccgacgaggcccgcgucgaggaguucaagcugaagaagauguggaagucccccaacggcacgauccggaacauccucgggggcaccguguuccgcgagcccaucaucugcaagaacaucccgcggcuggugcccggguggaccaagcccaucaccaucggccgccacgcccacggcgaccaguacaaggccacggacuucgucgcggaccgggccgggaccuucaagaugguguucacccccaaggacggcagcggggugaaggagugggaggucuacaacuucccggccggcggggugggcaugggcauguacaacaccgacgagagcaucuccggguucgcccacagcugcuuccaguacgcgauccagaagaaguggccccuguacauguccacgaagaacaccauccucaaggccuacgacggccgcuucaaggacaucuuccaggagaucuucgacaagcacuacaagaccgacuucgacaagaacaagaucugguacgagcaccggcugaucgacgacaugguggcccagguccucaagagcuccgggggcuucgugugggccugcaagaacuacgacggcgacgugcagagcgacauccuggcccagggguucggcucccuggggcugaugaccagcguccucgugugccccgacggcaagacgaucgaggcggaggccgcccacgggaccgugacccgccacuaccgggagcaccagaagggccgccccaccuccacgaacccgaucgccagcaucuucgccuggacccggggccuggagcaccgcgggaagcuggacggcaaccaggaccucauccgguucgcgcagaugcuggagaaggucugcguggagaccguggaguccggggccaugaccaaggaccuggccggcugcauccacgggcucagcaacgucaagcugaacgagcacuuccugaacacgaccgacuuccucgacaccaucaaguccaaccuggaccgcgcccugggccggcaguga

SEQ ID NO: 31408 - RNA, 1131 nt, Artificial Sequence
  derived and/or modified sequence opt1 from IDH3B__Homo_sapiens__NP_001245313
auggccgcccugagcggcgugcgcuggcucacccgggcgcuggucuccgccgggaaccccggcgccuggcgcgggcugagcaccuccgccgccgcgcacgccgccagccggucccaggccgaggacgugcgcguggagggcagcuucccggucacgaugcuccccggggacggcgugggccccgagcugaugcacgcggugaaggaggucuucaaggccgccgccgugcccguggaguuccaggagcaccaccuguccgagguccagaacauggccagcgaggagaagcucgagcagguccuguccagcaugaaggagaacaagguggcgaucaucgggaagauccacaccccgauggaguacaagggcgagcuggccuccuacgacaugcggcuccgccggaagcuggaccuguucgccaacguggugcacgucaagagccuccccggguacaugacccgccacaacaaccuggaccuggugaucauccgggagcagaccgagggcgaguacuccagccucgagcacgaguccgcccgcggggugaucgagugccugaagaucgugacgcgggccaagagccagcgcaucgcgaaguucgccuucgacuacgccaccaagaagggccggggcaaggucaccgccgugcacaaggccaacaucaugaagcugggggacggccucuuccugcagugcugcgaggagguggcggagcuguaccccaagaucaaguucgagaccaugaucaucgacaacugcugcaugcagcucguccagaaccccuaccaguucgacgugcuggugaugccgaaccuguacgggaacaucaucgacaaccucgccgccggccuggucggcggggccggcgugguccccggggaguccuacagcgccgaguacgcgguguucgagacgggcgcccgccaccccuucgcccaggccguggggcggaacaucgcgaaccccaccgccaugcugcucuccgccagcaacaugcugcgccaccugaaccucgaguaccacagcuccaugaucgccgacgccgucaagaaggugaucaaggugggcaagaucccgagcgcgguccccuccuuccugcugcacccccuccccuucagcugggccaucuga

SEQ ID NO: 31409 - RNA, 564 nt, Artificial Sequence
  derived and/or modified sequence opt1 from IDNK__Homo_sapiens__NP_001001551
auggccgcccccggcgcgcugcucgugaugggggucagcggcuccggcaagagcaccgugggggcccugcuggccuccgagcucggguggaaguucuacgacgccgacgacuaccaccccgaggagaaccgccggaagaugggcaagggcaucccccugaacgaccaggaccgcauccccuggcugugcaaccuccacgacauccugcugcgggacguggccagcgggcagcgcgucgugcucgcgugcuccgcccugaagaagaccuaccgggacauccugacgcagggcaaggacgggguggcccucaagugcgaggagagcggcaaggaggccaagcaggcggagaugcagcugcuggucgugcaccucuccgggagcuucgaggugaucuccggccgccugcugaagcgggagggccacuucaugcccccggagcuccugcagagccaguucgagacccuggagccgcccgccgcccccgagaacuucauccagaucuccgucgacaagaacgugagcgagaucaucgccaccaucauggagacccucaagaugaaguga

SEQ ID NO: 31410 - RNA, 1212 nt, Artificial Sequence
  derived and/or modified sequence opt1 from IDO1__Homo_sapiens__NP_002155
auggcccacgccauggagaacagcuggaccaucagcaaggaguaccacaucgacgaggaggugggcuucgcgcugcccaacccgcaggagaaccuccccgacuucuacaacgacuggauguucaucgccaagcaccuccccgaccugaucgagagcgggcagcugcgcgagcgggucgagaagcugaacaugcuguccaucgaccaccucaccgaccacaagagccagcgccuggcccggcuggugcucggcugcaucacgauggccuacgugugggggaagggccacggggacguccgcaaggugcugccccggaacaucgccgugccguacugccagcuguccaagaagcucgagcugccgcccauccuggucuacgcggacugcgugcucgccaacuggaagaagaaggaccccaacaagccccugaccuacgagaacauggacgugcuguucagcuuccgcgacggcgacugcuccaagggcuucuuccucgucagccugcugguggagaucgccgccgcguccgccaucaaggugauccccaccgucuucaaggccaugcagaugcaggagcgggacacccuccugaaggcccugcucgagaucgccagcugccuggagaaggcgcuccagguguuccaccagauccacgaccacgugaaccccaaggccuucuucuccguccugcgcaucuaccugagcggguggaagggcaacccccagcuguccgacgggcucguguacgagggcuucugggaggacccgaaggaguucgccgggggcagcgccggccaguccagcguguuccagugcuucgacguccugcuggggauccagcagacggccggcgggggccacgcggcccaguuccuccaggacaugcggcgcuacaugccgcccgcccaccggaacuuccugugcucccuggagagcaaccccuccgugcgcgaguucgugcucagcaagggcgacgccgggcugcgggaggccuacgacgcgugcgucaaggcccuggugagccuccgcuccuaccaccuccagaucgugaccaaguacauccugauccccgccagccagcagcccaaggagaacaagaccuccgaggaccccagcaagcuggaggccaagggcaccgggggcacggaccugaugaacuuccugaagaccguccgguccaccaccgagaagucccuccugaaggagggguga

SEQ ID NO: 31411 - RNA, 1263 nt, Artificial Sequence
  derived and/or modified sequence opt1 from IDO2__Homo_sapiens__NP_919270
augcugcacuuccacuacuacgacaccagcaacaagaucauggagccccaccgccccaacgugaagaccgccgucccccucucccuggagagcuaccacaucuccgaggaguacggcuuccugcuccccgacagccugaaggagcugcccgaccacuaccggccguggauggagaucgccaacaagcucccccagcugaucgacgcgcaccagcugcaggcccacguggacaagaugccccuccuguccugccaguuccugaaggggcaccgcgagcagcggcucgcccaccuggugcugagcuuccucacgaugggcuacgucuggcaggagggggaggcccagcccgccgaggugcugccgcgcaaccuggcgcuccccuucguggaggucucccggaaccugggccugccgcccauccucgugcacagcgaccuggugcugaccaacuggaccaagaaggaccccgacggguuccucgagaucggcaaccuggagaccaucaucuccuuccccggcggggagagccugcacggcuucauccucgucacggcccugguggagaaggaggccgugcccgggaucaaggcccugguccaggcgaccaacgccauccuccagcccaaccaggaggcccugcugcaggcccuccagcgccugcggcuguccauccaggacaucaccaagacccucggccagaugcacgacuacguggacccggacaucuucuacgccgggauccgcaucuuccugagcggcuggaaggacaaccccgcgaugcccgccggccugauguacgagggggugucccaggagccccucaaguacagcggcggguccgccgcccagagcacgguccugcacgccuucgacgaguuccugggcauccggcacuccaaggagagcggcgacuuccucuaccgcaugcgggacuacaugccgcccucccacaaggcguucaucgaggacauccacagcgcccccagccugcgcgacuacauccuguccagcgggcaggaccaccuccugaccgccuacaaccagugcgugcaggcccuggccgagcuccgguccuaccacaucaccauggugaccaaguaccugaucacggcggccgccaaggccaagcacggcaagcccaaccaccucccggggccgccccaggcccugaaggaccgcggcaccgggggcaccgcggucaugagcuuccugaaguccgugcgggacaagacccuggagagcauccugcacccccgcggcuga

SEQ ID NO: 31412 - RNA, 1653 nt, Artificial Sequence
  derived and/or modified sequence opt1 from IDS__Homo_sapiens__NP_000193
augcccccgccccgcaccggccgggggcugcucuggcugggccuggugcucagcuccgucugcguggcccuggggagcgagacccaggccaacuccacgaccgacgcgcugaacgugcuccugaucaucgucgacgaccugcgccccagccucggcugcuacggggacaagcuggugcggucccccaacaucgaccagcuggccagccacucccuccuguuccagaacgccuucgcccagcaggccgugugcgcgccgagccgcgucuccuuccugaccggccggcgccccgacaccacgcggcucuacgacuucaacagcuacuggcgcgugcacgccggcaacuucuccaccaucccccaguacuucaaggagaacggguacgugaccaugagcgucggcaagguguuccaccccgggaucuccagcaaccacaccgacgacuccccguacagcugguccuucccgcccuaccaccccagcuccgagaaguacgagaacacgaagaccugccggggccccgacggggagcugcacgccaaccugcucugccccguggacguccuggacgugcccgagggcacccugcccgacaagcagagcaccgagcaggccauccagcuccuggagaagaugaagacgagcgcguccccguucuuccuggccgugggcuaccacaagccccacauccccuuccgcuaccccaaggaguuccagaagcucuacccgcuggagaacaucacccuggcccccgaccccgagguccccgacgggcucccgcccguggccuacaaccccuggauggacauccggcagcgcgaggacgugcaggcccugaacaucagcguccccuacggcccgauccccguggacuuccagcggaagauccgccaguccuacuucgcgagcguguccuaccuggacacccaggucgggcggcuccugagcgcccuggacgaccuccagcuggccaacuccaccaucaucgccuucacgagcgaccacggcugggcccugggcgagcacggggagugggcgaaguacuccaacuucgacguggccacccacgugccccucaucuucuacgucccgggccgcaccgccagccugcccgaggccggggagaagcuguuccccuaccucgaccccuucgacuccgccagccagcugauggagccgggccggcaguccauggaccugguggagcucgucagccuguuccccacccuggcggggcucgccggccuccaggugccgccccgcugccccgugcccuccuuccacgucgagcugugccgggagggcaagaaccugcugaagcacuuccgcuuccgggaccuggaggaggaccccuaccugcccgggaacccgcgcgagcucaucgccuacagccaguacccccgccccuccgacaucccccaguggaacagcgacaagccgucccugaaggacaucaagaucaugggcuacagcauccggacgaucgacuaccgcuacaccgugugggugggguucaaccccgacgaguuccuggccaacuucagcgacauccacgccggcgagcucuacuucgucgacuccgacccccugcaggaccacaacauguacaacgacagccagggcggggaccuguuccagcuccugaugcccuga

SEQ ID NO: 31413 - RNA, 1962 nt, Artificial Sequence
  derived and/or modified sequence opt1 from IDUA__Homo_sapiens__NP_000194
augcgcccccugcggccgcgcgccgcccuccuggcgcugcucgccagccugcuggccgccccccccguggcccccgcggaggccccgcaccucguccacguggacgccgcccgggcgcuguggccccugcgccgguucuggcgcuccaccggcuucugccccccccucccgcacagccaggccgaccaguacgugcuguccugggaccagcagcugaaccucgccuacgucggggccgugccccaccggggcaucaagcaggugcgcacccacuggcugcuggagcucgucacgacccgggggagcaccggccgcgggcuguccuacaacuucacccaccuggacggcuaccucgaccugcugcgggagaaccagcuccugcccggcuucgagcugauggggagcgccuccggccacuucacggacuucgaggacaagcagcagguguucgaguggaaggaccucgugagcucccuggcgcgccgguacaucgggcgcuacggccuggcccacgucagcaaguggaacuucgagaccuggaacgagcccgaccaccacgacuucgacaacguguccaugaccaugcagggguuccucaacuacuacgacgccugcagcgagggccugcgggccgccuccccggcgcugcgccucggcgggcccggcgacagcuuccacacccccccccgguccccgcugagcugggggcugcuccgccacugccacgacggcacgaacuucuucaccggcgaggccggggugcggcuggacuacaucucccugcaccgcaagggcgcccggagcuccaucagcauccucgagcaggagaaggucguggcccagcagauccgccagcuguuccccaaguucgccgacacccccaucuacaacgacgaggcggacccccuggugggguggagccucccgcagcccuggcgcgccgacgucaccuacgccgccaugguggugaaggucaucgcccagcaccagaaccugcugcucgcgaacacgaccuccgccuuccccuacgcccugcugagcaacgacaacgccuuccucuccuaccacccccacccguucgcgcagcggacccugaccgcccgcuuccaggugaacaacacgcggcccccccacgugcagcugcuccgcaagcccguccugaccgccaugggccugcuggcccuccuggacgaggagcagcugugggccgaggugagccaggcggggaccgugcucgacuccaaccacaccgucggcgugcuggccagcgcccaccggccgcagggccccgccgacgccuggcgcgcggccguccugaucuacgccuccgacgacacgcgggcccaccccaaccgcagcguggccgugacccuccggcugcgcggggucccgcccggccccgggcugguguacgugacccgguaccucgacaacggccugugcucccccgacggggaguggcgccggcugggccgcccggucuuccccaccgcggagcaguuccggcgcaugcgggccgccgaggaccccguggccgcggccccccgcccgcuccccgccggcgggcggcugacgcugcgccccgcccuccgccugcccagccugcuccuggugcacgucugcgcccggccggagaagccccccggccaggugacccgccugcgggcgcucccccugacccaggggcagcuggugcucgucugguccgacgagcacgugggcagcaagugccuguggaccuacgagauccaguucucccaggacgggaaggccuacacgccggugagccgcaagcccuccaccuucaaccuguucgucuucagccccgacaccggcgccguguccggcagcuaccgggugcgcgcccucgacuacugggcccggcccgggccguucuccgaccccguccccuaccuggaggugcccgugccgcgcggcccccccagcccggggaaccccuga

SEQ ID NO: 31414 - RNA, 672 nt, Artificial Sequence
  derived and/or modified sequence opt1 from IER2__Homo_sapiens__NP_004898
auggaggugcagaaggaggcccagcgcaucaugacccugagcgucuggaagauguaccacucccggaugcagcgcggcgggcuccggcugcaccgcagccugcagcucucccuggugaugcggagcgcccgcgagcuguaccucuccgcgaagguggaggcccuggagcccgaggucagccugcccgccgcccuccccuccgacccccggcugcacccgccccgcgaggccgagagcaccgcggagacggccacccccgacggcgagcaccccuuccccgagccgauggacacccaggaggcccccaccgccgaggagacguccgcgugcugcgcgccccggcccgccaaggugagccgcaagcggcgcuccagcucccugagcgacgggggcgacgccgggcucgugccguccaagaaggcccggcuggaggagaaggaggaggaggagggcgccagcuccgaggucgccgaccgccugcagcccccgcccgcccaggccgagggcgccuuccccaaccucgcgcgggugcugcagcgccgguucagcgggcugcucaacugcucccccgccgccccgcccaccgccccgcccgccugcgaggcgaagcccgccugccgccccgccgacagcaugcugaacgugcugguccgggccgugguggccuucuga

SEQ ID NO: 31415 - RNA, 471 nt, Artificial Sequence
  derived and/or modified sequence opt1 from IER3__Homo_sapiens__NP_003888
augugccacagccgcuccugccaccccaccaugaccauccugcaggccccgacgcccgcccccagcaccauccccggcccgcggcgcggguccggccccgagaucuucaccuucgacccccuccccgagccggcggccgcccccgccgggcggcccagcgccucccgcggccaccggaagcgcagccggcgcgugcuguacccccgggucgugcgccggcagcugccgguggaggagcccaaccccgcgaagcgccuccuguuccugcuccugaccaucgucuucugccagauccugauggccgaggagggggugcccgccccgcucccgcccgaggacgcccccaacgcggccucccuggcccccacgcccgugagcgccguccuggagcccuucaaccucaccuccgagcccagcgacuacgcccuggaccuguccaccuuccuccagcagcacccggcggccuucuga

SEQ ID NO: 31416 - RNA, 249 nt, Artificial Sequence
  derived and/or modified sequence opt1 from IER3IP1__Homo_sapiens__NP_057181
auggccuucacccuguacagccuccugcaggccgcgcugcucugcgugaacgccaucgccguccugcacgaggagcgcuuccugaagaacaucggcugggggaccgaccagggcaucgggggcuucggggaggagcccggcaucaagucccagcucaugaaccugauccggagcgugcgcacggugaugcgggucccgcugaucaucgugaacuccaucgccaucgugcuccugcuccuguucggcuga

SEQ ID NO: 31417 - RNA, 984 nt, Artificial Sequence
  derived and/or modified sequence opt1 from IER5__Homo_sapiens__NP_057629
auggaguucaagcuggaggcccaccgcaucgugagcaucucccucggcaagaucuacaacagccggguccagcgcgggggcaucaagcugcacaagaaccugcucgugucccuggugcugcggagcgcccgccaggucuaccucuccgaccccugcccggggcuguaccuggcgggccccgccgggacccccgcgcccccgccccagcagcagcccggcgagcccgccgccggcccgcccgcgggguggggcgagcccccgccgcccgccgcccgggccagcuggcccgagaccgagccccagcccgagcgcuccagcguguccgacgcgccccgggugggggacgagguccccguggccaccgugaccggcgucggggacguguuccagggcggcgaggccgacgccaccgaggccgcguggagccgcguggaggggccccggcaggccgccgcccgcgaggccgagggcaccgccgggggcuggggcgucuucccggaggugucccgggccgcccgccggcccugcgggugcccccucggcggggaggacccgcccggcacgcccgccgccacgccccgcgcggccugcugcugcgcgccccagcccgccgaggacgagccgcccgccccgcccgccgugugcccccggaagcgcugcgccgccggggucggcggcgggcccgccggcugcccggcgcccgggagcacgccccugaagaagccccggcgcaaccuggagcagccgcccuccggcggggaggacgacgacgccgaggagauggagaccggcaacguggccaaccucaucagcaucuucggcuccagcuucuccgggcugcugcgcaagagccccggcgggggccgggaggaggaggagggggaggaguccggccccgaggccgccgagccgggccagaucugcugcgacaagcccgugcuccgggacaugaaccccuggagcaccgcgaucgucgccuucuga

SEQ ID NO: 31418 - RNA, 1692 nt, Artificial Sequence
  derived and/or modified sequence opt1 from IFFO1__Homo_sapiens__NP_001034759
augaacccccuguucggccccaaccucuuccugcugcagcaggagcagcaggggcucgccggcccccugggggacagccugggcggggaccacuucgccggcggcggggaccucccgcccgcgccccugucccccgccggccccgccgccuacagcccgcccgggcccggccccgcgccgcccgccgccauggcccugcgcaacgaccucggguccaacaucaacgugcugaagacccugaaccuccgguuccgcugcuuccuggccaagguccacgagcuggagcggcgcaaccggcuccuggagaagcagcugcagcaggcgcucgaggagggcaagcagggccgccgggggcugggccgccgggaccaggccgugcagaccggguucgugagccccauccgcccccugggccuccagcugggcgcccggcccgccgccgucugcucccccagcgcgcgcgugcuggggucccccgcccggagccccgccggcccccucgccccguccgccgcgagccuguccagcuccagcacguccaccagcaccaccuacuccagcuccgcccgcuucaugcccgggacgaucuggagcuucagccacgcccggcgccugggccccgggcucgagcccacccuggugcagggccccggccuguccuggguccaccccgacggggugggcgugcagaucgacaccaucacccccgagauccgggcccucuacaacguccuggccaaggugaagcgcgagcgggacgaguacaagcgccggugggaggaggaguacacggugcgcauccagcugcaggaccgcgucaacgagcuccaggaggaggcgcaggaggccgacgccugccaggaggagcuggcccugaagguggagcagcucaaggccgagcugguggucuucaaggggcugaugagcaacaaccucuccgagcuggacaccaagauccaggagaaggcgaugaagguggacauggacaucugccggcgcaucgacaucaccgccaagcugugcgacguggcccagcagcggaacugcgaggacaugauccagauguuccagaagaagcucguccccagcaugggcgggcgcaagcgggagcgcaaggccgcgguggaggaggacaccucccugagcgaguccgagggcccgcggcagcccgacggcgacgaggaggagagcacggcccuguccaucaacgaggagaugcagcgcaugcucaaccagcugcgggaguacgacuucgaggacgacugcgacagccugaccugggaggagaccgaggagacccuccugcugugggaggacuucuccggguacgccauggccgccgcggaggcccagggcgagcagcaggaggacagccuggagaaggugaucaaggacacggagucccucuucaagacccgcgagaaggaguaccaggagaccaucgaccagaucgagcuggagcuggccaccgccaagaacgacaugaaccggcaccuccacgaguacauggagaugugcagcaugaagcgcgggcuggacguccagauggagacgugccggcgccugaucacccaguccggcgaccgcaagagccccgccuucaccgcggugccgcucuccgacccgccgccgccgcccagcgaggccgaggacuccgaccgggacgugagcagcgacuccagcaugcgguga

SEQ ID NO: 31419 - RNA, 1413 nt, Artificial Sequence
  derived and/or modified sequence opt1 from IFFO2__Homo_sapiens__XP_011538932
auggugaacagccugcuguucggcgagauggcccuggccuucgggugcccgcccggcgggggcgggggcggcugccccgggggcgggggcgggggcggcggggcgggccccgggcccuccccggucaccgccgcccugcgcgacgaccucggcagcaacauccaccuccugaagggccucaacgugcgguuccgcugcuuccuggccaaggugcacgagcuggagcggcgcaaccggcuccuggagaagcagcuggagcagcagcaguccgagcgcgagcggcgccuccgguacaagaccuucagccgcgagcaggccguccagacggggcccgagcugcugcggccgcccgcgcccggcgggggccacgggcucuccagcggcgccgccgccggcgcgaacgccaacgccguggcccucgggggccugccgcccgggggcgggucccacccccagcacuacggccgccugcccggcaccaucuggagcuacacccaggugcggcgcaccgggggcgggggcgucgagacggugcaggggcccggcguguccuggguccaccccgacggcgugggggugcagaucgacaccaucacccccgagauccgggcccuguacaacguccuggcgaaggugaagcgcgagcgggacgaguacaagcgccggugggaggaggagcucgccaagcgcaugaaccugcagaccaugguggacacgcugcaggaggccgcccaggaggccgacgcgauccaggaggagaugaacgagaagaucgagcggcucaaggccgagcuggucguguucaagggccugaugagcgacguggucccgaagaagaaggagcgcaagguggccuccgacgacgacaucagcgagcaggacggggaggugaaccgcuucuccgacgacgaggucggcagcaugaacaucaccgacgagaugaagcggauguucaaccagcuccgcgagaccuucgacuucgacgacgacugcgacucccugaccugggaggagaacgaggacacgcugcuccugugggaggacuucaccaacugcaaccccaccaucgaccugcagggcgagcaggaggagaaccucgggaaccugauccacgagaccgagagcuucuucaagacgcgggacaaggaguaccaggagaccaucggccagaucgagcuggagcucgccaccgccaaguccgacaugaaccgccaccuccacgaguacauggagaugugcagcaugaagcgggggcuggacgugcagauggagaccugccgccggcugaucaagggcuccgcggaccgcaacagccccagccccuccagcguggccuccagcgacuccgggagcacggacgagauccaggacgaguucgagcgggaggccgacgucgagccgaugguguccuga

SEQ ID NO: 31420 - RNA, 2190 nt, Artificial Sequence
  derived and/or modified sequence opt1 from IFI16__Homo_sapiens__NP_001193496
augggcaagaaguacaagaacaucgugcugcucaaggggcuggaggucaucaacgacuaccacuuccgcauggucaagagccugcucuccaacgaccugaagcugaaccucaagaugcgggaggaguacgacaagauccagaucgccgaccugauggaggagaaguuccgcggcgacgccgggcugggcaagcucaucaagaucuucgaggacauccccacccuggaggaccuggcggagacccucaagaaggagaagcugaaggugaaggggccggcccugagccggaagcgcaagaaggagguggacgccacgucccccgcccccagcaccuccagcaccgugaagaccgagggcgccgaggcgacgcccggcgcccagaacccgaagaccguggccaagugccaggucacgccccggcgcaacgugcuccagaagcggcccgugaucgucaaggugcuguccaccaccaagcccuucgaguacgagaccccggagauggagaagaagaucauguuccacgccaccguggcgacccagacgcaguucuuccacgucaaggugcugaacaccagccucaaggagaaguucaacgggaagaagaucaucaucaucuccgacuaccuggaguacgacagccugcucgaggugaacgaggaguccaccgucagcgaggccggccccaaccagaccuucgaggugcccaacaagaucaucaaccgcgccaaggagacgcugaagaucgacauccugcacaagcaggccuccgggaacaucguguacggcgucuucaugcuccacaagaagaccgugaaccagaagaccaccaucuacgagauccaggacgaccgggggaagauggacguggucggcacgggccagugccacaacauccccugcgaggagggggacaagcugcagcuguucugcuuccgccuccggaagaagaaccagaugagcaagcugaucuccgagaugcacagcuucauccagaucaagaagaagaccaacccgcgcaacaacgaccccaaguccaugaagcugccccaggagcagcggcagcuccccuacccgagcgaggccuccaccaccuuccccgagagccaccuccgcacgccccagaugcccccgaccacccccagcuccagcuucuucaccaagaaguccgaggacacgaucagcaagaugaacgacuucaugcggaugcagauccugaaggagggcucccacuuccccgggcccuucaugaccagcaucggcccggcggagucccacccccacacgccccagaugcccccgagcacccccuccagcuccuuccugaccaccaagagcgaggacaccaucuccaagaugaacgacuucaugcgcaugcagauccugaaggagggcagccacuuccccgggccguucaugaccuccaucggccccgccgagagccacccccacacgccccagaugccgcccuccacccccagcuccagcuuccugaccacccucaagccccggcugaagaccgagccggaggaggugagcaucgaggacuccgcccagagcgaccugaaggaggugaugguccucaacgccacggaguccuucguguacgagcccaaggagcagaagaagauguuccacgccaccgucgcgaccgagaacgagguguuccgcgugaaggucuucaacaucgaccugaaggagaaguucacccccaagaagaucaucgccaucgccaacuacgugugccggaacggguuccuggagguguaccccuucacgcucgucgccgacgugaacgccgaccgcaacauggagaucccgaagggccugauccggagcgcguccgugacccccaagaucaaccagcugugcagccagaccaagggguccuucgucaacggcguguucgaggugcacaagaagaacguccgcggcgaguucaccuacuacgagauccaggacaacacggggaagauggagguggugguccacggccgccucaccaccaucaacugcgaggagggggacaagcugaagcugaccugcuucgagcucgcccccaagagcggcaacacgggggagcugcgguccgugauccacagccacaucaaggugaucaagacccgcaagaacaagaaggacauccugaaccccgacuccagcauggagaccuccccggacuucuucuucuga

SEQ ID NO: 31421 - RNA, 369 nt, Artificial Sequence
  derived and/or modified sequence opt1 from IFI27__Homo_sapiens__NP_001275885
auggaggccagcgcccugaccuccagcgcggugaccuccgucgccaagguggugcgcgucgccagcggcuccgccguggugcucccccuggcccggaucgcgacggucgugaucgggggcguggucgccauggccgccgugccgauggugcugagcgcgaugggguucaccgccgccggcaucgccuccagcuccaucgccgcgaagaugaugagcgccgccgccaucgccaacgggggcggcgucgcguccgggagccucguggccacccugcagucccugggcgccaccgggcucagcggccugacgaaguucauccugggguccaucggcagcgccaucgccgcggugaucgcccgcuucuacuga

SEQ ID NO: 31422 - RNA, 753 nt, Artificial Sequence
  derived and/or modified sequence opt1 from IFI30__Homo_sapiens__NP_006323
augacccugagcccccuccugcuguuccucccgccccugcugcuccugcuggacgugcccaccgccgccguccaggcgagcccccuccaggcccuggacuucuucggcaacgggccgcccgugaacuacaagacgggcaaccuguaccuccgcgggccccugaagaaguccaacgcgccccuggugaacgucacccucuacuacgaggcccugugcggcgggugccgggccuuccugauccgcgagcuguucccgaccuggcuccuggugauggagauccucaacgugacccugguccccuacggcaacgcccaggagcagaacguguccggccggugggaguucaagugccagcacggggaggaggagugcaaguucaacaagguggaggccugcguccuggacgagcucgacauggagcuggccuuccugacgaucgugugcauggaggaguucgaggacauggagcgcagccucccccugugccugcagcucuacgcccccggccuguccccggacaccaucauggagugcgcgaugggggaccggggcaugcagcugaugcacgccaacgcccagcgcaccgacgcccuccagccgccccacgaguacgugcccugggucaccgugaacgggaagccccuggaggaccagacgcagcugcucacccuggugugccagcuguaccagggcaagaagcccgacgucugccccagcuccaccagcucccuccggagcgugugcuucaaguga

SEQ ID NO: 31423 - RNA, 867 nt, Artificial Sequence
  derived and/or modified sequence opt1 from IFI35__Homo_sapiens__NP_005524
augagcgcgccccuggacgccgcccuccacgcccugcaggaggagcaggcccggcugaagaugcggcucugggaccugcagcagcugcgcaaggagcucggcgacuccccgaaggacaaggugcccuucagcguccccaagaucccccugguguuccgggggcacacccagcaggacccggaggugcccaagucccuggucagcaaccuccgcauccacugcccccugcuggccggcuccgcccucaucaccuucgacgaccccaagguggcggagcagguccugcagcagaaggagcacacgaucaacauggaggagugccggcugcgcguccaggugcagccgcucgagcugcccauggugaccaccauccaggugaugaugagcucccagcugagcgggcggcgcgugcucgugaccggcuuccccgccucccugcggcugagcgaggaggagcuccuggacaagcuggagaucuucuucgggaagacgcgcaacggcggcggggacgucgacgugcgggagcuccugcccggcuccgugaugcugggguucgcccgcgacggcgucgcccagcggcucugccagaucgggcaguucaccgugccgcugggcggccagcaggucccccugcgcgugagccccuacgugaacggggagauccagaaggcggagauccggucccagcccgugccgcgcagcguccucgugcugaacauccccgacauccuggacggccccgagcuccacgacgugcuggagauccacuuccagaagcccacccgcgggggcggcgaggucgaggcccugaccguggucccgcaggggcagcagggccucgccguguucacguccgagagcggguga

SEQ ID NO: 31424 - RNA, 1374 nt, Artificial Sequence
  derived and/or modified sequence opt1 from IFI44__Homo_sapiens__XP_011538818
auggccgugaccacccgccugacguggcuccacgagaagauccugcagaaccacuucggcgggaagcggcugagccuccuguacaagggcuccguccacggguuccgcaacggcgugcugcucgaccggugcugcaaccaggggcccacccugaccgugaucuacagcgaggaccacaucaucggcgccuacgcggaggaguccuaccaggagggcaaguacgccagcaucauccuguucgcccuccaggacaccaagaucuccgaguggaagcuggggcugugcacgccggagacccucuucugcugcgacgucaccaaguacaacagccccaccaacuuccagaucgacggccgcaaccggaaggugaucauggaccugaagacgauggagaaccuggggcucgcccagaacugcaccaucuccauccaggacuacgagguguuccgcugcgaggacagccuggacgagcggaagaucaagggcgucaucgagcugcgcaagucccuccugagcgcccugcggaccuacgagcccuacgggucccucgugcagcagauccgcauccugcugcucggccccaucggcgcgggcaagagcuccuucuucaacagcgugcgguccgucuuccaggggcacgugacccaccaggcccugguggggacgaacaccaccggcaucagcgagaaguaccgcaccuacuccauccgggacggcaaggacgggaaguaccugccguucauccucugcgacagccugggccuguccgagaaggagggcgggcucugccgcgacgacaucuucuacauccugaacgggaacauccgggaccgcuaccaguucaaccccauggagagcaucaagcugaaccaccacgacuacaucgacagccccucccucaaggaccggauccacugcgucgccuucguguucgacgccagcuccauccaguacuucagcucccagaugaucgugaagaucaagcgcauccggcgcgagcuggucaacgcgggcguggugcacgucgcccugcucacgcacguggacagcauggaccugaucaccaagggcgaccugaucgagaucgagcggugcgagcccgugcgcuccaagcucgaggagguccagcgcaagcugggguucgcccugagcgacaucuccguggugagcaacuacuccagcgagugggagcucgacccggucaaggacgugcugauccuguccgcccuccggcgcaugcugugggccgcggacgacuuccuggaggaccuccccuucgagcagaucggccggugguucgggggcgucgaggccuggaagcgcagcgggaaccugcgggaggagaucaucaacugcgcccagggcaagaaguga

SEQ ID NO: 31425 - RNA, 3078 nt, Artificial Sequence
  derived and/or modified sequence opt1 from IFIH1__Homo_sapiens__NP_071451
augagcaacggcuacuccaccgacgagaacuuccgcuaccugaucagcugcuuccgggcccgcgugaagauguacauccaggucgagcccgugcucgacuaccugaccuuccugccggccgaggugaaggagcagauccagcggacggucgcgaccuccgggaacaugcaggccguggagcuccugcugagcacccucgagaagggcguguggcaccugggguggacccgcgaguucgucgaggcccugcggcgcacgggcagcccccucgccgcccgguacaugaaccccgagcugaccgaccugcccuccccguccuucgagaacgcgcacgacgaguaccuccagcugcugaaccuccugcagcccacccugguggacaagcuccuggugcgcgacguccuggacaagugcauggaggaggagcuccugaccaucgaggaccggaaccgcaucgccgccgccgagaacaacgggaacgagagcggcgugcgggagcugcucaagcgcaucgugcagaaggagaacugguucuccgcguuccugaacguccugcggcagacgggcaacaacgagcucgugcaggagcugaccgggagcgacugcuccgagagcaacgccgagaucgagaaccugucccagguggacggcccccaggucgaggagcagcuccugagcaccaccgugcagcccaaccuggagaaggaggugugggggauggagaacaacuccagcgaguccagcuucgccgacuccagcgucgugagcgaguccgacacgagccucgccgagggcuccgugagcugccuggacgagucccuggggcacaacagcaacaugggcuccgacagcggcaccaugggguccgacagcgacgaggagaacgucgccgcgcgcgccuccccggagcccgagcuccagcugcggcccuaccagauggagguggcccagcccgcccuggagggcaagaacaucaucaucugccucccgaccgggagcggcaagacccgcguggccgucuacaucgcgaaggaccaccuggacaagaagaagaaggccuccgagcccggcaaggugaucguccuggugaacaaggugcuccuggucgagcagcuguuccggaaggaguuccagcccuuccucaagaagugguaccgcgugaucgggcugagcggcgacacgcagcugaagaucuccuuccccgagguggucaagagcugcgacaucaucaucuccaccgcccagauccucgagaacagccugcugaaccuggagaacggggaggacgccggcgugcagcucuccgacuucagccugaucaucaucgacgagugccaccacaccaacaaggaggccguguacaacaacaucaugcggcacuaccugaugcagaagcucaagaacaaccgccugaagaaggagaacaagccggucaucccccugccccagauccucgggcugaccgcgagccccggcgugggcggggccacgaagcaggccaaggccgaggagcacauccugaagcucugcgccaaccuggacgcguucaccaucaagaccgugaaggagaaccuggaccagcucaagaaccagauccaggagccgugcaagaaguucgccaucgccgacgccacccgggaggaccccuucaaggagaagcugcuggagaucaugacgcgcauccagaccuacugccagaugucccccaugagcgacuucggcacccagcccuacgagcagugggcgauccagauggagaagaaggccgccaaggaggggaaccgcaaggagcgggucugcgccgagcaccuccgcaaguacaacgaggcccugcagaucaacgacaccauccggaugaucgacgcguacacgcaccuggagaccuucuacaacgaggagaaggacaagaaguucgccgugaucgaggacgacuccgacgagggcggggacgacgaguacugcgacggcgacgaggacgaggacgaccucaagaagccgcugaagcuggacgagaccgaccgcuuccucaugacccuguucuucgagaacaacaagaugcugaagcggcucgccgagaaccccgaguacgagaacgagaagcugacgaagcugcgcaacaccaucauggagcaguacacccggaccgaggagagcgcccgcggcaucaucuucacgaagacccggcaguccgccuacgcgcucagccaguggaucaccgagaacgagaaguucgccgaggugggggucaaggcccaccaccugaucggcgccgggcacuccagcgaguucaagcccaugacccagaacgagcagaaggaggugaucuccaaguuccgcaccggcaagaucaaccugcucaucgccacgaccguggcggaggaggggcuggacaucaaggagugcaacaucgucauccgguacggccuggugaccaacgagaucgccauggugcaggcccgcggccgggcccgcgcggacgagagcaccuacguccucguggcccacuccgggagcggcgugaucgagcacgagacggucaacgacuuccgggagaagaugauguacaaggccauccacugcgugcagaacaugaagcccgaggaguacgcccacaagauccuggagcugcagaugcaguccaucauggagaagaagaugaagaccaagcgcaacaucgccaagcacuacaagaacaacccgagccucaucaccuuccugugcaagaacugcuccgugcuggcgugcagcggggaggacauccacgucaucgagaagaugcaccacgugaacaugacccccgaguucaaggagcucuacaucgugcgggagaacaaggcccugcagaagaagugcgccgacuaccagaucaacggcgagaucaucugcaagugcggccaggccugggggacgaugaugguccacaagggccuggaccuccccugccugaagauccgcaacuucgugguggucuucaagaacaacuccaccaagaagcaguacaagaaguggguggagcugccgaucaccuuccccaaccucgacuacagcgagugcugccuguucagcgacgaggacuga

SEQ ID NO: 31426 - RNA, 1344 nt, Artificial Sequence
  derived and/or modified sequence opt1 from IFIT1__Homo_sapiens__NP_001257858
augcccgaccuggagaaccgcgugcucgaccagaucgaguuccuggacaccaaguacagcgucggcauccacaaccugcucgccuacgugaagcaccugaaggggcagaacgaggaggcccugaagucccucaaggaggcggagaaccugaugcaggaggagcacgacaaccaggccaacgugcggagccuggucaccuggggcaacuucgccuggauguacuaccacauggggcgccucgccgaggcccagacguaccuggacaagguggagaacaucugcaagaagcuguccaacccguuccgguaccgcauggagugccccgagaucgacugcgaggagggcugggcgcuccugaagugcgggggcaagaacuacgagcgggccaaggccugcuucgagaaggugcuggaggucgaccccgagaaccccgagagcuccgccggcuacgcgaucagcgccuaccgccucgacggguucaagcuggccaccaagaaccacaagccguucucccugcucccccugcggcaggccgugcgccugaaccccgacaacggcuacaucaaggugcuccuggcccugaagcuccaggacgaggggcaggaggcggagggcgagaaguacaucgaggaggcccuggccaacaugagcucccagaccuacgucuuccgguacgccgccaaguucuaccgccggaaggggagcguggacaaggcgcuggagcuccugaagaaggcccugcaggagacccccacguccgugcuccugcaccaccagaucggccugugcuacaaggcccagaugauccagaucaaggaggccaccaagggccagccgcgcgggcagaaccgggagaagcucgacaagaugauccgcagcgccaucuuccacuucgaguccgcggucgagaagaagcccaccuucgagguggcccaccuggaccuggcccggauguacaucgaggccggcaaccaccgcaaggccgaggagaacuuccagaagcuccugugcaugaagcccguggucgaggagaccaugcaggacauccacuuccacuacgggcgguuccaggaguuccagaagaaguccgacgugaacgcgaucauccacuaccugaaggccaucaagaucgagcaggccagccucacgcgcgacaagagcaucaacucccugaagaagcuggugcuccggaagcugcgccggaaggcccuggaccucgagagccugucccugcucggcuucgucuacaagcuggagggcaacaugaacgaggcgcuggaguacuacgagcgcgcccugcgccucgccgccgacuucgagaacagcgugcggcaggggcccuga

SEQ ID NO: 31427 - RNA, 1419 nt, Artificial Sequence
  derived and/or modified sequence opt1 from IFIT2__Homo_sapiens__NP_001538
augagcgagaacaacaagaacucccuggagagcucccuccgccagcugaagugccacuucaccuggaaccugauggagggcgagaacagccucgacgacuucgaggacaagguguucuaccggaccgaguuccagaaccgcgaguucaaggccacgaugugcaaccugcuggccuaccucaagcaccugaaggggcagaacgaggcggcccuggagugccuccggaaggccgaggagcugauccagcaggagcacgccgaccaggccgagauccgcucccuggucaccuggggcaacuacgcguggguguacuaccacauggggcggcucagcgacgugcagaucuacgucgacaaggugaagcacgugugcgagaaguucuccagccccuaccgcaucgaguccccggagcuggacugcgaggagggcuggacccggcugaagugcgggggcaaccagaacgagcgcgccaaggucugcuucgagaaggcccucgagaagaagcccaagaaccccgaguucaccagcggccuggccaucgcguccuaccggcuggacaacuggcccccgagccagaacgccaucgacccccuccgccaggccauccggcugaaccccgacaaccaguaccugaaggugcuccuggcccugaagcuccacaagaugcgcgaggagggggaggaggagggcgagggggagaagcugguggaggaggcccuggagaaggcgcccggcgucacggacgugcuccgguccgccgccaaguucuaccgccggaaggacgagccggacaaggccaucgagcugcugaagaaggcccucgaguacauccccaacaacgcguaccugcacugccagaucgggugcugcuaccgcgccaagguguuccaggucaugaaccugcgggagaacggcauguacggcaagcgcaagcuccuggagcugaucgggcacgccguggcccaccucaagaaggccgacgaggcgaacgacaaccuguuccgggugugcagcauccuggccucccuccacgcccuggccgaccaguacgaggacgccgaguacuacuuccagaaggaguucagcaaggagcugacccccgucgcgaagcagcuccugcaccuccgcuacggcaacuuccagcuguaccagaugaagugcgaggacaaggccauccaccacuucaucgagggggugaagaucaaccagaagucccgggagaaggagaagaugaaggacaagcugcagaagaucgccaagaugcgccugagcaagaacggcgccgacuccgaggcgcuccacgugcuggccuuccugcaggagcugaacgagaagaugcagcaggccgacgaggacagcgagcgcggccucgagagcgggucccugauccccagcgccuccagcuggaacggcgaguga

SEQ ID NO: 31428 - RNA, 1317 nt, Artificial Sequence
  derived and/or modified sequence opt1 from IFIT3__Homo_sapiens__NP_001276687
auguacaaccugcucgccuacaucaagcaccuggacggcaacaacgaggccgcgcuggagugccuccgccaggccgaggagcugauccagcaggagcacgccgaccaggccgagauccggagccuggugaccugggggaacuacgccugggucuacuaccaccucggccgccuguccgacgcgcagaucuacguggacaaggugaagcagaccugcaagaaguucagcaaccccuacuccaucgaguacagcgagcuggacugcgaggagggguggacgcagcucaagugcggccggaacgagcgcgccaaggucugcuucgagaaggcccuggaggagaagccgaacaaccccgaguucuccagcgggcuggccaucgcgauguaccaccucgacaaccaccccgagaagcaguucuccaccgacgugcugaagcaggccaucgagcugagccccgacaaccaguacgugaagguccuccugggccugaagcuccagaagaugaacaaggaggccgagggcgagcaguucguggaggaggcccuggagaaguccccgugccagaccgacgugcugcggagcgccgcgaaguucuaccgccggaagggggaccucgacaaggccaucgagcuguuccagcgcguccuggaguccacccccaacaacggcuaccucuaccaccagaucgggugcugcuacaaggccaaggugcggcagaugcagaacacgggcgagagcgaggccuccgggaacaaggagaugaucgaggcccugaagcaguacgcgauggacuacagcaacaaggcccuggagaagggccucaacccccugaacgccuacuccgaccuggccgaguuccucgagaccgagugcuaccagacccccuucaacaaggaggugccggacgccgagaagcagcagagccaccagcgcuacugcaaccugcagaaguacaacggcaaguccgaggacaccgcgguccagcacgggcuggagggccucagcaucuccaagaaguccacggacaaggaggagaucaaggaccagccccagaacgugagcgagaaccugcugccccagaacgcccccaacuacugguaccuccaggggcugauccacaagcagaacggcgaccugcuccaggccgccaagugcuacgagaaggagcugggccggcugcuccgcgacgccccgagcgggaucggcagcaucuuccuguccgcgagcgagcuggaggacggguccgaggagaugggccagggggccgugagcuccagcccccgggagcuccuguccaacagcgagcagcugaacuga

SEQ ID NO: 31429 - RNA, 1449 nt, Artificial Sequence
  derived and/or modified sequence opt1 from IFIT5__Homo_sapiens__NP_036552
augagcgagauccgcaaggacacccugaaggccauccuccuggagcuggagugccacuucaccuggaaccuccugaaggaggacaucgaccuguucgagguggaggacacgaucggccagcagcucgaguuccugaccaccaagucccggcuggcccucuacaaccugcuggcguacgucaagcaccucaaggggcagaacaaggacgcccuggagugccuggagcaggccgaggagaucauccagcaggagcacagcgacaaggaggaggugcgcucccucgugaccuggggcaacuacgccugggucuacuaccacauggaccagcuggaggaggcccagaaguacacggggaagaucggcaacgugugcaagaagcugagcucccccagcaacuacaagcucgagugcccggagaccgacugcgagaaggggugggcgcugcugaaguucggcggcaaguacuaccagaaggccaaggccgccuucgagaaggcgcucgagguggagcccgacaaccccgaguucaacaucggguacgccaucaccgucuaccggcuggacgacuccgaccgcgagggcagcgugaaguccuucagccuggggccccuccggaaggccgugacccugaacccggacaacuccuacaucaaggucuuccuggcccucaagcugcaggacgugcacgccgaggcggagggcgagaaguacaucgaggagauccuggaccagaucagcucccagcccuacgugcuccgcuacgccgccaaguucuaccggcgcaagaacagcuggaacaaggcccuggagcugcucaagaaggcccuggaggucacgcccaccuccagcuuccugcaccaccagauggggcucugcuaccgggcgcagaugauccagaucaagaaggccacccacaaccgccccaagggcaaggacaagcugaagguggacgagcugaucuccagcgccaucuuccacuucaaggccgccauggagcgggacuccauguucgcguucgccuacaccgaccucgccaacauguacgccgagggcgggcaguacagcaacgccgaggacaucuuccgcaaggcgcugcggcuggagaacaucacggacgaccacaagcaccagauccacuaccacuacggccgcuuccaggaguuccaccgcaagagcgagaacaccgccauccaccacuaccucgaggcccugaaggugaaggaccgguccccgcugcggaccaagcucaccagcgcccugaagaagcuguccacgaagcgccucugccacaacgcgcuggacguccagagccuguccgcccugggguucguguacaagcucgagggcgagaagcggcaggccgccgaguacuacgagaaggcccagaagaucgaccccgagaacgcggaguuccugaccgcccugugcgagcuccgccugagcaucuga

SEQ ID NO: 31430 - RNA, 378 nt, Artificial Sequence
  derived and/or modified sequence opt1 from IFITM1__Homo_sapiens__NP_003632
augcacaaggaggagcacgagguggccguccugggcgcgcccccgagcaccauccucccccgcuccaccgugaucaacauccacagcgagacguccgugcccgaccacgucguguggagccuguucaacacccuguuccucaacuggugcugccugggguucaucgccuucgccuacuccgucaagagccgggaccgcaagauggugggcgacgugaccggggcccaggccuacgccuccaccgcgaagugccugaacaucugggcccucauccugggcauccugaugacgaucggguucauccuccugcugguguucggcagcgucaccguguaccacaucaugcuccagaucauccaggagaagcggggcuacuga

SEQ ID NO: 31431 - RNA, 399 nt, Artificial Sequence
  derived and/or modified sequence opt1 from IFITM2__Homo_sapiens__NP_006426
augaaccacaucgugcagaccuucagccccgucaacuccggccagccgcccaacuacgagaugcugaaggaggagcaggagguggccaugcucggggugccccacaaccccgccccgcccaugagcaccgucauccacauccgcuccgagacgagcgugcccgaccacguggucuggucccuguucaacacccuguucaugaacacgugcugccucggcuucaucgcguucgccuacagcgugaagucccgggaccgcaagauggugggggacgucaccggcgcccaggccuacgccagcaccgcgaagugccugaacaucugggcccugauccucgggaucuucaugaccauccugcugaucaucauccccgugcucgugguccaggcccagcgguga

SEQ ID NO: 31432 - RNA, 402 nt, Artificial Sequence
  derived and/or modified sequence opt1 from IFITM3__Homo_sapiens__NP_066362
augaaccacaccgugcagaccuucuucagccccgucaacuccggccagccgcccaacuacgagaugcugaaggaggagcacgagguggccgugcucggggcgccccacaaccccgccccgcccacgagcaccgucauccacauccgcuccgagaccagcgugcccgaccacguggucuggucccuguucaacacccuguucaugaaccccugcugccucggcuucaucgccuucgccuacagcgugaagucccgggaccgcaagauggugggggacgucacgggcgcccaggccuacgcgagcaccgccaagugccugaacaucugggcccugauccucgggauccugaugaccauccugcucaucgugaucccggugcugaucuuccaggccuacggcuga

SEQ ID NO: 31433 - RNA, 399 nt, Artificial Sequence
  derived and/or modified sequence opt1 from IFITM5__Homo_sapiens__NP_001020466
auggacaccgccuacccccgcgaggacacccgggccccgacgcccagcaaggcgggcgcccacaccgcccugacccucggggccccccaccccccgccccgcgaccaccugaucugguccguguucagcacccuguaccucaaccugugcugccugggcuuccucgcccuggcguacuccaucaaggcccgggaccagaaggucgugggggaccuggaggccgcccgccgguucggcagcaaggcgaagugcuacaacauccucgccgccauguggacgcuggugcccccccugcuccugcuggggcucgucgugaccggcgcccugcaccuggcccgccucgcgaaggacuccgccgccuucuucagcaccaaguucgacgacgccgacuacgacuga

SEQ ID NO: 31434 - RNA, 570 nt, Artificial Sequence
  derived and/or modified sequence opt1 from IFNA10__Homo_sapiens__NP_002162
auggcccugagcuucucccuccugauggccgugcugguccucagcuacaaguccaucugcagccugggcugcgaccugccccagacccacucccucgggaaccgccgggcgcugauccugcucggccagauggggcgcaucagcccguucuccugccugaaggaccggcacgacuuccgcaucccccaggaggaguucgacggcaaccaguuccagaaggcccaggccaucagcgugcugcacgagaugauccagcagaccuucaaccucuucuccacggaggacagcuccgccgccugggagcagagccugcuggagaaguucuccaccgagcucuaccagcagcugaacgaccuggaggcgugcgugauccaggaggucgggguggaggagacgccccucaugaacgaggacagcauccuggccgugcggaaguacuuccagcgcaucacccuguaccucaucgagcggaaguacucccccugcgccugggaggucgugcgcgccgagaucaugcggagccuguccuucagcaccaaccugcagaagcgccuccggcgcaaggacuga

SEQ ID NO: 31435 - RNA, 573 nt, Artificial Sequence
  derived and/or modified sequence opt1 from IFNA13__Homo_sapiens__NP_008831
augauggccagccccuucgcccugcucauggcgcuggugguccuguccugcaagagcuccugcagccucggcugcgaccugccggagacccacucccuggacaaccgccggacccucaugcugcuggcccagaugagccgcaucucccccagcuccugccucauggaccggcacgacuucggguucccccaggaggaguucgacggcaaccaguuccagaaggcccccgccaucagcgugcugcacgagcugauccagcagaucuucaaccucuucacgaccaaggacuccagcgccgcgugggacgaggaccugcuggacaaguucugcaccgagcucuaccagcagcugaacgaccuggaggccugcgugaugcaggaggagcgcgucggggagaccccgcucaugaacgccgacuccauccuggccgugaagaaguacuuccggcgcaucacgcuguaccucaccgagaagaaguacagccccugcgcgugggaggugguccgggccgagaucaugcgcucccugagccuguccaccaaccuccaggagcggcugcgccggaaggaguga

SEQ ID NO: 31436 - RNA, 570 nt, Artificial Sequence
  derived and/or modified sequence opt1 from IFNA14__Homo_sapiens__NP_002163
auggcccugcccuucgcccucaugauggcgcuggugguccugagcugcaaguccagcugcucccucggcugcaaccugagccagacccacucccugaacaaccgccggacccucaugcugauggcccagaugcgccggaucagcccguucuccugccugaaggaccgccacgacuucgaguucccccaggaggaguucgacgggaaccaguuccagaaggcccaggccaucagcgugcuccacgagaugaugcagcagacguucaaccuguucuccaccaagaacagcuccgccgcgugggacgagacccugcucgagaaguucuacaucgagcuguuccagcagaugaacgaccuggaggccugcgugauccaggaggucggcguggaggagacgccccucaugaacgaggacagcauccuggccgugaagaaguacuuccagcggaucacccuguaccucauggagaagaaguacucccccugcgccugggaggucgugcgcgcggagaucaugcggagccuguccuucagcaccaaccugcagaagcgccuccggcgcaaggacuga

SEQ ID NO: 31437 - RNA, 570 nt, Artificial Sequence
  derived and/or modified sequence opt1 from IFNA16__Homo_sapiens__NP_002164
auggcccugagcuucucccuccugauggccgugcugguccucagcuacaaguccaucugcagccugggcugcgaccugccccagacccacucccucgggaaccgccgggcgcugauccugcucgcccagaugggccgcaucagccacuucuccugccugaaggaccgguacgacuucggguucccgcaggagguguucgacggcaaccaguuccagaaggcccaggccaucagcgccuuccacgagaugauccagcagaccuucaaccuguucuccacgaaggacagcuccgcggccugggacgagacccuccuggacaaguucuacaucgagcuguuccagcagcucaacgaccuggaggccugcgugacccaggaggucgggguggaggagaucgcccugaugaacgaggacagcauccucgcggugcgcaaguacuuccagcggaucacccuguaccugaugggcaagaaguacucccccugcgccugggaggucgugcgcgccgagaucaugcggagcuucuccuucagcacgaaccuccagaagggccugcgccggaaggacuga

SEQ ID NO: 31438 - RNA, 570 nt, Artificial Sequence
  derived and/or modified sequence opt1 from IFNA17__Homo_sapiens__NP_067091
auggcccugagcuucucccuccugauggccgugcugguccucagcuacaaguccaucugcagccugggcugcgaccugccccagacccacucccucgggaaccgccgggcgcugauccugcucgcccagaugggccgcaucagcccguucuccugccugaaggaccggcacgacuucgggcugccccaggaggaguucgacggcaaccaguuccagaagacccaggccaucagcgugcuccacgagaugauccagcagacguucaaccuguucuccaccgaggacagcuccgccgccugggagcagagccugcucgagaaguucuccaccgagcuguaccagcagcugaacaaccucgaggcgugcgugauccaggaggucgggauggaggagacgccccugaugaacgaggacagcauccuggccgugcgcaaguacuuccagcggaucacccucuaccugaccgagaagaaguacucccccugcgccugggaggugguccgcgccgagaucaugcggagccuguccuucagcaccaaccuccagaagauccugcgccggaaggacuga

SEQ ID NO: 31439 - RNA, 570 nt, Artificial Sequence
  derived and/or modified sequence opt1 from IFNA1__Homo_sapiens__NP_076918
auggccagccccuucgcccugcucauggugcuggucgugcuguccugcaagagcuccugcagccucggcugcgaccugccggagacccacucccuggacaaccgccggacccucaugcugcuggcgcagaugagccgcaucucccccagcuccugccucauggaccggcacgacuucggguucccccaggaggaguucgacggcaaccaguuccagaaggcccccgccaucagcgugcugcacgagcugauccagcagaucuucaaccucuucacgaccaaggacuccagcgccgccugggacgaggaccugcuggacaaguucugcaccgagcucuaccagcagcugaacgaccuggaggcgugcgucaugcaggaggagcgcgugggggagaccccgcucaugaacgccgacuccauccuggccgugaagaaguacuuccggcgcaucacgcuguaccucaccgagaagaaguacagccccugcgccugggaggucgugcgggcggagaucaugcgcucccugagccuguccaccaaccuccaggagcggcugcgccggaaggaguga

SEQ ID NO: 31440 - RNA, 570 nt, Artificial Sequence
  derived and/or modified sequence opt1 from IFNA21__Homo_sapiens__NP_002166
auggcccugagcuucucccuccugauggccgugcugguccucagcuacaaguccaucugcagccugggcugcgaccugccccagacccacucccucgggaaccgccgggcgcugauccugcucgcccagaugggccgcaucagcccguucuccugccugaaggaccggcacgacuucggguucccccaggaggaguucgacggcaaccaguuccagaaggcccaggccaucagcgugcugcacgagaugauccagcagaccuucaaccucuucuccacgaaggacagcuccgccaccugggagcagagccugcuggagaaguucuccaccgagcucaaccagcagcugaacgaccuggaggcgugcgugauccaggaggucgggguggaggagacgccccucaugaacguggacagcauccuggccgucaagaaguacuuccagcgcaucacccuguaccucaccgagaagaaguacucccccugcgccugggagguggugcgggccgagaucaugcgcagcuucucccugagcaagaucuuccaggagcggcugcgccggaaggaguga

SEQ ID NO: 31441 - RNA, 567 nt, Artificial Sequence
  derived and/or modified sequence opt1 from IFNA2__Homo_sapiens__NP_000596
auggcccugaccuucgcccuccugguggcgcugcucguccugagcugcaaguccagcugcuccgugggcugcgaccugccccagacccacagccucgggucccgccggacgcugaugcugcucgcccagaugcgccggaucagccuguucuccugccugaaggaccgccacgacuucggcuucccgcaggaggaguucgggaaccaguuccagaaggccgagaccauccccgugcuccacgagaugauccagcagaucuucaaccuguucagcaccaaggacuccagcgccgccugggacgagacccugcucgacaaguucuacacggagcuguaccagcagcugaacgaccucgaggcgugcgucauccagggcgugggggugaccgagacgccccugaugaaggaggacuccauccuggccguccggaaguacuuccagcgcaucacccucuaccugaaggagaagaaguacagccccugcgccugggagguggugcgggccgagaucaugcgcuccuucagccuguccaccaaccuccaggagagccugcgguccaaggaguga

SEQ ID NO: 31442 - RNA, 570 nt, Artificial Sequence
  derived and/or modified sequence opt1 from IFNA4__Homo_sapiens__NP_066546
auggcccugagcuucucccuccugauggccgugcugguccucagcuacaaguccaucugcagccugggcugcgaccugccccagacccacucccucgggaaccgccgggcgcugauccugcucgcccagaugggccgcaucagccacuucuccugccugaaggaccggcacgacuucggguucccggaggaggaguucgacggccaccaguuccagaaggcccaggccaucagcgugcugcacgagaugauccagcagaccuucaaccucuucuccacggaggacagcuccgccgcgugggagcagagccugcuggagaaguucuccaccgagcucuaccagcagcugaacgaccuggaggccugcgugauccaggaggucgggguggaggagacgccccucaugaacgaggacagcauccuggccgugcgcaaguacuuccagcggaucacccuguaccucaccgagaagaaguacucccccugcgccugggaggucgugcgcgcggagaucaugcggagccuguccuucagcaccaaccugcagaagcgccuccggcgcaaggacuga

SEQ ID NO: 31443 - RNA, 570 nt, Artificial Sequence
  derived and/or modified sequence opt1 from IFNA5__Homo_sapiens__NP_002160
auggcccugcccuucgugcuccugauggcccuggucgugcucaacugcaagagcaucugcucccugggcugcgaccugccgcagacccacagccucuccaaccgccggacccugaugaucauggcgcagauggggcgcaucagccccuucuccugccugaaggaccggcacgacuucggcuucccccaggaggaguucgacgggaaccaguuccagaaggcccaggccaucagcgugcuccacgagaugauccagcagacguucaaccuguucuccaccaaggacagcuccgccaccugggacgagacccugcucgacaaguucuacacggagcuguaccagcagcugaacgaccucgaggccugcaugaugcaggaggucggcguggaggacacgccccugaugaacguggacagcauccugaccguccgcaaguacuuccagcggaucacccucuaccugaccgagaagaaguacuccccgugcgcgugggagguggugcgcgccgagaucaugcggagcuucucccugagcgccaaccuccaggagcgccugcggcgcaaggaguga

SEQ ID NO: 31444 - RNA, 570 nt, Artificial Sequence
  derived and/or modified sequence opt1 from IFNA6__Homo_sapiens__NP_066282
auggcccugcccuucgcccuccugauggcgcuggugguccucagcugcaaguccagcugcucccuggacugcgaccugccgcagacccacagccucggccaccgccggaccaugaugcugcuggcccagaugcgccggaucucccucuucagcugccugaaggaccgccacgacuuccgguucccccaggaggaguucgacgggaaccaguuccagaaggccgaggccaucuccgugcugcacgaggugauccagcagacguucaaccucuucagcaccaaggacuccagcgucgccugggacgagcgccugcuggacaagcucuacaccgagcuguaccagcagcugaacgaccucgaggcgugcgugaugcaggaggugugggucggcgggacgccccugaugaacgaggacuccauccuggccgugcggaaguacuuccagcgcaucacccucuaccugaccgagaagaaguacagccccugcgccugggaggugguccgggccgagaucaugcgcuccuucagcuccagccggaaccugcaggagcgccuccggcgcaaggaguga

SEQ ID NO: 31445 - RNA, 570 nt, Artificial Sequence
  derived and/or modified sequence opt1 from IFNA7__Homo_sapiens__NP_066401
auggcccgcagcuucucccugcucauggugguccuggugcugagcuacaaguccaucugcagccucggcugcgaccugccccagacccacucccugcggaaccgccgggcccucauccugcuggcgcagauggggcgcaucagcccguucuccugccucaaggaccggcacgaguuccgcuuccccgaggaggaguucgacggccaccaguuccagaagacccaggccaucagcgugcugcacgagaugauccagcagacguucaaccuguucuccaccgaggacagcuccgccgccugggagcagagccuccuggagaaguucuccaccgagcuguaccagcagcucaacgaccuggaggccugcgucauccaggagguggggguggaggagacgccccugaugaacgaggacuucauccucgcgguccggaaguacuuccagcgcaucacccuguaccugauggagaagaaguacagccccugcgccugggagguggugcgggccgagaucaugcgcuccuucagcuucuccaccaaccucaagaagggccugcggcgcaaggacuga

SEQ ID NO: 31446 - RNA, 570 nt, Artificial Sequence
  derived and/or modified sequence opt1 from IFNA8__Homo_sapiens__NP_002161
auggcccugaccuucuaccuccugguggcccuggucgugcucagcuacaaguccuucagcucccugggcugcgaccugccccagacccacagccucgggaaccgccgggcgcugauccugcucgcccagaugcgccggaucuccccguucagcugccugaaggaccgccacgacuucgaguucccccaggaggaguucgacgacaagcaguuccagaaggcccaggccaucuccgugcugcacgagaugauccagcagacguucaaccucuucagcaccaaggacuccagcgccgcgcuggacgagacccugcucgacgaguucuacaucgagcuggaccagcagcugaacgaccucgaguccugcgucaugcaggaggugggcgugaucgagagcccccugauguacgaggacuccauccuggccguccggaaguacuuccagcgcaucacccucuaccugacggagaagaaguacagcuccugcgccugggagguggugcgggccgagaucaugcgcagcuucucccugagcaucaaccuccagaagcggcugaaguccaaggaguga

SEQ ID NO: 31447 - RNA, 1674 nt, Artificial Sequence
  derived and/or modified sequence opt1 from IFNAR1__Homo_sapiens__NP_000620
augauggugguccugcucggcgccaccacccuggugcugguggccgucgcgcccugggugcucagcgccgccgccgggggcaagaaccugaaguccccgcagaagguggaggucgacaucaucgacgacaacuucauccugcgcuggaaccggagcgacgaguccguggggaacgugacguucagcuucgacuaccagaagaccggcauggacaacuggaucaagcucuccgggugccagaacaucaccagcaccaagugcaacuucuccagccugaagcugaacgucuacgaggagaucaagcuccgcauccgggccgagaaggagaacacguccagcugguacgagguggacuccuucacccccuuccgcaaggcgcagaucggcccgcccgaggugcaccuggaggccgaggacaaggccaucgucauccacaucagccccggcaccaaggacuccgugaugugggcccuggacgggcucagcuucaccuacucccuggugaucuggaagaacagcuccggcgucgaggagcggaucgagaacaucuacagccgccacaagaucuacaagcugucccccgagacgaccuacugccucaaggugaaggcggcccugcugaccagcuggaagaucgggguguacagccccguccacugcaucaagaccacgguggagaacgagcugcccccgcccgagaacaucgagguguccguccagaaccagaacuacgugcucaagugggacuacaccuacgccaacaugaccuuccaggugcaguggcugcacgccuuccucaagcggaaccccggcaaccaccuguacaaguggaagcagauccccgacugcgagaacgucaagaccacgcagugcguguucccgcagaacgucuuccagaaggggaucuaccugcuccgcgugcaggccagcgacggcaacaacaccuccuucuggagcgaggagaucaaguucgacaccgagauccaggcguuccugcugccgcccguguucaacauccggucccucagcgacuccuuccacaucuacaucggcgcccccaagcagagcgggaacacccccgucauccaggacuacccccugaucuacgagaucaucuucugggagaacacguccaacgccgagcgcaagaucaucgagaagaagaccgacgugaccgugcccaaccugaagccccucaccgucuacugcgugaaggcccgggcccacacgauggacgagaagcugaacaagagcuccguguucagcgacgcggucugcgagaagaccaagccgggcaacaccuccaagaucuggcugaucguggggaucugcaucgcccucuucgcccugcccuucgugaucuacgccgccaaggucuuccugcgcugcaucaacuacguguucuuccccagccucaagcccuccagcuccaucgacgaguacuucagcgagcagccgcugaagaaccugcuccuguccaccagcgaggagcagaucgagaagugcuucaucaucgagaacaucagcacgaucgcgaccguggaggagaccaaccagaccgacgaggaccacaagaaguacuccagccagacgucccaggacagcggcaacuacuccaacgaggacgagagcgaguccaagaccagcgaggagcugcagcaggacuucgucuga

SEQ ID NO: 31448 - RNA, 996 nt, Artificial Sequence
  derived and/or modified sequence opt1 from IFNAR2__Homo_sapiens__NP_997467
augcugcucagccagaacgccuucaucuuccgcucccugaaccuggugcucauggucuacaucagccugguguucggcaucuccuacgacagccccgacuacaccgacgaguccugcaccuucaagaucagccugcggaacuuccgcuccauccucagcugggagcugaagaaccacuccaucgugccgacgcacuacacccugcucuacaccaucaugagcaagcccgaggaccugaaggucgugaagaacugcgccaacaccacgcgguccuucugcgaccugaccgacgaguggcgcagcacccacgaggcguacgugaccguccucgagggguucuccggcaacacgacccuguucagcugcucccacaacuucuggcuggccaucgacaugagcuucgagccgcccgaguucgagaucgugggguucaccaaccacaucaacgugauggucaaguuccccuccaucguggaggaggagcuccaguucgaccugagccuggugaucgaggagcaguccgagggcaucgucaagaagcacaagcccgagaucaaggggaacaugagcggcaacuucaccuacaucaucgacaagcucauccccaacacgaacuacugcgugagcguguaccuggagcacuccgacgagcaggccgucaucaagagcccccugaagugcacccuccugccgcccggccaggaguccgagagcgccgaguccgccaagaucgggggcaucaucaccguguuccugaucgcgcucgugcugaccagcacgaucgucacccugaaguggaucggguacaucugccuccggaacucccugcccaaggugcugcgccagggccucgccaagggguggaacgccguggccauccaccggugcagccacaacgcgcugcaguccgagacccccgagcugaagcagagcuccugccucagcuucccguccagcugggacuacaagcgcgccucccugugccccagcgacuga

SEQ ID NO: 31449 - RNA, 564 nt, Artificial Sequence
  derived and/or modified sequence opt1 from IFNB1__Homo_sapiens__NP_002167
augaccaacaagugccugcuccagaucgcccugcugcucugcuucagcaccacggcccuguccaugagcuacaaccugcucggcuuccugcagcgcuccagcaacuuccagugccagaagcugcucuggcagcugaacgggcggcuggaguacugccucaaggaccgcaugaacuucgacauccccgaggagaucaagcagcugcagcaguuccagaaggaggacgcggcccugaccaucuacgagaugcuccagaacaucuucgccaucuuccggcaggacuccagcuccaccggcuggaacgagaccaucguggagaaccugcuggccaacgucuaccaccagaucaaccaccucaagacggugcuggaggagaagcuggagaaggaggacuucacccgcgggaagcucaugagcucccugcaccugaagcgguacuacggccgcauccuccacuaccugaaggccaaggaguacagccacugcgcguggaccaucgugcgggucgagauccugcgcaacuucuacuucaucaaccggcucaccggguaccugcgcaacuga

SEQ ID NO: 31450 - RNA, 627 nt, Artificial Sequence
  derived and/or modified sequence opt1 from IFNE__Homo_sapiens__NP_795372
augaucaucaagcacuucuucggcaccgugcugguccuccuggccagcaccacgaucuucucccuggaccucaagcugaucaucuuccagcagcgccaggugaaccaggagagccugaagcuccugaacaagcugcagacccucuccauccagcagugccugccccaccggaagaacuuccugcucccgcagaagucccugagcccccagcaguaccagaaggggcacacccuggccauccuccacgagaugcugcagcagaucuucagccuguuccgcgcgaacaucucccucgacggcugggaggagaaccacaccgagaaguuccugauccagcugcaccagcagcucgaguaccuggaggcccugauggggcucgaggccgagaagcugagcggcacgcugggguccgacaaccuccggcuccaggugaagauguacuuccgccggauccacgacuaccuggagaaccaggacuacagcacgugcgccugggccaucguccagguggagaucucccgcugccuguucuucguguucagccugaccgagaagcuguccaagcagggccggccccucaacgacaugaagcaggagcugaccaccgaguuccgcagcccccgguga

SEQ ID NO: 31451 - RNA, 501 nt, Artificial Sequence
  derived and/or modified sequence opt1 from IFNG__Homo_sapiens__NP_000610
augaaguacaccagcuacauccucgccuuccagcucugcaucgugcugggcucccuggggugcuacugccaggaccccuacgucaaggaggccgagaaccucaagaaguacuucaacgcgggccacagcgacguggccgacaacgggacccuguuccugggcauccucaagaacuggaaggaggaguccgaccgcaagaucaugcagagccagaucguguccuucuacuucaagcuguucaagaacuucaaggacgaccagagcauccagaaguccgucgagacgaucaaggaggacaugaacgugaaguucuucaacagcaacaagaagaagcgggacgacuucgagaagcugaccaacuacuccgugaccgaccucaacguccagcgcaaggccauccacgagcugauccaggugauggccgagcugagcccggccgcgaagaccgggaagcggaagcgcucccagaugcuguuccggggccgccgggccagccaguga

SEQ ID NO: 31452 - RNA, 1470 nt, Artificial Sequence
  derived and/or modified sequence opt1 from IFNGR1__Homo_sapiens__NP_000407
auggcccuccuguuccugcugccccucgugaugcagggcgucagccgcgccgagauggggaccgcggaccugggcccguccagcgugcccacccccacgaacgugaccaucgaguccuacaacaugaaccccaucgucuacugggaguaccagaucaugccccaggugcccguguucaccgucgaggugaagaacuacggggugaagaacagcgaguggaucgacgccugcaucaacaucucccaccacuacugcaacaucagcgaccacgucggcgaccccuccaacagccugugggugcgggugaaggcccgcgucgggcagaaggaguccgccuacgccaagagcgaggaguucgcggugugccgggacggcaagaucgggcccccgaagcucgacauccgcaaggaggagaagcagaucaugaucgacaucuuccaccccuccguguucgucaacggcgacgagcaggagguggacuacgaccccgagaccacgugcuacauccggguguacaacgucuacgugcgcaugaacggcagcgagauccaguacaagauccugacccagaaggaggacgacugcgacgagauccagugccagcuggccauccccguguccagccucaacucccaguacugcgucagcgccgagggggugcugcacguguggggcgucaccaccgagaaguccaaggaggugugcaucacgaucuucaacagcuccaucaaggggagccuguggaucccggucguggccgcgcuccugcuguuccucgugcugagccuggucuucaucugcuucuacaucaagaagaucaacccccucaaggagaaguccaucauccugcccaagagccugaucuccguggugcggagcgccacccucgagaccaagcccgaguccaaguacgucagccugaucaccuccuaccagccguucagccuggagaaggagguggugugcgaggagccccucucccccgccacgguccccggcaugcacaccgaggacaacccgggcaagguggagcacaccgaggagcugagcuccaucaccgagguggucacgaccgaggagaacauccccgacguggugcccgggagccaccugacccccaucgagcgcgaguccagcuccccgcucagcuccaaccagagcgagcccggcuccaucgcccugaacagcuaccacagccggaacugcuccgagagcgaccacucccgcaacggguucgacaccgacagcuccugccuggagagccacuccagccucuccgacagcgaguucccgcccaacaacaagggcgagaucaagacggagggccaggagcugaucaccgucaucaaggccccgaccuccuucggguacgacaagccccacgugcugguggaccuccuggucgacgacagcggcaaggagucccugaucggguaccggcccaccgaggacagcaaggaguucuccuga

SEQ ID NO: 31453 - RNA, 1014 nt, Artificial Sequence
  derived and/or modified sequence opt1 from IFNGR2__Homo_sapiens__NP_005525
augcgccccacccugcucuggagccugcugcuccugcugggcguguucgccgccgcggccgccgccccgcccgacccccucucccagcugcccgccccgcagcaccccaagauccggcuguacaacgcggagcagguccucagcugggagcccguggcccuguccaacagcacccgccccguggucuaccaggugcaguucaaguacacggacuccaagugguucaccgccgacaucaugagcaucggggugaacugcacccagaucaccgccacggagugcgacuucaccgcggccuccccgagcgccggcuuccccauggacuucaacgucacccugcggcuccgcgccgagcugggggcccugcacuccgcgugggugaccaugcccugguuccagcacuaccggaacgugacggucgggcccccggagaacaucgaggugacccccggcgagggcagccucaucauccgcuucuccagccccuucgacaucgccgacaccuccaccgccuucuucugcuacuacgugcacuacugggagaagggcgggauccagcaggucaagggccccuuccggagcaacuccaucagccuggacaaccugaagccgucccgcguguacugccuccaggugcaggcccagcugcuguggaacaagagcaacaucuuccgggucgggcaccucuccaacaucagcugcuacgagacgauggccgacgcgagcaccgagcugcagcaggucauccugaucuccgugggcaccuucagccuccuguccgugcuggccggggccugcuucuuccucgugcugaaguaccgcggccugaucaaguacugguuccacaccccgcccagcaucccccuccagaucgaggaguaccugaaggaccccacgcagcccauccuggaggcccucgacaaggacuccagccccaaggacgacgugugggacuccgucagcaucaucuccuuccccgagaaggagcaggaggacgugcugcagacccuguga

SEQ ID NO: 31454 - RNA, 624 nt, Artificial Sequence
  derived and/or modified sequence opt1 from IFNK__Homo_sapiens__NP_064509
augagcaccaagcccgacaugauccagaagugccuguggcucgagauccugaugggcaucuucaucgccgggacccugucccucgacugcaaccugcugaacgugcaccuccgccgggucacguggcagaaccugcgccaccugagcuccaugagcaacuccuucccgguggagugccuccgggagaacaucgccuucgagcugccccaggaguuccugcaguacacccagcccaugaagcgcgacaucaagaaggcguucuacgagaugagccuccaggccuucaacaucuucucccagcacaccuucaaguacuggaaggagcggcaccugaagcagauccagaucggccuggaccagcaggccgaguaccucaaccagugccuggaggaggacaagaacgagaacgaggacaugaaggagaugaaggagaacgagaugaagcccagcgaggcccgcgugccgcagcuguccagccucgagcugcggcgcuacuuccaccggaucgacaacuuccugaaggagaagaaguacuccgacugcgccugggagaucguccgcguggagauccggcgcugccucuacuacuucuacaaguucaccgcgcuguuccggcgcaaguga

SEQ ID NO: 31455 - RNA, 603 nt, Artificial Sequence
  derived and/or modified sequence opt1 from IFNL1__Homo_sapiens__NP_742152
auggccgccgcguggaccgugguccuggugacccucgugcugggccuggccgucgccgggcccgugccgacgagcaagcccaccaccaccggcaaggggugccacaucggccgcuucaagucccucagcccccaggagcuggccuccuucaagaaggcccgggacgcgcuggaggagagccucaagcugaagaacugguccugcagcucccccguguucccggggaacugggaccugcgccuccugcagguccgggagcgccccguggcccuggaggccgagcucgcccugacgcugaaggugcucgaggcggccgccggccccgcccuggaggacguccuggaccagccccuccacacccugcaccacauccugagccagcuccaggccugcauccagccgcagcccaccgcgggcccccggccccgcgggcggcugcaccacuggcugcaccgccuccaggaggccccgaagaaggaguccgccggcugccuggaggccagcgugaccuucaaccuguuccggcuccugacgcgcgaccugaaguacguggccgacgggaaccucugccugcggaccuccacccaccccgagagcaccuga

SEQ ID NO: 31456 - RNA, 603 nt, Artificial Sequence
  derived and/or modified sequence opt1 from IFNL2__Homo_sapiens__XP_011525058
augaagcuggacaugaccggcgacugcacccccgugcucguccugauggccgccgugcugacggugaccggggcggucccgguggcccgccuccacggcgcccugcccgacgcccgggggugccacaucgcccaguucaagagccugagcccccaggagcuccaggcguucaagcgcgccaaggacgcccuggaggagucccugcuccugaaggacugccggugccacucccgccuguucccccggaccugggaccuccgccagcuccaggugcgggagcgcccgauggcccuggaggcggagcuggcccugacccugaagguccucgaggccacggccgacaccgaccccgcccugguggacgugcuggaccagccccuccacacccugcaccacauccugagccaguuccgggcgugcauccagccccagccgaccgccggcccccgcacgcgggggcgccuccaccacuggcuguaccggcugcaggaggcccccaagaaggagucccccggcugccucgaggccagcgucaccuucaaccuguuccgccugcucacccgggaccugaacugcguggccuccggcgaccugugcguguga

SEQ ID NO: 31457 - RNA, 591 nt, Artificial Sequence
  derived and/or modified sequence opt1 from IFNL3__Homo_sapiens__NP_742151
augaccggcgacugcaugcccgugcugguccucauggccgccgugcugaccgugacgggggcggucccgguggcccgccugcggggcgcccuccccgacgcccgcgggugccacaucgcccaguucaagagccugagcccccaggagcugcaggcguucaagcgggccaaggacgcccucgaggagucccugcugcucaaggacugcaagugccgcucccggcuguucccccgcaccugggaccugcggcagcuccaggugcgcgagcggccggucgcccuggaggcggagcuggcccucacccugaaggugcuggaggccaccgccgacacggaccccgcccucggcgacgugcuggaccagccccugcacacccuccaccacauccugagccagcugcgcgcgugcauccagccccagccgaccgccgggccccggacccgcggccggcuccaccacuggcugcaccgccugcaggaggcccccaagaaggagucccccggcugccucgaggccagcgucacguucaaccuguuccggcugcucacccgcgaccugaacugcguggccuccggggaccugugcguguga

SEQ ID NO: 31458 - RNA, 588 nt, Artificial Sequence
  derived and/or modified sequence opt1 from IFNW1__Homo_sapiens__NP_002168
auggcccuccuguucccccugcuggccgcgcucgugaugaccagcuacuccccggucggcagccuggggugcgaccugccccagaaccacggccuccugucccgcaacacccuggugcuccugcaccagaugcggcgcaucagccccuuccugugccucaaggaccggcgcgacuuccgguucccccaggagauggugaaggggucccagcugcagaaggcccacgucaugagcgugcugcacgagaugcuccagcagaucuucucccuguuccacacggagcgcagcuccgccgccuggaacaugacccugcucgaccagcugcacaccggccugcaccagcagcuccagcaccuggagaccugccugcuccagguggucggggagggcgagagcgccggcgcgaucuccagcccggcccugacgcugcggcgcuacuuccaggggauccggguguaccucaaggagaagaaguacuccgacugcgccugggaggugguccgcauggagaucaugaagucccuguuccugagcaccaacaugcaggagcggcuccgcagcaaggaccgggaccugggcuccagcuga

SEQ ID NO: 31459 - RNA, 1356 nt, Artificial Sequence
  derived and/or modified sequence opt1 from IFRD1__Homo_sapiens__NP_001007246
augcccaagaacaagaagcgcaacaccccgcaccggggcagcuccgccggcggcgggggcagcggggccgcggccgccaccgccgccacggcgggcggccagcaccgcaacgugcagcccuucuccgacgaggacgccagcaucgagaccaugucccacugcagcggguacuccgaccccagcuccuucgccgaggacggccccgagguccuggacgaggaggggacccaggaggaccucgaguacaagcugaagggccugaucgaccucacccuggacaagagcgccaagacgcggcaggcggcccuggaggggaucaagaacgcccucgccuccaagaugcuguacgaguucauccuggagcgccggaugacccucaccgacagcaucgagcgcugccugaagaagggcaaguccgacgagcagcgggccgcggccgcccuggccagcgugcucugcauccagcugggcccggggaucgaguccgaggagauccugaagacccucggccccauccugaagaagaucaucugcgacgggagcgccuccaugcaggcgcgccagacgugcgcgaccugcuucggcgugugcugcuucaucgccaccgacgacaucaccgagcuguacagcacgcucgagugccuggagaacaucuucaccaaguccuaccugaaggagaaggacaccaccgucaucugcagcacgcccaacaccgugcuccacaucagcucccugcuggccuggacccuccugcugaccaucugccccaucaacgaggugaagaagaagcucgagaugcacuuccacaagcugccgagccugcucuccugcgacgacgucaacaugcggaucgccgccggcgagagccuggcccugcuguucgagcuggcccgcgggaucgaguccgacuucuucuacgaggacauggagagccugacgcagaugcuccgggcccuggccaccgacggcaacaagcaccgcgcgaagguggacaagcggaagcagcgcuccguguuccgggacguccugcgcgccguggaggagcgggacuuccccaccgagaccaucaaguucgggcccgagcgcauguacaucgacugcugggugaagaagcacacguacgacaccuucaaggagguccucggcagcgggaugcaguaccaccuccaguccaacgaguuccugcggaacguguucgagcucgggcccccggugaugcuggacgccgccacccugaagaccaugaagaucagccgcuucgagcggcaccucuacaacuccgcggccuucaaggcccgcacgaaggcccgcagcaagugccgggacaagcgcgccgacgucggcgaguucuucuga

SEQ ID NO: 31460 - RNA, 3099 nt, Artificial Sequence
  derived and/or modified sequence opt1 from IFT122__Homo_sapiens__NP_001267475
auguucaacggcaucaucagcauccgcaacaagaacggggaggagaaggugaagaucgagcggcccggcgggucccugagcccgaucugguccaucugcuggaaccccagccgcgaggagcggaacgacauccucgccgucgccgacuggggccagaagguguccuucuaccagcugagcgggaagcagaucggcaaggaccgcgcgcugaacuucgaccccugcugcaucuccuacuucaccaagggcgaguacauccuccucgggggcagcgacaagcaggucucccuguucaccaaggacggggugcggcucggcacggugggggagcagaacagcuggguguggaccugccaggccaagcccgacuccaacuacgucguggugggcugccaggacggcaccaucagcuucuaccagcugaucuucuccaccguccacgggcuguacaaggaccgcuacgccuaccgggacagcaugacggacgugaucgugcagcaccucaucaccgagcagaagguccgcaucaagugcaaggagcuggugaagaagaucgccaucuaccggaaccgccuggccauccagcucccggagaagauccugaucuacgagcuguacuccgaggaccucagcgacaugcacuaccgggugaaggagaagaucaucaagaaguucgagugcaaccugcuggucgugugcgcgaaccacaucauccucugccaggagaagcgccugcagugccuguccuucagcggcgugaaggagcgggaguggcagauggagucccucauccgcuacaucaaggucaucgggggcccgcccggccgggaggggcugcuggugggccucaagaacgggcagauccugaagaucuucguggacaaccuguucgccaucguccuccugaagcaggccaccgccgugcgcugccuggacaugagcgcgagccggaagaagcucgccguggucgacgagaacgacacgugccugguguacgacaucgacaccaaggagcuccuguuccaggagcccaacgccaacuccgucgccuggaacacccagugcgaggacaugcugugcuucagcggcgggggcuaccugaacaucaaggccuccaccuuccccgugcaccgccagaagcuccagggcuucguggucggguacaacggcagcaagaucuucugccugcacguguucuccaucagcgcgguggaggucccccaguccgcccccauguaccaguaccuggaccggaagcuguucaaggaggccuaccagaucgccugccugggggugaccgacacggacuggcgcgagcuggccauggaggcgcucgagggccuggacuucgagaccgccaagaaggccuucauccgggugcaggaccugcgcuaccucgagcugaucagcuccaucgaggagcgcaagaagcgcggggagaccaacaacgaccuguuccucgccgacgucuucagcuaccagggcaaguuccacgaggccgcgaagcuguacaagcgguccggccacgagaaccuggcccuggagauguacaccgaccucugcauguucgaguacgccaaggacuuccuggggagcggcgaccccaaggagacgaagaugcugaucaccaagcaggccgacugggcccggaacaucaaggagccgaaggcggccguggagauguacaucuccgccggggagcacgugaaggccaucgagaucugcggcgaccacgggugggucgacaugcucaucgacaucgcgcgcaagcuggacaaggccgagcgggagccccugcuccugugcgccaccuaccugaagaagcucgacagccccggcuacgccgccgagaccuaccugaagaugggcgaccugaagucccucgugcagcugcacguggagacgcagcgcugggacgaggcguucgcccugggggagaagcaccccgaguucaaggacgacaucuacaugccguacgcccaguggcucgccgagaacgaccgguucgaggaggcccagaaggcguuccacaaggccggccgccagcgggaggccguccaggugcuggagcagcugaccaacaacgccguggccgagagccgcuucaacgacgcggccuacuacuacuggaugcucuccaugcagugccuggacaucgcccaggaccccgcccagaaggacaccaugcuggggaaguucuaccacuuccagcggcucgcggagcuguaccacggcuaccacgccauccaccgccacaccgaggaccccuucagcguccaccggcccgagacgcuguucaacaucucccgcuuccuccugcacagccugccgaaggacacccccagcggcaucuccaaggugaagauccucuucacccuggccaagcagagcaaggcccugggggccuaccggcucgcgcgccacgccuacgacaagcugcggggccuguacauccccgcccgcuuccagaaguccaucgagcucgggacccugacgauccgggccaagcccuuccacgacagcgaggagcuggugccgcucugcuaccgcugcuccaccaacaacccccugcugaacaaccucggcaacgucugcaucaacugccgccagcccuucaucuucagcgccuccagcuacgacgugcugcaccugguggaguucuaccucgaggaggggaucaccgacgaggaggcgaucucccugaucgaccuggagguccuccggcccaagcgcgacgaccggcagcuggagaucgccaacaacagcucccagauccugcgccucguggagaccaaggacagcaucggcgacgaggacccguucacggccaagcuguccuucgagcagggcgggagcgaguucgugcccgucguggugucccggcugguccuccgcagcaugucccggcgcgacgugcugaucaagcgguggcccccgccccugcgcuggcaguacuuccggagccuccugcccgacgccagcaucaccaugugccccuccugcuuccagauguuccacagcgaggacuacgagcugcucgugcugcagcacggcugcugcccguacugccgccggugcaaggacgaccccgggcccuga

SEQ ID NO: 31461 - RNA, 4389 nt, Artificial Sequence
  derived and/or modified sequence opt1 from IFT140__Homo_sapiens__NP_055529
auggcccuguacuacgaccaccagaucgaggcccccgacgcggccggcagcccguccuucaucagcuggcaccccgugcaccccuuccucgccgucgccuacaucuccaccaccagcacgggguccguggacaucuaccuggagcagggcgagugcgugcccgacacccacgucgagcgcccguuccggguggccagccugugcuggcaccccacccgccucgugcuggcggucgggugggagaccggcgaggugacgguguucaacaagcaggacaaggagcagcacaccaugccccugacccacaccgccgacaucacgguccuccgguggucccccagcgggaacugccugcuguccggcgaccgccucggcgugcugcugcucuggcggcuggaccagcgcgggcgggugcagggcaccccgcugcucaagcacgaguacgggaagcaccugacccacugcaucuuccgccugcccccgcccggcgaggaccucguccagcuggccaaggccgcggugagcggggacgagaaggcccuggacauguucaacuggaagaaguccagcuccggcagccuccugaagaugggcucccacgaggggcugcuguucuucgugagccugauggacggcaccguccacuacguggacgagaaggggaagacgacccagguggucuccgccgacagcaccauccagaugcuguucuacauggagaagcgggaggcccucgugguggucaccgagaaccugcgccugucccucuacacggugccgcccgagggcaaggccgaggaggugaugaaggucaagcugagcggcaagaccgggcggcgcgcggacaucgcccugaucgagggcagccuccuggugauggccgucggggaggccgcccugcgguucugggacaucgagcgcggcgagaacuacauccucucccccgacgagaaguucggguucgagaagggcgagaacaugaacugcgugugcuacugcaaggugaagggccugcuggcggccgggaccgaccggggccgcgucgccauguggcggaaggugcccgacuuccucgggagccccggcgccgaggggaaggaccgcugggcccugcagacccccacggagcugcagggcaacaucacccagauccaguggggcucccggaagaaccuccuggcggugaacagcgucaucuccguggccauccugagcgagcgcgccauguccagccacuuccaccagcaggucgccgccaugcaggucucccccagccuccugaacgugugcuuccuguccaccgggguggcgcacagccuccggaccgacaugcacaucuccggcguguucgccacgaaggacgccguggccguguggaacgggcgccaggucgcgaucuucgagcugagcggcgccgccauccgcuccgccgggaccuuccugugcgagacccccgugcuggccaugcacgaggagaacguguacaccgucgagagcaaccggguccaggugcgcacguggcagggcaccgugaagcagcuccugcuguucuccgagaccgagggcaacccgugcuuccucgacaucugcgggaacuuccugguggugggcaccgaccuggcgcacuucaagagcuucgaccucucccggcgcgaggccaaggcccacugcagcugccggagccuggccgagcugguccccggggugggcggcaucgccucccuccgcugcagcuccagcggguccacgaucagcauccugcccuccaaggcggacaacagccccgacuccaagaucugcuucuacgacguggagauggacaccgucaccguguucgacuucaagaccggccagaucgaccggcgcgagacgcugagcuucaacgagcaggagaccaacaagucccaccucuucguggacgaggggcugaagaacuacgucccggugaaccacuucugggaccagagcgagccccggcuguucgugugcgaggccguccaggagacgccccgcucccagccccagagcgccaacggccagccgcaggacgggcgggccggccccgccgcggacgugcucauccuguccuucuucaucagcgaggagcacggcuuccugcuccacgaguccuucccccgcccggccaccagccacagccugcuggggauggaggugcccuacuacuacuucacccggaagcccgaggaggccgaccgcgaggacgaggucgagcccggcugccaccacaucccgcagauggugucccggcgcccccuccgggacuucguggggcuggaggacugcgacaaggccacccgcgacgcgaugcugcacuucagcuucuucgucaccaucggcgacauggacgaggccuucaaguccaucaagcucaucaagagcgaggccgugugggagaacauggcccggaugugcgugaagacccagcgccuggacgucgccaaggugugccuggggaacaugggccacgcgcgcggcgcccgggcccuccgcgaggccgagcaggagcccgagcuggaggcccggguggcgguccuggccacccagcucgggaugcuggaggacgccgagcagcuguaccgcaagugcaagcggcacgaccuccugaacaaguucuaccaggccgccggccgcuggcaggaggcgcuccagguggccgagcaccacgaccgggugcaccuccgcuccacguaccaccgguacgccgggcaccuggaggccagcgcggacugcucccgcgcccugagcuacuacgagaaguccgacacccaccgguucgaggucccccgcaugcucagcgaggaccugccgucccuggagcucuacgugaacaagaugaaggacaagacccuguggcgguggugggcccaguaccuggagagccagggcgagauggacgccgcccuccacuacuacgagcuggcgcgcgaccacuucucccuggugcggauccacugcuuccaggggaacguccagaaggccgcccagaucgccaacgagaccggcaaccucgccgcgagcuaccaccuggcccgccaguacgagucccaggaggaggugggccaggccguccacuucuacacgcgggcccaggccuucaagaacgcgauccgccugugcaaggagaacgggcucgacgaccagcugaugaaccuggcccuccugagcucccccgaggacaugaucgaggccgcccgguacuacgaggagaagggcgugcagauggaccgcgccgugaugcuguaccacaaggcggggcacuucagcaaggcccucgagcuggccuucgccacccagcaguucgucgcgcugcagcucaucgccgaggaccuggacgagaccuccgaccccgcccugcucgcccggugcagcgacuucuucaucgagcacagccaguacgagcgcgccguggagcugcugcucgcggcccgcaaguaccaggaggcccugcagcugugccucggccagaacauguccaucaccgaggagauggccgagaagaugacgguggccaaggacagcuccgaccugcccgaggagagccggcgcgagcugcucgagcagaucgcggacugcugcaugcggcagggguccuaccaccuggccaccaagaaguacacccaggccggcaacaagcugaaggccaugcgcgcccuccucaagagcggcgacaccgagaagaucacguucuucgcguccgucagccggcagaaggagaucuacaucauggccgccaacuaccugcagucccuggacuggcgcaaggagccggagaucaugaagaacaucaucggguucuacaccaagggccgggcccuggaccugcucgcgggguucuacgacgccugcgcccagguggagaucgacgaguaccagaacuacgacaaggcccacggcgcccugaccgaggcguacaagugccuggccaaggccaaggccaagagcccccucgaccaggagacccgccuggcccagcugcagucccggauggcgcucgugaagcgcuucauccaggcccggcgcacguacaccgaggaccccaaggagagcaucaagcagugcgagcugcugcucgaggagcccgaccuggacuccaccauccggaucggcgacgucuacggguuccugguggagcacuacgugcgcaaggaggaguaccagaccgccuaccgguuccucgaggagaugcgccggcgccugccgcuggccaacaugagcuacuacgucagcccccaggccguggacgcggugcaccggggccuggggcucccccugccccgcacggucccggagcagguccgccacaacuccauggaggacgcccgggagcuggacgaggaggugguggaggaggccgacgacgaccccuga

SEQ ID NO: 31462 - RNA, 5250 nt, Artificial Sequence
  derived and/or modified sequence opt1 from IFT172__Homo_sapiens__NP_056477
augcaccugaagcaccuccggacccugcugagcccccaggacggcgccgccaaggugaccugcauggcguggucccagaacaacgccaaguucgccgugugcacgguggaccgggugguccugcuguacgacgagcacggggagcggcgggacaaguucagcaccaagccggccgacaugaaguacggccgcaaguccuacauggugaaggggauggccuucagccccgacuccaccaagaucgcgaucggccagaccgacaacaucaucuacguguacaagaucggggaggacuggggcgacaagaaggucaucugcaacaaguucauccagacgagcgccgugaccugccugcaguggcccgccgaguacaucaucguguucggccuggccgaggggaagguccggcuggcgaacaccaagaccaacaaguccagcacgaucuacggcaccgaguccuacguggugagccugaccaccaacugcuccgggaagggcauccucagcgggcacgccgacggcacgaucguccgcuacuucuucgacgacgagggcuccggggagagccagggcaagcuggugaaccaccccugcccgcccuacgcccuggccugggccaccaacuccaucguggcggccgggugcgaccggaagaucgucgccuacggcaaggagggccacaugcuccagaccuucgacuacagccgcgacccccaggagcgggaguucaccacggccguguccagccccgggggccaguccgugguccuggggagcuacgaccgccugcggguguucaacuggaucccgcgccggagcaucugggaggaggccaagcccaaggagaucaccaaccucuacaccaucaccgcgcuggccuggaagcgcgacggcucccggcugugcguggggacgcucugcggcggcgucgagcaguucgacugcugccugcgccggagcaucuacaagaacaaguucgagcugaccuacguggggcccucccaggugaucgucaagaaccucagcuccggcacccgcgugguccucaagagccacuacggguacgagguggaggaggugaagauccugggcaaggagcgguaccucgucgcccacaccuccgagacgcugcugcucggggaccugaacaccaaccgccugagcgagaucgccuggcagggcuccggcgggaacgagaaguacuucuucgagaacgagaacgugugcaugaucuucaacgccggcgagcucacccugguggaguacgggaacaacgacacccugggcagcguccggacggaguucaugaacccccaccucaucuccgugcgcaucaacgagcgcugccagcgggggaccgaggacaacaagaagcuggcguaccugaucgacaucaagaccaucgccaucguggaccucaucggcggcuacaacaucgggaccgucagccacgagucccgcguggacuggcuggagcugaacgagacgggccacaagcuccuguuccgggaccgcaagcugcggcuccaccuguacgacaucgagagcugcuccaagaccaugauccugaacuucugcagcuacaugcagugggugccgggguccgacguccucguggcccagaaccgcaacagccugugcgugugguacaacaucgaggcccccgagcgggucaccauguucaccauccgcggcgacgugaucggccuggagcgcgggggcgggaagacggaggugauggucauggagggcgugaccaccguggccuacacccucgacgaggggcugaucgaguucggcaccgcgaucgacgacggcaacuacauccgcgccacggccuuccuggagacccuggagaugacccccgagaccgaggccauguggaagacgcucuccaagcuggcgcuggaggcccggcagcuccacaucgccgagcgcugcuucagcgcccuggggcaggucgccaaggcgcgguuccugcacgagaccaacgagaucgccgaccaggugagccgcgaguacggcggggagggcaccgacuucuaccaggugcgggcccgccucgccaugcuggagaagaacuacaagcuggccgagaugaucuuccucgagcagaacgcggucgaggaggccauggggauguaccaggagcugcaccggugggacgagugcaucgccguggccgaggccaagggccaccccgcgcuggagaagcuccgccgguccuacuaccaguggcugauggacacccagcaggaggagcgcgccggcgagcugcaggagagccagggggacggccucgccgccaucucccuguaccugaaggcggggcucccggccaaggccgcccgccuggugcugacgcgggaggagcuccuggccaacaccgagcuggucgagcacaucaccgcggcccucaucaagggcgagcuguacgagcgcgccggggaccuguucgagaagauccacaacccccagaaggcccucgagugcuaccggaagggcaacgccuucaugaaggcgguggagcuggcccgccuggccuuccccguggaggucgugaagcucgaggaggccuggggcgaccaccuggugcagcagaagcagcuggacgccgcgaucaaccacuacaucgaggcccggugcagcaucaaggccaucgaggccgcgcucggggcccgccaguggaagaaggccaucuacauccuggaccugcaggaccggaacaccgccuccaaguacuacccccucgucgcccagcacuacgcgagccugcaggaguacgagaucgccgaggagcuguacacgaagggcgaccgcaccaaggacgccaucgacauguacacccaggccgggcggugggagcaggcccacaagcucgcgaugaagugcaugcgcccggaggacguguccgugcuguacaucacccaggcccaggagauggagaagcagggcaaguaccgggaggccgagcgccuguacgucacggugcaggagcccgaccucgccaucaccauguacaagaagcacaagcuguacgacgacaugauccggcugguggggaagcaccaccccgaccuccugagcgacacccaccuccaccucggcaaggagcuggaggccgagggccgccugcaggaggcggaguaccacuaccucgaggcccaggaguggaaggccaccgucaacauguaccgggccuccgggcugugggaggaggccuaccgcguggcgcggacgcagggcggggccaacgcccacaagcacguggccuaccugugggccaagagccucggcggcgaggccgccguccgccugcugaacaagcucgggcugcuggaggccgccguggaccacgcggccgacaacugcuccuucgaguucgccuucgagcucagccggcuggcccugaagcacaagacccccgaggugcaccucaaguacgccauguuccuggaggacgagggcaaguucgaggaggcggaggccgaguucauccgcgccgggaagccgaaggaggccguccugauguucgugcacaaccaggacugggaggccgcgcagcggguggccgaggcccacgaccccgacuccgucgccgaggugcucgugggccaggcgcgcggggcccuggaggagaaggacuuccagaaggccgagggccugcuccugcgcgcccagcggcccggccuggcccucaacuacuacaaggaggcggggcuguggagcgacgcccugcgcaucugcaaggacuacguccccucccagcucgaggcccugcaggaggaguacgagcgggaggccaccaagaagggcgcccgcgggguggagggcuucgucgagcaggcgcggcacugggagcaggccggggaguacagccgcgccguggacugcuaccugaaggugcgggacuccggcaacagcggccucgccgagaagugcuggaugaaggccgcggagcugagcaucaaguuccugccgccccagcgcaacauggaggucgugcucgccguggggccccagcugaucggcaucgggaagcacuccgccgccgcggagcuguaccucaaccuggaccuggucaaggaggccaucgacgccuucaucgagggcgaggaguggaacaaggccaagcggguggccaaggagcucgacccgcgcuacgaggacuacguggaccagcacuacaaggaguuccugaagaaccaggggaaggucgacagccuggugggcguggacgucaucgcggcccucgaccuguacguggagcagggccagugggacaagugcaucgagaccgccacgaagcagaacuacaagauccugcacaaguacguggcccucuacgccacccaccugauccgggagggguccagcgcgcaggcccuggcccuguacguccagcacggcgcccccgccaacccccagaacuucaacaucuacaagcgcaucuucaccgacaugguguccagccccgggaccaacugcgcggaggccuaccacuccugggccgaccuccgggacgugcuguucaaccugugcgagaaccucgucaagagcuccgaggccaacagcccggcccacgaggaguucaagacgaugcugcugaucgcgcacuacuacgccacccgcuccgccgcccagagcgugaagcagcucgagaccguggcggcccggcuguccgucagccugcuccgccacacccagcugcugcccguggacaaggccuucuacgaggccggcaucgccgcgaaggccgugggcugggacaacauggccuucaucuuccucaaccgguuccuggaccugacggacgccaucgaggaggggacccucgacggccuggaccacuccgacuuccaggacaccgacauccccuucgaggucccccugccggccaagcagcacgugcccgaggcggagcgcgaggaggugcgggacuggguccucaccgugagcauggaccagcgccuggagcagguccugccccgcgacgagcgcggggcguacgaggccucccucgucgccgccagcacgggcgugcgcgcgcugcccugccugaucaccggguacccgauccuccggaacaagaucgaguucaagcgccccggcaaggccgccaacaaggacaacuggaacaaguuccugauggccaucaagaccucccacagccccgugugccaggacguccugaaguucaucagccaguggugcggcgggcuccccuccaccagcuucuccuuccaguga

SEQ ID NO: 31463 - RNA, 561 nt, Artificial Sequence
  derived and/or modified sequence opt1 from IFT27__Homo_sapiens__NP_001171172
auggugaagcuggccgccaagugcauccucgcgggcgaccccgccgucgggaagaccgcccuggcccagaucuuccgcagcgacggcgcccacuuccagaaguccuacacccugacgaccgggauggaccucguggugaagaccgucccggugcccgacaccggcgacagcguggagcuguucaucuucgacuccgcggggaaggagcuguucagcgagaugcucgacaagcugugggagucccccaacguccugugccucguguacgacgugacgaacgaggagagcuucaacaacugcuccaaguggcuggagaaggcccggagccaggcccccggcaucucccugccgggcguccucguggggaacaagaccgaccuggccggccgccgggcgguggacagcgccgaggcccgcgccugggcccuggggcagggccucgagugcuucgagaccuccgucaaggagauggagaacuucgaggcgcccuuccacugccuggccaagcaguuccaccagcuguaccgggagaagguggagguguuccgcgcccucgccuga

SEQ ID NO: 31464 - RNA, 627 nt, Artificial Sequence
  derived and/or modified sequence opt1 from IFT43__Homo_sapiens__NP_001096034
auggaggaccugcucgaccuggacgaggagcugcgcuacagccucgccaccucccgggccaagaugggccgccgggcgcagcaggagagcgcccaggccgagaaccaccugaacgggaagaacuccagccugacccucacgggcgagaccuccagcgccaagcugccccgcugccggcagggcgggugggccggggacuccgugaaggcgagcaaguuccgccggaaggccuccgaggagaucgaggacuuccgccugcggccgcagagccucaacggcuccgacuacggcggggacauccccaucauccccgaccuggaggagguccaggaggaggacuucgugcuccagguggccgcgcccccgagcauccagaucaagcgcgucaugaccuaccgggaccuggacaacgaccugaugaaguacuccgccauccagacccuggacggcgagaucgaccucaagcugcugacgaaggugcucgcccccgagcacgaggugcgcgaggacgacgucgggugggacugggaccaccuguucaccgaggugagcuccgaggugcugaccgagugggacccccuccagaccgagaaggaggaccccgccggccaggcccggcacacguga

SEQ ID NO: 31465 - RNA, 1290 nt, Artificial Sequence
  derived and/or modified sequence opt1 from IFT57__Homo_sapiens__NP_060480
augaccgccgcccuggcgguggucaccacgagcggccucgaggacggggugccccgcucccggggcgaggggaccggcgaggugguccuggagcgcgggccgggcgccgccuaccacauguucguggugauggaggaccuggucgagaagcucaagcugcugcgguacgaggaggaguuccuccgcaagagcaaccugaaggcccccucccggcacuacuucgcccugcccaccaaccccggcgagcaguucuacauguucugcacccucgcggccuggcugaucaacaaggccgggcgcccguucgagcagccccaggaguacgacgaccccaacgccacgaucagcaacauccuguccgagcuccggagcuucggccgcaccgcggacuucccgcccuccaagcucaagagcggguacggcgagcacgugugcuacgugcuggacugcuucgccgaggaggcccugaaguacaucggguucaccuggaagcggcccaucuaccccgucgaggagcuggaggaggaguccguggccgaggacgacgccgagcugacccucaacaagguggacgaggaguucgucgaggaggagacggacaacgaggagaacuucaucgaccugaacgugcugaaggcgcagaccuaccaccucgacaugaacgagaccgccaagcaggaggacauccuggagagcaccacggacgccgccgaguggucccuggagguggagcgcguccucccccagcugaaggugaccauccggaccgacaacaaggacuggcgcauccacguggaccagaugcaccagcaccggagcggcaucgaguccgcccugaaggagaccaagggcuuccucgacaagcugcacaacgagaucacgcgcacccuggagaagaucagcucccgggagaaguacaucaacaaccagcucgagaaccugguccaggaguaccgcgcggcccaggcccagcugagcgaggccaaggagcgguaccagcaggggaacggcggggugaccgagcgcacccggcuccuguccgaggugauggaggagcuggagaaggucaagcaggagauggaggagaagggcagcuccaugacggacggcgccccgcucgugaagaucaagcagagccugaccaagcugaagcaggagaccguggagauggacauccgcaucgggaucgucgagcacacccuccugcagagcaagcugaaggagaaguccaacaugacgcggaacaugcacgcgaccgugauccccgagcccgccaccggcuucuacuga

SEQ ID NO: 31466 - RNA, 1803 nt, Artificial Sequence
  derived and/or modified sequence opt1 from IFT74__Homo_sapiens__NP_001092693
auggccagcaaccacaaguccagcgccgcgcgccccgugucccggggcggggucggccugaccgggcgcccgcccagcggcauccggccccucuccgggaacauccgcguggccaccgccaugcccccgggcacggcccggcccggcagccgcgggugccccaucggcaccgggggcgugcuguccagccagaucaaggucgcccaccggcccgugacccagcaggggcugaccggcaugaagacgggcaccaaggggccgcagcgccagauccucgacaaguccuacuaccugggccugcuccggagcaagaucuccgagcugaccaccgaggugaacaagcugcagaaggggaucgagauguacaaccaggagaacagcgucuaccucuccuacgagaagcgcgcggagacgcuggccguggagaucaaggagcugcagggccagcucgccgacuacaacaugcugguggacaagcugaacaccaacaccgagauggaggaggucaugaacgacuacaacaugcucaaggcccagaacgaccgggagacccagagccuggacgugaucuucacggagcgccaggcgaaggagaagcagauccgguccguggaggaggagaucgagcaggagaagcaggccaccgacgacaucaucaagaacaugagcuucgagaaccaggucaaguaccuggagaugaagaccaccaacgagaagcuccugcaggagcuggacacgcuccagcagcagcuggacucccagaacaugaagaaggagagccuggaggccgagaucgcccacucccaggugaagcaggaggccgugcuccugcacgagaagcuguacgagcucgagagccaccgcgaccagaugaucgcggaggacaagagcaucggcucccccauggaggagcgggagaagcugcugaagcagaucaaggacgacaaccaggagaucgccagcauggagcgccagcucaccgacaccaaggagaagaucaaccaguucaucgaggagauccggcagcuggacauggaccuggaggagcaccagggggagaugaaccagaaguacaaggagcucaagaagcgcgaggagcacauggacaccuucaucgagacguucgaggagaccaagaaccaggagcugaagcggaaggcccagaucgaggccaacaucgucgcccugcucgagcacugcucccgcaacaucaaccggaucgagcagaucagcuccaucaccaaccaggagcugaagaugaugcaggacgaccugaacuucaagagcaccgaggugcagaagucccagagcacggcgcagaaccucaccuccgacauccagcgccugcagcuggaccuccagaagauggagcugcuggagagcaagaugaccgaggagcagcacucccucaagagcaagaucaagcagaugaccacggaccuggagaucuacaacgaccugcccgcccucaaguccagcggcgaggagaagaucaagaagcugcaccaggagcgcaugauccuguccacccaccggaacgccuucaagaagaucauggagaagcagaacaucgaguacgaggcccugaagacccagcuccaggagaacgagacccacagccagcugacgaaccuggagcgcaaguggcagcaccucgagcagaacaacuucgccaugaaggaguucaucgcgaccaagucccaggagagcgacuaccagcccaucaagaagaacgugaccaagcagaucgccgaguacaacaagaccaucgucgacgcccugcacuccacgagcgggaacuga

SEQ ID NO: 31467 - RNA, 1923 nt, Artificial Sequence
  derived and/or modified sequence opt1 from IFT80__Homo_sapiens__NP_001177171
augcugcgcagcacccucgcccagcagggcacccccguguacuccgucgccugggggccggacagcgagaaggugcuguacacggcgggcaagcagcugaucaucaagccccuccagcccaacgccaaggugcugcaguggaaggcccacgacgggaucauccugaaggucgacuggaacuccgugaacgaccucauccugagcgccggcgaggacugcaaguacaaggugugggacuccuacgggcggccccuguacaacagccagccgcacgagcaccccaucaccuccgucgccugggcgcccgacggcgagcuguucgccgugggcagcuuccacacccuccgccugugcgacaagaccgggugguccuacgcccucgagaagcccaacacgggcagcaucuucaacaucgccugguccaucgacgggacccagaucgcgggcgccugcgggaacggccacguggucuucgcccacgugguggagcagcacugggaguggaagaacuuccaggucacccugaccaagcggcgcgccaugcagguccggaacgugcugaacgacgccguggaccuccuggaguuccgcgaccgggugaucaaggcgagccugaacuacgcccaccucguggucuccacgagccugcagugcuacguguucuccaccaagaacuggaacaccccgaucaucuucgaccugaaggagggcaccgugagccucauccugcaggccgagcgccacuuccugcucgucgacggguccagcaucuaccuguacuccuacgagggccgguucaucagcagccccaaguuccccgggaugcgcacggacauccugaacgcccagaccgugucccucagcaacgacaccaucgccauccgggacaaggcggacgagaagaucaucuuccuguucgaggccuccaccggcaagccccugggcgacgggaaguuccucagccacaagaacgagauccuggagaucgcccuggaccagaagggccucacgaacgaccgcaagaucgccuucaucgacaagaaccgggaccugugcaucaccuccgugaagcgcuucgggaaggaggagcagaucaucaagcugggcaccaugguccacacccucgccuggaacgacacgugcaacauccugugcgggcugcaggacacccgguucaucgugugguacuacccgaacaccgucuacguggaccgcgacauccuccccaagacccuguacgagcgggacgcgagcgaguucuccaagaacccccacaucgugagcuucgucggcaaccaggugacgauccgccgggccgacggcucccuggugcacaucagcaucacccccuacccggccauccuccacgaguacgucuccagcuccaagugggaggacgccgugcgccugugccgguucgugaaggagcagaccaugugggccugccuggcggccauggccgucgccaaccgcgacaugaccacggcggagaucgccuacgccgccaucggggagaucgacaaggugcaguacaucaacagcaucaagaaccuccccuccaaggagagcaagauggcccacauccugcuguucuccggcaacauccaggaggcggagaucgugcuccugcaggccgggcuggucuaccaggccauccagaucaacaucaaccuguacaacugggagcgcgcccucgagcuggccgugaaguacaagacccacguggacaccguccuggcguaccggcagaaguuccucgagaccuucggcaagcaggagacgaacaagcgcuaccugcacuacgccgaggggcugcagaucgacugggagaagaucaaggccaagaucgagauggagaucaccaaggagcgggagcagagcuccagcagccaguccagcaaguccaucggccucaagcccuga

SEQ ID NO: 31468 - RNA, 2646 nt, Artificial Sequence
  derived and/or modified sequence opt1 from IFT88__Homo_sapiens__XP_005266603
augaagguggagagcggcaugaagaucaagguccacaacaacgccgaguccgagaccgccgugggguuccuggagguggaccagggcugccccaucuucggguucccgggcccccaccgcaagaagaacugccucgggccccacaugaaguucaccaacacgaagguccagaugaugcagaacgugcaccuggcgcccgagaccgacgaggacgaccuguacagcggcuacaacgacuacaacccgaucuacgacaucgaggagcucgagaacgacgccgccuuccagcaggccgugcggaccucccacggccgccggccgcccaucaccgccaagaucagcuccacggcggucacccgccccaucgccaccggguacggcagcaagaccucccuggccagcuccaucgggcggcccaugacgggcgccauccaggacggggugacccgccccaugaccgcggugcgggccgccggcuucaccaaggccgcccugcgcggcagcgcguucgacccccucucccagagccgggggcccgccuccccgcuggaggccaagaagaaggacagccccgaggagaagaucaagcagcuggagaaggaggucaacgagcucguggaggaguccugcaucgccaacagcugcggcgaccugaagcuggcccucgagaaggcgaaggacgccgggcgcaaggagcgggugcugguccgccagcgggagcaggucacgacccccgagaacaucaaccuggaccucaccuacuccgugcuguucaaccuggccagccaguacuccgugaacgagauguacgccgaggcccucaacaccuaccaggugaucgugaagaacaagauguucagcaacgcgggcauccugaagaugaacaugggcaacaucuaccugaagcagcgcaacuacagcaaggccaucaaguucuaccggauggcccucgaccagguccccuccgugaacaagcagaugcgcaucaagaucaugcagaacaucggggugacguucauccaggccggccaguacagcgacgccaucaacuccuacgagcacaucaugagcauggcgccgaaccugaaggccggguacaaccugaccaucugcuacuucgccaucggcgaccgggagaagaugaagaaggccuuccagaagcucaucaccgucccccuggagaucgacgaggacaaguacaucucccccagcgacgacccccacaccaaccuggugacggaggcgaucaagaacgaccaccuccgccagauggagcgggagcgcaaggccauggccgagaaguacaucaugaccuccgccaagcugaucgccccggugaucgagaccagcuucgcggccggguacgacuggugcgucgagguggucaaggccucccaguacguggagcuggccaacgaccucgagaucaacaaggccgugaccuaccugcggcagaaggacuacaaccaggcggucgagauccugaaggugcucgagaagaaggacagccgcgugaaguccgccgccgccacgaaccugagcgcccuguacuacaugggcaaggacuucgcgcaggccuccagcuacgccgacaucgccgucaacuccgaccgcuacaaccccgcggcccucaccaacaagggcaacaccguguucgccaacggggacuacgagaaggccgccgaguucuacaaggaggcgcugcggaacgacagcuccugcaccgaggcccuguacaacaucggccucacguacgagaagcugaaccgccuggacgaggcccucgacugcuuccugaagcugcacgccauccuccggaacagcgccgaggugcuguaccagaucgcgaacaucuacgagcugauggagaaccccucccaggccaucgaguggcucaugcaggucgugagcgugauccccaccgacccgcagguccugagcaagcugggggagcuguacgaccgcgagggcgacaagucccaggccuuccaguacuacuacgagagcuaccgguacuuccccugcaacaucgaggugaucgaguggcucggggccuacuacaucgacacccaguucugggagaaggccauccaguacuucgagcgcgcgucccugauccagcccacccaggugaaguggcagcugauggucgccagcugcuuccggcgcuccggcaacuaccagaaggcccucgacacguacaaggacacccaccggaaguuccccgagaacguggagugccugcgcuuccuggugcggcucugcaccgaccugggccugaaggacgcccaggaguacgcgcgcaagcucaagcggcuggagaagaugaaggagauccgcgagcagcggaucaagagcgggcgcgacggcuccgggggcagccgggggaagcgcgagggcuccgccagcggcgacuccgggcagaacuacagcgccuccagcaagggcgagcggcuguccgcccgccuccgcgcccugccggggaccaacgagcccuacgagagcuccagcaacaaggagaucgacgcgagcuacgucgacccccugggcccgcagaucgagcggcccaagacggccgccaagaagcgcaucgacgaggacgacuucgccgacgaggagcucggcgacgaccugcugcccgaguga

SEQ ID NO: 31469 - RNA, 1020 nt, Artificial Sequence
  derived and/or modified sequence opt1 from IGBP1__Homo_sapiens__NP_001542
auggccgccgaggacgagcugcagcucccccgccugccggagcuguucgagaccggccggcagcuccuggacgagguggaggucgcgaccgagcccgccgggagccgcaucgugcaggagaagguguucaagggccuggaccuccuggagaaggccgccgagaugcugucccagcucgaccuguucagccggaacgaggaccuggaggagaucgccuccacggaccucaaguaccugcugguccccgcguuccagggggcccucaccaugaagcaggucaaccccagcaagcgccuggaccaccuccagcgggcccgcgagcacuucaucaacuaccugacccagugccacugcuaccacguggccgaguucgagcugccgaagaccaugaacaacuccgcggagaaccacacggccaacagcuccauggccuaccccagccugguggccauggccucccagcggcaggcgaagauccagcgcuacaagcagaagaaggagcucgagcaccggcugagcgccaugaaguccgccguggagagcggccaggccgacgacgagcgcgugcgggaguacuaccugcuccaccuccagcgcuggaucgacaucucccuggaggagaucgagagcaucgaccaggagaucaagauccugcgggagcgcgacuccagccgggaggccuccaccagcaacuccagccgccaggagcggccgcccgucaagcccuucauccugacccgcaacauggcgcaggccaagguguucggggccggcuaccccagccugcccaccaugacgguguccgacugguacgagcagcaccggaaguacggcgcccuccccgaccaggggaucgccaaggcggccccggaggaguuccgcaaggccgcccagcagcaggaggagcaggaggagaaggaggaggaggacgacgagcagacccugcaccgggcccgcgagugggacgacuggaaggacacccacccccgcggcuacgggaaccggcagaacaugggcuga

SEQ ID NO: 31470 - RNA, 2445 nt, Artificial Sequence
  derived and/or modified sequence opt1 from IGDCC3__Homo_sapiens__NP_004875
auggccgugcagcgcgccgcgagcccccggcgcccgcccgcgccccuguggccccggcuccugcugccgcuccugcugcuccugcugcccgcccccuccgagggccucgggcacagcgccgagcuggccuucgccgucgagcccuccgacgacguggccgugccgggccagcccaucguccuggacugccgcguggaggggaccccgcccgugcggaucaccuggcgcaagaacggcgucgagcuccccgagagcacgcacuccacccugcuggccaacgggagccucaugauccggcacuuccgccuggagcccggcggcucccccagcgacgagggggacuacgagugcguggcccagaaccgguucggccugguggucucccgcaaggcgcggauccaggccgccaccaugagcgacuuccacgugcacccccaggccaccgugggggaggagggcggggucgcccgcuuccagugccagauccacggccucccgaagccccugaucacgugggagaagaaccgggugcccaucgacaccgacaacgagcgcuacacccugcuccccaagggcgugcugcagaucaccgggcugcgggcggaggacggcgggaucuuccacugcgucgccuccaacaucgccagcauccgcaucucccacggcgcccggcucacggugagcggcuccgggagcggcgccuacaaggagccggcgauccugguggggcccgagaaccugacccucaccguccaccagaccgccgugcuggagugcguggccacgggcaacccccgccccaucgucuccuggagccggcuggacgggcgcccgaucggcguggagggcauccaggugcucgggaccggcaaccugaucaucuccgacgucaccgugcagcacagcggggucuacgugugcgccgccaaccggcccggcacccgcgugcgccggacggcgcaggggcgccuggucgugcaggcccccgccgaguucgugcagcacccccagagcaucucccggccggccggcaccaccgccauguucacgugccaggcgcagggcgagcccccgccccacgucaccuggcucaagaacggccaggugcuggggcccgggggccacgugcgccugaagaacaacaacagcacccucaccaucuccgggaucggccccgaggacgaggccaucuaccagugcgucgccgagaacagcgccggcuccagccaggcguccgcccggcugaccgugcugugggccgaggggcuccccggcccgccccgcaacgugcgggccgucagcguguccagcacggaggugcgcgucuccuggagcgagccccuggccaacaccaaggagaucaucggguacgugcugcacauccggaaggcggccgacccgcccgagcucgaguaccaggaggccguguccaagagcaccuuccagcaccuggucuccgaccuggagcccagcaccgccuacuccuucuacaucaaggccuacacgccccgcggcgcgagcuccgccagcgugcccacccucgccagcacccugggcgaggccccggccccgccgccccuguccgugcggguccucgggagcuccagccugcagcugcugugggagcccuggccccgccucgcgcagcacgagggcggguucaagcuguucuaccggcccgccuccaagaccagcuucacgggccccauccugcuccccgggaccguguccagcuacaaccugucccagcuggaccccaccgccguguacgaggucaagcuccuggccuacaaccagcacggcgacggcaacgcgaccgugcgcuucgugagccugcgcggggccuccgagcggacggcccucagcccgcccugcgacugccggaaggaggaggccgccaaccagaccuccaccaccggcaucgucaucgggauccacaucggcgugaccugcaucaucuucugcgugcuguuccuccuguucgggcagcgcggccggguccugcugugcaaggacguggagaaccagcucagcccgccccagggcccccgcucccagcgcgaccccgggauccuggcgcugaacggcgcccggcgcgggcagcggggccagcucgggcgcgacgagaagcggguggacaugaaggagcuggagcagcuguucccgcccgccagcgccgccggccagcccgacccccgccccacgcaggaccccgcggcccccgccccgugcgaggagacccagcucuccguccugccccugcagggcugcgggcucauggagggcaagaccaccgaggccaagacgaccgaggccaccgcgcccugcgccgggcuggccgccgcgcccccgccgcccgacggcgggcccggccugcucagcgagggccaggccagccggcccgccgccgcccgcgugacccagcccgcgcacuccgagcaguga

SEQ ID NO: 31471 - RNA, 462 nt, Artificial Sequence
  derived and/or modified sequence opt1 from IGF1__Homo_sapiens__NP_000609
augggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcauguga

SEQ ID NO: 31472 - RNA, 4104 nt, Artificial Sequence
  derived and/or modified sequence opt1 from IGF1R__Homo_sapiens__NP_000866
augaaguccggcagcgggggcgggagccccaccucccuguggggccuccuguuccugagcgccgcccucucccuguggccgaccagcggggagaucugcggccccggcaucgacauccgcaacgacuaccagcagcugaagcggcucgagaacugcaccgugaucgagggguaccugcacauccugcucaucuccaaggcggaggacuaccgcagcuaccgguuccccaagcugaccgucaucaccgaguaccugcuccuguuccgcguggccggccuggagucccucggggaccuguuccccaaccugaccgugauccggggcuggaagcuguucuacaacuacgcccuggucaucuucgagaugacgaaccugaaggacaucgggcucuacaaccugcgcaacaucacccggggcgccauccgcaucgagaagaacgccgaccugugcuaccucagcaccguggacuggucccugauccuggacgcggugagcaacaacuacaucgucggcaacaagccgcccaaggagugcggggaccucugccccggcaccauggaggagaagcccaugugcgagaagacgaccaucaacaacgaguacaacuaccggugcuggaccaccaaccgcugccagaagaugugcccguccacgugcgggaagcgggccugcaccgagaacaacgagugcugccaccccgagugccugggcagcugcuccgcccccgacaacgacaccgccugcguggcgugccgccacuacuacuacgccggcgugugcguccccgccugcccgcccaacaccuaccgguucgagggguggcgcugcguggaccgggacuucugcgccaacauccugagcgccgaguccagcgacuccgagggcuucgugauccacgacggggagugcaugcaggagugccccagcggcuucauccgcaacgggagccaguccauguacugcauccccugcgagggcccgugccccaaggucugcgaggaggagaagaagacgaagaccaucgacagcgugaccuccgcgcagaugcuccagggcugcaccaucuucaaggggaaccugcugaucaacauccggcgcggcaacaacaucgccagcgagcucgagaacuucauggggcugaucgagguggucacgggcuacgugaagauccggcacucccacgcccuggugagccucuccuuccugaagaaccugcgccucauccugggggaggagcagcuggagggcaacuacagcuucuacguccucgacaaccagaaccugcagcagcugugggacugggaccaccggaaccucaccaucaaggccggcaagauguacuucgccuucaaccccaagcugugcguguccgagaucuaccgcauggaggaggugaccgggaccaagggccgccagagcaagggggacaucaacacgcggaacaacggcgagcgcgcguccugcgagagcgacguccugcacuucaccuccaccaccacgagcaagaaccggaucaucaucaccuggcaccgcuaccggcccccggacuaccgcgaccucaucuccuucaccguguacuacaaggaggcccccuucaagaacgugaccgaguacgacgggcaggacgccugcggcagcaacuccuggaacauggucgacguggaccugccgcccaacaaggacgucgagcccggcauccugcugcacgggcucaagcccuggacgcaguacgccguguacgugaaggccgucacccugaccaugguggagaacgaccacauccggggcgccaagagcgagauccuguacauccgcaccaacgcguccgugcccagcaucccccucgacguccugagcgccuccaacagcuccagccagcugaucgugaaguggaacccgcccucccuccccaacgggaaccugagcuacuacaucgugcgguggcagcgccagccgcaggacggcuaccuguaccggcacaacuacugcuccaaggacaagauccccauccgcaaguacgccgacggcacgaucgacaucgaggaggucaccgagaaccccaagaccgaggugugcgggggcgagaaggggcccugcugcgccugcccgaagaccgaggcggagaagcaggccgagaaggaggaggccgaguaccggaagguguucgagaacuuccuccacaacagcaucuucgucccccgccccgagcggaagcgccgggacgugaugcaggucgccaacaccacgauguccagccgcucccggaacaccaccgcggccgacaccuacaacaucacggaccccgaggagcuggagaccgaguacccguucuucgagagccgcguggacaacaaggagcgcaccgugaucuccaaccugcggcccuucacccucuaccgcaucgacauccacagcugcaaccacgaggccgagaagcugggcugcuccgccagcaacuucguguucgcccggacgaugcccgcggagggggccgacgacauccccggcccggucaccugggagccccgccccgagaacuccaucuuccugaaguggcccgagccggagaaccccaacggccucauccugauguacgagaucaaguacgggagccagguggaggaccagcgggagugcgugagccgccaggaguaccggaaguacggcggggccaagcugaaccgccucaaccccggcaacuacaccgcccggauccaggccaccucccugagcgggaacggcuccuggacggaccccgucuucuucuacgugcaggcgaagaccggcuacgagaacuucauccaccugaucaucgcccucccgguggccguccugcugaucgucgggggccucgugaucaugcuguacguguuccaccgcaagcggaacaacagccgccuggggaacggcgugcucuacgccuccgugaaccccgaguacuucagcgccgcggacgucuacgugcccgacgagugggagguggcccgggagaagaucaccaugucccgcgagcuggggcagggcagcuucggcauggucuacgaggggguggccaagggcguggucaaggacgagcccgagacccggguggccaucaagacggugaacgaggcggccuccaugcgcgagcggaucgaguuccugaacgaggccagcgucaugaaggaguucaacugccaccacguggugcgccuccugggggucgugucccagggccagccgacccuggugaucauggagcucaugacccgcggggaccucaagagcuaccugcggucccuccggcccgagauggagaacaaccccguccuggccccgcccagccuguccaagaugauccagauggccggcgagaucgcggacggcauggccuaccucaacgccaacaaguucgugcaccgcgaccuggccgcccgcaacugcaugguggcggaggacuucaccgucaagaucggggacuucggcaugacgcgggacaucuacgagaccgacuacuaccgcaagggcgggaagggccugcuccccgugcgguggaugagccccgagucccugaaggacgggguguucaccaccuacagcgacgucugguccuucggcgugguccugugggagaucgccacgcucgccgagcagccguaccaggggcugagcaacgagcagguccugcgcuucgugauggagggcgggcuccuggacaagcccgacaacugccccgacaugcuguucgagcucaugcggaugugcuggcaguacaaccccaagaugcgcccgagcuuccuggagaucaucuccagcaucaaggaggagauggagcccggcuuccgggagguguccuucuacuacagcgaggagaacaagcugcccgagcccgaggagcucgaccuggagccggagaacauggaguccgugccccuggaccccagcgccuccagcuccagccucccccugccggaccgccacuccggccacaaggccgagaacgggcccggccccggggugcugguccuccgggcgagcuucgacgagcgccagcccuacgcccacaugaacggcgggcggaagaacgagcgcgcccugccgcugccccaguccagcacgugcuga

SEQ ID NO: 31473 - RNA, 1317 nt, Artificial Sequence
  derived and/or modified sequence opt1 from IGF2BP1__Homo_sapiens__NP_001153895
augaacaagcuguacaucggcaaccucaacgagagcgugacccccgccgaccuggagaaggucuucgccgagcacaagaucuccuacagcgggcaguuccuggugaaguccggcuacgcguucguggacugcccggacgagcacugggccaugaaggccaucgagaccuucagcgggaaggucgagcuccagggcaagcgccuggagaucgagcacuccgugcccaagaagcagcggagccgcaagauccagauccggaacaucccgccccagcugcgcugggaggugcucgacucccugcuggcccaguacgggacggucgagaacugcgagcaggucaacaccgagagcgagaccgccguggugaacgugaccuacuccaaccgggagcagacgcgccaggcggacgaggugccccucaagauccuggcccacaacaacuucgucggccggcugaucggcaaggaggggcgcaaccucaagaagguggagcaggacaccgagaccaagaucaccaucagcucccugcaggaccugacgcucuacaaccccgagcggaccaucaccgugaagggcgccaucgagaacugcugccgcgccgagcaggagaucaugaagaagguccgggaggcguacgagaacgacguggccgccaugagccugcagucccaccugauccccgggcucaaccuggccgccgugggccuguuccccgcgagcuccagcgccgucccgcccccgcccuccagcgugaccggggccgcccccuacuccagcuucaugcaggcccccgagcaggagauggugcaggucuucauccccgcgcaggccgugggcgccaucaucggcaagaaggggcagcacaucaagcagcucagccgcuucgccuccgccagcaucaagaucgcgcccccggagacgcccgacuccaaggugcggauggucaucaucaccggcccgcccgaggcccaguucaaggcccaggggcgcaucuacggcaagcugaaggaggagaacuucuucggccccaaggaggaggugaagcuggagacccacauccggguccccgccagcgccgcggggcgcgugaucggcaagggcgggaagaccgugaacgagcuccagaaccugacggccgccgaggucguggugccccgggaccagacccccgacgagaacgaccaggucaucgugaagaucaucgggcacuucuacgccucccagauggcgcagcgcaagauccgggacauccuggcccaggugaagcagcagcaccagaagggccagagcaaccaggcccaggcccgccggaaguga

SEQ ID NO: 31474 - RNA, 1671 nt, Artificial Sequence
  derived and/or modified sequence opt1 from IGF2BP2__Homo_sapiens__NP_001007226
augaugaacaagcuguacaucggcaaccucagccccgccgugaccgccgacgaccugcgccagcuguucggggaccggaagcucccgcuggcgggccagguccugcucaaguccggguacgccuucguggacuaccccgaccagaacugggccauccgcgccaucgagacccugagcggcaagguggagcugcacgggaagaucauggaggucgacuacuccgugagcaagaagcuccggucccgcaagauccagauccggaacaucccgccccaccuccagugggaggugcuggacggccugcuggcccaguacggcacggucgagaacguggagcaggucaacaccgacaccgagaccgcgguggugaacgugacguacgccacccgcgaggaggccaagaucgccauggagaagcugagcgggcaccaguucgagaacuacuccuucaagaucagcuacauccccgacgaggaggucuccagccccuccccgccccagcgggcgcagcgcggcgaccacagcucccgggagcaggggcacgcccccggcgggaccagccaggcccgccagaucgacuucccccuccggauccuggugcccacccaguucgugggcgccaucaucggcaaggaggggcugacgaucaagaacaucaccaagcagacccagucccgcgucgacauccaccggaaggagaacagcggcgccgcggagaagcccgugaccauccacgccacgccggaggggaccuccgaggccugccgcaugauccucgagaucaugcagaaggaggccgacgagaccaagcuggccgaggagaucccccugaagauccucgcgcacaacggccuggugggccggcugaucgggaaggagggccgcaaccucaagaagaucgagcacgagaccgggacgaagaucaccaucagcucccugcaggaccugagcaucuacaaccccgagcggaccaucaccgucaagggcacgguggaggccugcgccagcgccgagaucgagaucaugaagaagcuccgcgaggccuucgagaacgacaugcuggcggugaacacccacuccggguacuucagcucccuguacccccaccaccaguucggcccguucccccaccaccacagcuaccccgagcaggagaucgucaaccucuucauccccacccaggccgugggcgccaucaucgggaagaagggcgcccacaucaagcagcuggcccgguucgcgggggccuccaucaagaucgccccggccgagggccccgacgugagcgagcgcauggucaucaucaccgggccgcccgaggcgcaguucaaggcccagggccggaucuucggcaagcugaaggaggagaacuucuucaaccccaaggaggaggugaagcucgaggcccacauccgcguccccuccagcacggccgggcgcgugaucggcaagggcgggaagaccgugaacgagcugcagaaccugaccuccgccgaggucaucgugccccgggaccagacccccgacgagaacgaggaggugaucguccgcaucaucgggcacuucuucgcgagccagacggcccagcggaagauccgcgagaucgugcagcaggucaagcagcaggagcagaaguacccgcagggcguggccucccagcggagcaaguga

SEQ ID NO: 31475 - RNA, 1740 nt, Artificial Sequence
  derived and/or modified sequence opt1 from IGF2BP3__Homo_sapiens__NP_006538
augaacaagcuguacaucggcaaccucagcgagaacgccgcccccuccgaccuggagagcaucuucaaggacgcgaagaucccgguguccgggcccuuccuggucaagaccggcuacgccuucguggacugccccgacgagagcugggcccucaaggccaucgaggcccuguccgggaagaucgagcugcacggcaagcccaucgagguggagcacagcgucccgaagcgccagcggauccgcaagcuccagauccggaacaucccgccccaccuccagugggaggugcuggacucccugcuggugcaguacggggucguggagagcugcgagcaggucaacaccgacuccgagacggcgguggugaacgugaccuacagcuccaaggaccaggcccgccaggcccuggacaagcucaacggcuuccagcuggagaacuucacccugaaggucgccuacauccccgacgagauggcggcccagcagaacccccuccagcagccccggggccgccgggggcugggccagcgcgggagcucccggcagggcagccccggguccgugagcaagcagaagcccugcgaccugccgcuccgccugcuggugcccacccaguucgucggcgccaucaucggcaaggagggggccacgauccggaacaucaccaagcagacccaguccaagaucgacgugcaccgcaaggagaacgccggcgcggccgagaaguccaucaccauccucagcacgcccgaggggaccagcgccgccugcaagagcauccuggagaucaugcacaaggaggcccaggacaucaaguucaccgaggagaucccccugaagauccucgcgcacaacaacuucgugggccggcugaucggcaaggaggggcgcaaccugaagaagaucgagcaggacaccgacacgaagaucaccaucuccccgcuccaggagcugacccuguacaaccccgagcggaccaucacggucaagggcaacguggagaccugcgccaaggccgaggaggagaucaugaagaagauccgcgagagcuacgagaacgacaucgccuccaugaaccuccaggcccaccugauccccgggcugaaccucaacgcgcugggccuguucccgcccaccagcgggaugcccccgcccaccuccggcccgcccagcgccaugacgccgcccuacccccaguucgagcaguccgagaccgagaccgugcaccucuucauccccgcccugagcgucggcgccaucaucgggaagcagggccagcacaucaagcagcugucccgguucgccggggcgagcaucaagaucgcccccgccgaggcccccgacgcgaaggugcgcauggugaucaucaccggcccgcccgaggcccaguucaaggcccaggggcggaucuacggcaagaucaaggaggagaacuucgucucccccaaggaggaggugaagcucgaggcccacauccgcguccccagcuucgccgcgggccgggugaucgggaagggcgggaagacggugaacgagcugcagaaccuguccagcgccgaggucguggugccccgcgaccagacccccgacgagaacgaccaggucguggugaagaucaccggccacuucuacgccugccaggucgcccagcgcaagauccaggagauccucacccaggugaagcagcaccagcagcagaaggcccugcaguccgggcccccgcagagccggcgcaaguga

SEQ ID NO: 31476 - RNA, 711 nt, Artificial Sequence
  derived and/or modified sequence opt1 from IGF2__Homo_sapiens__NP_001121070
auggugagccccgacccccagaucaucgucguggcccccgagaccgagcuggccuccaugcagguccagcgcaccgaggacggcgugacgaucauccagaucuucuggguggggcggaagggcgagcuccugcgccggacccccgugagcuccgcgaugcagacccccauggggaucccgaugggcaagagcaugcugguccuccugaccuuccuggccuucgccuccugcugcaucgccgccuaccgccccagcgagacgcucugcgggggcgagcugguggacacccugcaguucgugugcggcgaccggggguucuacuucucccgccccgcgagccgggucucccgccggagccgcggcaucguggaggagugcugcuuccgguccugcgaccucgcccugcuggagaccuacugcgccacccccgccaagagcgagcgcgacguguccacgccgcccaccguccuccccgacaacuucccccgguacccgguggggaaguucuuccaguacgacaccuggaagcagagcacccagcgccugcggcgcggccugcccgcgcuccugcgggcccgccgggggcacgugcuggccaaggagcucgaggccuuccgcgaggccaagcggcaccgcccccugaucgcgcugcccacgcaggacccggcccacggcggcgccccgcccgagauggccuccaaccgcaaguga

SEQ ID NO: 31477 - RNA, 7476 nt, Artificial Sequence
  derived and/or modified sequence opt1 from IGF2R__Homo_sapiens__NP_000867
augggcgccgccgcggggcggagcccccaccugggccccgcccccgcccggcgcccccagcggagccuccugcugcuccagcugcugcuccugguggccgcccccgggagcacccaggcgcaggccgcccccuuccccgagcugugcuccuacaccugggaggccgucgacaccaagaacaacgugcucuacaagaucaacaucugcggcagcguggacaucguccagugcgggcccuccagcgcggugugcaugcacgaccugaagacccgcaccuaccacuccgugggcgacagcguccugcgguccgccacccgcagccuccuggaguucaacaccaccguguccugcgaccagcagggcaccaaccaccgggugcagagcuccaucgccuuccugugcgggaagacccucggcacccccgaguucgucaccgccaccgagugcgugcacuacuucgaguggcgcaccaccgccgcgugcaagaaggacaucuucaaggccaacaaggaggugccgugcuacgucuucgacgaggagcugcggaagcacgaccugaacccccucaucaagcugagcggggccuaccugguggacgacuccgaccccgacaccagccucuucaucaacgugugccgcgacaucgacacccugcgggaccccggcucccagcugcgcgccugcccgcccgggaccgccgcgugccucguccggggccaccaggccuucgacgugggccagccccgcgacgggcugaagcuggugcggaaggaccgccucguccugagcuacgugcgggaggaggccggcaagcuggacuucugcgacgggcacucccccgccgugaccaucaccuucgucugccccagcgagcgccgggagggcaccauccccaagcucaccgccaagagcaacugccgcuacgagaucgaguggaucacggaguacgcgugccaccgggacuaccuggaguccaagaccugcagccuguccggcgagcagcaggacgugagcaucgaccucacgccccuggcccaguccgggggcagcuccuacaucagcgacgggaaggaguaccuguucuaccucaacgugugcggcgagaccgagauccaguucugcaacaagaagcaggccgccgucugccaggugaagaaguccgacacgagccaggucaaggccgcggggcgcuaccacaaccagacccugcgcuacuccgacggcgaccugacccucaucuacuucggcggggacgagugcagcuccggcuuccagcggaugagcgugaucaacuucgagugcaacaagaccgccgggaacgacggcaaggggacgcccguguucaccggcgaggucgacugcaccuacuucuucaccugggacacggaguacgccugcgugaaggagaaggaggaccugcugugcggcgccaccgacgggaagaagcgcuacgaccucuccgcgcuggugcggcacgccgagcccgagcagaacugggaggccgucgacggcagccagaccgagaccgagaagaagcacuucuucaucaacaucugccaccgcgugcugcaggaggggaaggcccggggcugccccgaggacgccgcggugugcgccgucgacaagaacggguccaagaaccucggcaaguucaucagcucccccaugaaggagaagggcaacauccagcugagcuacagcgacggggacgacugcggccacgggaagaagaucaagacgaacaucacccuggugugcaagcccggcgaccucgaguccgcccccgugcugcgcaccagcggcgagggcgggugcuucuacgaguucgaguggcacaccgccgccgcgugcguccuguccaagaccgagggggagaacugcacgguguucgacagccaggccggcuucuccuucgaccugagcccccucaccaagaagaacggggccuacaagguggagaccaagaaguacgacuucuacaucaacgucugcggccccguguccgugagccccugccagccggacuccggcgccugccaggucgccaagagcgacgagaagaccuggaaccuggggcuguccaacgcgaagcucagcuacuacgacggcaugauccagcugaacuaccgcgggggcacgcccuacaacaacgagcgccacacgccccgggccacccugaucaccuuccucugcgaccgcgacgccggggugggcuucccggaguaccaggaggaggacaacuccacguacaacuuccggugguacaccagcuacgccugccccgaggagccccuggagugcguggucaccgaccccuccacccuggagcaguacgaccucagcucccuggcgaaguccgagggcgggcugggcgggaacugguacgccauggacaacagcggcgagcacgugacguggcgcaaguacuacaucaacgugugccggccgcucaaccccguccccgggugcaaccgcuacgccuccgccugccagaugaaguacgagaaggaccagggcagcuucaccgaggugguguccaucagcaaccugggcauggccaagaccgggcccgucguggaggacuccggcagccugcuccuggaguacgugaacggguccgcgugcaccacgagcgacggccggcagaccaccuacaccacgcgcauccaccuggucugcucccgggggcgccucaacagccacccgaucuucucccugaacugggagugcguggugagcuuccuguggaacaccgaggccgccugccccauccagaccaccacggacaccgaccaggccugcuccauccgggaccccaacagcggcuucgucuucaaccucaacccccugaacuccagccagggcuacaacguguccgggaucggcaagaucuucauguucaacgugugcgggaccaugccggucugcggcaccauccugggcaagcccgccagcgggugcgaggcggagacgcagaccgaggagcucaagaacuggaagcccgcccgccccgugggcaucgagaagucccugcagcugagcaccgagggguucaucacccucacguacaagggcccgcugagcgccaaggggaccgccgacgccuucaucgugcgcuucgucugcaacgacgacguguacuccggcccccugaaguuccuccaccaggacaucgacagcggccaggggauccggaacaccuacuucgaguucgagaccgcgcuggccugcgugcccucccccgucgacugccaggugacggaccuggccggcaacgaguacgaccucaccgggcugagcaccgugcgcaagccguggaccgccgucgacaccuccguggacggccggaagcgcacguucuaccugagcgugugcaacccccuccccuacauccccgggugccagggcuccgcggucggcagcugccugguguccgaggggaacagcuggaaccugggcgugguccagauguccccgcaggccgccgccaacgggagccucuccaucauguacgugaacggcgacaagugcgggaaccagcgguucagcacccgcaucaccuucgagugcgcccagaucuccggcagccccgcguuccagcugcaggacggcugcgaguacgucuucaucuggcggaccguggaggccugccccgugguccgcguggagggggacaacugcgaggugaaggacccgcggcacggcaaccuguacgaccucaagccccuggggcugaacgacacgaucgucuccgccggcgaguacaccuacuacuuccgcgugugcggcaagcucagcuccgacgugugccccaccagcgacaagagcaaggucguguccagcugccaggagaagcgggagccccagggguuccacaagguggccggccugcugacccagaagcucacguacgagaacgggcugcugaagaugaacuucaccggcggggacacgugccacaaggucuaccagcgcuccaccgccaucuucuucuacugcgaccggggcacgcagcgcccgguguuccucaaggagaccagcgacugcuccuaccuguucgaguggcggacccaguacgcgugcccgcccuucgaccugaccgagugcagcuucaaggacggcgccgggaacuccuucgaccucagcucccugagccgcuacuccgacaacugggaggccaucacgggcaccggggaccccgagcacuaccugaucaacgugugcaagagccucgccccgcaggccggcaccgagcccugcccgcccgaggcggccgccugccugcucgggggcuccaagccggucaaccucggccgggugcgcgacgggccccaguggcgggacggcaucaucgugcugaaguacgucgacggggaccugugccccgacggcauccgcaagaaguccaccacgauccgguucacgugcuccgagagccaggugaacucccgccccauguucaucagcgccguggaggacugcgaguacaccuucgccuggccgaccgcgacggccugccccaugaaguccaacgagcacgacgacugccaggucaccaaccccagcaccgggcaccucuucgaccugagcucccugagcggccgcgccggcuucaccgccgcguacuccgagaaggggcucguguacaugagcaucugcggcgagaacgagaacugcccgcccggggugggcgccugcuucgggcagacgcggaucuccgucggcaaggccaacaagcgccugcgguacguggaccaggugcugcagcucgucuacaaggacggcagccccugccccuccaagagcgggcuguccuacaagagcgugaucuccuucgugugccgccccgaggccggccccaccaaccggcccaugcugaucagccucgacaagcagaccugcacccuguucuucuccuggcacacgccccuggccugcgagcaggcgaccgagugcagcguccgcaacggguccagcaucguggaccucagcccccugauccaccggaccggcggcuacgaggccuacgacgagagcgaggacgacgccuccgacaccaacccggacuucuacaucaacaucugccagccccugaaccccaugcacggggugccgugccccgccggcgccgcggucugcaaggugcccaucgacgggcccccgaucgacaucggccgcguggccgggccgcccauccucaaccccaucgccaacgagaucuaccugaacuucgagagcagcacgccgugccuggccgacaagcacuucaacuacaccucccucaucgccuuccacugcaagcggggcgucagcaugggcacccccaagcugcugcgcaccuccgagugcgacuucguguucgagugggagacccccguggucugccccgacgaggugcggauggacgggugcacgcucaccgacgagcagcugcuguacagcuucaaccucuccagccuguccaccagcaccuucaaggugacgcgcgacucccggaccuacagcgucggcgugugcaccuucgcgguggggccggagcagggcgggugcaaggacggcggcgucugccugcucuccgggaccaagggcgccagcuucgggcgccugcaguccaugaagcuggacuaccggcaccaggacgaggccguggugcucagcuacgucaacggcgaccgcugcccgcccgagacggacgacggggugcccugcguguucccguucaucuucaacggcaaguccuacgaggagugcaucaucgagagccgggccaagcuguggugcuccaccaccgcggacuacgaccgcgaccacgaguggggcuucugccggcacagcaacuccuaccgcaccagcagcaucaucuucaagugcgacgaggacgaggacaucgggcgcccccaggucuucuccgaggugcggggcugcgacgucacguucgaguggaagaccaagguggugugcccgcccaagaagcuggagugcaaguucguccagaagcacaagaccuacgaccugcgccuccugagcucccugaccgggagcuggucccucgugcacaacggcgugagcuacuacaucaaccugugccagaagaucuacaaggggccgcugggcugcuccgagcgggccagcaucugccgccggacgaccaccggcgacguccaggugcucgggcuggugcacacccagaagcugggcgucaucggggacaaggugguggucacguacuccaagggcuaccccugcggcgggaacaagaccgccagcuccgugaucgagcugaccugcaccaagacggugggccgccccgccuucaagcgguucgacaucgacagcugcaccuacuacuucuccugggacagccgcgccgcgugcgccgucaagccccaggaggugcagauggugaacgggaccaucaccaacccgaucaacggcaaguccuucagccugggggacaucuacuucaagcuguuccgggccuccggcgacaugcgcacgaacggcgacaacuaccucuacgagauccagcugagcagcaucaccuccagccggaaccccgccugcuccggggccaacaucugccaggucaagcccaacgaccagcacuucagccgcaaggugggcaccuccgacaagaccaaguacuaccugcaggacggggaccucgacguggucuucgcgagcuccagcaagugcggcaaggacaagacgaaguccgugagcuccaccaucuucuuccacugcgacccccugguggaggacgggaucccggaguucagccacgagaccgccgacugccaguaccuguucuccugguacaccagcgccgucugcccccucggcgugggcuucgacuccgagaaccccggggacgacggccagaugcacaaggggcugagcgagcggucccaggccgugggcgccguccugagccuccugcugguggcgcucacgugcugccugcuggcccuccugcuguacaagaaggagcgccgggagaccgugaucuccaagcucacgaccugcugccgccggagcagcaacgucuccuacaaguacagcaaggugaacaaggaggaggagacggacgagaacgagaccgaguggcugauggaggagauccagcugccgccgccccggcaggggaaggagggccaggagaacggccacaucaccaccaaguccgugaaggcccucagcucccugcacggggacgaccaggacagcgaggacgagguccugaccauccccgaggugaaggugcacuccggccgcggggccggcgcggagagcucccacccgguccgcaacgcccagagcaacgcccuccaggagcgggaggacgaccgcgugggccuggugcgcggggagaaggcccggaagggcaaguccagcuccgcccagcagaagacggucagcuccaccaagcuggugagcuuccacgacgacuccgacgaggaccuccugcacaucuga

SEQ ID NO: 31478 - RNA, 1932 nt, Artificial Sequence
  derived and/or modified sequence opt1 from IGFALS__Homo_sapiens__NP_001139478
auggcccugcgcaaggccggcgaccucgagccccaguucacccccgagcggcgcuuccggcugugcugguaccaggcgcacagcgggcgcgcccugcucggcccgccgccccaggccuccccgcccgccgggggccuggcccuggcgcuccugcugcucagcuggguggcccuggggccccggucccuggagggcgccgaccccggcacccccggggaggccgagggccccgcgugccccgccgccugcgucugcagcuacgacgacgacgccgacgagcucuccguguucugcagcucccgcaaccugacccggcugcccgacggggugcccggcgggacccaggcccucuggcuggacggcaacaaccugagcuccgucccgcccgcggccuuccagaaccucagcucccugggcuuccugaaccuccagggcgggcagcuggggagccuggagccccaggcccuccugggccuggagaaccucugccaccuccaccuggagcgcaaccagcuccggucccuggcccugggcaccuucgcccacacccccgcgcucgccagccuggggcuguccaacaaccgccucagccggcuggaggacggccuguucgaggggcucggcucccugugggaccugaaccucggguggaacagccuggccgugcugcccgacgccgccuuccgcggccugggcucccugcgggagcuggugcucgcggggaaccgccuggccuaccugcagcccgcccuguucagcggccucgccgagcugcgggagcuggaccucagccgcaacgcccugcgggcgaucaaggccaacgucuucgugcagcugccccgccuccagaagcuguaccuggaccggaaccucaucgccgccguggcgccgggggccuuccugggccugaaggcccuccgcuggcuggaccugucccacaaccgggucgccgggcuccuggaggacaccuuccccggccugcucggccugcgcgugcugcgccucagccacaacgccaucgcgucccugcggccccgcaccuucaaggaccugcacuuccucgaggagcugcagcuggggcacaaccggauccgccagcucgccgagcggagcuucgagggccuggggcagcuggaggugcucacccuggaccacaaccagcugcaggaggucaaggccggcgccuuccucgggcugaccaacguggccgugaugaaccuguccggcaacugccuccgcaaccugcccgagcaggucuuccggggccuggggaagcuccacagccugcaccuggagggcuccugccucgggcgcauccggccgcacacguucaccggccugagcggccugcgccgccucuuccugaaggacaacgggcuggugggcaucgaggagcagucccucugggggcuggcggagcugcucgagcuggaccugaccagcaaccagcucacccaccucccccaccggcuguuccagggccuggggaagcuggaguaccugcuccugucccggaaccgccuggccgagcuccccgccgacgcccugggcccccugcagcgggccuucuggcucgacgugagccacaaccgccuggaggcgcugccgaacucccuccuggcgccccugggccggcuccgcuaccugagccugcggaacaacucccuccgcacguucacgccccagccgcccgggcuggagcgccuguggcucgagggcaaccccugggacugcgggugcccccugaaggcccugcgggacuucgcccuccagaacccgagcgccgucccccgcuucgugcaggccaucugcgagggcgacgacugccagccgcccgccuacaccuacaacaacaucacgugcgccuccccgcccgagguggucgggcuggaccugcgggaccucagcgaggcccacuucgcgcccugcuga

SEQ ID NO: 31479 - RNA, 780 nt, Artificial Sequence
  derived and/or modified sequence opt1 from IGFBP1__Homo_sapiens__NP_000587
augagcgaggugcccgucgcccgcguguggcuggugcuccugcugcucaccguccaggugggcgugaccgccggggcgccguggcagugcgcccccugcuccgccgagaagcuggcccugugcccgcccgucagcgccuccugcagcgaggugacgcgguccgcgggcugcgggugcugccccaugugcgcccucccccugggcgccgccugcgggguggcgaccgcccgcugcgcccggggccugagcugccgcgcccuccccggcgagcagcagccccugcacgcccugacccgggggcagggcgcgugcguccaggaguccgacgccagcgccccgcacgccgccgaggcggggucccccgagagccccgaguccaccgagaucacggaggaggagcuccuggacaacuuccaccugauggcccccagcgaggaggaccacuccauccucugggacgccaucagcaccuacgacggcuccaaggcccugcacgugaccaacaucaagaaguggaaggagccgugccgcaucgagcuguaccggguggucgagagccucgccaaggcgcaggagaccuccggggaggagaucagcaaguucuaccugcccaacugcaacaagaacggcuucuaccacucccgccagugcgagacgagcauggacggcgaggccgggcugugcuggugcguguaccccuggaacggcaagcggauccccgggagcccggagauccgcggcgaccccaacugccagaucuacuucaacgugcagaacuga

SEQ ID NO: 31480 - RNA, 987 nt, Artificial Sequence
  derived and/or modified sequence opt1 from IGFBP2__Homo_sapiens__NP_000588
augcugccccgcgugggcugcccggcccucccccugcccccgccgccccugcucccccugcugccccuccugcugcuccugcugggggccagcggcgggggcgggggcgcgcgggccgagguccucuuccgcugcccgcccugcacccccgagcggcuggccgccugcgggcccccgcccguggccccgcccgcggccguggccgccgucgccggcggcgcgcgcaugcccugcgccgagcuggugcgggagcccgggugcggcugcugcuccgugugcgcccgccucgagggggaggccugcggcgucuacaccccgcggugcggccaggggcugcgcugcuacccccaccccggcagcgagcugccccuccaggcgcuggugaugggggagggcacgugcgagaagcggcgcgacgccgaguacggcgccucccccgagcaggucgccgacaacggggacgaccacagcgagggcgggcugguggagaaccacguggacuccaccaugaacaugcucggcgggggcggcagcgccgggcggaagccccugaaguccggcaugaaggagcuggcgguguuccgcgagaaggucaccgagcagcaccggcagauggggaagggcgggaagcaccaccucggccuggaggagcccaagaagcugcgcccgccgcccgcccggacccccugccagcaggagcucgaccaggugcuggagcgcaucagcacgaugcggcugcccgacgagcgcggcccccucgagcaccuguacucccugcacauccccaacugcgacaagcacgggcucuacaaccugaagcagugcaagaugagccugaacggccagcgcggggagugcuggugcgugaaccccaacaccggcaagcucauccagggggcccccaccauccggggcgaccccgagugccaccuguucuacaacgagcagcaggaggcccggggcguccacacccagcgcaugcaguga

SEQ ID NO: 31481 - RNA, 876 nt, Artificial Sequence
  derived and/or modified sequence opt1 from IGFBP3__Homo_sapiens__NP_000589
augcagcgcgcccggcccacccugugggccgcggcccucacccugcuggugcuccugcgcggcccgcccgucgcccgggccggggccagcuccgcgggccuggggcccguggugcgcugcgagcccugcgacgcccgggcccucgcccagugcgcgccgccgcccgccgucugcgccgagcuggugcgcgagcccggcugcgggugcugccugacgugcgcccucagcgagggccagcccugcggcaucuacaccgagcggugcggguccggccugcgcugccagcccagccccgacgaggcccggccccugcaggcgcuccuggacgggcgcggccugugcgugaacgccuccgccgucagccggcuccgcgccuaccugcugccggccccgcccgcgcccgggaacgccuccgagagcgaggaggaccgguccgccggcagcguggagucccccagcguguccagcacccaccgcgucuccgaccccaaguuccacccccuccacagcaagaucaucaucaucaagaagggccacgccaaggacucccagcgguacaagguggacuacgagagccaguccaccgacacgcagaacuucagcagcgaguccaagcgcgagaccgaguacgggcccugccggcgcgagauggaggacacccugaaccaccugaaguuccucaacgugcugagcccgcggggcguccacauccccaacugcgacaagaagggguucuacaagaagaagcagugccgccccuccaagggccggaagcgcggcuucugcuggugcguggacaaguacgggcagccccugccgggcuacaccacgaaggggaaggaggacgugcacugcuacagcaugcaguccaaguga

SEQ ID NO: 31482 - RNA, 777 nt, Artificial Sequence
  derived and/or modified sequence opt1 from IGFBP4__Homo_sapiens__NP_001543
augcugccccucugccugguggccgcccugcuccuggcggccggcccggggcccagccugggcgacgaggccauccacugcccgcccugcuccgaggagaagcucgcccgcugccggccgcccgucgggugcgaggagcuggugcgcgagcccggcugcgggugcugcgcgaccugcgcccugggccucggcaugcccugcgggguguacaccccgcggugcggcagcgggcugcgcugcuacccgccccggggcgucgagaagccccugcacacgcucaugcacgggcagggcgugugcauggagcuggccgagaucgaggccauccaggagucccugcagcccagcgacaaggacgagggcgaccaccccaacaacuccuucagccccugcuccgcccacgaccgccggugccuccagaagcacuucgcgaagauccgcgaccggagcaccuccgggggcaagaugaaggugaacggggcgccccgcgaggacgcccggcccgucccccagggcagcugccaguccgagcugcaccgcgcccuggagcggcucgccgccagccagucccgcacccacgaggaccuguacaucauccccauccccaacugcgaccggaacggcaacuuccacccgaagcagugccaccccgcccuggacgggcagcgcggcaagugcuggugcguggaccggaagaccggggugaagcuccccggcgggcuggagcccaagggcgagcuggacugccaccagcucgccgacagcuuccgcgaguga

SEQ ID NO: 31483 - RNA, 819 nt, Artificial Sequence
  derived and/or modified sequence opt1 from IGFBP5__Homo_sapiens__NP_000590
auggugcugcucaccgccguccugcugcuccuggccgcguacgccggccccgcccagagccugggguccuucgugcacugcgagccgugcgacgagaaggcccucagcaugugcccgcccagcccccugggcugcgagcuggugaaggagcccgggugcggcugcugcaugaccugcgcccucgcggaggggcaguccugcggcgucuacacggagcgcugcgcccagggccugcggugccugccccgccaggacgaggagaagccccuccacgcccugcugcacgggcggggcgugugccucaacgagaaguccuaccgcgagcaggucaagaucgagcgggacagccgcgagcacgaggagcccaccaccuccgagauggccgaggagaccuacagcccgaagaucuuccggcccaagcacacgcgcaucuccgagcugaaggcggaggccgugaagaaggaccggcgcaagaagcugacccagagcaaguucgucgggggcgccgagaacaccgcccacccccggaucaucuccgcccccgagaugcgccaggagagcgagcaggggccgugccggcgccacauggaggcgucccuccaggagcugaaggccagcccccggauggugccccgcgccguguaccugcccaacugcgaccggaagggcuucuacaagcgcaagcagugcaagccgucccggggccgcaagcgggggaucugcuggugcguggacaaguacggcaugaagcuccccgggauggaguacguggacggcgacuuccagugccacaccuucgacagcuccaacgucgaguga

SEQ ID NO: 31484 - RNA, 723 nt, Artificial Sequence
  derived and/or modified sequence opt1 from IGFBP6__Homo_sapiens__NP_002169
augacgccccaccgccugcucccgccccugcugcuccugcuggcccuccugcuggccgcgagccccggcggggcccucgcccggugccccggcugcgggcagggcgugcaggccgggugcccgggcggcugcgucgaggaggaggacgggggcucccccgccgaggggugcgcggaggccgagggcugccugcgccgggaggggcaggagugcggcguguacacccccaacugcgcccccggccugcagugccacccgcccaaggacgacgaggcgccccuccgcgcccugcugcucgggcggggccgcugccugcccgcccgggccccggccguggccgaggagaaccccaaggagagcaagccccaggcggggaccgcccgcccccaggacgucaaccggcgcgaccagcagcggaacccgggcaccuccaccacccccagccagcccaacuccgccggcgugcaggacacggagauggggcccugccgccggcaccuggacagcgugcuccagcagcugcagaccgaggucuaccgcggcgcccagacccuguacgugccgaacugcgaccaccggggguucuaccgcaagcggcagugccgcuccagccagggccagcggcgcgggcccugcuggugcguggaccggaugggcaagucccuccccggcagccccgacgggaacggcuccagcuccugcccgaccgggagcuccggcuga

SEQ ID NO: 31485 - RNA, 840 nt, Artificial Sequence
  derived and/or modified sequence opt1 from IGFBP7__Homo_sapiens__NP_001240764
auggagcgccccagccugcgggcccuccugcugggcgccgcggggcuccugcugcuccugcugccgcucuccagcuccagcuccagcgacacgugcggccccugcgagcccgccuccugcccgccccugccgccccuggggugccuccugggcgagacccgcgacgccugcgggugcugccccaugugcgcccggggcgagggcgagcccugcgggggcgggggcgccgggcgcggcuacugcgcgcccggcauggagugcgucaagagccggaagcgccggaaggggaaggccggcgccgccgcgggcggccccggcguguccggggugugcgugugcaagagccgcuaccccgucugcggcuccgacgggaccaccuacccgagcggcugccagcugcgggccgccucccagcgcgccgagagccgcggggagaaggccaucacccagguguccaaggggaccugcgagcagggccccagcaucgugacgccgcccaaggacaucuggaacgucaccggggcccagguguaccucuccugcgaggugaucggcauccccacccccguccugaucuggaacaaggugaagcgggggcacuacggcgugcagcggaccgagcugcuccccggggaccgcgacaaccuggcgauccagacgcggggcggccccgagaagcacgaggucaccgggugggugcuggugagcccgcucuccaaggaggacgccggcgaguacgagugccacgccagcaacagccaggggcaggccuccgcgagcgccaagaucaccgucguggacgcccugcacgagauccccgugaagaagggcacccaguga

SEQ ID NO: 31486 - RNA, 837 nt, Artificial Sequence
  derived and/or modified sequence opt1 from IGFBPL1__Homo_sapiens__NP_001007564
augccccgccugagccuccugcugccgcuccugcugcuccugcugcucccccugcugccgccccucucccccagccugggcauccgggacgucgggggccgccggcccaagugcgggcccugccgccccgagggcugcccggcccccgcccccugccccgcgccggggaucuccgcccuggacgagugcggcugcugcgcccggugccucggcgccgagggggccagcugcggcgggcgcgcgggcgggcggugcggccccggccuggugugcgccucccaggccgccggggcggcccccgagggcaccgggcugugcgugugcgcccagcgcggcaccgugugcggcagcgacgggcgguccuaccccagcgucugcgcccuccgccugcgggcccgccacacgccgcgggcgcaccccggccaccuccacaaggcccgcgacgggcccugcgaguucgcccccgugguggucgugccgccccgguccgugcacaacgucaccggcgcccagguggggcugagcugcgaggugcgcgccguccccacccccgugaucaccuggcggaaggugacgaaguccccggagggcacccaggcgcuggaggagcugcccggcgaccacgucaacaucgccguccaggugcgcgggggccccagcgaccacgaggccaccgccuggauccucaucaacccccugcggaaggaggacgaggggguguaccagugccacgccgcgaacauggugggcgaggccgagucccacagcaccgugacgguccuggaccucuccaaguaccgcagcuuccacuucccggcccccgacgaccggauguga

SEQ ID NO: 31487 - RNA, 333 nt, Artificial Sequence
  derived and/or modified sequence opt1 from IGFL1__Homo_sapiens__NP_940943
auggcgccccgcggcugcaucguggccgucuucgccaucuucugcaucagccggcugcucugcucccacggggccccgguggcccccaugacccccuaccugaugcugugccagccccacaagcgcugcggcgacaaguucuacgacccgcuccagcacugcugcuacgacgacgccguggucccccuggcccggacccagacgugcgggaacugcaccuuccgcgugugcuucgagcagugcugccccuggaccuucauggugaagcugaucaaccagaacugcgacagcgcgcggaccuccgacgaccgccucugccggagcgucuccuga

SEQ ID NO: 31488 - RNA, 1068 nt, Artificial Sequence
  derived and/or modified sequence opt1 from IGFLR1__Homo_sapiens__NP_078936
augggccccgggcgcugccugcucaccgcccugcugcuccuggcccuggcgccgccgcccgaggccagccaguacugcggccggcucgaguacuggaaccccgacaacaagugcugcuccagcugccugcagcgcuucgggcccccgcccugccccgacuacgaguuccgggagaacugcggccugaacgaccacggggacuucgugaccccgcccuuccgcaagugcuccagcggccagugcaaccccgacggcgccgagcucugcucccccugcgggggcggggccgucacgcccacccccgccgcgggcgggggccggacccccuggcgcugccgggagcgccccgugccggccaagggccacugcccccugacccccgggaaccccggcgccccgagcucccaggagcggagcucccccgccagcuccaucgcguggcgcacgcccgagcccgugccgcagcaggccuggcccaacuuccugccccucgucgugcuggugcugcuccugacccuggccgucaucgccauccuccuguucauccugcucuggcaccugugcuggcccaaggagaaggccgacccguaccccuaccccgggcuggugugcggcgugccgaacacccacacccccagcuccagccaccucuccagccccggcgcgcuggagacgggggacaccuggaaggaggccucccugcucccccugcugagccgggagcucuccagccuggccagccagccgcugucccgccuccuggacgagcuggagguccucgaggagcugaucgugcugcucgaccccgagcccggccccgggggcgggauggcccacggcaccacccggcaccuggccgcgcgcuacggccugccggccgccuggagcacguucgccuacucccuccggcccagccgcagcccccugcgggcccugaucgagaugguggucgcgcgcgagcccuccgccucccucgggcagcugggcacccaccuggcccagcucgggcgggccgacgcccugcgcgugcugagcaagcugggcuccagcggggugugcugggcguga

SEQ ID NO: 31489 - RNA, 2982 nt, Artificial Sequence
  derived and/or modified sequence opt1 from IGHMBP2__Homo_sapiens__NP_002171
auggccagcgccgcgguggaguccuucgucaccaagcagcuggaccuccuggagcuggagcgcgacgccgagguggaggagcggcgcagcuggcaggagaacaucucccucaaggagcugcagagccggggcgugugccugcucaagcugcaggucuccagccagcgcaccgggcuguacggccggcuccuggugacguucgagccccgccgguacggguccgccgccgcccugccgagcaacuccuucaccagcggcgacaucguggggcucuacgacgcggccaacgagggcucccagcuggccaccggcauccugacccgcgucacgcagaaguccgugaccguggccuucgacgagagccacgacuuccagcucagccuggaccgggagaacuccuaccgccugcucaagcuggcgaacgacgucaccuaccggcgccugaagaaggcccucaucgcccugaagaaguaccacagcgggcccgccuccagccugaucgagguccucuucggccgguccgcccccagccccgcgagcgagauccacccgcugaccuucuucaacacgugccuggacaccucccagaaggaggccguccucuucgcccugagccagaaggagcuggccaucauccacgggccgcccggcaccgggaagaccacgaccgugguggagaucauccuccaggccgugaagcagggccugaaggugcugugcugcgcgcccuccaacaucgccguggacaaccucguggagcgccuggcccugugcaagcagcggauccuccgccugggccaccccgcccggcugcucgagagcauccagcagcacucccuggacgccguccuggcgcgcagcgacuccgcccagaucguggccgacauccggaaggacaucgaccagguguucgucaagaacaagaagacccaggacaagcgcgagaaguccaacuuccggaacgagaucaagcuccugcgcaaggagcugaaggagcgcgaggaggccgccaugcucgagagccugaccagcgcgaacguggugcuggccacgaacaccggggccuccgccgacggcccccucaagcugcugcccgagagcuacuucgacgucguggucaucgacgagugcgcgcaggcccuggaggccuccugcuggaucccccuccugaaggcccggaagugcauccuggccggggaccacaagcagcucccgcccaccaccgugagccacaaggcggcccuggccggccugucccucagccugauggagcgccuggccgaggaguacggcgcccgggugguccgcacgcucaccgugcaguaccggaugcaccaggcgaucaugcgcugggccuccgacaccauguaccuggggcagcugaccgcccacagcuccguggcccggcaccuccugcgcgaccugcccggcgucgccgcgacggaggagaccggggugccccuccugcugguggacaccgccggcugcggccucuucgagcuggaggaggaggacgagcagagcaaggggaacccgggcgagguccggcuggugagccuccacauccaggcccugguggacgccgggguccccgcgcgcgacaucgccguggugucccccuacaaccugcaggucgaccuccugcggcagagccuggugcaccgccaccccgagcucgagaucaaguccguggacggcuuccaggggcgggagaaggaggccgucauccugagcuucgugcgcuccaaccggaagggcgaggugggguuccuggccgaggaccgccggaucaacgucgccgugacccgcgcgcggcgccacguggccgucaucugcgacagccgcacggugaacaaccacgccuuccucaagacccugguggaguacuucacccagcacggcgagguccggaccgccuucgaguaccuggacgacaucgugccggagaacuacucccacgagaacagccagggcuccagccacgccgcgacgaagccccaggggcccgccaccuccacccgcaccggcagccagcggcaggagggcgggcaggaggccgccgcccccgcgcgccaggggcggaagaagccggccggcaagucccucgccagcgaggcccccucccagcccagccugaacggcgggucccccgagggcguggagagccaggacggggucgaccacuuccgcgcgaugaucguggaguucauggccagcaagaagaugcagcuggaguucccgcccucccucaacagccacgaccggcugcgcgugcaccagaucgccgaggagcacggccugcggcacgacuccagcggcgaggggaagcgccgguucaucacggucuccaagcgcgcgccccggccgcgcgccgcccucggcccgcccgccgggaccggcgggcccgcgccccugcagcccgugccgcccacccccgcccagaccgagcagccgccccgggagcagcgcggccccgaccagcccgaccugcggacccuccaccuggagcgccugcagcgggugcgcagcgcccagggccagcccgccuccaaggagcagcaggccagcgggcagcagaagcuccccgagaagaagaagaagaaggccaagggccaccccgccacggaccugccgaccgaggaggacuucgaggcccuggucuccgcggccgugaaggccgacaacacgugcggguucgccaagugcaccgccggcgugaccacccucgggcaguucugccagcugugcagccggcgcuacugccugucccaccaccuccccgagauccacggcugcggcgagcgcgcgcgggcccacgcccgccagcggaucagccgcgaggggguccuguacgccggcuccgggaccaagaacggcagccuggaccccgcgaagcgggcccagcuccagcgccggcuggacaagaagcuguccgagcucagcaaccagcgcaccucccggcgcaaggagcgggggacguga

SEQ ID NO: 31490 - RNA, 480 nt, Artificial Sequence
  derived and/or modified sequence opt1 from IGJ__Homo_sapiens__NP_653247
augaagaaccaccuccuguucuggggcgugcuggccgucuucaucaaggccgugcacgugaaggcgcaggaggacgagcgcaucguccugguggacaacaagugcaagugcgcccggaucaccagccgcaucauccgguccagcgaggaccccaacgaggacaucguggagcgcaacauccggaucaucgucccgcucaacaaccgcgagaacaucuccgaccccaccagcccccugcggacgcgcuucguguaccaccuguccgaccucugcaagaagugcgaccccaccgagguggagcuggacaaccagaucgucaccgccacccagagcaacaucugcgacgaggacuccgccacggagaccugcuacaccuacgaccggaacaagugcuacaccgccguggugccgcuggucuacgggggcgagacgaagaugguggagaccgcgcucacccccgacgccugcuaccccgacuga

SEQ ID NO: 31491 - RNA, 642 nt, Artificial Sequence
  derived and/or modified sequence opt1 from IGLL1__Homo_sapiens__NP_064455
augcgccccggcaccgggcagggcgggcuggaggccccgggcgagcccgggcccaaccuccggcagcgcuggccccugcugcuccugggccuggccguggucacccacggccuccugcggccgacggcggccagccagucccgcgcccuggggcccggcgcccccgggggcagcucccggagcucccuccgcagccggugggggcgcuuccugcugcagcggggcuccuggaccggcccccgcugcuggccgcggggguuccagagcaagcacaacuccgugacccacguguucggcagcgggacccagcucacgguccugucccagcccaaggccacccccagcgugacccuguucccgcccuccagcgaggagcuccaggcgaacaaggccacccuggugugccugaugaacgacuucuaccccggcauccucacggucaccuggaaggccgacggcacccccaucacccaggggguggagaugacgacccccuccaagcagagcaacaacaaguacgccgcguccagcuaccugucccugaccccggagcaguggcgcagccggcgcagcuacuccugccaggugaugcacgagggcagcaccgucgagaagacgguggcccccgccgagugcuccuga

SEQ ID NO: 31492 - RNA, 7872 nt, Artificial Sequence
  derived and/or modified sequence opt1 from IGSF10__Homo_sapiens__NP_849144
augaaggugaagggccgcgggaucacgugccugcuggucagcuucgccgugaucugccugguggccacccccggcgggaaggcgugcccgcggcgcugcgccugcuacaugcccaccgagguccacugcaccuuccgguaccugaccagcauccccgacagcaucccgcccaacguggagcgcaucaaccugggcuacaacucccuggugcggcugauggagaccgacuucagcgggcugaccaagcuggagcugcucaugcugcacuccaacggcauccacaccauccccgacaagaccuucagcgaccugcaggcccuccagguccugaagauguccuacaacaaggugcgcaagcugcagaaggacaccuucuacggccuccggagccugacccgccugcacauggaccacaacaacaucgaguucaucaaccccgagguguucuacgggcucaacuuccugcggcugguccaccucgagggcaaccagcugaccaagcugcaccccgacaccuucgugucccucagcuaccugcagaucuucaagaucuccuucaucaaguuccuguaccucagcgacaacuuccugaccucccugccccaggagauggugagcuacaugcccgaccucgacucccuguaccugcacgggaaccccuggaccugcgacugccaccucaaguggcugagcgacuggauccaggagaagcccgacgucaucaagugcaagaaggaccgcucccccagcuccgcccagcagugcccccugugcaugaacccccggaccagcaagggcaagccccucgccauggugagcgccgccgccuuccagugcgccaagcccaccaucgacuccagccugaaguccaagagccugaccauccucgaggacuccagcuccgcguucaucagcccccagggguucauggcccccuucggcucccugacgcugaacaugaccgaccagagcggcaacgaggccaacauggugugcuccauccagaagcccagccgcaccucccccaucgccuucaccgaggagaacgacuacaucguccucaacacgagcuucuccaccuuccuggugugcaacaucgacuacgggcacauccagcccguguggcagauccuggcccucuacagcgacagcccccucauccuggagcggagccaccuccuguccgagacgccccagcuguacuacaaguacaagcaggucgcgcccaagcccgaggacaucuucaccaacaucgaggccgaccugcgcgccgaccccagcuggcucaugcaggaccagaucagccugcagcugaaccggacggccaccaccuucuccacccuccagauccaguacagcuccgacgcccagaucacgcugccccgcgcggagaugcggcccgugaagcacaaguggaccaugaucagccgcgacaacaacaccaagcuggagcacaccgugcucgucggcgggacggugggccugaacugccccggccagggggaccccaccccgcacguggacuggcugcucgccgacggcuccaagguccgggcccccuacgugagcgaggacgggcgcauccugaucgacaaguccggcaagcuggagcuccagauggccgacagcuucgacaccggggucuaccacugcaucuccagcaacuacgacgacgccgacauccugaccuaccggaucacggugguggagccccuggucgaggcguaccaggagaacggcauccaccacaccguguucaucggcgagacccucgaccugcccugccacuccaccgggauccccgacgccagcaucuccugggugauccccggcaacaacguccuguaccagagcucccgcgacaagaaggugcucaacaacgggacccugcgcauccuccaggugacgcccaaggaccagggcuacuaccggugcgucgccgccaaccccagcgggguggacuuccucaucuuccagguguccgucaagaugaagggccagcgcccgcuggagcacgacggcgagaccgaggggagcggccuggacgagagcaaccccaucgcccaccucaaggagccgcccggggcgcagcugcggaccuccgcccugauggaggccgaggugggcaagcacaccagcuccacgagcaagcgccacaacuaccgggagcucacccugcagcgccgcggggacuccacccaccgccgguuccgcgagaaccggcgccacuucccgcccagcgcccggcgcaucgacccccagcacugggcggcccugcucgagaaggccaagaagaacgccaugcccgacaagcgggagaacaccacgguguccccgccgcccgucgugacccagcugcccaacaucccgggcgaggaggacgacagcuccggcaugcuggcccuccacgaggaguucauggugcccgcgaccaaggcccugaaccugcccgcccgcaccgucacggccgacagccggaccaucuccgacagccccaugaccaacaucaacuacgggaccgaguucuccccgguggugaacagccagauccugccgcccgaggagccgacggacuucaagcuguccaccgccaucaagaccaccgcgaugagcaagaacaucaaccccacgauguccagccagauccagggcaccaccaaccagcacuccagcaccgucuucccccugcuccugggggccacggaguuccaggacagcgaccagaugggccgcggccgggagcacuuccagucccgcccgcccaucaccgugcgcaccaugaucaaggacgugaacgucaagaugcugagcuccaccacgaacaagcuccugcuggagagcgugaacaccaccaacucccaccagaccagcgugcgggaggucuccgagccccgccacaaccacuucuacagccacacgacccagauccucuccaccagcaccuuccccuccgacccccacacggccgcccacagccaguuccccaucccccggaacuccaccgugaacaucccccuguuccgccgguucgggcgccagcggaagaucggcgggcgcggccggaucaucagccccuaccgcaccccggugcugcggcgccaccgguacuccaucuuccgcagcaccacccggggguccagcgagaaguccacgaccgccuucagcgcgaccguccucaacgugaccugccugagcugccugccccgcgagcggcucacgaccgccaccgccgcccuguccuuccccagcgcggcccccaucaccuucccgaaggccgacaucgcccgcgugcccuccgaggagagcacgacccugguccagaacccccuccugcugcucgagaacaagcccuccguggagaagaccaccccgacgaucaaguacuuccggaccgagaucagccaggugacccccaccggcgccgucaugacguacgcgcccaccuccauccccauggagaagacccacaaggugaacgccagcuacccgcgcguguccagcaccaacgaggccaagcgggacuccgucaucacgagcucccugagcggcgccaucaccaagccgcccaugaccaucaucgccaucacccgcuucucccgccggaagauccccuggcagcagaacuucgugaacaaccacaaccccaaggggcgccugcggaaccagcacaaggugagccuccagaaguccacggcggucaugcugcccaagaccagccccgcccugccgcgcgacaaggugucccccuuccacuucaccacccucagcacgagcgugaugcagauccccuccaacacccugaccaccgcccaccacacgaccaccaagacccacaaccccggcagccugccgacgaagaaggagcuccccuucccgccccugaacccgaugcugcccuccaucaucagcaaggacuccagcaccaaguccaucaucagcacccagaccgccauccccgccaccacgcccaccuucccggcguccgucaucaccuacgagacccagacggagcggagccgcgcccagaccauccagcgggagcaggagccccagaagaagaaccgcaccgaccccaacaucucccccgaccagagcuccggguucaccacgccgaccgccaugacgccgcccgugcucaccacggccgagaccagcgugaagcccuccgucagcgcguucacccacuccccgcccgagaacaccacgggcaucagcuccaccaucagcuuccacagccggacccugaaccugaccgacgugaucgaggagcucgcccaggccuccacgcagacccugaaguccaccaucgccuccgagaccacgcugagcuccaagagccaccaguccaccaccacccgcaaggccaucauccggcacagcacgaucccgcccuuccucuccagcuccgcgacccugaugccggugcccaucuccccgcccuucacccagcgcgccgucaccgacaacguggccacgccgaucuccgggcugaugaccaacaccgucgugaagcuccacgagagcucccggcacaacgccaagccccagcagcugguggccgaggucgcgaccagccccaaggugcacccgaacgccaaguucacgaucggcaccacccacuucaucuacuccaaccugcuccacagcacccccaugcccgcccugacgaccgugaagucccagaacagcaagcugacccccagcccgugggccgagaaccaguucuggcacaagcccuacuccgagaucgccgagaagggcaagaagcccgaggucagcaugcucgcgaccaccgggcuguccgaggccacgacccuggugagcgacugggacggccagaagaacaccaagaaguccgacuucgacaagaagcccgugcaggaggccaccacgagcaagcuccugccguucgacucccugagccgcuacaucuucgagaagccccggaucgucgggggcaaggccgccuccuucaccauccccgcgaacagcgacgccuuccuccccugcgaggccguggggaacccgcugcccaccauccacuggacccgcgugcccuccggccuggaccucagcaagcggaagcagaacucccgcguccaggugcugcccaacggcacgcugagcauccagcggguggagauccaggaccgcgggcaguaccugugcuccgccagcaaccucuucggcaccgaccaccuccacgucacccuguccguggugagcuacccgccccgcauccucgagcggcgcaccaaggagaucacgguccacagcggguccaccguggagcugaagugccgggcggagggccgccccagccccaccgugaccuggauccuggccaaccagacggucguguccgagagcucccaggggagccggcaggccguggucaccguggacggcacccucgugcugcacaaccuguccaucuacgaccgcggcuucuacaagugcgucgccagcaaccccggcgggcaggacucccuccuggugaagauccaggugaucgccgcgccgcccgucauccuggagcagcggcgccaggugaucguggggaccuggggcgagagccucaagcugcccugcacggccaaggggaccccgcagcccuccgucuacugggugcugagcgacgggaccgaggugaagccccuccaguucaccaacuccaagcuguuccuguucagcaacggcacgcucuacauccggaaccuggccuccagcgaccgcgggaccuacgagugcaucgccaccuccagcaccggcuccgagcggcgcgucgugaugcugacgauggaggagcgggugaccagcccgcgcaucgaggccgcgagccagaagcggaccgaggucaacuucggggacaagcuccugcugaacugcuccgccaccggcgagcccaagccccagaucauguggcgccuccccagcaaggccgugguggaccagcagcaccgggucggcuccuggauccacguguacccgaacgggagccuguucaucggcuccgugacggagaaggacagcggggucuaccugugcguggcccgcaacaagaugggcgacgaccucauccugaugcacgugucccugcggcucaagcccgccaagaucgaccacaagcaguacuuccgcaagcagguccugcacgggaaggacuuccagguggacugcaaggcgagcggcucccccgugcccgagaucagcuggucccugccggacggcaccaugaucaacaacgccaugcaggccgacgacagcgggcaccggacccgccgcuacacccucuucaacaacggcacgcuguacuucaacaaggucgggguggccgaggagggcgacuacacgugcuacgcgcagaacacccuggggaaggacgagaugaagguccaccucaccgugaucaccgccgcgccccggauccgccaguccaacaagacgaacaagcggaucaaggccggcgacaccgccgugcuggacugcgaggucaccggcgaccccaagcccaagaucuucuggcugcucccgagcaacgacaugaucuccuucagcaucgaccgcuacaccuuccacgcgaacgggucccugacgaucaacaaggugaagcugcucgacagcggcgaguacgugugcgucgcccggaaccccuccggggacgacaccaagauguacaagcuggacguggugagcaagccgccccugaucaacggccucuacaccaaccgcaccgucaucaaggccacggccgugcggcacagcaagaagcacuucgacugccgcgccgagggcaccccgucccccgaggugauguggaucaugcccgacaacaucuuccugaccgcgcccuacuacgggagccggaucaccguccacaagaacggcacgcuggagauccgcaacgugcggcucuccgacagcgccgacuucaucugcguggcccgcaacgagggcggggaguccguccugguggugcagcuggagguccucgagaugcugcggcgcccgaccuuccggaaccccuucaacgagaagaucguggcccagcugggcaagagcaccgcccucaacugcuccguggacggcaacccgccgcccgagaucaucuggauccugcccaacggcacccgcuucagcaacgggccccaguccuaccaguaccugaucgcgagcaacggcuccuucaucaucagcaagacgacccgggaggacgccgggaaguaccgcugcgccgcccggaacaaggucggcuacaucgagaagcucgugauccuggagaucgggcagaagcccgugauccugaccuacgcgcccggcaccgucaagggcaucuccggggagagccucucccugcacugcgugagcgacggcauccccaagcccaacaucaaguggacgaugccguccggguacguggucgaccgcccccagaucaacggcaaguacauccugcacgacaacgggacccucgugaucaaggaggccaccgccuacgaccgcggcaacuacaucugcaaggcccagaacagcgugggccacacccugaucacgguccccgugaugaucguggccuacccgccccggaucaccaaccggccgccccgguccaucgucacccgcaccggggcggccuuccagcugcacugcguggcccucggcgugcccaagcccgagaucacgugggagaugcccgaccacagccugcugagcaccgccuccaaggagcggacccacgggagcgagcagcuccaccuccagggcacccuggucauccagaacccccagacguccgacagcgggaucuacaagugcaccgccaagaacccccucggcuccgacuacgcggccaccuacauccaggugaucuga

SEQ ID NO: 31493 - RNA, 1296 nt, Artificial Sequence
  derived and/or modified sequence opt1 from IGSF11__Homo_sapiens__NP_001015887
augaccagccagcgcagcccccuggccccgcuccugcugcucucccugcacggcguggccgcgucccuggaggucagcgagucccccgggagcauccagguggcccggggccagcccgccgugcuccccugcaccuucacgaccuccgccgcccugaucaaccugaacgucaucuggauggugaccccgcucagcaacgcgaaccagcccgagcaggucauccuguaccagggcgggcagauguucgacggggcgccccgcuuccacggccgggugggcuucaccgggacgaugcccgccaccaacguguccaucuucaucaacaacacccagcugagcgacaccggcacguaccagugccucgugaacaaccugccggacaucgggggccgcaacaucggggucaccggccugaccgugcucgugccgcccuccgcgccccacugccagauccagggcagccaggacaucggguccgacgucauccugcugugcagcuccgaggagggcaucccccggcccaccuaccucugggagaagcuggacaacacgcugaagcucccgcccaccgccacccaggaccaggugcaggggaccgugacgauccgcaacaucagcgcccuguccagcggccuguaccagugcgucgccuccaacgccaucggcaccagcacgugccuccuggaccuccaggugaucagcccccagccccggaacaucgggcucaucgccggcgccaucgggaccggcgccgugaucaucaucuucugcaucgcccugauccugggggccuucuucuacuggcgcuccaagaacaaggaggaggaggaggaggagauccccaacgagauccgggaggacgaccugcccccgaagugcagcuccgccaaggcguuccacaccgagaucagcuccagcgacaacaacacccugaccuccagcaacgccuacaacucccgcuacuggagcaacaaccccaagguccaccggaacaccgaguccgugagccacuucuccgaccugggccagagcuucuccuuccacagcggcaacgccaacauccccuccaucuacgccaacgggacgcaccucgugcccggccagcacaagacccuggucgugaccgccaaccgcgggagcuccccgcaggucaugagccggagcaacggcuccgugagccgcaagccccggccgccccacacccacuccuacacgaucagccacgcgacccuggagcgcaucggggccgugcccgucauggugcccgcccagucccgggccggcagccucguguga

SEQ ID NO: 31494 - RNA, 4026 nt, Artificial Sequence
  derived and/or modified sequence opt1 from IGSF1__Homo_sapiens__NP_001164432
augacccuggaccgccccggcgagggggccaccaugcucaagacguucaccgugcugcuguucugcauccggaugagccucggcaugaccuccaucgucauggacccgcagcccgagcuguggaucgagagcaacuacccccaggcccccugggagaacaucacccuguggugccgcuccccgagccggaucuccagcaaguuccuccugcugaaggacaagacgcagaugaccuggauccgccccucccacaagaccuuccaggugagcuuccucaucggggcgcugaccgaguccaacgccggccuguaccggugcugcuacuggaaggagacgggguggagcaagcccuccaaggugcucgagcuggaggcccccggccagcugccgaagcccaucuucuggauccaggccgagacccccgcccuccccggcugcaacgucaacauccugugccacggguggcugcaggaccucguguucaugcuguucaaggagggcuacgcggagccgguggacuaccagguccccaccgggaccauggccaucuucagcaucgacaaccugacgcccgaggacgagggcguguacaucugccgcacccacauccagaugcuccccacccugugguccgagccgagcaacccccugaagcucguggucgccgggcuguaccccaagcccacccugacggcccacccgggccccaucauggcgcccggcgagucccucaaccugcggugccaggggcccaucuacggcaugaccuucgcccugaugcgcguggaggaccucgagaaguccuucuaccacaagaagaccaucaagaacgaggccaacuucuucuuccagagccugaagauccaggacaccgggcacuaccugugcuucuacuacgacgccagcuaccggggcucccuccugagcgacgugcugaagaucugggucacggacaccuucccgaagaccuggcuccuggcccgccccagcgcgguggugcagaugggccagaacgucucccugcggugccgcgggcccguggacggcguggggcucgcccuguacaagaagggcgaggacaagccccugcaguuccucgacgccaccagcaucgacgacaacacguccuucuuccugaacaacgucaccuacagcgacaccgggaucuacuccugccacuaccugcucaccuggaagacgagcauccggaugccgucccacaacaccguggagcugaugguggucgacaagccgcccaagcccagccuguccgccuggcccagcaccguguucaagcucggcaaggccaucacccugcagugccgcgugucccaccccguccuggaguucagccuggagugggaggagcgggagacguuccagaaguucuccgugaacggcgacuucaucaucagcaacgucgacgggaagggcaccgggaccuacuccugcagcuaccgcguggagacccaccccaacaucuggucccaccggagcgagccgcucaagcugaugggccccgcgggguaccugacguggaacuacgugcucaacgaggccauccgccugucccugaucaugcagcucgucgcccugcugcucguggugcuguggauccgguggaagugccgccggcugcgcauccgcgaggccuggcuccugggcaccgcccagggcgucaccaugcuguucaucgugaccgcgcuccugugcugcgccaucagcuucgccgggcugugcaacggcgugcucaucgaggagaccgagaucgucaugcccacgcccaagccggagcugugggccgagaccaacuucccccuggcccccuggaagaaccucacccuguggugccggagccccuccgggagcaccaaggaguucgugcugcucaaggacggcacgggguggaucgcgacccgcccggccuccgagcagguccgggccgccuucccccugggcgcgcugacccagagccacaccggcuccuaccacugccacagcugggaggagauggccguguccgagcccagcgaggcccucgagcugguggggacggacauccugcccaagccggugaucuccgccagccccaccauccgcggccaggagcuccagcugcggugcaagggguggcuggccggcaugggcuucgcgcucuacaaggagggggagcaggagcccguccagcagcugggcgccguggggcgcgaggccuucuucaccauccagcggauggaggacaaggacgagggcaacuacuccugccgcacccacacggagaagcggcccuucaaguggagcgagccguccgagccccuggagcucgugaucaaggagauguaccccaagcccuucuucaagaccugggccagcccggucgugacccccggggcccgcgugaccuucaacugcuccacgccccaccagcacaugagcuucauccuguacaaggacggcuccgagaucgcgagcagcgaccgguccugggccagcccgggcgccuccgccgcccacuuccugaucaucagcgucgggaucggcgacgggggcaacuacuccugccgcuacuacgacuucagcaucugguccgagcccagcgaccccguggagcucguggucaccgaguucuaccccaagccgacccugcuggcgcagcccgggcccgugguguuccccggcaaguccgucauccuccggugccagggcaccuuccaggggaugcgcuucgcccugcugcaggagggcgcccacgugccgcuccaguuccggagcguguccgggaacagcgccgacuuccugcugcacacggucggcgcggaggacuccgggaacuacagcugcaucuacuacgagaccaccauguccaaccgcggcagcuaccucuccaugccccugaugaucugggugaccgacacguuccccaagcccuggcuguucgccgagccgagcuccgugguccccaugggccagaacgugacccucuggugccgggggcccgugcacggcgucggguacauccugcacaaggagggcgaggccaccagcaugcagcugugggggagcaccuccaacgacggcgccuuccccaucacgaacaucagcggcaccuccauggggcgcuacagcugcugcuaccacccggacuggaccuccagcaucaagauccagcccuccaacacccucgagcugcuggugacgggccuccugcccaagcccagccugcucgcccagccggggcccaugguggcgcccggcgagaacaugacccugcagugccagggcgagcugcccgacuccaccuucguccuccugaaggagggggcccaggagccgcuggagcagcagcggcccagcggcuaccgcgccgacuucuggaugcccgccgugcgcggggaggacuccggcaucuacagcugcguguacuaccucgacuccacccccuucgccgcgagcaaccacuccgacagccuggagaucugggucacggacaagccgcccaagcccucccugagcgccuggccguccaccauguucaagcucgggaaggacaucacccugcagugccggggcccccugcccggcguggaguucgugcucgagcacgacggggaggaggcgccccagcaguucagcgaggacggcgacuucgucaucaacaacguggaggggaagggcaucgggaacuacagcugcuccuaccgccugcaggccuacccggacaucuggagcgagcccuccgacccccuggagcucgugggcgccgccggccccgucgcccaggagugcaccguggggaacaucgugcggagcucccugaucgucguggucgugguggcccugggcgucgugcucgccaucgaguggaagaaguggccgcgccugcggacccgcgggagcgagacggacggccgggaccagaccaucgcgcuggaggagugcaaccaggagggggagcccggcacccccgccaacucccccagcuccaccagccagcgcaucuccguggagcucccgguccccaucuga

SEQ ID NO: 31495 - RNA, 1224 nt, Artificial Sequence
  derived and/or modified sequence opt1 from IGSF5__Homo_sapiens__NP_001073913
augggccagaaggagcgcagcaccgccgacacccugcccgaccucgaggaguggaaguccgccgcggggcugcggugguggcagacggccguggucgacggcagcggguccggcaacgaggugaucgaggggccgcagaacgcccgcgugcugaagggcagccaggcccgguucaacugcaccgucucccagggcuggaagcucaucaugugggcccugagcgacaugguggugcuguccguccgccccauggagcccaucaucaccaacgaccgguucaccagccagcgcuacgaccagggcggcaacuucacguccgagaugaucauccacaacguggagcccagcgacuccgggaacauccggugcagccuccagaacucccgccugcacggcagcgcguaccugaccgugcaggucaugggggagcuguucaucccguccgugaaccucguggucgccgagaacgagcccugcgaggugaccugccugcccagccacuggacccggcuccccgacaucuccugggagcugggccugcucgugagccacuccagcuacuacuucgucccggagcccagcgaccugcaguccgccgugagcauccuggcccucacgccccaguccaacggcacccugaccugcguggcgaccuggaagucccugaaggcccgcaagagcgccacggucaaccucaccgugauccggugcccccaggacaccgggggcgggaucaacaucccgggcgugcugagcucccugcccagccucggcuucucccugcccaccugggggaaggucggccuggggcucgccggcacgaugcugcugacccccacgugcacccucaccauccgcugcugcugcugccggcgccggugcugcgggugcaacugcugcugccgcugcugcuucugcugccggcgcaagcggggcuuccgcauccaguuccagaagaaguccgagaaggagaagaccaacaaggagaccgagaccgagagcggcaacgagaacagcggguacaacuccgacgagcagaagacgaccgacaccgccagccugccgcccaaguccugcgagagcuccgaccccgagcagcggaacagcuccugcgggcccccgcaccagcgcgcggaccagcgcccgccccggcccgccagccacccccaggccagcuucaaccuggccucccccgagaaggugagcaacaccacgguggucuga

SEQ ID NO: 31496 - RNA, 726 nt, Artificial Sequence
  derived and/or modified sequence opt1 from IGSF6__Homo_sapiens__NP_005840
augggcaccgccagccgcuccaacaucgcccggcaccuccagaccaaccugauccuguucugcgugggggcggucggcgccugcacgcugagcgugacccagcccugguaccucgagguggacuacacccacgaggccgucaccaucaagugcacguucuccgccaccgggugcccgagcgagcagccgaccugccugugguuccgcuacggcgcccaccagcccgagaaccugugccucgacgggugcaaguccgaggcggacaaguucaccgugcgggaggcccugaaggagaaccaggugagccugacggucaaccgcgugaccuccaacgacagcgccaucuacaucugcggcaucgccuuccccuccgugcccgaggcgcgggccaagcagaccggcgggggcaccacgcucgucgugcgcgagaucaagcugcugagcaaggagcuccgguccuuccugaccgcccuggugagccuccuguccgucuacgugaccggggugugcgucgccuucauccugcucagcaaguccaagagcaacccccugcgcaacaaggagaucaaggaggacucccagaagaagaaguccgcccggcgcaucuuccaggagaucgcgcaggagcuguaccacaagcggcacguggagaccaaccagcagagcgagaaggacaacaacacguacgagaaccgccgggugcucagcaacuacgagcgccccuga

SEQ ID NO: 31497 - RNA, 1842 nt, Artificial Sequence
  derived and/or modified sequence opt1 from IGSF8__Homo_sapiens__NP_001193594
augggcgcccugcgccccacccuccugccgcccagccugccccuccugcugcuccugaugcuggggaugggcugcugggcccgggaggugcucguccccgaggggccgcuguaccgcguggcgggcaccgccguguccaucagcugcaacgucaccggguacgagggccccgcccagcagaacuucgagugguuccuguaccggcccgaggcccccgacaccgcccucggcaucguguccaccaaggacacccaguucagcuacgcgguguucaagucccgcgucguggccggggaggugcagguccagcggcugcagggcgacgccguggugcugaagaucgcccgccuccaggcgcaggacgccgggaucuacgagugccacacgccgagcaccgacacccgguaccugggcuccuacagcgggaaggucgagcugcgcgugcuccccgacgugcugcaggucuccgccgccccgcccggcccccggggccgccaggcccccaccagcccgccccggaugacggugcacgaggggcaggagcuggcgcucggcugccuggcccgcaccuccacccagaagcacacccaccuggccgugagcuucgggcgguccguccccgaggcccccgugggccgcagcacgcuccaggagguggucggcauccgguccgaccuggccguggaggcgggggcccccuacgccgagcgccuggccgccggcgagcuccggcuggggaaggagggcaccgaccgcuaccggaugguggucgggggcgcgcaggccggcgacgccgggaccuaccacugcaccgccgccgaguggauccaggaccccgacggcagcugggcgcagaucgccgagaagcgcgccgugcuggcccacgucgacgugcagacgcucuccagccagcuggcggugaccgucgggccgggcgagcggcgcaucgggcccggcgagccccuggagcuccugugcaacguguccggcgcccugcccccggccgggcgccacgccgccuacagcgugggcugggagauggcgcccgccggggcccccggccccgggcggcucgucgcccagcuggacaccgagggcgugggcagccuggggccgggcuacgaggggcgccacaucgccauggagaagguggcgucccggaccuaccgccuccggcuggaggccgcccgccccggcgacgccggcacguaccggugccuggccaaggcguacguccgcgggagcggcacccggcuccgcgaggccgccuccgcccggagccgcccccugccggugcacgugcgggaggagggggucgugcuggaggcgguggccuggcucgccggcgggaccgucuaccgcggcgagaccgccucccugcugugcaacaucagcgugcggggcgggccgcccggccuccgccuggccgcguccugguggguggagcggcccgaggacggggagcugagcuccguccccgcccagcuggugggcggggugggccaggacggcgucgccgagcucggggugcgccccggcgggggccccgugagcgucgagcugguggggccccggucccaccgccugcgccuccacagccugggcccggaggacgagggcguguaccacugcgcccccuccgccuggguccagcacgcggacuacagcugguaccaggccggguccgcccggagcggccccgugacgguguaccccuacaugcacgcccuggacacccucuucgucccgcugcugguggggaccggcguggcccucgucaccggggcgacggugcugggcaccaucacgugcugcuucaugaagcgccugcggaagcgcuga

SEQ ID NO: 31498 - RNA, 1236 nt, Artificial Sequence
  derived and/or modified sequence opt1 from IHH__Homo_sapiens__NP_002172
augagccccgcccgccugcggccgcgccuccacuucugccuggugcugcuccugcugcucgucgugcccgccgcguggggcugcgggcccggccggguggucgggucccgccggcggcccccgcgcaagcuggugccccuggccuacaagcaguucagccccaacgugcccgagaagacccucggcgccuccgggcgcuacgagggcaagaucgcccggagcuccgagcgcuucaaggagcugaccccgaacuacaaccccgacaucaucuucaaggacgaggagaacacgggcgccgaccggcugaugacccagcgcugcaaggaccggcucaacagccuggcgaucuccgucaugaaccaguggcccggggugaagcugcgcgugaccgagggcugggacgaggacgggcaccacagcgaggagucccuccacuacgagggccgggccgucgacaucaccacgagcgaccgcgaccggaacaaguacgggcugcuggcccgccucgccguggaggcgggcuucgacuggguguacuacgaguccaaggcccacguccacugcagcgugaaguccgagcacagcgccgccgccaagaccggcgggugcuuccccgcgggcgcccaggugcggcuggaguccggggcccgcgucgcccugagcgccgugcggccgggcgaccgcgugcucgcgaugggcgaggacgggucccccaccuucagcgacguccugaucuuccuggaccgcgagccccaccggcuccgcgccuuccaggugaucgagacccaggacccgccccggcgccuggcccugacgcccgcccaccuccuguucaccgccgacaaccacaccgagcccgcggcccgguuccgcgccaccuucgccucccacgugcagcccggccaguacguccugguggccggggugccgggccuccagcccgcgcgggucgccgccgugagcacgcacgucgcccugggggcguacgcgccccugaccaagcacggcacccucgugguggaggacgucguggccagcugcuucgccgccguggccgaccaccaccuggcccagcuggccuucuggccccuccgccuguuccacucccuggccuggggcagcuggaccccgggggagggcguccacugguacccccagcuccuguaccggcuggggcgccuccugcuggaggagggcuccuuccacccccucgggaugagcggcgccggcuccuga

SEQ ID NO: 31499 - RNA, 3999 nt, Artificial Sequence
  derived and/or modified sequence opt1 from IKBKAP__Homo_sapiens__NP_003631
augcgcaaccugaagcuguuccggacccucgaguuccgcgacauccagggccccgggaacccgcagugcuucagccugcggaccgagcagggcacggugcucaucggguccgagcacggccugaucgaggucgaccccgugagccgcgaggugaagaacgaggucucccugguggccgagggguuccuccccgaggacggcagcggccggaucguggggguccaggaccugcuggaccaggaguccgugugcguggccaccgcgagcggcgacgucauccucugcucccugagcacccagcagcuggagugcgugggguccguggccagcggcaucuccgucaugagcuggucccccgaccaggagcucgugcugcuggccaccgggcagcagacgcucaucaugaugaccaaggacuucgagccgauccuggagcagcagauccaccaggacgacuucggcgagagcaaguucaucaccgugggcugggggcgcaaggagacccaguuccacggcuccgaggggcggcaggccgccuuccagaugcagaugcacgagagcgcgcugcccugggacgaccaccgcccccaggucacguggcggggcgacggccaguucuucgccguguccguggucugccccgagaccggggcccgcaaggugcggguguggaaccgcgaguucgcccuccagagcaccuccgagccggucgcgggccuggggcccgcccuggccuggaagcccagcggcagccucaucgccuccacccaggacaagcccaaccagcaggacaucguguucuucgagaagaacgggcugcugcacggccacuucacgcucccguuccugaaggacgaggugaaggucaacgaccugcucuggaacgccgacagcuccgugcuggcggucuggcuggaggaccuccagcgggaggagagcuccauccccaagaccugcgugcagcuguggaccgugggcaacuaccacugguaccugaagcagagccucuccuucagcacgugcgggaaguccaagaucgucagccugaugugggaccccgugacccccuaccgccugcacgugcucugccagggcuggcacuaccuggccuacgacuggcacuggaccaccgaccgguccgucggggacaacagcuccgaccugagcaacguggccgugaucgacggcaaccgcguccucgugaccguguuccggcagacggucgugccgccgcccaugugcaccuaccagcugcuguucccccaccccgugaaccaggucaccuuccucgcccacccccagaaguccaacgaccuggccgugcuggacgcgagcaaccagaucuccguguacaagugcggggacugccccagcgccgaccccaccgucaagcucggcgccgugggcggguccggcuucaaggugugccugcgcacgccgcaccuggagaagcgguacaagauccaguucgagaacaacgaggaccaggacgucaacccccucaagcuggggcugcugaccuggaucgaggaggacguguuccucgccgugagccacagcgaguucagcccccgcuccgucauccaccaccugaccgccgcguccagcgagauggacgaggagcacggccagcugaacguguccagcuccgccgccguggacggggucaucaucagccucugcugcaacuccaagaccaagagcguggugcugcagcuggccgacggccagaucuucaaguaccucugggagucccccagccuggccaucaagccguggaagaacuccggcggguuccccguccgguuccccuacccgugcacgcagaccgagcuggcgaugaucggcgaggaggagugcgugcucgggcugaccgaccgcugccgcuucuucaucaacgacaucgagguggccagcaacaucaccuccuucgccgucuacgacgaguuccugcuccugacgacccacagccacacgugccagugcuucugccugcgggacgccuccuucaagacccuccaggcgggccugagcagcaaccacgugucccacggcgaggugcugcgcaaggucgagcgggggagccgcaucgugaccguggucccccaggacaccaagcucgugcugcagaugccccggggcaaccuggaggugguccaccaccgcgcccucgugcuggcccagauccggaaguggcuggacaagcucauguucaaggaggccuucgagugcaugcgcaagcugcggaucaaccugaaccucaucuacgaccacaaccccaagguguuccuggggaacgucgagaccuucaucaagcagaucgacuccgugaaccacaucaaccuguucuucaccgagcucaaggaggaggacgugaccaagacgauguacccggcccccgucaccagcuccguguaccugagccgcgaccccgacggcaacaagaucgaccuggugugcgacgcgaugcgggccgucauggaguccaucaacccccacaaguacugccucagcauccugaccucccacgugaagaagaccacgccggagcuggagaucguccuccagaaggugcacgagcugcaggggaacgcccccagcgaccccgacgccguguccgccgaggaggcgcugaaguaccuccugcaccuggucgacgugaacgagcucuacgaccacagccugggcaccuacgacuucgaccuggugcucauggucgccgagaagucccagaaggaccccaaggaguaccugccguuccugaacacccucaagaagauggagaccaacuaccagcgcuucacgaucgacaaguaccugaagcgguacgagaaggccaucggccaccugagcaagugcgggcccgaguacuuccccgagugccucaaccugaucaaggacaagaaccuguacaacgaggcccucaagcuguacucccccagcucccagcaguaccaggacaucagcaucgccuacggcgagcaccugaugcaggagcacauguacgagccggcggggcucauguucgcccgcugcggcgcccacgagaaggcccuguccgcguuccugaccugcgggaacuggaagcaggcccucugcguggccgcccagcugaacuucaccaaggaccagcuggugggccucggccggacccuggccgggaagcuggucgagcagcgcaagcacaucgacgcggccauggugcucgaggagugcgcccaggacuacgaggaggccgugcugcugcuccuggagggcgccgcgugggaggaggcccugcggcucgucuacaaguacaaccgccuggacaucaucgagacgaacgugaagcccagcauccuggaggcccagaagaacuacauggccuuccucgacagccagaccgccaccuucucccggcacaagaagcgccugcuggugguccgcgagcucaaggagcaggcgcagcaggccgggcuggacgacgaggugccccacggccaggagagcgaccuguucuccgagaccagcuccguggucagcggguccgagaugagcggcaaguacucccacagcaacucccggaucagcgcccgcuccagcaagaaccggcgcaaggccgagcggaagaagcacucccucaaggagggcagcccccuggaggaccuggcgcuccuggaggcccuguccgagguggugcagaacacggagaaccucaaggacgaggucuaccacauccugaaggugcuguuccucuucgaguucgacgagcaggggcgcgagcugcagaaggccuucgaggacacccugcagcucauggagcggagccugccggagaucuggacccugaccuaccagcagaacuccgccacgcccgugcugggccccaacagcaccgccaacagcaucauggcguccuaccagcagcagaagaccagcguccccgugcucgacgccgagcuguucaucccgcccaagaucaaccgccggacccaguggaagcugucccuccuggacuga

SEQ ID NO: 31500 - RNA, 2265 nt, Artificial Sequence
  derived and/or modified sequence opt1 from IKBKB__Homo_sapiens__NP_001177649
auguucagcggcgggugccacucccccggcuucgggcgcccgagccccgccuuccccgcccccggcuccccgccgcccgcgccccggcccugccgccaggagaccggggagcagaucgccaucaagcagugccggcaggagcugagcccccgcaaccgggagcgcuggugccucgagauccagaucaugcggcgccugacccaccccaacguggucgccgcccgggacgugcccgagggcaugcagaaccuggccccgaacgaccucccccugcuggcgauggaguacugccagggcggggaccuccgcaaguaccugaaccaguucgagaacugcugcggccugcgggagggggccauccucacgcugcuguccgacaucgccagcgcccuccgcuaccugcacgagaaccggaucauccaccgcgaccugaagcccgagaacaucgugcuccagcagggcgagcagcggcugauccacaagaucaucgaccugggguacgcgaaggagcucgaccagggcucccugugcaccagcuucgucggcacccugcaguaccucgcccccgagcugcuggagcagcagaaguacaccgugacgguggacuacugguccuucgggacccucgccuucgagugcaucaccggcuuccgcccguuccugcccaacuggcagcccguccaguggcacagcaaggugcggcagaaguccgagguggacaucgucgugagcgaggaccugaacgggaccgugaaguucuccagcucccuccccuacccgaacaaccugaacagcguccuggccgagcgccucgagaaguggcugcagcugaugcucauguggcacccccggcagcgcggcacggaccccaccuacggccccaacgggugcuucaaggcccuggacgacauccugaaccucaagcuggugcacauccugaacauggugaccggcaccauccacacguacccggucaccgaggacgagucccuccagagccugaaggcgcggauccagcaggacaccgggauccccgaggaggaccaggagcugcuccaggaggccggccuggcccugauccccgacaagcccgccacccagugcaucuccgacgggaagcucaacgagggccacacgcuggacauggaccugguguuccucuucgacaacagcaagaucaccuacgagacccagaucagcccgcgcccccagcccgaguccgugagcugcauccugcaggagccgaagcgcaaccuggccuucuuccagcugcggaaggucuggggccagguguggcacuccauccagacccucaaggaggacugcaaccgccugcagcaggggcagcgggcggccaugaugaaccugcuccgcaacaacagcugccuguccaagaugaagaacagcauggccuccaugagccagcagcugaaggccaagcucgacuucuucaagacguccauccagaucgaccuggagaaguacagcgagcagaccgaguucggcaucaccuccgacaagcugcuccuggccuggcgggagauggagcaggcgguggagcugugcgggcgcgagaacgaggucaagcuccugguggagcggaugauggcccugcagaccgacaucguggaccuccagcgcagccccaugggccggaagcagggcgggacgcuggacgaccuggaggagcaggcccgcgagcucuaccggcgccugcgggagaagccccgcgaccagcggaccgagggcgacucccaggagaugguccgccugcuccugcaggccauccagagcuucgagaagaaggugcgggucaucuacacccagcuguccaagaccguggugugcaagcagaaggcccucgagcugcugcccaaggucgaggagguggugagccucaugaacgaggacgagaagacggucgugcgccugcaggagaagcggcagaaggagcuguggaaccuccugaagaucgcgugcuccaaggugcgcgggccggucagcggcucccccgacagcaugaacgccagccgccugucccagcccgggcagcucaugagccagcccuccaccgccagcaacucccugccggagcccgccaagaaguccgaggagcugguggcggaggcccacaaccucugcacccugcuggagaacgccauccaggacaccgugcgggagcaggaccagagcuucacggcccucgacuggagcuggcugcagaccgaggaggaggagcacuccugccuggagcaggccagcuga

SEQ ID NO: 31501 - RNA, 1896 nt, Artificial Sequence
  derived and/or modified sequence opt1 from IKBKE__Homo_sapiens__NP_001180250
auggaguacugcagcuccggcagccugcucuccgugcuggagagccccgagaacgccuucgggcugccggaggacgaguuccucgucgugcugcgcugcguggucgccggcaugaaccaccuccgggagaacgggaucgugcaccgcgacaucaagcccggcaacaucaugcggcuggugggggaggagggccaguccaucuacaagcugaccgacuucggcgccgcccgcgagcuggacgacgacgagaaguucgucagcguguacgggaccgaggaguaccuccaccccgacauguacgagcgggccgugcugcgcaagccccagcagaaggccuucggcgucacgguggaccugugguccaucggggugacccucuaccacgccgcgaccggcagccugccguucauccccuucgggggcccccggcgcaacaaggagaucauguaccggaucaccacggagaagcccgccggcgccaucgccggggcgcagcgccgggagaacggcccgcuggagugguccuacacccuccccaucacgugccagcugagccuggggcuccagucccagcugguccccauccuggccaacauccucgagguggagcaggccaagugcuggggcuucgaccaguucuucgccgagaccagcgacauccugcagcgcguggucgugcacguguucucccugagccaggccguccuccaccacaucuacauccacgcgcacaacaccaucgccaucuuccaggaggccgugcacaagcagaccuccguggcgccccggcaccaggaguaccuguucgagggccaccugugcguccucgagccgagcguguccgcccagcacaucgcccacaccaccgccagcagcccccugacgcuguucagcaccgccauccccaaggggcucgccuuccgcgaccccgcccuggacgugccgaaguucguccccaagguggaccugcaggcggacuacaacaccgccaagggcguccucggggccggcuaccaggcccugcggcuggcccgcgcgcuccuggacgggcaggagcugauguuccggggccuccacugggugauggaggugcugcaggcgaccugccgccggacgcuggaggucgcccgcaccagccuccuguaccuguccagcucccucggcaccgagcgguucagcuccguggccgggacccccgagauccaggagcugaaggccgccgccgagcugcgcagccgccuccggacgcuggccgaggugcugucccgcugcagccagaacaucaccgagacccaggagucccugagcucccucaaccgggagcuggucaagagccgcgaccaggugcacgaggaccgguccauccagcagauccagugcugccuggacaagaugaacuucaucuacaagcaguucaagaagucccgcaugcggcccggccucggguacaacgaggagcagauccacaagcuggacaaggugaacuucucccaccuggccaagcgccuccugcaggucuuccaggaggagugcgugcagaaguaccaggcgagccuggugacccacggcaagcggaugcgcgucgugcacgagacgcggaaccaccuccgccugguggggugcuccgucgccgccugcaacaccgaggcccagggcgugcaggagagccuguccaagcuccuggaggagcugagccaccagcuccugcaggaccgggccaagggcgcgcaggccagcccgccgcccaucgcccccuaccccucccccacccgcaaggaccugcuccugcacaugcaggagcugugcgaggggaugaagcuccuggccagcgaccugcucgacaacaaccggaucaucgagcgccugaaccgggugcccgcgcccccggacgucuga

SEQ ID NO: 31502 - RNA, 1464 nt, Artificial Sequence
  derived and/or modified sequence opt1 from IKBKG__Homo_sapiens__NP_001093326
auggcccuggugauccaggucggcaagcuccgcccccgggaggugcgcaccccgcagaccaucaaccccagccuguuccccucccugcccgugaagcucagcuccaucaucgaggucccgagcgggggcgagcggugcugcucccgccggacgcugguguacaaggcccgcgcguucuggaagggggcgccccugcccugcuggaugaaccggcaccucuggaagucccagcugugcgagauggugcagcccagcggcgggccggccgccgaccaggacguccugggcgaggagagcccccucggcaagcccgccaugcugcaccuccccuccgagcagggggccccggagacccugcagcgcugccuggaggagaaccaggagcugcgggacgccauccgccagagcaaccagauccuccgggagcgcugcgaggagcugcugcacuuccaggccucccagcgggaggagaaggaguuccucaugugcaaguuccaggaggcccgcaagcugguggagcggcugggccucgagaagcuggaccugaagcgccagaaggagcaggcgcuccgggagguggagcaccugaagcgcugccagcagcagauggccgaggacaaggccagcgucaaggcccaggugaccucccugcucggggagcugcaggagagccagucccggcuggaggccgcgaccaaggagugccaggcccucgagggccgcgcccgggccgccagcgagcaggcgcgccagcuggaguccgagcgcgaggcccugcagcagcagcacagcgugcaggucgaccagcuccggaugcaggggcaguccguggaggccgcccugcgcauggagcggcaggccgcgagcgaggagaagcgcaagcuggcccagcuccagguggccuaccaccagcuguuccaggaguacgacaaccacaucaagagcuccgucgugggcagcgagcggaagcgcggcaugcagcuggaggaccucaagcagcagcugcagcaggccgaggaggcccugguggcgaagcaggaggucaucgacaagcucaaggaggaggccgagcagcacaagaucgugauggagacggugcccguccugaaggcccaggccgacaucuacaaggcggacuuccaggccgagcggcaggcccgcgagaagcuggccgagaagaaggagcuccugcaggagcagcuggagcagcuccagcgggaguacuccaagcugaaggccagcugccaggaguccgcgcgcaucgaggacaugcggaagcgccacguggaggugagccaggcgccccugcccccggcccccgccuaccuguccagcccccucgcccugcccucccagcggcgcagcccgcccgaggagccgcccgacuucugcugccccaagugccaguaccaggcccccgacauggacacccugcagauccacgucauggagugcaucgaguga

SEQ ID NO: 31503 - RNA, 1674 nt, Artificial Sequence
  derived and/or modified sequence opt1 from IK__Homo_sapiens__NP_006074
augcccgagcgcgacagcgagccguucuccaacccccuggcccccgacggccacgacguggacgacccccacagcuuccaccaguccaagcucaccaacgaggacuuccggaagcugcugaugaccccgcgcgccgcgcccacgagcgccccgcccuccaagagccggcaccacgagaugccccgcgaguacaacgaggacgaggaccccgccgcccggcgccggaagaagaaguccuacuacgccaagcuccgccagcaggagaucgagcgggagcgcgagcuggcggagaaguaccgggaccgcgccaaggagcggcgcgacggggucaacaaggacuacgaggagaccgagcugaucagcaccaccgccaacuaccgggccgugggccccacggcggaggccgacaaguccgccgccgagaagcgccggcagcucauccaggagagcaaguuccucgggggcgacauggagcacacccaccuggugaaggggcucgacuucgcccugcugcagaagguccgcgcggagaucgccuccaaggagaaggaggaggaggagcucauggagaagccccagaaggagaccaagaaggacgaggacccggagaacaagaucgaguucaagacccggcugggccgcaacguguaccggaugcuguucaagagcaaggccuacgagcgcaacgagcuguuccugcccggccgcauggccuacguggucgaccuggacgacgaguacgccgacacggacauccccaccacccucauccgguccaaggcggacugccccaccauggaggcccagacgacccugaccaccaacgacaucgugaucagcaagcugacgcagauccucuccuaccugcgccaggggacccggaacaagaagcugaagaagaaggacaagggcaagcucgaggagaagaagccgcccgaggccgacaugaacaucuucgaggacaucggggacuacgugcccagcaccaccaagacgccccgcgacaaggagcgggagcgcuaccgggagcgcgagcgggaccgcgagcgggaccgcgaccgggaccgcgagcgggagcgcgagcgggaccgcgagcgggagcgcgagcgcgaccgggagcgcgaggaggagaagaagcggcacuccuacuucgagaagccgaaggucgacgacgagcccauggacguggacaagggccccgggagcaccaaggagcugaucaaguccaucaacgagaaguucgccggcagcgccggcugggaggggaccgagagccugaagaagcccgaggacaagaagcagcucggcgacuucuucgggauguccaacagcuacgcggagugcuacccggccaccauggacgacauggccguggacuccgacgaggaggucgacuacagcaagauggaccagggcaacaagaagggcccccuggggcgcugggacuucgacacgcaggaggaguacuccgaguacaugaacaacaaggaggcccugcccaaggccgcguuccaguacggcaucaagaugagcgaggggcggaagacccgccgguucaaggagaccaacgacaaggccgagcucgaccgccaguggaagaagaucuccgccaucaucgagaagcggaagaagauggaggccgacggcguggaggugaagcgccccaaguacuga

SEQ ID NO: 31504 - RNA, 1299 nt, Artificial Sequence
  derived and/or modified sequence opt1 from IKZF1__Homo_sapiens__NP_001207697
auggacgccgacgagggccaggacaugagccagguguccgggaaggagagcccgccggucuccgacacccccgacgagggcgacgagcccaugcccaucccggaggaccugagcaccacguccgggggccagcagagcuccaagagcgaccgcgugguggccuccaacgucaagguggagacccagagcgacgaggagaacgggcgggcgugcgagaugaacggcgaggagugcgccgaggaccuccgcaugcuggacgccuccggcgagaagaugaacgggagccaccgggaccagggcuccagcgcccuguccggggugggcgggauccgccuccccaacggcaagcugaagugcgacaucugcggcaucaucugcaucgggcccaacguccugauggugcacaagcggagccacaccggcgagcgccccuuccagugcaaccagugcggggccuccuucacccagaagggcaaccuccugcggcacaucaagcugcacagcggcgagaagccguucaagugccaccucugcaacuacgcgugccgccggcgcgacgcccugacggggcaccuccggacccacuccggcgacaaggggcugagcgacacccccuacgacagcuccgccagcuacgagaaggagaacgagaugaugaagucccacgugauggaccaggccaucaacaacgcgaucaacuaccugggcgccgagagccugcgcccccucguccagaccccgcccgggggcuccgagguggugcccgucaucagccccauguaccagcugcacaagccccuggccgagggcacgccccgguccaaccacagcgcccaggacuccgccguggagaaccuccugcugcucagcaaggcgaagcuggugcccuccgagcgcgaggccagccccuccaacagcugccaggacuccaccgacaccgagagcaacaacgaggagcagcgguccgggcugaucuaccucaccaaccacaucgcgccccacgcccgcaacggccugagccugaaggaggagcaccgggccuacgaccuccugcgcgccgccuccgagaacagccaggacgcccugcgggucgugagcacguccggggagcagaugaagguguacaagugcgagcacugccgcguccucuuccuggaccacgugauguacaccauccacaugggcugccacggguuccgggacccguucgagugcaacaugugcggcuaccacagccaggaccgcuacgaguucuccagccacaucacccgcggcgagcaccgguuccacauguccuga

SEQ ID NO: 31505 - RNA, 1503 nt, Artificial Sequence
  derived and/or modified sequence opt1 from IKZF2__Homo_sapiens__NP_001072994
auggagaccgaggccaucgacggcuacaucacgugcgacaacgagcugagccccgagcgggagcacuccaacauggccaucgaccucaccagcuccaccccgaacgggcagcacgcgagccccucccacaugaccagcaccaacuccgugaagcuggagaugcagagcgacgaggagugcgaccggaagccccugucccgcgaggacgagauccggggccacgacgaggggagcucccucgaggagccccugaucgagagcuccgaggucgccgacaaccgcaaggugcaggagcugcagggcgagggcgggauccggcucccgaacggcgagcgccccuuccacugcaaccagugcggggccagcuucacgcagaagggcaaccugcugcggcacaucaagcuccacuccggggagaagcccuucaagugccccuucugcagcuacgccugccgccggcgcgacgcccugaccggccaccuccggacccacuccguggggaagccgcacaagugcaacuacugcggccgcagcuacaagcagcgguccagccucgaggagcacaaggagcgcugccacaacuaccugcagaacgucagcauggaggcggccggccaggugaugucccaccacgugccgcccauggaggacugcaaggagcaggagcccaucauggacaacaacaucagccugguccccuucgagcggcccgccgugaucgagaagcucaccgggaacaugggcaagcgcaaguccagcacgccccagaaguucgugggggagaagcugaugcgguucuccuaccccgacauccacuucgacaugaaccugaccuacgagaaggaggccgagcucaugcagagccacaugauggaccaggcgaucaacaacgccaucaccuaccugggcgccgaggcccugcacccgcucaugcagcacccgcccuccaccaucgccgaggucgcgcccgugaucagcuccgccuacagccagguguaccaccccaaccgcaucgagcggcccaucucccgcgagacggccgacagccacgagaacaacauggacggccccaucucccugauccggcccaagagccgcccgcaggagcgcgaggccucccccagcaacuccugccuggacagcaccgacuccgagagcagccacgacgaccaccaguccuaccaggggcaccccgcccucaaccccaagcggaagcagagcccggcguacaugaaggaggacgucaaggcccuggacaccaccaaggcccccaagggcucccugaaggacaucuacaagguguucaacggggagggcgagcagauccgcgccuucaagugcgagcacugccgggugcuguuccuggaccacgucauguacacgauccacauggggugccacggcuaccgcgacccccuggagugcaacaucugcggcuaccggagccaggaccgcuacgaguucuccagccacaucgugcgcggggagcacaccuuccacuga

SEQ ID NO: 31506 - RNA, 1428 nt, Artificial Sequence
  derived and/or modified sequence opt1 from IKZF3__Homo_sapiens__NP_001244337
auggaggacauccagaccaacgccgagcugaaguccacccaggagcagagcgugcccgccgacgacagcaugaaggucaaggacgaguacuccgagcgcgacgagaacgugcucaagagcgagccgaugggcaacgcggaggagcccgagauccccuacuccuacagccgggaguacaacgaguacgagaacaucaagcuggagcgccacguggucuccuucgacagcucccggcccacgagcgggaagaugaacugcgacgugugcggccuguccugcaucagcuucaacgugcucaugguccacaagcgcucccacaccggggagcggccguuccagugcaaccagugcggcgccagcuucacccagaaggggaaccugcugcgccacaucaagcuccacaccggcgagaagcccuucaagugccaccugugcaacuacgccugccagcggcgcgacgcccugacgggccaccuccggacccacuccguggagaagcccuacaagugcgaguucugcgggcgcagcuacaagcagcgguccagccuggaggagcacaaggagcgcugccggaccuuccugcaguccaccgaccccggcgacacggccagcgcggaggcccgccacaucaaggccgagauggggagcgagcgggcccucgugcuggaccgccuggcguccaacgucgccaagcgcaagagcuccaugccgcagaaguucaucggcgagaagcggcacugcuucgacgugaacuacaacagcuccuacauguacgagaaggagagcgagcucauccagacccggaugauggaccaggccaucaacaacgccaucuccuaccugggggccgaggcgcugcgcccccucgugcagaccccgcccgcccccaccagcgagaugguccccgugaucuccagcauguaccccaucgcccugacgcgggccgagauguccaacggcgcgccccaggagcuggagaagaaguccauccaccucccggagaaguccgugcccagcgagcgcggccugagccccaacaacagcgggcacgacuccaccgacaccgacagcaaccacgaggagcgccagaaccacaucuaccagcagaaccacaugguccugucccgggcccgcaacggcaugccccuccugaaggaggugccgcggagcuacgagcugcucaagcccccgcccaucugcccccgcgacagcgugaaggucaucaacaaggagggggaggugauggacguguaccggugcgaccacugccgcguccuguuccuggacuacgugauguucaccauccacaugggcugccacggcuuccgggaccccuucgagugcaacaugugcggguaccgcucccacgaccgguacgaguucagcucccacaucgcccgcggcgagcaccgggcccuccugaaguga

SEQ ID NO: 31507 - RNA, 1758 nt, Artificial Sequence
  derived and/or modified sequence opt1 from IKZF4__Homo_sapiens__NP_071910
augcacacgcccccggcccugccccgccgguuccagggcgggggccgcgugcggacccccgggagccaccgccagggcaaggacaaccucgagcgggaccccuccgggggcugcgucccggacuuccugccccaggcccaggacagcaaccacuucaucauggagucccuguucugcgagagcuccggcgacagcucccucgagaaggaguuccugggggcgcccgugggccccagcguguccaccccgaacagccagcacuccagccccucccgcagccuguccgccaacagcaucaaggucgagauguacuccgacgaggagagcucccggcuccuggggcccgacgagcgccugcucgagaaggacgacagcgugaucguggaggacagccuguccgagccccugggcuacugcgacgggagcggcccggagccccacucccccggcgggauccggcuccccaacggcaagcugaagugcgacgucugcgggauggugugcaucggcccgaacgugcugaugguccacaagcgcagccacaccggcgagcggcccuuccacugcaaccagugcggggccuccuucacccagaagggcaaccuccugcgccacaucaagcugcacagcggggagaagcccuucaagugccccuucugcaacuacgccugccggcgccgggacgcccucaccggccaccuccgcacgcacuccgugagcuccccgaccguggggaagcccuacaagugcaacuacugcggccggagcuacaagcagcaguccacccuggaggagcacaaggagcgcugccacaacuaccugcagagccuguccaccgaggcgcaggcccuggccggccagcccggggacgagauccgggaccucgagaugguccccgacagcaugcugcacuccagcuccgagcgcccgacguucaucgaccggcuggccaacagccucaccaagcgcaagcgcuccacgccccagaaguucgugggcgagaagcagaugcgguucagccugagcgaccugcccuacgacgugaacuccgggggcuacgagaaggacgucgagcucguggcgcaccacagccuggagcccggguucggcuccagccuggccuucgugggcgccgagcaccuccgcccgcugcggcugccgcccaccaacugcaucuccgagcucacccccgucaucagcuccguguacacccagaugcagccccugcccgggcgccuggagcuccccggcagccgggaggccggggagggcccggaggaccuggccgacgggggcccccugcucuaccgcccccggggcccccugaccgacccgggggcgucccccagcaacggcugccaggacuccaccgacacggagagcaaccacgaggaccgcguggccggggucgugucccugccccaggggcccccgccccagcccccgcccaccaucguggucggccggcacagccccgccuacgccaaggaggaccccaagccccaggagggccuccugcgcggcaccccggggcccuccaaggaggugcugcgggucgugggcgagagcggggagcccgugaaggccuucaagugcgagcacugccgcauccucuuccuggaccacgucauguucaccauccacaugggcugccacggcuuccgggaccccuucgagugcaacaucugcggguaccacucccaggaccgcuacgaguucagcagccacaucgugcggggcgagcacaaggugggguga

SEQ ID NO: 31508 - RNA, 537 nt, Artificial Sequence
  derived and/or modified sequence opt1 from IL10__Homo_sapiens__XP_011507808
augcacagcuccgcccugcucugcugccuggugcugcucaccggcgugcgcgccagccccgggcagggcacccaguccgagaacagcugcacgcacuucccggggaaccugcccaacaugcugcgggaccuccgcgacgcguucucccgggugaagaccuucuuccagaugaaggaccagcuggacaaccugcuccugaaggagagccugcucgaggacuucaagggcuaccuggggugccaggcccuguccgagaugauccaguucuaccucgaggaggugaugccccaggccgagaaccaggaccccgacaucaaggcccacgucaacagccugggcgagaaccugaagacccuccgccugcggcugcgccggugccaccgcuuccucccgugcgagaacaaguccaaggccguggagcaggucaagaacgcguucaacaagcugcaggagaagggcaucuacaaggccaugagcgaguucgacaucuucaucaacuacaucgaggccuacaugaccaugaagauccggaacuga

SEQ ID NO: 31509 - RNA, 1737 nt, Artificial Sequence
  derived and/or modified sequence opt1 from IL10RA__Homo_sapiens__NP_001549
augcugcccugccucgugguccugcuggccgcccuccugagccugcgccucggcuccgacgcgcacgggaccgagcugccgagcccgcccuccgugugguucgaggccgaguucuuccaccacauccugcacuggacccccauccccaaccagagcgaguccacgugcuacgagguggcccuccugcgguacggcaucgagagcuggaacuccaucagcaacugcucccagacccugagcuacgaccucaccgccgucacccuggaccuguaccacuccaacggguaccgcgcccgggugcgcgcgguggacggcagccggcacuccaacuggacggucaccaacacccgcuucagcguggacgaggugacccucacggucggguccgugaaccuggagauccacaacggcuucauccugggcaagauccagcucccccggcccaagauggcccccgccaacgacaccuacgagagcaucuucucccacuuccgcgaguacgagaucgccauccggaaggugccggggaacuucaccuucacccacaagaaggucaagcacgagaacuucagccugcugacguccggcgaggugggggaguucugcgugcaggucaagcccagcguggcgagccgcuccaacaagggcauguggagcaaggaggagugcaucucccucacccggcaguacuucaccgugaccaacgucaucaucuucuucgccuucgugcugcugcucagcggggcccuggccuacugccuggcccuccagcuguacgugcgccggcgcaagaagcugcccuccguccuccuguucaagaagcccagcccguucaucuucaucucccagcggcccagccccgagacgcaggacaccauccacccccuggacgaggaggcguuccucaagguguccccggagcugaagaaccuggaccuccacggcagcaccgacuccggcuucgggagcaccaagcccucccugcagacggaggagccccaguuccugcuccccgacccgcacccccaggccgaccgcacccugggcaaccgggagccgcccgugcugggggacagcugcuccagcggcuccagcaacuccaccgacagcggcaucugccuccaggagcccagccugucccccagcaccgggcccacgugggagcagcaggucggcuccaacagccgcgggcaggacgacuccggcaucgaccuggugcagaacagcgaggggcgggccggcgacacccagggcggguccgcccucggccaccacagcccgcccgagcccgagguccccggggaggaggacccggccgcgguggccuuccagggcuaccugcgccagacccggugcgccgaggagaaggccaccaagacggggugccuggaggaggagagcccccucaccgacggccugggccccaaguucgggcgcugccugguggacgaggccggccugcacccgcccgcgcucgccaagggguaccugaagcaggacccccuggagaugacccucgccuccuccggcgcccccaccgggcaguggaaccagcccacggaggaguggagccugcuggcccucuccagcugcuccgaccugggcaucagcgacugguccuucgcgcacgaccuggccccgcucggcugcgucgccgcccccgggggccugcuggggagcuucaacagcgaccucgugacccugccccugaucuccagccuccaguccagcgaguga

SEQ ID NO: 31510 - RNA, 978 nt, Artificial Sequence
  derived and/or modified sequence opt1 from IL10RB__Homo_sapiens__NP_000619
auggccuggagccugggcuccuggcucgggggcugccugcuggugagcgcccucgggauggucccgccgcccgagaacgugcgcaugaacuccgugaacuucaagaacauccugcagugggagagccccgcguucgccaagggcaaccugaccuucaccgcccaguaccucuccuaccggaucuuccaggacaagugcaugaacacgacccugaccgagugcgacuucagcucccugagcaaguacggggaccacacccuccgcguccgggccgaguucgccgacgagcacuccgacugggugaacaucacguucugccccguggacgacaccaucaucggcccgcccggcaugcaggucgaggugcuggcggacagccugcacaugcgcuuccucgcccccaagaucgagaacgaguacgagaccuggaccaugaagaacguguacaacuccuggacguacaacguccaguacuggaagaacgggaccgacgagaaguuccagaucacgccccaguacgacuucgaggugcugcggaaccuggagcccuggaccaccuacugcgugcagguccgcggcuuccuccccgaccggaacaaggccggggaguggagcgagcccgugugcgagcagaccacccacgacgagaccgugcccuccuggauggucgccgugauccugauggcgagcguguucauggucugccuggcccuccugggcugcuucgcccugcucuggugcguguacaagaagacgaaguacgccuucagcccccgcaacucccugccccagcaccugaaggaguuccucgggcacccccaccacaacacccugcuguucuucuccuucccccucagcgacgagaacgacguguucgacaagcuguccgucaucgccgaggacagcgagagcggcaagcagaacccgggcgacuccugcagccuggggaccccgcccggccaggggccccaguccuga

SEQ ID NO: 31511 - RNA, 600 nt, Artificial Sequence
  derived and/or modified sequence opt1 from IL11__Homo_sapiens__NP_000632
augaacugcgugugccgccugguccucguggugcugagccuguggcccgacaccgccgucgcccccgggcccccgcccggcccgccccgggugucccccgacccccgcgcggagcucgacagcaccgugcugcugacgcggucccuccuggccgacacccgccagcuggccgcccagcuccgggacaaguuccccgccgacggcgaccacaaccuggacagccugcccacccucgcgauguccgccggggcccugggcgcccugcagcuccccgggguccugacccgccugcgggcggaccuccugagcuaccugcgccacgugcaguggcuccggcgcgccggcggcuccagccugaagacgcuggagcccgagcucgggacccugcaggcccggcuggaccgccuccugcggcgccugcagcuccugaugucccggcuggcccucccccagcccccgcccgacccgcccgccccgccccuggcgccgcccagcuccgccuggggcgggauccgcgccgcccacgccauccugggcgggcuccaccugacccuggacugggcggugcggggccuccugcugcucaagacccgccuguga

SEQ ID NO: 31512 - RNA, 1269 nt, Artificial Sequence
  derived and/or modified sequence opt1 from IL11RA__Homo_sapiens__NP_001136256
augagcuccagcugcuccggccugagccgcgugcucgucgccguggccaccgcgcugguguccgccagcucccccugcccgcaggccugggggccgcccggcguccaguacgggcagcccggccggagcgugaagcugugcugccccggggugaccgccggcgaccccgucuccugguuccgcgacggcgagcccaagcuccugcaggggcccgacagcggccuggggcacgagcucgugcuggcccaggcggacuccacggacgagggcaccuacaucugccagacccuggacggggcccucggcggcaccgugacgcugcagcugggguacccgcccgcccggcccgucgugagcugccaggccgcggacuacgagaacuucuccugcaccuggagccccucccagaucagcggccucccgacccgcuaccugaccuccuaccggaagaagacggugcugggggccgacagccagcgccggucccccagcaccggccccuggcccugcccgcaggacccccucggcgccgcccgcugcgucgugcacggggccgaguucuggagccaguaccggaucaacgugaccgaggucaacccccugggcgcguccacccgccugcucgacgugagccugcaguccauccugcggcccgacccgccccaggggcuccgcguggagagcguccccggcuacccccggcgccugcgggccuccuggacguacccggccagcuggcccugccagccccacuuccugcucaaguuccgccugcaguaccggcccgcccagcacccggccugguccaccguggagcccgcggggcuggaggaggugaucaccgacgccgucgccggccucccccacgccgugcgcgugagcgcccgggacuuccuggacgcgggcaccugguccacguggagcccggaggccugggggacccccuccaccggcaccauccccaaggagauccccgccugggggcagcugcacacgcagccggaggucgagccccagguggacagccccgcgcccccgcgccccucccuccagccccacccccggcugcuggaccaccgcgacagcgucgagcaggucgccgugcucgccucccugggcauccugagcuuccucgggcugguggccggcgcccuggcccucggccuguggcugcgccuccggcgcgggggcaaggacggguccccgaagcccggcuuccuggcgagcgugauccccguggaccggcgccccggggccccgaaccuguga

SEQ ID NO: 31513 - RNA, 762 nt, Artificial Sequence
  derived and/or modified sequence opt1 from IL12A__Homo_sapiens__NP_000873
auguggcccccgggcagcgccucccagcccccgcccagccccgccgcggccaccgggcugcaccccgccgcccgccccgugucccuccagugccggcugagcaugugccccgcccgcucccugcuccuggucgcgacccuggugcuccuggaccaccugagccucgcccggaaccugccgguggccacgcccgaccccggcauguuccccugccugcaccacucccagaaccuccugcgcgccgucagcaacaugcugcagaaggcgcggcagacccucgaguucuacccgugcaccuccgaggagaucgaccacgaggacaucaccaaggacaagacgagcaccguggaggccugccugccccuggagcucaccaagaacgaguccugccugaacagccgcgagaccuccuucaucacgaacgggagcugccuggccucccggaagaccagcuucaugauggcccucugccuguccagcaucuacgaggaccugaagauguaccagguggaguucaagaccaugaacgccaagcuccugauggaccccaagcgccagaucuuccuggaccagaacaugcucgcggucaucgacgagcugaugcaggcccugaacuucaacuccgagaccgugccccagaaguccagccucgaggagccggacuucuacaagacgaagaucaagcugugcauccugcuccacgccuuccggauccgcgccgugaccaucgaccgggucaugagcuaccugaacgccagcuga

SEQ ID NO: 31514 - RNA, 987 nt, Artificial Sequence
  derived and/or modified sequence opt1 from IL12B__Homo_sapiens__NP_002178
augugccaccagcagcuggugaucagcugguucucccucgucuuccuggccagcccccugguggccaucugggagcucaagaaggacguguacgucguggagcuggacugguacccggacgcgcccggcgagauggugguccugaccugcgacacccccgaggaggacgggaucacguggacccucgaccaguccagcgaggugcugggcuccgggaagacccugaccauccaggugaaggaguucggcgacgccgggcaguacacgugccacaagggcggcgagguccucagccacucccugcugcuccugcacaagaaggaggacgggaucuggagcaccgacauccugaaggaccagaaggagcccaagaacaagaccuuccuccgcugcgaggccaagaacuacuccggccgguucacgugcugguggcugaccaccaucagcaccgaccugaccuucuccgucaagagcucccgcgggagcuccgacccgcagggcgugacgugcggggccgccacccucagcgcggagcgggugcgcggcgacaacaaggaguacgaguacuccguggagugccaggaggacagcgccugccccgccgccgaggagucccugcccaucgaggugauggucgacgcggugcacaagcugaaguacgagaacuacaccagcagcuucuucauccgggacaucaucaagcccgacccgcccaagaaccuccagcugaagccccugaagaacucccgccagguggaggucagcugggaguaccccgacaccugguccacgccgcacagcuacuucucccucaccuucugcguccaggugcagggcaagagcaagcgggagaagaaggaccgcguguucaccgacaagaccuccgccacggugaucugccggaagaacgccagcaucuccgugcgcgcccaggaccgguacuacagcuccagcugguccgagugggccagcguccccugcuccuga

SEQ ID NO: 31515 - RNA, 2109 nt, Artificial Sequence
  derived and/or modified sequence opt1 from IL12RB1__Homo_sapiens__NP_001276953
auguucgugggccuguucagccuccuguccuucaacgucuuccgcagcggggacggcguggccgagccccggcgcuggcagcggggguccccgggcgccguggggcuguacgucgaccccauggagccccucgugaccuggguggucccccugcuguuccucuuccugcugagccgccagggcgcggccugccggaccuccgagugcugcuuccaggacccgcccuaccccgacgccgacagcggcuccgccagcgggccccgcgaccuccggugcuaccgcaucuccagcgaccgguacgagugcuccuggcaguacgagggcccgacggccggggugagccacuuccugcgcugcugccuguccagcggccggugcugcuacuucgcggccggguccgccacccgccuccaguucagcgaccaggccggcguguccguccuguacaccgugacccuguggguggagagcugggcgcggaaccagacggagaagucccccgaggucacccuccagcuguacaacagcgugaaguacgagccgccccugggcgacaucaaggugagcaagcucgccgggcagcugcgcauggagugggagacccccgacaaccaggucggcgccgaggugcaguuccggcaccgcacccccuccagccccuggaagcugggggacugcggcccccaggacgacgacacggaguccugccucugcccgcuggagaugaacguggcccaggaguuccagcugcggcgccggcagcucggcagccagggguccagcugguccaaguggagcucccccgucugcgugccgcccgagaacccgccccagccccaggugcgcuucagcgucgagcagcugggccaggacgggcggcgccgccugacccucaaggagcagcccacccagcuggagcugcccgagggcugccaggggcucgcccccggcaccgaggugacguaccggcugcagcugcacaugcucuccugccccugcaaggcgaaggccacccgcacccugcaccugggcaagaugcccuaccucagcggggccgccuacaacguggccgucaucuccagcaaccaguucggcccggggcugaaccagaccuggcacauccccgcggacacgcacaccgagcccguggcccugaacaucuccgucggcaccaacgggaccacgauguacuggccggcccgggcccagagcaugaccuacugcaucgaguggcagcccgugggccaggacggcgggcucgccacgugcucccugaccgcgccccaggaccccgacccggccggcauggccaccuacagcuggucccgcgagagcggggccaugggccaggagaagugcuacuacaucaccaucuucgccagcgcgcaccccgagaagcugacccucugguccaccgugcugagcacguaccacuucgggggcaacgccuccgccgccggcacgccccaccacgucagcgugaagaaccacucccuggacagcguguccgucgacugggcgcccagccuccuguccacgugcccgggggugcugaaggaguacgugguccggugccgcgacgaggacagcaagcaggucuccgagcaccccgugcagcccaccgagacccaggugacccucagcggccugcgggccgggguggccuacaccgugcagguccgcgccgacaccgccuggcugcggggcguguggucccagccccagcgcuucagcaucgaggugcaggucuccgacuggcugaucuucuucgcgagccucggcuccuuccugagcauccugcucgugggggugcugggcuaccuggggcucaaccgggccgcccgccaccugugcccgccccugcccacccccugcgccagcuccgccaucgaguucccgggcgggaaggagaccuggcaguggaucaaccccgucgacuuccaggaggaggcgagccuccaggaggcccuggugguggagauguccugggacaagggcgagcggaccgagccccuggagaagaccgagcuccccgagggcgccccggagcuggcccuggacaccgagcucagccuggaggacggggaccgcugcaaggccaagauguga

SEQ ID NO: 31516 - RNA, 441 nt, Artificial Sequence
  derived and/or modified sequence opt1 from IL13__Homo_sapiens__NP_002179
augcacccccugcucaacccgcugcugcucgcccugggccugauggcccuccugcugaccaccgugaucgcgcucacgugccucgggggcuucgccagccccgggcccgugcccccguccaccgcccugcgcgagcucaucgaggagcuggucaacaucacccagaaccagaaggcgccccugugcaacggcagcauggugugguccaucaaccucaccgccgggauguacugcgccgcccuggagagccugaucaacgucuccggcugcagcgccaucgagaagacgcagcggaugcucuccggcuucugcccccacaaggugagcgccgggcaguucuccagccugcacgugcgcgacaccaagaucgaggucgcgcaguucgugaaggaccugcuccugcaccugaagaagcuguuccgggagggccaguucaacuga

SEQ ID NO: 31517 - RNA, 1284 nt, Artificial Sequence
  derived and/or modified sequence opt1 from IL13RA1__Homo_sapiens__NP_001551
auggaguggcccgcccgccugugcggccucugggcccugcugcucugcgccgggggcgggggcgggggcggcggggcggccccgaccgagacccagccgcccgugacgaaccugagcgucuccguggagaaccugugcaccgugaucuggaccuggaacccgcccgagggcgccagcuccaacugcagccucugguacuucucccacuucggggacaagcaggacaagaagaucgcccccgagacccggcgcagcaucgaggucccccugaacgagcggaucugccuccaggugggcucccagugcagcacgaacgaguccgagaagcccagcauccugguggagaagugcaucuccccgcccgagggggaccccgagagcgcggucaccgagcugcagugcaucuggcacaaccuguccuacaugaagugcagcuggcuccccggccgcaacaccucccccgacaccaacuacacgcuguacuacuggcaccggagccuggagaagauccaccagugcgagaacaucuuccgcgagggccaguacuucgggugcuccuucgaccucaccaaggugaaggacagcuccuucgagcagcacagcgugcagaucauggucaaggacaacgccggcaagaucaagcccagcuucaacaucgugccccugaccucccgggugaagcccgacccgccccacaucaagaaccugagcuuccacaacgacgaccucuacguccagugggagaacccccagaacuucaucucccgcugccuguucuacgagguggaggugaacaacagccagaccgagacgcacaacgucuucuacgugcaggaggccaagugcgagaaccccgaguucgagcggaacguggagaacaccuccugcuucauggucccgggggugcugcccgacacccucaacaccgugcgcauccgggucaagacgaacaagcugugcuacgaggacgacaagcuguggagcaacuggucccaggagaugagcaucggcaagaagcgcaacuccacccucuacaucaccaugcugcugaucgugcccgugaucgucgccggcgcgaucaucgugcuccugcuguaccucaagcggcugaagaucaucaucuucccgcccauccccgaccccgggaagaucuucaaggagauguucggcgaccagaacgacgacacccugcacuggaagaaguacgacaucuacgagaagcagacgaaggaggagaccgacagcgucgugcucaucgagaaccugaagaaggccucccaguga

SEQ ID NO: 31518 - RNA, 1143 nt, Artificial Sequence
  derived and/or modified sequence opt1 from IL13RA2__Homo_sapiens__NP_000631
auggccuucgugugccuggccaucggcugccucuacaccuuccugaucagcaccacguucgggugcaccuccagcuccgacaccgagaucaaggucaacccgccccaggacuucgagaucguggaccccggcuaccugggguaccucuaccugcaguggcagccgccccugagccucgaccacuucaaggagugcaccguggaguacgagcugaaguaccgcaacaucggcuccgagacguggaagaccaucaucaccaagaaccugcacuacaaggacggguucgaccucaacaagggcaucgaggcgaagauccacacccugcugcccuggcagugcacgaacggcagcgagguccaguccagcugggccgagaccaccuacuggaucagcccccaggggauccccgagaccaaggugcaggacauggacugcguguacuacaacuggcaguaccuccugugcuccuggaagcccggcaucgggguccugcucgacacgaacuacaaccuguucuacugguacgagggccuggaccacgcccuccagugcguggacuacaucaaggccgacgggcagaacaucggcugccgguucccguaccuggaggccuccgacuacaaggacuucuacaucugcgugaacggcagcuccgagaacaagcccauccgcagcuccuacuucaccuuccagcugcagaacaucgucaagccccugcccccgguguaccucaccuucacccgggagagcuccugcgagaucaagcugaaguggagcaucccccucgggcccauccccgcgcgcugcuucgacuacgagaucgagauccgggaggacgacacgacccuggugaccgccaccgucgagaacgagacguacacccugaagaccaccaacgagacgcgccagcucugcuucguggugcgguccaaggucaacaucuacugcagcgacgacggcaucuggagcgagugguccgacaagcagugcugggagggggaggaccugagcaagaagacccugcuccgcuucuggcugccguucggcuucauccugauccucgugaucuucgugaccggccugcugcuccggaagcccaacaccuaccccaagaugauccccgaguucuucugcgacacguga

SEQ ID NO: 31519 - RNA, 489 nt, Artificial Sequence
  derived and/or modified sequence opt1 from IL15__Homo_sapiens__NP_000576
augcgcaucagcaagccccaccuccgguccaucagcauccagugcuaccugugccugcugcucaacucccacuuccugaccgaggccggcauccacguguucauccuggggugcuucagcgccggccucccgaagaccgaggcgaacugggucaacgugaucuccgaccugaagaagaucgaggaccugauccagagcaugcacaucgacgccacgcucuacaccgaguccgacgugcaccccagcugcaaggucaccgccaugaagugcuuccugcuggagcuccaggugaucucccuggagagcggggacgccuccauccacgacaccguggagaaccugaucauccucgccaacaacagccuguccagcaacggcaacgucacggaguccgggugcaaggagugcgaggagcuggaggagaagaacaucaaggaguuccuccagagcuucgugcacaucgugcagauguucaucaacaccuccuga

SEQ ID NO: 31520 - RNA, 696 nt, Artificial Sequence
  derived and/or modified sequence opt1 from IL15RA__Homo_sapiens__NP_001230468
augagcguggagcacgccgacaucugggucaaguccuacagccuguacucccgcgagcgguacaucugcaacagcggcuucaagcgcaaggccgggaccuccagccucaccgagugcgugcugaacaaggcgacgaacguggcccacuggaccacccccucccugaagugcauccgggaccccgcccucguccaccagcgccccgccccgcccagcaccgugacgaccgccggcgugacgccccagcccgagucccugagccccuccgggaaggagcccgcggccagcuccccgagcuccaacaacaccgccgccaccaccgcggccaucguccccggcagccagcugaugcccuccaagagccccuccaccgggaccacggagaucagcagccacgaguccagccacggcaccccgucccagaccaccgccaagaacugggagcucacggccagcgccucccaccagccgcccggcguguacccccaggggcacagcgacaccaccguggcgaucuccaccagcacgguccugcugugcggccucuccgccgugagccugcuggccugcuaccucaagucccggcagaccccgccccuggccagcguggagauggaggccauggaggcgcugcccgucaccugggggaccuccagccgcgacgaggaccucgagaacugcucccaccaccuguga

SEQ ID NO: 31521 - RNA, 3996 nt, Artificial Sequence
  derived and/or modified sequence opt1 from IL16__Homo_sapiens__NP_001165599
auggagagccacucccgcgccggcaagagccggaaguccgccaaguuccgcagcaucucccggagccugaugcucugcaacgcgaagaccuccgacgacgggagcucccccgacgagaaguacccggaccccuucgagaucagccuggcccagggcaaggaggggaucuuccacuccagcgugcagcuggccgacaccuccgaggccggccccagcuccguccccgaccucgcccuggcgagcgaggccgcccagcugcaggccgcggggaacgaccgcggcaagacgugccggcgcaucuucuucaugaaggaguccagcaccgccuccagccgggagaagccgggcaagcucgaggcccagagcuccaacuuccuguuccccaaggccugccaccagcgcgcccggagcaacuccaccagcgugaaccccuacugcacccgcgagaucgacuuccccaugacgaagaaguccgcggccccgaccgaccggcagcccuacagccugugcuccaaccgcaagagccucucccagcagcuggacugccccgccgggaaggccgccggcaccagccggcccacccgcucccugagcacggcgcagcucgugcagccguccgggggccugcaggccagcgucaucuccaacaucgugcugaugaaggggcaggccaagggccucggcuucagcaucguggggggcaaggacuccaucuacgggcccaucggcaucuacgucaagaccaucuucgccggcggggccgcggccgccgacggccggcugcaggagggggacgagauccuggagcucaacggcgagagcauggccgggcugacccaccaggacgcccugcagaaguucaagcaggcgaagaagggccuccugacccugacggugcgcacccggcucaccgccccccccucccugugcagccaccugagcccgccccucugccgcucccugagcuccagcaccugcaucacgaaggacuccagcuccuucgcccuggagagccccuccgcccccaucagcaccgcgaagccgaacuaccggaucaugguggaggucucccuccagaaggaggccggcguggggcugggcaucgggcugugcagcgugcccuacuuccagugcaucuccggcaucuucguccacacccucagccccggguccguggcccaccuggacggccgccugcggugcggcgacgagaucguggagaucagcgacucccccguccacugccucacccugaacgagguguacacgauccugagccacugcgacccggggcccgugcccaucaucgucagccgccaccccgacccgcagguguccgagcagcagcucaaggaggccguggcccaggcggucgagaacaccaaguucggcaaggagcgccaccaguggagccuggagggggugaagcggcuggaguccagcuggcacggccgccccacccucgagaaggagcgggagaagaacuccgcccccccgcaccgccgggcccagaaggugaugauccgcagcuccagcgacuccagcuacauguccgggagccccggcggcucccccgggagcggcuccgccgagaagcccagcuccgacgucgacaucagcacccacuccccgagccugccccuggcccgggagcccgugguccucagcaucgcguccagccgccugccccaggaguccccgccccugcccgagagccgggacucccaccccccgcuccgccugaagaagagcuucgagauccuggugcggaagcccauguccagcaagcccaagcccccgccccgcaaguacuucaaguccgacagcgacccccagaagucccuggaggagcgggagaacagcuccugcagcuccgggcacacgcccccgaccugcggccaggaggcccgcgagcuccugccccugcuccugccccaggaggacaccgccggccggagccccuccgccagcgccgggugcccgggccccgggaucggcccccagaccaaguccagcacggagggggagccgggcuggcgccgggcgagccccgugacccagaccucccccaucaagcacccccugcucaagcgccaggcccggauggacuacagcuucgacaccacggccgaggacccguggguccgcaucuccgacugcaucaagaaccuguucagccccaucauguccgagaaccacggccacaugccccugcagcccaacgccagccucaacgaggaggaggggacccagggccacccggacgggaccccccccaagcuggacaccgcgaacggcacgcccaagguguacaaguccgccgacagcuccaccgugaagaaggggccgcccgucgcccccaagcccgccugguuccgccagagccugaagggccuccggaaccgcgccuccgacccgcggggccugcccgaccccgcgcugagcacccagcccgccccggccucccgcgagcaccucgggagccacauccgggccuccagcuccagcuccagcauccgccagcggaucagcuccuucgagaccuucggcagcucccagcugcccgacaagggggcccagcgccugagccuccagcccuccagcggcgaggcggccaagccccuggggaagcacgaggagggccgguucuccggccugcucgggcgcggcgccgccccgacccuggugccccagcagcccgagcaggugcugagcuccgggagccccgccgcguccgaggcccgggacccgggcgucagcgaguccccccccccggggcgccagcccaaccagaagacgcucccccccggcccggacccccugcugcggcuccugagcacccaggccgaggagucccagggccccgugcugaagaugcccagccagcgcgcccgguccuucccgcucacccgcagccaguccugcgagaccaagcugcuggacgagaagacgagcaagcucuacagcaucuccagccagguguccagcgcggucaugaagucccugcugugccuccccagcuccaucagcugcgcccagacccccugcauccccaaggagggggccuccccgaccagcuccagcaacgaggacuccgccgccaacggcagcgcggagaccuccgcccuggacacgggguucagccugaaccucuccgagcugcgggaguacaccgagggccugaccgaggccaaggaggacgacgacggcgaccacagcucccuccagagcgggcagagcgugaucucccugcugagcuccgaggagcucaagaagcugaucgaggaggugaagguccuggacgaggccacccucaagcagcuggacggcauccacgugacgauccugcacaaggaggagggggccggccucggguucagccuggcgggcggcgccgaccuggagaacaaggugaucaccguccaccgcguguuccccaacgggcucgccucccaggagggcaccauccagaaggggaacgaggugcugagcaucaacggcaagucccugaaggggaccacgcaccacgacgcccucgccauccugcggcaggcgcgcgagccccggcaggccgucaucgugacccgcaagcugacccccgaggccaugccggaccucaacagcuccaccgacagcgccgccuccgcgagcgccgccuccgacgugagcgucgaguccacggaggccaccgugugcaccgugacccuggagaagaugagcgcgggccugggcuucucccucgaggggggcaaggggagccugcacggcgacaagccccugacgaucaaccgcaucuucaagggggccgccagcgagcaguccgagaccguccagcccggcgacgagauccuccagcugggcgggaccgccaugcagggccugacccgguucgaggccuggaacaucaucaaggcgcuccccgacgggccggugacgaucgugauccgccggaagagccugcaguccaaggagaccaccgccgccggcgacagcuga

SEQ ID NO: 31522 - RNA, 468 nt, Artificial Sequence
  derived and/or modified sequence opt1 from IL17A__Homo_sapiens__NP_002181
augacccccggcaagaccagccuggugucccuccugcugcuccugagccuggaggccaucgucaaggccgggaucaccaucccgcgcaaccccggcugccccaacuccgaggacaagaacuucccccggaccgugauggugaaccucaacauccacaaccgcaacaccaacaccaacccgaagcggagcuccgacuacuacaaccgcagcacgucccccuggaaccugcaccggaacgaggaccccgagcgcuaccccagcgucaucugggaggcgaagugccggcaccuggggugcaucaacgccgacggcaacguggacuaccacaugaacuccgugccgauccagcaggagauccucguccugcgccgggagccgccccacugccccaacagcuuccgccuggagaagauccucguguccguggggugcacgugcgucacccccaucgugcaccacguggccuga

SEQ ID NO: 31523 - RNA, 543 nt, Artificial Sequence
  derived and/or modified sequence opt1 from IL17B__Homo_sapiens__NP_055258
auggacuggccccacaaccuccuguuccugcugaccaucagcaucuuccucggccuggggcagccccgcucccccaagagcaagcggaagggccaggggcgccccggcccccuggccccggggccccaccaggugccccucgaccuggucucccggaugaagcccuacgcccgcauggaggaguacgagcggaacaucgaggagaugguggcgcagcugcgcaacagcuccgagcucgcccagcggaagugcgaggugaaccugcagcuguggaugagcaacaagcgcucccucagcccguggggcuacuccaucaaccacgaccccagccggauccccgucgaccugcccgaggcccgcugccugugccucggcugcgugaacccguucaccaugcaggaggaccgguccauggugagcguccccguguucucccaggugcccguccgccggcgccugugcccgcccccgccccggaccgggcccugccgccagcgggccgugauggagaccaucgccgugggcugcacgugcaucuucuga

SEQ ID NO: 31524 - RNA, 594 nt, Artificial Sequence
  derived and/or modified sequence opt1 from IL17C__Homo_sapiens__NP_037410
augacccugcuccccggccugcuguuccucaccuggcugcacacgugccuggcccaccacgacccgagccuccgcgggcacccccacucccacggcacgccccacugcuacagcgccgaggagcugccccuggggcaggcgccgccccaccuccuggcccggggcgccaagugggggcaggcccugcccguggcccucgucuccagccuggaggcggccucccaccgcggccggcacgagcgccccagcgccaccacccagugcccggugcugcggcccgaggaggugcucgaggccgacacccaccagcgcuccaucagccccuggcgguaccgcgucgacaccgacgaggaccgguacccccagaagcuggcguucgccgagugccugugccgcggcugcaucgacgcccggaccgggcgcgagaccgccgcccucaacuccgugcggcugcugcagagccuccuggugcugcgccggcgcccgugcucccgggacggcagcgggcuccccacccccggcgcguucgccuuccacaccgaguucauccacguccccguggggugcacgugcgugcugccgcgcuccgucuga

SEQ ID NO: 31525 - RNA, 609 nt, Artificial Sequence
  derived and/or modified sequence opt1 from IL17D__Homo_sapiens__NP_612141
augcugguggccggcuuccuccuggcccugcccccgagcugggcggccggggcgccccgcgccggccggcgccccgcccggccccgcgggugcgccgaccggccggaggagcuccuggagcagcuguacggccgccucgccgccgggguccuguccgccuuccaccacacccugcagcucggcccccgggagcaggcgcgcaacgccagcugccccgccggcgggcggcccgccgaccgccgguuccgcccgcccaccaaccugcgguccgugagccccugggccuaccgcaucuccuacgaccccgcgcgguacccgcgcuaccugcccgaggccuacugccucugccggggcugccugaccgggcuguucggcgaggaggacgugcgcuuccggagcgcccccgucuacaugcccaccguggugcuccgccggaccccggccugcgccgggggccgcuccgucuacaccgaggcguacgugacgauccccgugggcugcacgugcguccccgagcccgagaaggacgccgacagcaucaacuccagcaucgacaagcagggggccaagcugcugcucggcccgaacgacgcccccgccgggcccuga

SEQ ID NO: 31526 - RNA, 492 nt, Artificial Sequence
  derived and/or modified sequence opt1 from IL17F__Homo_sapiens__XP_011512578
augaccgugaagacccugcacggccccgccauggucaaguaccuccugcugagcauccucgggcuggccuuccuguccgaggcggccgcccgcaagaucccgaaggugggccacaccuucuuccagaagcccgagagcugcccgcccgugcccgggggcuccaugaagcucgacaucgggaucaucaacgagaaccagcgggucagcaugucccgcaacaucgagagccgguccaccagccccuggaacuacaccgugaccugggaccccaaccgcuaccccuccgaggugguccaggcccagugccggaaccugggcugcaucaacgcccagggcaaggaggacaucagcaugaacuccgugccgauccagcaggagacgcuggugguccgccggaagcaccaggggugcagcguguccuuccagcucgagaaggugcuggucaccgugggcugcacgugcgugacccccgucauccaccacgugcaguga

SEQ ID NO: 31527 - RNA, 2499 nt, Artificial Sequence
  derived and/or modified sequence opt1 from IL17RA__Homo_sapiens__NP_001276834
augggcgccgcccgcagcccgcccuccgcggugcccgggccccugcucggccugcugcuccugcugcucgggguccuggcccccggcggggccagccugcggcuccuggaccaccgcgcccuggugugcucccagccgggccucaacugcaccgugaagaacagcacgugccuggacgacuccuggauccacccccggaaccugacccccagcucccccaaggaccuccagauccagcugcacuucgcccacacccagcagggcgaccuguucccggucgcgcacaucgaguggacccuccagaccgacgccagcauccuguaccuggagggggccgagcucuccgugcugcagcugaacacgaacgagcgccucugcgugcgguucgaguuccugagcaagcugcgccaccaccaccggcgcuggcgguucaccuucucccacuucgucguggaccccgaccaggaguacgaggugaccguccaccaccuccccaagcccaucccggacggcgaccccaaccaccagagcaagaacuuccuggugcccgacugcgagcacgcccgcaugaaggugaccacgcccugcauguccagcgggucccugugggacccgaacaucaccgucgagacccucgaggcgcaccagcugcgggugagcuucacccuguggaacgaguccacgcacuaccagauccuccugaccagcuucccccacauggagaaccacuccugcuucgagcacaugcaccacauccccgcgccccgcccggaggaguuccaccagcggagcaacgugacccugacccuccgcaaccugaagggcugcugccggcaccagguccagauccagcccuucuucagcuccugccugaacgacugccuccgccacagcgccacgguguccugccccgagaugcccgacaccccggagcccauccccgggcccggcagcgagaaguacuccgacgacaccaaguacaccgacggccugccggccgccgaccugaucccgccgccccucaagccccggaagguguggaucaucuacagcgccgaccacccccuguacgucgacguggugcugaaguucgcccaguuccuccugacggccugcgggaccgaggucgcccuggaccuccuggaggagcaggccaucuccgaggcgggcgugaugaccuggguggggcgccagaagcaggagauggucgagagcaacuccaagaucaucgugcugugcagccggggcacccgcgccaaguggcaggcccugcucggccgcggggcccccguccggcugcgcugcgaccacggcaagcccgugggggaccuguucacggccgcgaugaacaugauccuccccgacuucaagcggcccgccugcuucggcaccuacguggucugcuacuucuccgaggugagcugcgacggggacgugcccgaccuguucggcgccgccccgcgcuacccccugauggaccgguucgaggaggucuacuuccgcauccaggaccucgagauguuccagcccggccggaugcaccgcgugggggagcuguccggcgacaacuaccugcggagccccgggggccgccagcuccgggccgcgcuggaccgcuuccgggacuggcagguccgcugcccggacugguucgagugcgagaaccuguacuccgccgacgaccaggacgcccccagccucgacgaggagguguucgaggagccccugcugcccccggggaccggcaucgugaagcgggcgccccucgugcgcgagcccggcucccaggccugccuggccaucgacccccuggucggggaggagggcggggccgccguggccaagcucgagccgcaccuccagccccggggccagcccgcgccccagccgcugcacacccuggugcuggccgccgaggagggggcccuggucgccgcgguggagcccggcccccucgccgacggcgccgccgugcgccuggcccuggcgggggagggcgaggccugcccgcuccuggggagccccggcgccggccggaacuccguccuguuccuccccguggaccccgaggacagcccgcuggggagcuccacgcccauggccagccccgaccugcuccccgaggacgugcgcgagcaccuggagggccugaugcucucccuguucgagcagagccuguccugccaggcgcagggcgggugcagccggccggccaugguccucaccgacccccacacccccuacgaggaggagcagcgccaguccgugcagagcgaccagggguacaucucccgcagcagcccccagccgcccgagggccugaccgagauggaggaggaggaggaggaggagcaggaccccggcaagcccgcccugccgcucucccccgaggaccuggagucccugcggagccuccagcgccagcugcuguuccggcagcuccagaagaacuccgggugggacacgaugggcagcgaguccgaggggcccagcgccuga

SEQ ID NO: 31528 - RNA, 1509 nt, Artificial Sequence
  derived and/or modified sequence opt1 from IL17RB__Homo_sapiens__NP_061195
augagccuggugcuccugucccuggccgcccucugccgcagcgcggugccccgggagccgaccgugcagugcggcuccgagaccgggcccagccccgaguggaugcugcagcacgaccugauccccggcgaccuccgcgaccugcggguggagccggucacgaccuccguggccaccggggacuacagcauccugaugaacguguccuggguccuccgcgccgacgccagcauccggcugcugaaggccaccaagaucugcgugacgggcaaguccaacuuccagagcuacuccugcgugcgcugcaacuacaccgaggcguuccagacccagacccggcccagcgggggcaaguggacguucuccuacaucggcuuccccgucgagcucaacaccguguacuucaucggggcccacaacauccccaacgccaacaugaacgaggacggcccgagcauguccgugaacuucaccagccccgggugccuggaccacaucaugaaguacaagaagaagugcgucaaggccggcucccugugggaccccaacaucaccgcgugcaagaagaacgaggagacgguggaggugaacuucaccaccacgccccucgggaaccgcuacauggcccugauccagcacagcaccaucaucggcuucucccaggucuucgagccgcaccagaagaagcagacccgggccagcguggugauccccgucaccggcgacagcgagggggccaccgugcagcugacgcccuacuucccgaccugcggcuccgacugcauccgccacaaggggaccgugguccucugcccccagaccggcgugcccuucccccuggacaacaacaagagcaagcccggcggguggcugccgcuccugcugcucucccugcugguggccacguggguccucguggcgggcaucuaccugauguggcggcacgagcgcaucaagaagaccagcuucuccaccaccacgcugcucccgcccaucaagguccuggugguguaccccagcgagaucugcuuccaccacaccaucugcuacuucaccgaguuccugcagaaccacugccgguccgaggucauccucgagaaguggcagaagaagaagaucgccgagauggggcccgugcaguggcuggccacccagaagaaggccgccgacaagguggucuuccugcucagcaacgacgugaacuccgugugcgacggcacgugcggcaagagcgaggggucccccagcgagaacucccaggaccuguucccccuggcguucaaccucuucugcagcgaccugcgcucccagauccaccuccacaaguacgucgugguguacuuccgggagaucgacaccaaggacgacuacaacgcccugagcgucugccccaaguaccaccugaugaaggacgccaccgccuucugcgccgagcugcuccacgugaagcagcaggucuccgcgggcaagcgcagccaggccugccacgacgggugcugcucccuguga

SEQ ID NO: 31529 - RNA, 2124 nt, Artificial Sequence
  derived and/or modified sequence opt1 from IL17RC__Homo_sapiens__NP_001190192
augcccgugccgugguuccugcucagccuggcccugggccgcucccccguggugcucagccuggagcggcugguggggccccaggacgccacccacugcucccccggccucagcugccgccugugggacuccgacauccugugccucccgggggacaucguccccgcgcccggccccgugcuggccccgacccaccuccagacggagcuggugcugcggugccagaaggagaccgacugcgaccugugccuccgcgucgccgugcaccuggccgugcacgggcacugggaggagcccgaggacgaggagaaguucggcggcgccgcggacagcggggucgaggagccccggaacgccucccugcaggcccagguggugcucagcuuccaggccuaccccaccgcgcgcugcguccugcuggagguccaggugccggccgcccucgugcaguucggccaguccguggggagcguggucuacgacugcuucgaggccgcccugggcuccgaggugcggaucuggagcuacacccagccccgcuacgagaaggagcugaaccacacgcagcagcuccccgacugccgggggcuggagguguggaacuccauccccagcugcugggcgcugccguggcucaacgucuccgccgacggcgacaacgugcaccuggugcugaacgucagcgaggagcagcacuucggccucucccuguacuggaaccaggugcaggggccgcccaagccccgcuggcacaagaaccugaccggcccgcagaucaucacccucaaccacaccgaccugguccccugccugugcauccagguguggccccucgagcccgacagcgugcggacgaacaucugcccguuccgcgaggacccccgggcccaccagaaccuguggcaggccgcccgccugcggcuccugacccugcaguccuggcuccuggacgcgcccugcagccugcccgccgaggccgcccucugcuggcgcgcccccgggggcgaccccugccagccccuggucccgccccugagcugggagaacgugaccguggacaagguccucgaguucccccugcugaagggccaccccaaccugugcguccaggugaacuccagcgagaagcuccagcugcaggagugccugugggcggacucccucgggccgcugaaggacgacgugcugcuccuggagacccggggcccccaggacaaccgcagccugugcgcccucgagcccuccgggugcacgagccugcccuccaaggccagcacccgggccgcccgccugggcgaguaccuccugcaggaccugcaguccgggcagugccuccagcugugggacgacgaccugggcgcgcucugggccugcccgauggacaaguacauccacaagcggugggcccugguguggcuggccugccuccuguucgcggccgcccugagccucauccugcugcucaagaaggaccacgccaaggccgcggcccgcggccgcgccgcccugcugcucuacuccgccgacgacagcggguucgagcggcuggugggcgcgcuggccuccgcccucugccagcugccccugcgcgucgccguggaccucuggagccggcgcgagcuguccgcccaggggcccguggcgugguuccacgcccagcggcgccagacccugcaggagggcggggucguggugcuccuguucagccccggcgccgucgcccugugcuccgaguggcuccaggacggcgugagcgggccgggcgcgcacgggccccacgacgccuuccgggccucccugagcugcgugcugcccgacuuccuccagggccgcgcccccgggagcuacgucggcgccugcuucgaccggcugcugcacccggacgcggugcccgcccucuuccgcaccgugcccgucuucacgcugcccucccagcugccggacuuccucggcgcccugcagcagccccgggcgccccgcagcgggcggcugcaggagcgcgccgagcaggucucccgggcccuccagcccgcccuggacagcuacuuccacccgcccggcacccccgccccggggcgcggcgugggccccggggccggccccggggccggcgacgggaccuga

SEQ ID NO: 31530 - RNA, 2220 nt, Artificial Sequence
  derived and/or modified sequence opt1 from IL17RD__Homo_sapiens__NP_060033
auggcccccuggcugcagcucugcagcguguucuucaccgucaacgccugccugaacggcucccagcuggccguggccgccgggggcagcgggcgcgcccggggcgccgacacgugcggguggcgcggcgugggcccggcgucccggaacagcgggcucuacaacaucaccuucaaguacgacaacugcaccaccuaccugaaccccgucggcaagcacgugaucgccgacgcccagaacaucaccaucucccaguacgccugccacgaccagguggcggucacgauccuguggagccccggggcccucggcaucgaguuccugaagggguuccgcgugauccuggaggagcucaaguccgagggccggcagugccagcagcugauccugaaggaccccaagcagcucaacagcuccuucaagcgcaccggcauggagagccagccguuccugaacaugaaguucgagaccgacuacuucgugaaggucgugcccuuccccuccaucaagaacgagagcaacuaccaccccuucuucuuccggacccgcgccugcgaccugcuccugcagccggacaaccuggccugcaagcccuucuggaagccccggaaccucaacaucucccagcacgggagcgacaugcaggucuccuucgaccacgcgccccacaacuucggcuuccgcuucuucuaccugcacuacaagcugaagcacgaggggccguucaagcggaagacgugcaagcaggagcagaccaccgagaccacgagcugccuccugcagaacgugucccccggcgacuacaucaucgagcugguggacgacaccaacaccacccgcaaggugaugcacuacgcccucaagcccguccacagccccugggccggcccgauccgggccguggccaucacggugccccuggucgugaucuccgccuucgcgacccuguucaccgugaugugccgcaagaagcagcaggagaacaucuacagccaccucgacgaggagagcuccgagagcuccaccuacacggccgcccugccccgggagcgccugcggccccgcccgaaggucuuccucugcuacagcuccaaggacgggcagaaccacaugaacguggugcagugcuucgccuacuuccugcaggacuucugcggcugcgaggucgcccuggaccucugggaggacuucagccugugccgggaggggcagcgcgagugggugauccagaagauccacgagucccaguucaucaucgucgugugcagcaagggcaugaaguacuucguggacaagaagaacuacaagcacaagggcgggggccggggguccggcaagggggagcuguuccucgucgcggugagcgccaucgccgagaagcugcgccaggccaagcaguccagcuccgccgcgcugagcaaguucaucgccguguacuucgacuacuccugcgagggcgacguccccgggauccucgaccugagcaccaaguaccgccugauggacaaccucccccagcugugcucccaccuccacagccgggaccacggccugcaggagcccggccagcacacccgccaggggucccggcgcaacuacuuccggagcaagagcggccgcucccuguacguggccaucugcaacaugcaccaguucaucgacgaggagccggacugguucgagaagcaguucgugcccuuccacccgccgccccugcgguaccgcgagcccguccucgagaaguucgacagcgggcuggugcugaacgacgugaugugcaagcccggccccgaguccgacuucugccugaaggucgaggccgcggugcucggggccaccggccccgccgacagccagcacgagucccagcacggcgggcuggaccaggacggcgaggcccggcccgcccuggacgggagcgcggcccuccagccccugcugcacacggugaaggccggcuccccgagcgacaugccccgcgacuccggcaucuacgacagcuccguccccagcuccgagcucagccugccccugauggaggggcucuccaccgaccagaccgagaccagcucccugacggagagcgugagcuccagcuccggccugggggaggaggagccgcccgcccuccccagcaagcugcuguccagcggcuccugcaaggccgaccucgggugccggagcuacaccgacgagcugcacgcgguggcgccccuguga

SEQ ID NO: 31531 - RNA, 1602 nt, Artificial Sequence
  derived and/or modified sequence opt1 from IL17RE__Homo_sapiens__NP_001180309
augggcagcucccgccuggccgcccuccugcugccccuccugcugaucgugaucgaccucagcgacuccgcggggaucggcuuccggcaccucccccacuggaacacccgcugcccccuggccagccacaccgacgacuccuucacggggagcuccgccuacauccccugccggaccuggugggcccuguucagcaccaagcccuggugcguccgcguguggcacugcucccggugccugugccagcaccuccugagcggcggguccggccugcagcgcggccuguuccaccuccuggugcagaaguccaagaaguccagcaccuucaaguucuaccggcgccacaagaugccggcccccgcgcagcggaagcugcucccccgccggcaccugagcgagaagucccaccacaucagcauccccagcccggacaucucccacaaggggcugcgcagcaagcggacgcagcccagcgaccccgagaccugggagucccucccccgccuggacagccagcggcacggcgggccggaguucuccuucgaccugcuccccgaggcccgcgccauccgggucaccaucagcuccggccccgaggugagcgugcgccugugccaccagugggcccuggagugcgaggagcucuccagccccuacgacguccagaagaucguguccgggggccacaccguggagcugccguacgaguuccugcuccccugccugugcaucgaggcgagcuaccugcaggaggacacgguccggcgcaagaagugccccuuccaguccuggcccgaggccuacggcagcgacuucuggaaguccgugcacuucaccgacuacagccagcacacccagauggugauggcccucacccugcggugcccgcugaagcucgaggccgcccugugccagcgccacgacuggcacacgcugugcaaggaccuccccaacgcgaccgcccgcgaguccgacgggugguacguccuggagaagguggaccugcacccccagcucugcuucaaguucagcuucggcaacuccagccacguggagugcccccaccagaccgggucccugaccagcuggaacgucagcauggacacgcaggcccagcagcugauccuccacuucuccagccggaugcacgccaccuucuccgccgcguggagccugccgggccugggccaggacacccucgugccgcccguguacaccgucucccaggcccgcgggagcucccccgugagccuggaccugaucauccccuuccugcggcccggcugcugcgugcuccugcacgccucccugagcucccccgggggcgaggacgccuggcucaucggggucggcggcagcgugccguccgggguggccguccgcugccccgugugccuggaggcgccccuggucagcggcugccuccugcagacgcccggggcccuggacccgggcaccgccgggccgccccaccccaccggcugcugcuccggcccccaccuccccgcccccaccgugcggcccgggccgagcgccgcguccgccccgcccgcccgcggcgggcugggcggggccgcggcccccggcggcagcgccggguga

SEQ ID NO: 31532 - RNA, 1011 nt, Artificial Sequence
  derived and/or modified sequence opt1 from IL17REL__Homo_sapiens__NP_001001694
augagccgcuccgugcuggaggcccucaccagcuccaccgccaugcagugcguccccagcgacggcugcgcgaugcugcugcgggugcgcgccuccaucacccuccacgagcggcugcgcgggcuggaggccugcgccaugagccucgacacccaggagacccagugccaguccgugugggucgcccgggcgagccaccgccagcagggcgggcagcagcuccaggugcacuucggcugcuucgccguguccgucgcccagcaccuguacgugacccugcggacgaucccgcacuucugcggggugcagcuggaccagcgccaccuggucgaggccggcaagcucagcuacuggguggaccggcgccggaaggcgauccuggugcaggucccccgcgccuccggcagccccgacuacuaccugcggcucugccugaagcgcuucacgugcgaggacgccggggcccccgugcgggugaccgccaacuccgucagccaggcgguguuccugccguacucccaggagcuccccugccugugccuggagggcuggagcgccacccccgacgccgugcgcauccagaucugccccuucgagaacgacacggaggcccucgagguccugugggacaccguguacuaccacccggagucccagacccugagcugggagcccgccugccccguguccgggcacgucagccucugcuggcggcccggcccgggggcgggcugccgcaagcugcagcagagcucccagcuggugcaccggcgcgugcaguacccccucgucgacacccagccccagcugugccugaaguucagcacguccuggggcagcugggugcggugccccuucgagcagcgccgcuucccgaccccgcccaccucccggugcacgugcgucaccgggggcagccacuccagccuccccgccaacgcccacucccgccccgcccggagccugcagccccaggugaccuggcagccgccccugcuccugcccuccuga

SEQ ID NO: 31533 - RNA, 585 nt, Artificial Sequence
  derived and/or modified sequence opt1 from IL18BP__Homo_sapiens__NP_001034749
augaccaugcgccacaacuggacccccgaccugagcccgcucugggugcugcugcucugcgcccacgucgugacgcugcuggugcgggccacccccgucucccagaccaccacggcggccaccgccagcgugcgcuccaccaaggaccccugccccagccagccgcccguguuccccgccgccaagcagugccccgcgcucgaggucaccuggccggagguggaggugccccugaacggcacgcugucccucagcugcgucgccugcucccgguuccccaacuucagcauccuguacuggcuggggaacggcuccuucaucgagcaccuccccgggcgccugugggagggcagcaccucccgggagcgcgggagcaccggcacccagcugugcaaggcccucgugcuggagcagcugacgccggcccuccacuccaccaacuucagcugcgugcuggucgaccccgagcaggucgugcagcggcacguggugcuggcgcagcucugggccggccugcgcgccacccugccgcccacccaggaggcccuccccuccagccacuccagcccccagcagcagggguga

SEQ ID NO: 31534 - RNA, 570 nt, Artificial Sequence
  derived and/or modified sequence opt1 from IL18__Homo_sapiens__NP_001230140
auggccgccgagcccguggaggacaacugcaucaacuucgucgccaugaaguucaucgacaacacccuguacuucaucgagaaccucgagagcgacuacuucggcaagcuggaguccaagcugagcgugauccgcaaccucaacgaccaggugcuguucaucgaccaggggaaccggccgcuguucgaggacaugaccgacuccgacugccgcgacaacgcgccccggacgaucuucaucaucagcauguacaaggacucccagccccgcggcauggccgucaccaucagcgugaagugcgagaagaucuccacccucagcugcgagaacaagaucaucuccuucaaggagaugaacccgcccgacaacaucaaggacaccaagagcgacaucaucuucuuccagcgguccgugcccgggcacgacaacaagaugcaguucgagagcuccagcuacgagggcuacuuccuggccugcgagaaggagcgcgaccuguucaagcucauccugaagaaggaggacgagcugggggaccgguccaucauguucacgguccagaacgaggacuga

SEQ ID NO: 31535 - RNA, 1626 nt, Artificial Sequence
  derived and/or modified sequence opt1 from IL18R1__Homo_sapiens__NP_003846
augaacugccgcgagcugccccucacccugugggugcugaucagcgucuccaccgccgagagcugcacgucccggccgcacaucaccgugguggagggcgagcccuucuaccucaagcacugcagcugcucccuggcccacgagaucgagaccaccaccaagagcugguacaaguccagcgggucccaggagcacgucgagcugaacccccgcagcuccagccggaucgcgcuccacgacugcgugcuggaguucuggcccguggagcugaacgacaccggcuccuacuucuuccagaugaagaacuacacccagaaguggaagcucaacgucauccgccggaacaagcacagcugcuucaccgagcgccaggugacguccaagaucguggaggucaagaaguucuuccagaucacgugcgagaacagcuacuaccagacccuggugaacuccaccagccuguacaagaacugcaagaagcuccugcuggagaacaacaagaacccgacgaucaagaagaacgccgaguucgaggaccagggguacuacuccugcgugcacuuccuccaccacaacggcaagcuguucaacaucaccaagaccuucaacaucaccaucgucgaggaccggagcaacaucgugcccgugcugcucgggcccaagcugaaccacgucgccguggagcugggcaagaacgugcgccucaacugcagcgcccugcugaacgaggaggacgucaucuacuggauguucggcgaggagaacggguccgaccccaacauccacgaggagaaggagaugcggaucaugacgccggagggcaaguggcacgccagcaaggugcuccgcaucgagaacaucggggaguccaaccugaacgugcuguacaacugcaccgucgcgagcaccggcgggaccgacacgaaguccuucauccucgugcggaaggccgacauggccgacauccccggccacguguucacccgcggcaugaucaucgccguccugauccugguggcggucgugugccucgugaccgucugcgugaucuaccggguggaccugguccuguucuaccgccaccucacccggcgcgacgagacgcugaccgacgggaagaccuacgacgccuucgugagcuaccugaaggagugccggcccgagaacggcgaggagcacaccuucgccguggagauccucccccgcguccuggagaagcacuucggguacaagcugugcaucuucgagcgggacguggugccgggcggcgccgucguggacgagauccacucccucaucgagaagucccgccggcugaucaucgugcugagcaagagcuacauguccaacgagguccgcuacgagcucgagagcgggcugcacgaggcccugguggagcgcaagaucaagaucauccucaucgaguucacgcccgugaccgacuucaccuuccugccccagucccugaagcuccucaagagccaccggguccugaaguggaaggcggacaagucccugagcuacaacucccgcuucuggaagaaccugcuguaccugaugcccgccaagaccgugaagccgggccgggacgagcccgaggugcuccccguccugagcgaguccuga

SEQ ID NO: 31536 - RNA, 1800 nt, Artificial Sequence
  derived and/or modified sequence opt1 from IL18RAP__Homo_sapiens__NP_003844
augcugugccucggcuggaucuuccuguggcugguggccggggagcgcaucaagggcuucaacaucagcgggugcuccaccaagaagcuccuguggaccuacagcacgcgguccgaggaggaguucguccuguucugcgaccuccccgagccgcagaagucccacuucugccaccgcaaccggcugagccccaagcagguccccgagcaccuccccuucaugggcagcaacgaccuguccgacgugcagugguaccagcagccgagcaacggggacccccuggaggacauccgcaaguccuacccccacaucauccaggacaagugcacccugcacuuccucacccccggcgugaacaacagcggcuccuacaucugccggccgaagaugaucaagagccccuacgacguggccugcugcgugaagaugauccuggaggucaagccccagaccaacgcguccugcgaguacagcgccucccacaagcaggaccugcuccuggggagcacgggcuccaucagcugccccucccugagcugccagagcgacgcccaguccccggccgugaccugguacaagaacgggaagcuccugagcguggagcgcuccaaccggaucgucguggacgagguguacgacuaccaccagggcaccuacgucugcgacuacacccagagcgacacgguguccagcuggaccgugcgcgccgucguccaggugcggaccaucgugggggacaccaagcugaagcccgacauccucgaccccguggaggacacgcuggagguggagcugggcaagccccucaccaucuccugcaaggcgcgcuucggcuucgagcgggucuucaacccggugaucaagugguacaucaaggacagcgaccuggagugggagguguccguccccgaggccaagagcaucaaguccacccugaaggacgagaucaucgagcgcaacaucauccucgagaaggugacccagcgggaccugcgccggaaguucgucugcuucgugcagaacagcaucgggaacacgacccaguccgugcagcugaaggagaagcgcggcgucgugcuccuguacauccugcucgggaccaucggcacccugguggccguccuggccgcgagcgcccuccuguaccggcacuggaucgagaucgugcugcucuaccgcacguaccaguccaaggaccagacccugggcgacaagaaggacuucgacgccuucgugagcuacgccaagugguccagcuuccccuccgaggccaccagcagccuguccgaggagcaccucgcgcugagccuguuccccgacguccucgagaacaaguacggguacucccugugccugcucgagcgggacguggccccgggcgggguguacgccgaggacaucgucagcaucaucaagcgcucccggcgcggcaucuucauccugagccccaacuacgugaacgggcccuccaucuucgagcugcaggccgccgugaaccuggcgcucgacgaccagacccugaagcugauccucaucaaguucugcuacuuccaggagcccgagagccugccgcaccuggucaagaaggcccuccgcgugcugcccacggugaccuggcggggccugaaguccgucccgcccaacagccgcuucugggccaagaugcgguaccacaugcccgugaagaacucccagggcuucaccuggaaccagcuccgcaucaccagccggaucuuccaguggaaggggcugucccgcacggagaccaccggccggagcucccagcccaaggagugguga

SEQ ID NO: 31537 - RNA, 534 nt, Artificial Sequence
  derived and/or modified sequence opt1 from IL19__Homo_sapiens__NP_037503
augaagcugcagugcgugagccucuggcugcugggcaccauccucauccugugcuccgucgacaaccacgggcugcgccggugccucaucagcaccgacaugcaccacaucgaggaguccuuccaggagaucaagcgcgccauccaggccaaggacacguuccccaacgugaccauccugagcacccuggagacccuccagaucaucaagccgcuggacgugugcugcgucacgaagaaccugcucgcguucuacguggaccggguguucaaggaccaccaggagcccaaccccaagauccugcgcaagaucuccagcaucgccaacuccuuccuguacaugcagaagacccuccggcagugccaggagcagcgccagugccacugccggcaggaggccaccaacgccacccgcgucauccacgacaacuacgaccagcuggaggugcacgccgcggccaucaagagccugggcgagcucgacguguuccuggccuggaucaacaagaaccacgaggucauguucuccgccuga

SEQ ID NO: 31538 - RNA, 816 nt, Artificial Sequence
  derived and/or modified sequence opt1 from IL1A__Homo_sapiens__NP_000566
auggccaaggugcccgacauguucgaggaccugaagaacugcuacagcgagaacgaggaggacuccagcuccaucgaccaccucagccugaaccagaaguccuucuaccacgucagcuacggcccgcugcacgagggcugcauggaccaguccgugagccucuccaucagcgagaccuccaagaccagcaagcugacguucaaggaguccaugguggucguggccaccaacggcaaggugcugaagaagcgccggcucagccugucccagagcaucaccgacgacgaccuggaggcgaucgccaacgacuccgaggaggagaucaucaagccccgcagcgcccccuucuccuuccucagcaacgucaaguacaacuucaugcggaucaucaaguacgaguucauccugaacgacgcccugaaccagagcaucauccgcgccaacgaccaguaccucaccgcggccgcccugcacaaccuggacgaggccgugaaguucgacaugggggcguacaaguccagcaaggacgacgccaagaucacggugauccuccggaucuccaagacccagcuguacgucaccgcccaggacgaggaccagcccgugcugcucaaggagaugccggagauccccaagaccaucacgggcagcgagaccaaccugcuguucuucugggagacccacgggaccaagaacuacuucacguccguggcccaccccaaccucuucaucgccaccaagcaggacuacugggucugccuggcgggcgggcccccgagcaucaccgacuuccagauccuggagaaccaggccuga

SEQ ID NO: 31539 - RNA, 810 nt, Artificial Sequence
  derived and/or modified sequence opt1 from IL1B__Homo_sapiens__NP_000567
auggccgaggugcccgagcuggccagcgagaugauggcguacuacuccggcaacgaggacgaccucuucuucgaggccgacgggccgaagcagaugaagugcagcuuccaggaccuggaccugugcccccucgacggcgggauccagcugcgcaucuccgaccaccacuacagcaagggcuuccggcaggccgccuccgucgugguggccauggacaagcugcgcaagaugcucguccccugcccccagaccuuccaggagaacgaccugagcaccuucuucccguucaucuucgaggaggagcccaucuucuucgacacgugggacaacgaggcguacgugcacgacgcccccgugcggucccugaacugcacccuccgcgacagccagcagaagucccuggucaugagcgggcccuacgagcugaaggcccuccaccuccagggccaggacauggagcagcaggucguguucuccaugagcuucgugcagggcgaggaguccaacgacaagaucccgguggcccuggggcugaaggagaagaaccuguaccugagcugcgugcucaaggacgacaagcccacccugcagcuggaguccgucgaccccaagaacuaccccaagaagaagauggagaagcgguucguguucaacaagaucgagaucaacaacaagcucgaguucgagagcgcgcaguucccgaacugguacaucuccaccagccaggccgagaacaugcccguguuccugggcgggacgaagggcgggcaggacaucaccgacuucaccaugcaguucgucuccagcuga

SEQ ID NO: 31540 - RNA, 459 nt, Artificial Sequence
  derived and/or modified sequence opt1 from IL1F10__Homo_sapiens__NP_115945
augugcagccugcccauggcccgcuacuacaucaucaaguacgccgaccagaaggcgcucuacacccgggacggccagcugcuggugggggacccggucgccgacaacugcugcgccgagaagaucugcauccuccccaaccgcggccuggcccggaccaaggugcccaucuuccuggggauccagggcgggucccgcugccucgccugcguggagacggaggagggccccagccugcagcuggaggacgucaacaucgaggagcucuacaagggcggggaggaggcgacccgguucaccuucuuccaguccagcuccggcagcgccuuccgccuggaggccgccgcguggccggggugguuccugugcggccccgccgagccccagcagcccgugcagcucaccaaggaguccgagccgagcgcccggacgaaguucuacuucgagcaguccugguga

SEQ ID NO: 31541 - RNA, 1710 nt, Artificial Sequence
  derived and/or modified sequence opt1 from IL1R1__Homo_sapiens__XP_011509420
augaaggugcugcuccgccugaucugcuucaucgcccugcucaucagcucccuggaggccgacaagugcaaggagcgggaggagaagaucauccuggucagcuccgcgaacgagaucgacgugcgccccugcccgcucaaccccaacgagcacaagggcaccaucaccugguacaaggacgacagcaagacgcccguguccaccgagcaggccagccggauccaccagcacaaggagaagcugugguucguccccgccaagguggaggacuccgggcacuacuacugcgugguccgcaacagcuccuacugccugcggaucaagaucagcgccaaguucguggagaacgagccgaaccucugcuacaacgcccaggcgaucuucaagcagaagcugcccguggccggcgacgggggccuggucugccccuacauggaguucuucaagaacgagaacaacgagcuccccaagcugcagugguacaaggacugcaagccgcugcuccuggacaacauccacuucuccggggugaaggaccgccugaucgugaugaacgucgccgagaagcaccggggcaacuacacgugccacgccagcuacaccuaccucggcaagcaguaccccaucacccgcgugaucgaguucaucacccuggaggagaacaagcccacccggcccgugaucgucuccccggcgaacgagaccauggagguggaccuggggagccagauccagcucaucugcaacgugacgggccagcuguccgacaucgccuacuggaaguggaacgggagcgucaucgacgaggacgaccccgugcugggcgaggacuacuacuccguggagaaccccgccaacaagcgccggagcacccucaucaccguccugaacaucuccgagaucgagagccgcuucuacaagcaccccuucacgugcuucgccaagaacacccacgggaucgacgccgcguacauccagcugaucuacccggugaccaacuuccagaagcacaugaucggcaucugcgugacccucaccgucaucaucgugugcagcgucuucaucuacaagaucuucaagaucgacaucgugcugugguaccgggacuccugcuacgacuuccugcccaucaaggccagcgacggcaagacguacgacgccuacauccucuaccccaagaccgugggggagggcuccaccagcgacugcgacaucuucgucuucaaggugcugcccgaggugcuggagaagcagugcggguacaagcuguucaucuacggccgcgacgacuacgucggcgaggacaucguggaggugaucaacgagaacgucaagaagucccggcgccucaucaucauccuggugcgggagaccagcggguucuccuggcucggcgggagcuccgaggagcagaucgccauguacaacgcccuggugcaggacggcaucaaggucgugcugcucgagcuggagaagauccaggacuacgagaagaugccggagagcaucaaguucaucaagcagaagcacggggcgauccgcugguccggcgacuucacgcagggcccccagagcgccaagacccgguucuggaagaacgugcgcuaccacaugcccguccagcggcgcucccccagcuccaagcaccagcugcucagcccggccaccaaggagaagcugcagcgcgaggcccacgugccccugggguga

SEQ ID NO: 31542 - RNA, 1197 nt, Artificial Sequence
  derived and/or modified sequence opt1 from IL1R2__Homo_sapiens__NP_004624
augcugcgccucuacgugcuggucaugggcgugagcgccuucacccugcagcccgccgcgcacaccggggccgcccgguccugccgcuuccggggccgccacuacaagcgggaguuccgccucgagggggagccgguggcccugcggugcccccagguccccuacuggcugugggccagcgugagcccccgcaucaaccucacguggcacaagaacgacuccgcgcggaccgugccgggcgaggaggagacccgcaugugggcccaggacggggcccuguggcugcuccccgcccugcaggaggacuccggcaccuacgucugcacgacccggaacgcgagcuacugcgacaagauguccaucgagcugcgcguguucgagaacaccgacgccuuccuccccuucaucagcuacccccagauccugacccuguccacgagcggcgugcucgucugcccggaccuguccgaguucacccgggacaagaccgacgugaagauccagugguacaaggacagccugcuccuggacaaggacaacgagaaguuccuguccgugcgcgggaccacgcaccuccugguccacgacguggcccuggaggacgccggcuacuaccggugcgugcucaccuucgcccacgaggggcagcaguacaacaucacccgcagcaucgagcugcggaucaagaagaagaaggaggagaccauccccgucaucaucagcccccugaagacgaucuccgcgucccucggcagccgccugaccauccccugcaagguguuccuggggaccggcaccccgcucacgaccaugcugugguggaccgccaacgacacccacaucgaguccgccuaccccggcgggcgggugacggagggcccccgccaggaguacagcgagaacaacgagaacuacaucgaggucccccugaucuucgacccggugacccgggaggaccuccacauggacuucaagugcgugguccacaacacccugagcuuccagacccugcgcacgaccgugaaggaggccuccagcaccuucuccugggggaucgugcucgcgccccugagccuggccuuccucguccugggcggcaucuggaugcaccgccggugcaagcaccgcaccgggaaggccgacggccugacggugcucuggccccaccaccaggacuuccaguccuaccccaaguga

SEQ ID NO: 31543 - RNA, 1713 nt, Artificial Sequence
  derived and/or modified sequence opt1 from IL1RAP__Homo_sapiens__NP_001161401
augacccugcucuggugcguggucagccuguacuucuacggcauccugcaguccgacgccagcgagcgcugcgacgacugggggcucgacaccaugcggcagauccagguguucgaggacgagcccgcccgcaucaagugcccccuguucgagcacuuccugaaguucaacuacuccacggcgcacagcgccggccucacccugaucugguacuggacccggcaggaccgcgaccuggaggagcccaucaacuuccggcuccccgagaaccgcaucuccaaggagaaggacgugcugugguuccggcccacccugcucaacgacacggggaacuacacgugcaugcugcgcaacaccaccuacugcagcaaggucgccuucccgcuggagguggugcagaaggacuccugcuucaacagccccaugaagcuccccguccacaagcuguacaucgaguacggcauccagcggaucacgugccccaacguggacggguacuucccguccagcgugaagcccaccaucaccugguacaugggcugcuacaagauccagaacuucaacaacgucauccccgagggcaugaaccuguccuuccucaucgcccugaucagcaacaacgggaacuacacgugcguggugaccuaccccgagaacggccgcaccuuccaccugacccggacccucaccgucaagguggugggguccccgaagaacgccgucccgcccgugauccacagccccaacgaccacguggucuacgagaaggagcccggcgaggagcugcugauccccugcaccguguacuucuccuuccucauggacagccgcaacgaggugugguggaccaucgacgggaagaagcccgacgacaucaccaucgacgucacgaucaacgaguccaucagccacucccggaccgaggacgagacccgcacccagauccugagcaucaagaaggugacgagcgaggaccugaagcgguccuacgugugccacgcgcgcagcgccaagggcgaggucgccaaggccgcgaaggugaagcagaagguccccgccccgcgguacaccguggagcucgccugcggcuucggggccaccgugcugcuggucgugauccucaucguggucuaccacguguacuggcuggagauggugcuguucuaccgcgcccacuucggcaccgacgagacgauccucgacgggaaggaguacgacaucuacgucuccuacgcgcggaacgccgaggaggaggaguucgugcugcugacccuccgcggcgugcuggagaacgaguucggcuacaagcugugcaucuucgaccgggacagccuccccgggggcaucgucaccgacgagacccuguccuucauccagaagucccgccgccugcucguggugcugagccccaacuacguccugcaggggacgcaggcccuccuggagcugaaggccggccucgagaacauggccagccgggggaacaucaacgugauccuggugcaguacaaggcggucaaggagaccaaggugaaggagcugaagcgcgccaagaccgugcugaccgucaucaaguggaagggcgagaaguccaaguacccccagggccgguucuggaagcagcuccagguggccaugccggugaagaaguccccgcgccggagcagcuccgacgagcaggggcugagcuacuccagccugaagaacgucuga

SEQ ID NO: 31544 - RNA, 2091 nt, Artificial Sequence
  derived and/or modified sequence opt1 from IL1RAPL1__Homo_sapiens__XP_005274498
augaaggcccccaucccgcaccugauccuccuguacgccaccuucacccagagccugaagguggucacgaagcgcggcuccgcggacgggugcaccgacuggagcaucgacaucaagaaguaccaggugcucgugggcgagcccguccggaucaagugcgcccuguucuacggguacauccgcaccaacuacucccuggcccagagcgccggccucucccugaugugguacaagagcuccgggcccggcgacuucgaggagcccaucgccuucgacggcagccggauguccaaggaggaggacagcaucugguuccgcccgacccugcuccaggacuccgggcuguacgcgugcgugauccggaacagcacguacugcaugaagguguccaucagccugaccgucggcgagaacgacaccgggcucugcuacaacuccaagaugaaguacuucgagaaggccgagcugagcaaguccaaggagaucagcugccgcgacaucgaggacuuccugcuccccacccgggagcccgagauccugugguacaaggagugccgcacgaagaccuggcggcccuccaucguguucaagcgcgacacccugcucauccgggaggugcgcgaggacgacaucggcaacuacacgugcgagcugaaguacgggggcuucgucgugcggcgcaccaccgagcugaccgugaccgccccgcucacggacaagccgcccaagcugcuguaccccauggagagcaagcucaccauccaggagacccagcugggcgacagcgccaaccugaccugccgggcguucuucggguacuccggcgacgucagcccccucaucuacuggaugaagggggagaaguucaucgaggaccuggacgagaaccgcgugugggaguccgacauccggauccugaaggagcaccucggcgagcaggaggugagcaucucccugaucgucgacagcguggaggagggcgaccuggggaacuacuccugcuacguggagaacggcaacgggcgccggcacgccagcguccuccugcacaagcgcgagcugauguacacgguggagcucgccggcgggcugggcgccauccugcuccugcuggugugccucgucaccaucuacaagugcuacaagaucgagaucaugcuguucuaccggaaccacuucggcgccgaggagcuggacggggacaacaaggacuacgacgcguaccucuccuacaccaagguggaccccgaccaguggaaccaggagaccggcgaggaggagcgcuucgcccuggagauccugcccgacaugcucgagaagcacuacggguacaagcuguucauccccgaccgcgaccugaucccgacgggcaccuacaucgaggacguggcccggugcgucgaccagagcaagcgccugaucaucgugaugacccccaacuacgucgugcggcgcgggugguccaucuucgagcucgagacccggcugcgcaacaugcuggugacgggcgagaucaaggucauccucaucgagugcagcgagcugcggggcaucaugaacuaccaggagguggaggcccugaagcacaccaucaagcuccugaccgugaucaaguggcacgggcccaagugcaacaagcugaacuccaaguucuggaagcgccuccaguacgagaugcccuucaagcggaucgagccgaucacccacgagcaggcccuggacgucagcgagcagggccccuucggggagcugcagacgguguccgcgaucagcauggccgccgccaccuccaccgcccucgcgaccgcccaccccgaccugcgcagcacguuccacaacaccuaccacucccagaugcggcagaagcacuacuaccgcagcuacgaguacgacgugcccccgaccggcacccugccccucaccagcaucgggaaccagcacacguacugcaacauccccaugacccugaucaacggccagcggccccagaccaaguccagccgcgagcagaacccggacgaggcccacaccaacuccgccauccugccccuccugccccgggagacgagcaucuccagcgucaucugguga

SEQ ID NO: 31545 - RNA, 2061 nt, Artificial Sequence
  derived and/or modified sequence opt1 from IL1RAPL2__Homo_sapiens__NP_059112
augaagcccccguuccugcucgcccugguggucugcagcgugguguccaccaaccugaagauggucagcaagcgcaacuccguggacggcugcaucgacuggagcguggaccucaagaccuacauggcccuggcgggggagcccguccgggugaagugcgcccuguucuacuccuacauccgcacgaacuacagcaccgcccaguccaccggccuccggcugaugugguacaagaacaagggggaccuggaggagcccaucaucuucagcgaggugcgcauguccaaggaggaggacagcaucugguuccacuccgccgaggcccaggacagcggcuucuacacgugcguccuccggaacuccaccuacugcaugaaggugagcaugucccugaccguggcggagaacgagagcgggcugugcuacaacucccgcauccgguaccucgagaaguccgaggucaccaagcgcaaggagaucagcugccccgacauggacgacuucaagaaguccgaccaggagccggacguggugugguacaaggagugcaagcccaagauguggcggagcaucaucauccagaagggcaacgcccugcugauccaggagguccaggaggaggacggcgggaacuacacgugcgagcucaaguacgagggcaagcuggugcgccggaccaccgagcugaaggugaccgcccuccugaccgacaagccgcccaagccccuguuccccauggagaaccagcccagcgucaucgacgugcagcucgggaagccccugaacaucccgugcaaggccuucuucggcuucagcggggaguccggccccaugaucuacuggaugaagggcgagaaguucaucgaggagcuggcggggcacauccgcgagggcgagauccggcuccugaaggagcaccugggggagaaggagguggagcucgcccugaucuucgacagcgucguggaggccgaccuggccaacuacacgugccacguggagaaccgcaacggccggaagcacgccuccguccuccugcgcaagaaggaccugaucuacaagaucgagcucgcgggcgggcugggcgccaucuuccugcuccuggugcugcucgucgugaucuacaagugcuacaacaucgagcugaugcuguucuaccggcagcacuucggggccgacgagaccaacgacgacaacaaggaguacgacgccuaccucagcuacaccaagguggaccaggacacccuggacugcgacaaccccgaggaggagcaguucgcccuggagguccuccccgacgugcuggagaagcacuacggcuacaagcuguucaucccggagcgcgaccucauccccuccgggacguacauggaggaccugacccgguacguggagcagagccgccggcugaucaucguccugacccccgacuacauccuccgccgcggcugguccaucuucgagcuggagagccggcugcacaacaugcucguguccggcgagaucaaggugauccugaucgagugcaccgagcugaaggggaaggucaacugccaggagguggagagccucaagcgcuccaucaagcugcugagccucaucaaguggaagggcuccaagagcuccaagcugaacagcaaguucuggaagcaccugguguacgagaugcccaucaagaagaaggagaugcucccgcggugccacguccuggacuccgcggagcaggggcuguucggcgagcuccagcccauccccagcaucgccaugacgagcaccuccgccacccuggugagcucccaggccgaccugcccgaguuccacccgagcgacuccaugcagauccgccacugcugccggggguacaagcacgagauccccgccaccacgcuccccgugcccagccugggcaaccaccacaccuacugcaaccugccgcucacccugcugaacggccagcucccccugaacaacacccugaaggacacgcaggaguuccaccgcaacuccagccuccugccccuguccagcaaggagcucuccuucaccagcgacaucugguga

SEQ ID NO: 31546 - RNA, 636 nt, Artificial Sequence
  derived and/or modified sequence opt1 from IL1RL1__Homo_sapiens__NP_001269337
auguacagcaccguguccggcagcgagaagaacuccaagaucuacugccccaccaucgaccuguacaacuggacggccccgcucgagugguucaagaacugccaggcccugcaggggagccgcuaccgggcgcacaaguccuuccuggucaucgacaacgugaugaccgaggacgccggcgacuacacgugcaaguucauccacaacgagaacggggccaacuacagcgugaccgccacccgcuccuucaccgucaaggacgagcagggcuucagccucuuccccgugaucggggcccccgcgcagaacgagaucaaggagguggagaucggcaagaacgccaaccugaccugcuccgccugcuucggcaaggggacccaguuccuggccgcgguccucuggcagcugaacggcacgaagaucaccgacuucggggagccccggauccagcaggaggagggccagaaccagagcuucuccaacgggcuggccugccucgacauggugcugcgcaucgccgacgugaaggaggaggaccugcuccugcaguacgacugccuggcccucaaccugcacggccugcggcgccacaccguccggcucagccgcaagaacccguccaaggagugcuucuga

SEQ ID NO: 31547 - RNA, 1728 nt, Artificial Sequence
  derived and/or modified sequence opt1 from IL1RL2__Homo_sapiens__NP_003845
auguggagccugcuccugugcggccuguccaucgcccucccccugagcgugaccgccgacgggugcaaggacaucuucaugaagaacgagauccuguccgcgagccagccguucgccuucaacugcaccuucccgcccaucacguccggcgaggucagcgugaccugguacaagaacuccagcaagauccccguguccaagaucauccagagccgcauccaccaggacgagaccuggauccucuuccugcccauggaguggggcgacuccggggucuaccagugcgugaucaaggggcgggacagcugccaccgcauccacgugaaccugaccgucuucgagaagcacuggugcgacacguccaucggcggccuccccaaccugagcgacgaguacaagcagauccugcaccucgggaaggacgacucccugaccugccaccuccacuuccccaagagcugcgugcugggccccaucaagugguacaaggacugcaacgagaucaagggggagcgguucaccgugcuggagacccgccugcucgucuccaacgugagcgccgaggaccggggcaacuacgccugccaggccauccugacgcacuccgggaagcaguacgaggugcugaacggcaucaccgucagcaucaccgagcgcgcgggcuacgggggcagcgugccgaagaucaucuaccccaagaaccacuccaucgaggugcagcucgggaccacgcugaucgucgacugcaacgugaccgacaccaaggacaacaccaaccugcggugcuggcgcgugaacaacacgcucgucgacgacuacuacgacgagagcaagcggauccgcgagggcguggagacccacguguccuuccgggagcacaaccuguacaccgucaacaucaccuuccuggaggugaagauggaggacuacggccuccccuucaugugccacgccggggugagcacggccuacaucauccugcagcugcccgccccggacuuccgcgcguaccucaucggcgggcugaucgcccuggucgccguggccgucuccgugguguacaucuacaacaucuucaagaucgacaucguccucugguaccggagcgccuuccacuccaccgagaccaucguggacggcaagcuguacgacgcguacgugcuguaccccaagccccacaaggagagccagcgccacgccgucgacgcccucgugcugaacauccugcccgaggugcucgagcggcagugcggguacaagcuguucaucuucggccgcgacgaguucccgggccaggccgucgccaacgugaucgacgagaacgugaagcugugccggcgccucaucgucaucguggugcccgagucccugggguucggccugcucaagaaccugagcgaggagcagaucgcggucuacuccgcccugauccaggacgggaugaaggugauccucaucgagcuggagaagaucgaggacuacaccgugaugcccgagagcauccaguacaucaagcagaagcacggcgccauccgguggcacggggacuucacggagcagucccagugcaugaagaccaaguucuggaagaccguccgcuaccacaugcccccgcggcgcugccgccccuucccgcccgugcagcugcugcagcacacccccugcuaccggacggccggccccgagcucggcagccgccggaagaagugcacccugaccaccggguga

SEQ ID NO: 31548 - RNA, 480 nt, Artificial Sequence
  derived and/or modified sequence opt1 from IL1RN__Homo_sapiens__NP_000568
auggcccuggagaccaucugccgccccagcggccggaaguccagcaagaugcaggccuuccgcaucugggacgugaaccagaagaccuucuaccuccggaacaaccagcuggucgcgggguaccugcagggcccgaacgugaaccucgaggagaagaucgacgugguccccaucgagccccacgcccuguuccuggggauccacggcgggaagaugugccucuccugcgucaagagcggcgacgagacgcgccugcagcuggaggccgugaacaucaccgaccucuccgagaaccggaagcaggacaagcgcuucgccuucauccggagcgacuccggccccaccaccagcuucgaguccgccgcgugcccggggugguuccugugcacggccauggaggccgaccagcccgugagccugaccaacaugcccgacgagggcgugauggugaccaaguucuacuuccaggaggacgaguga

SEQ ID NO: 31549 - RNA, 531 nt, Artificial Sequence
  derived and/or modified sequence opt1 from IL20__Homo_sapiens__NP_061194
augaaggccagcucccuggccuucagccuccuguccgcggccuucuaccugcucuggacccccagcaccggccugaagacgcugaaccucggguccugcgugaucgccaccaaccugcaggagauccgcaacggcuucagcgagauccggggguccguccaggccaaggacggcaacaucgacauccgcauccugcggcgcaccgagagccuccaggacaccaagccggccaaccggugcugccugcugcgccaccuccugcggcuguaccucgaccgcguguucaagaacuaccagacgcccgaccacuacacccugcggaagaucuccagccuggcgaacuccuuccucaccaucaagaaggaccugcgccugugccacgcccacaugaccugccacugcggggaggaggccaugaagaaguacagccagauccucucccacuucgagaagcuggagccccaggccgcgguggucaaggcccugggcgagcucgacauccugcugcaguggauggaggagacggaguga

SEQ ID NO: 31550 - RNA, 1515 nt, Artificial Sequence
  derived and/or modified sequence opt1 from IL20RA__Homo_sapiens__NP_001265651
augaagaacgugcugcaguggaccccgcccgagggccuccagggggucaaggugaccuacacggugcaguacuucaucuacggccagaagaaguggcugaacaagagcgagugccgcaacaucaaccggaccuacugcgaccuguccgccgagaccagcgacuacgagcaccaguacuacgccaaggucaaggcgaucugggggaccaagugcuccaagugggccgagagcggccgcuucuaccccuuccucgagacgcagaucgggccgcccgagguggcccugaccaccgacgagaaguccaucagcgugguccugaccgcccccgagaaguggaagcggaaccccgaggaccuccccguguccaugcagcagaucuacagcaaccugaaguacaacguguccguccugaacaccaagagcaaccgcaccuggucccagugcgugaccaaccacacccucgugcugacguggcuggagcccaacacccucuacugcguccacguggagagcuucgugcccggcccgccccggcgcgcccagcccuccgagaagcagugcgcgcggacccugaaggaccagagcuccgaguucaaggccaagaucaucuucugguacguccugcccaucagcaucaccguguuccucuucuccgugaugggcuacagcaucuaccgcuacauccacgucgggaaggagaagcaccccgccaaccugauccugaucuacggcaacgaguucgacaagcgguucuucgugcccgccgagaagaucgugaucaacuucaucacgcucaacaucuccgacgacagcaagaucagccaccaggacaugucccugcugggcaagagcuccgacgucagcucccucaacgacccccagccgagcgggaaccugcgcccgccccaggaggaggaggaggugaagcaccugggguacgcgucccaccucauggagaucuucugcgacagcgaggagaacaccgagggcaccucccugacccagcaggagagccugucccggacgaucccgcccgacaagaccgugaucgaguacgaguacgacguccgcaccaccgacaucugcgccggccccgaggagcaggagcucagccugcaggaggagguguccacgcaggggacccugcucgagagccaggccgcccuggccguccugggcccccagacccuccaguacuccuacacgccccagcugcaggaccuggacccccucgcgcaggagcacacggacagcgaggaggggcccgaggaggagcccuccaccacccugguggacugggacccccagaccggccggcugugcaucccgagccucuccagcuucgaccaggacagcgagggcugcgagcccuccgagggggacggccugggggaggagggccugcucagccgccuguacgaggagcccgccccggaccggccgcccggggagaacgagacguaccugaugcaguucauggaggaguggggccucuacgugcagauggagaacuga

SEQ ID NO: 31551 - RNA, 936 nt, Artificial Sequence
  derived and/or modified sequence opt1 from IL20RB__Homo_sapiens__NP_653318
augcagaccuucaccauggugcuggaggagaucuggacgagccucuucaugugguucuucuacgcccugauccccugccugcucaccgacgaggucgccauccugccggcgccccagaaccuguccgugcucagcaccaacaugaagcaccuccugauguggucccccgugaucgcccccggcgagaccgucuacuacagcguggaguaccagggggaguacgagucccuguacacgagccacaucuggaucccguccagcuggugcucccugaccgagggccccgagugcgacgugaccgacgacaucaccgccacgguccccuacaaccugcgcgugcgggccacccucgggagccagaccuccgccuggagcauccugaagcaccccuucaaccgcaacuccaccauccugacgcggccgggcauggagaucaccaaggacggguuccaccucgugaucgagcuggaggaccugggcccccaguucgaguuccucgucgcguacuggcgccgggagcccggcgccgaggagcacgugaagauggugcgcagcgggggcauccccguccaccuggagaccauggagccgggggccgccuacugcgugaaggcgcagaccuucgugaaggccaucggccgguacuccgccuucagccagacggagugcgucgaggugcagggggaggccaucccccuggugcucgcccuguucgcguucgucggcuucaugcugauccucgugguggucccccuguucguguggaagaugggccgccugcuccaguacuccugcugccccguggucgugcugccggacacccugaagaucaccaacagcccccagaagcucaucuccugccggcgcgaggaggucgacgccugcgccaccgccgugaugagccccgaggagcugcugcgggccuggaucagcuga

SEQ ID NO: 31552 - RNA, 489 nt, Artificial Sequence
  derived and/or modified sequence opt1 from IL21__Homo_sapiens__NP_068575
augcgcagcucccccggcaacauggagcggaucgugaucugccugauggucaucuuccucgggacccuggugcacaagagcuccagccagggccaggaccgccacaugauccggaugcgccagcugaucgacaucguggaccagcucaagaacuacgucaacgaccuggugcccgaguuccugcccgcccccgaggacguggagaccaacugcgagugguccgccuucagcugcuuccagaaggcgcagcucaaguccgccaacacggggaacaacgagcggaucaucaacgucagcaucaagaagcugaagcgcaagcccccguccaccaacgccggccggcgccagaagcaccggcugaccugccccagcugcgacuccuacgagaagaagccgcccaaggaguuccucgagcgcuucaagagccugcugcagaagaugauccaccagcaccucuccagccggacccacggguccgaggacagcuga

SEQ ID NO: 31553 - RNA, 1617 nt, Artificial Sequence
  derived and/or modified sequence opt1 from IL21R__Homo_sapiens__NP_068570
augccccgcggcugggccgccccgcugcuccugcugcuccugcagggcggcugggggugccccgaccuggugugcuacaccgacuaccuccagaccgucaucugcauccuggagauguggaaccugcaccccagcacgcucacccugaccuggcaggaccaguacgaggagcugaaggacgaggcgaccuccugcagccuccaccgguccgcccacaacgccacgcacgccaccuacacgugccacauggacguguuccacuucauggccgacgacaucuucagcgugaacaucaccgaccaguccggcaacuacagccaggagugcggguccuuccugcuggcggagagcaucaagcccgccccgcccuucaacgucaccgugaccuucuccggccaguacaacaucagcuggcgcuccgacuacgaggaccccgccuucuacaugcucaagggcaagcugcaguacgagcugcaguaccggaaccgcggggaccccugggccgugagcccgcggcgcaagcucaucuccgucgacagccgguccgugagccugcugccccucgaguuccgcaaggacuccagcuacgagcuccaggugcgggcgggccccaugcccggguccagcuaccagggcaccuggagcgagugguccgaccccgucaucuuccagacccagagcgaggagcugaaggagggguggaacccccaccuccugcugcuccugcugcucgugaucguguucauccccgccuucuggucccugaagacgcacccccuguggcgccucuggaagaagaucugggccgucccgagccccgagcgguucuucaugccccuguacaagggcugcuccggcgacuucaagaagugggugggggcccccuucaccggcagcucccuggagcucgggccguggagccccgaggugcccuccacccuggaggucuacagcugccacccgccccgcucccccgccaagcggcugcagcucaccgagcugcaggagcccgcggagcugguggagagcgacggcgugcccaagccguccuucuggcccacggcccagaacagcggcggguccgccuacagcgaggagcgcgaccggcccuacggccucgucuccaucgacaccgugaccgugcuggacgccgaggggccgugcaccuggcccugcagcugcgaggacgacggcuaccccgcccuggaccucgacgcggggcuggagcccuccccgggccuggaggacccccuccuggacgccggcacgaccguccugagcugcgggugcgugagcgccggcucccccgggcugggcgggccccucggcagccugcuggaccgccucaagccgccccuggccgacggcgaggacugggccgggggccugcccuggggcgggcggucccccgggggcgugagcgaguccgaggcgggcagcccgcucgccgggcuggacauggacaccuucgacuccggcuucgucgggagcgacugcuccagccccguggagugcgacuucaccucccccggcgacgaggggcccccgcgcagcuaccugcggcagugggucgugaucccgccgccccuguccagccccgggccccaggccuccuga

SEQ ID NO: 31554 - RNA, 540 nt, Artificial Sequence
  derived and/or modified sequence opt1 from IL22__Homo_sapiens__NP_065386
auggccgcccugcagaaguccgugagcagcuuccucaugggcacccuggcgaccuccugccugcuccugcuggcccuccugguccagggcggggccgccgcccccaucagcucccacugccgccuggacaagagcaacuuccagcagccguacaucacgaaccggaccuucaugcucgcgaaggaggccucccuggccgacaacaacaccgacgugcgccugaucggggagaagcuguuccacggcgugagcauguccgagcggugcuaccucaugaagcagguccugaacuucacccucgaggaggugcuguucccccagagcgaccgcuuccagcccuacaugcaggaggugguccccuuccuggcccggcucuccaaccgccugagcacgugccacaucgagggggacgaccugcacauccagcggaacgugcagaagcucaaggacaccgugaagaagcugggcgaguccggcgagaucaaggcgaucggggagcuggaccuccuguucaugagccugcgcaacgccugcaucuga

SEQ ID NO: 31555 - RNA, 792 nt, Artificial Sequence
  derived and/or modified sequence opt1 from IL22RA2__Homo_sapiens__NP_443194
augaugcccaagcacugcuuccugggcuuccucaucagcuucuuccugaccgggguggccggcacccaguccacccacgagagccugaagccgcagcgcguccaguuccagucccggaacuuccacaacauccuccaguggcagcccgggcgcgcccugaccggcaacagcuccguguacuucgugcaguacaagaucauguucagcugcuccaugaaguccagccaccagaagcccagcgggugcuggcagcacaucuccugcaacuuccccggcugccggacccuggcgaaguacggccagcgccaguggaagaacaaggaggacugcugggggacccaggagcucagcugcgaccugacguccgagaccagcgacauccaggagccguacuacggccggguccgcgccgccuccgccgggagcuacuccgaguggagcaugacgccccgguucacccccuggugggagaccaagaucgacccgcccgugaugaacaucacccaggugaacggcucccugcucgucauccugcacgcccccaaccugcccuaccgcuaccagaaggagaagaacgugagcaucgaggacuacuacgagcuccuguaccggguguucaucaucaacaacagccuggagaaggagcagaaggucuacgagggggcgcaccgcgccguggagaucgaggcccucacgccccacuccagcuacugcguggucgccgagaucuaccagccgaugcuggaccggcgcucccagcggagcgaggagcgcugcguggagauccccuga

SEQ ID NO: 31556 - RNA, 570 nt, Artificial Sequence
  derived and/or modified sequence opt1 from IL23A__Homo_sapiens__XP_011536779
augcugggcagccgcgccgugaugcuccugcugcuccugcccuggaccgcccaggggcgggcggucccgggcggguccagccccgccuggacccagugccagcagcugucccagaagcucugcacgcuggccuggagcgcccacccccuggugggccacauggaccuccgcgaggagggggacgaggagaccaccaacgacgugccccacauccagugcggcgacggcugcgacccgcaggggcugcgggacaacucccaguucugccugcagcgcauccaccagggccucaucuucuacgagaagcugcuggggagcgacaucuucaccggcgagcccucccuccugcccgacagccccgucgggcagcugcacgccucccuccugggccugagccagcuccugcagccggagggccaccacugggagacgcagcagauccccucccugagccccucccagcccuggcagcggcuccugcugcgcuucaagauccuccggagccugcaggcguucguggccguggccgcccgcgucuucgcgcacggggccgccacccuguccccguga

SEQ ID NO: 31557 - RNA, 1980 nt, Artificial Sequence
  derived and/or modified sequence opt1 from IL23R__Homo_sapiens__XP_011539091
augcugcucugccacggcauccuguuccccuggauccagguguucgcccgcaagcugcaggaggggaacagccucuuccugcugccggacaugaaccaggucaccauccagugggacgccgugaucgcgcucuacauccuguucuccuggugccacggcgggaucaccaacaucaacugcagcggccacaucuggguggagcccgccacgaucuucaagauggggaugaacaucuccaucuacugccaggccgccaucaagaacugccagccccggaagcugcacuucuacaagaacggcaucaaggagcgcuuccagaucacccggaucaacaagaccaccgcccgccucugguacaagaacuuccuggagccccacgcgagcauguacugcacggccgagugcccgaagcacuuccaggagacccugaucugcggcaaggacaucuccagcggguacccgcccgacauccccgacgaggugaccugcgugaucuacgaguacuccggcaacaugaccugcacguggaacgccgggaagcucaccuacaucgacaccaaguacgugguccacgucaagagccuggagaccgaggaggagcagcaguaccugacguccagcuacaucaacaucuccaccgacagccuccagggcgggaagaaguaccugguguggguccaggccgcgaacgcccugggcauggaggaguccaagcagcuccagauccaccuggacgacaucgugauccccagcgccgccgugaucucccgggccgagaccaucaacgcgaccguccccaagacgaucaucuacugggacagccagaccaccaucgagaagguguccugcgagaugcgcuacaaggccaccacgaaccagaccuggaacgugaaggaguucgacaccaacuucaccuacguccagcagagcgaguucuaccuggagcccaacaucaaguacguguuccaggugcggugccaggagacgggcaagcgcuacuggcagcccugguccagccucuucuuccacaagaccccggagaccgucccccaggugaccagcaaggccuuccagcacgacacguggaacuccgggcugaccguggccagcaucuccaccggccaccugaccagcgacaaccgcggggacaucggccuccugcugggcaugaucgucuucgccgugaugcucuccauccugagccugaucgggaucuucaaccgguccuuccggacgggcaucaagcgccggauccuccugcugauccccaaguggcucuacgaggacauccccaacaugaagaacagcaacguggucaagaugcugcaggagaacuccgagcugaugaacaacaacagcuccgagcagguccucuacguggacccgaugaucaccgagaucaaggagaucuucauccccgagcacaagcccaccgacuacaagaaggagaacaccgggccccuggagacgcgcgacuacccgcagaacagccuguucgacaacaccaccgugguguacauccccgaccucaacaccggcuacaagccccagaucuccaacuuccugcccgaggggagccaccuguccaacaacaacgagaucaccagccucacgcugaagccgcccgucgacucccuggacagcggcaacaacccccggcuccagaagcaccccaacuucgcguucuccgugagcagcgugaacucccugagcaacaccaucuuccugggcgagcucucccugauccugaaccagggggagugcagcuccccggacauccagaacagcgucgaggaggagaccaccaugcugcucgagaacgacucccccagcgagacgauccccgagcagacccugcugccggacgaguucguguccugccucggcaucgugaacgaggagcugcccagcaucaacaccuacuucccccagaacauccuggagucccacuucaaccgcaucagccuccuggagaaguga

SEQ ID NO: 31558 - RNA, 624 nt, Artificial Sequence
  derived and/or modified sequence opt1 from IL24__Homo_sapiens__NP_001172085
augaacuuccagcagcgccugcagagccucuggacccuggccucccggcccuucugcccgccccugcucgccaccgcgagccagaugcagauggugguccugcccugccugggcuucacgcuccugcuguggucccaggugagcggggcccagggccaggaguuccacuucgggcccugccaggugaagggcgucgugccgcagaagcucugggaggccuucugggccgugaaggacaccaugcaggcccaggacaacaucaccuccgcgcgccugcugcagcaggagguccuccagaacgugagcgacgccgaguccugcuaccuggugcacacccugcucgaguucuaccugaagacggucuucaagaacuaccacaaccggaccguggaggugcgcacccucaagagcuucuccacccuggccaacaacuucguccugaucgugagccagcugcagcccucccaggagaacgagauguucagcauccgggacuccgcccaccgccgguuccuccuguuccgccgggcguucaagcagcuggacguggaggccgcccucacgaaggcccugggggaggucgacauccugcucaccuggaugcagaaguucuacaagcuguga

SEQ ID NO: 31559 - RNA, 534 nt, Artificial Sequence
  derived and/or modified sequence opt1 from IL25__Homo_sapiens__NP_073626
augcgcgagcggccccgccugggcgaggacagcucccucaucagccuguuccugcaggucgucgccuuccucgccauggugauggggacccacaccuacucccacuggccgagcugcugccccuccaagggccaggacacgagcgaggagcugcugcggugguccaccgugcccgugcccccgcucgagcccgcgcgccccaaccggcaccccgagagcugccgcgccuccgaggacgggccgcugaacagccgggccaucucccccuggcgcuacgagcuggaccgggaccucaaccgccugccccaggaccuguaccacgcccggugccucugcccccacugcgugagccugcagaccggcucccacauggacccgcgcgggaacagcgagcugcucuaccacaaccagaccguguucuaccggcgccccugccacggcgagaagggcacgcacaagggguacugccuggagcggcgccuguaccgggucucccucgccugcgugugcgugcgcccccgggucaugggcuga

SEQ ID NO: 31560 - RNA, 516 nt, Artificial Sequence
  derived and/or modified sequence opt1 from IL26__Homo_sapiens__XP_011536870
augcuggugaacuucauccuccgcugcggccugcugcucgucacccugagccuggccaucgccaagcacaagcaguccagcuucaccaaguccugcuacccccgggggacgcucagccaggcgguggacgcccuguacaucaaggccgccuggcugaaggccaccaucccggaggaccgcaucaagaacauccggcuccugaagaagaagaccaagaagcaguucaugaagaacugccaguuccaggagcagcugcucuccuucuucauggaggacguguucggccagcugcagcugcaggggugcaagaagauccgcuucgucgaggacuuccacagccuccggcagaagcugucccacugcaucagcugcgcguccagcgcccgcgagaugaaguccaucacccggaugaagcgcaucuucuaccggaucggcaacaaggggaucuacaaggccaucagcgagcuggacauccuccuguccuggaucaagaagcugcucgagagcucccaguga

SEQ ID NO: 31561 - RNA, 732 nt, Artificial Sequence
  derived and/or modified sequence opt1 from IL27__Homo_sapiens__NP_663634
augggccagaccgccggggaccugggcuggcgccucucccugcugcuccugccccugcuccuggugcaggccggggucuggggcuucccgcggccgcccgggcgcccccagcugucccuccaggagcugcggcgcgaguucaccgugagccugcaccucgcgcggaagcugcuguccgaggugcgcggccaggcccaccgguucgccgagagccaccuccccggcgucaaccuguaccugcucccccugggggagcagcugcccgacgugucccucacguuccaggccuggcgccggcugagcgaccccgagcgccugugcuucaucuccaccacccuccagccguuccacgcccugcugggcgggcucggcacccaggggcgguggacgaacauggagcgcaugcagcugugggcgaugcggcuggaccuccgcgaccugcagcggcaccuccgcuuccaggugcuggccgccggcuucaaccugcccgaggaggaggaggaggaggaggaggaggaggaggaggagcggaagggccugcuccccggggcccugggcagcgcgcugcaggggcccgcccaggucuccuggccgcagcuccugagcaccuaccgccugcuccacucccuggagcuggugcucagccgggccgugcgcgagcugcugcuccuguccaaggccggccacagcgucuggccccugggcuuccccacccugagcccccagccguga

SEQ ID NO: 31562 - RNA, 1911 nt, Artificial Sequence
  derived and/or modified sequence opt1 from IL27RA__Homo_sapiens__NP_004834
augcgcggcgggcggggcgcccccuucuggcuguggccccuccccaagcuggcccugcucccccugcuguggguccucuuccagcgcacccggccccaggggagcgccggcccgcugcagugcuacggggucggcccccugggcgaccucaacugcuccugggagccccugggggaccugggcgcccccagcgagcuccaccuccagucccagaaguaccgcagcaacaagacccagacgguggccguggccgccgggcgguccugggucgcgaucccgcgcgagcagcugaccaugagcgacaagcuccugguguggggcaccaaggccgggcagccccuguggccgcccguguucgucaaccucgagacccagaugaagcccaacgcgccccggcugggccccgacguggacuucuccgaggacgacccccuggaggccacggugcacugggccccgcccaccuggcccagccacaagguccucaucugccaguuccacuaccgccggugccaggaggccgccuggacccugcuggagcccgagcucaagaccaucccgcugacgcccguggagauccaggaccuggagcucgccaccggcuacaagguguacgggcgcugccggauggagaaggaggaggaccuguggggcgaguggucccccauccugagcuuccagaccccgcccuccgcccccaaggacgugugggugagcgggaaccugugcggcacccccggcggggaggagccccugcugcucuggaaggcgccgggccccugcgugcaggucuccuacaaggugugguucugggucgggggccgcgagcugagccccgaggggaucacgugcugcugcucccugaucccgagcggcgccgagugggcccggguguccgccgugaacgccaccagcugggagccccucaccaaccugucccuggugugccucgacagcgcgagcgcgccccgcuccgucgccgugagcuccaucgccggcagcaccgagcugcuggugacguggcagcccgggccgggcgagccccucgagcacgucguggacugggcccgggacggggacccccuggagaagcugaacuggguccgccugcccccgggcaaccucuccgcccugcuccccgggaacuucaccgugggcgugcccuaccggaucaccgucaccgccgugagcgccuccggccuggccagcgccuccagcguguggggguuccgcgaggagcuggcgccccuggucggcccgacgcucuggcggcugcaggacgccccgcccgggacccccgccaucgccuggggcgaggugccccgccaccagcugcgggggcaccucacccacuacacccugugcgcgcaguccggcacgagccccuccgugugcaugaacgucagcggcaacacccaguccgugacccugcccgaccuccccugggggccgugcgagcugugggugaccgccagcacgaucgccggccaggggccgcccggccccauccugcgccuccaccuccccgacaacacccugcgcuggaagguccugcccggcauccuguuccuguggggccucuuccugcuggggugcgggcucucccuggccaccagcggccggugcuaccaccuccgccacaaggugcugccccggugggugugggagaaggucccggaccccgccaacuccagcagcgggcagccccacauggagcagguccccgaggcgcagccgcugggcgaccugcccauccucgagguggaggagauggagccgccgcccgugauggaguccagccagcccgcccaggccaccgcgccccuggacuccggcuacgagaagcacuuccugcccacgcccgaggagcucgggcugcugggcccgccccgcccccaggugcucgccuga

SEQ ID NO: 31563 - RNA, 462 nt, Artificial Sequence
  derived and/or modified sequence opt1 from IL2__Homo_sapiens__NP_000577
auguaccgcaugcagcugcucagcugcaucgcccugucccuggcccucgugaccaacagcgcgcccaccuccagcuccacgaagaagacccagcugcagcuggagcaccuccugcuggaccuccagaugauccugaacggcaucaacaacuacaagaacccgaagcugacccggaugcucaccuucaaguucuacaugcccaagaaggccacggagcugaagcaccuccagugccuggaggaggagcugaagccccuggaggagguccucaaccuggcccagagcaagaacuuccaccuccgcccccgggaccugaucuccaacaucaacgugaucgugcuggagcugaaggggagcgagaccaccuucaugugcgaguacgccgacgagaccgccacgaucgucgaguuccucaaccgcuggaucaccuucugccaguccaucaucagcacccugaccuga

SEQ ID NO: 31564 - RNA, 819 nt, Artificial Sequence
  derived and/or modified sequence opt1 from IL2RA__Homo_sapiens__NP_000408
auggacagcuaccugcucauguggggccugcugaccuucaucauggugcccgggugccaggccgagcucugcgacgacgacccgcccgagaucccccacgccaccuucaaggcgauggccuacaaggagggcacgaugcugaacugcgagugcaagcgcggguuccggcgcaucaaguccggcagccuguacaugcucugcaccgggaacuccagccacuccagcugggacaaccagugccagugcaccuccagcgccacccggaacacgaccaagcaggucacgccccagccggaggagcagaaggagcgcaagaccaccgagaugcagucccccaugcagcccguggaccaggccagccugcccggccacugccgggagccgccgcccugggagaacgaggccaccgagcgcaucuaccacuucguggucggccagaugguguacuaccagugcgugcagggguaccgggcgcugcaccgcggccccgccgaguccgucugcaagaugacccacgggaagacccgguggacgcagccccagcucaucugcaccggcgagauggagaccagccaguuccccggggaggagaagccccaggccucccccgagggccgcccggagagcgagaccuccugccuggugacgaccaccgacuuccagauccagaccgagauggccgcgacgauggagaccagcaucuucaccaccgaguaccagguggccgucgccggcugcguguuccugcucaucuccgugcugcugcucagcgggcugacguggcagcggcgccagcggaagucccgccggaccaucuga

SEQ ID NO: 31565 - RNA, 1656 nt, Artificial Sequence
  derived and/or modified sequence opt1 from IL2RB__Homo_sapiens__NP_000869
auggccgcccccgcgcugagcuggcgccucccgcugcugauccuccugcugccccucgccaccuccugggccagcgccgccgugaacggcaccucccaguucacgugcuucuacaacagccgggcgaacaucuccugcgucuggagccaggacggggcccugcaggacaccuccugccaggugcacgccuggcccgaccgccggcgcuggaaccagaccugcgagcugcuccccgugagccaggccuccugggcgugcaaccugauccugggcgccccggacagccagaagcucaccacggucgacaucgugacccugcgggugcugugccgcgaggggguccgguggcgcgugauggccauccaggacuucaagcccuucgagaaccuccggcugauggcccccaucucccuccaggugguccacguggagacccaccgcugcaacaucagcugggagaucucccaggccagccacuacuucgagcggcaccuggaguucgaggcgcgcacccugucccccggccacacgugggaggaggccccgcugcucacccugaagcagaagcaggaguggaucugccuggagacccucacccccgacacgcaguacgaguuccaggugcgggucaagccccugcagggggaguucaccaccuggagccccuggucccagccgcuggccuuccgcaccaagcccgccgcccucggcaaggacacgauccccuggcugggccaccuccugguggggcugagcggcgcguucggguucaucauccugguguaccuccugaucaacugccggaacaccggccccuggcugaagaagguccucaagugcaacaccccggaccccuccaaguucuucagccagcugagcuccgagcacgggggcgacgugcagaaguggcugagcucccccuuccccagcuccagcuucuccccgggcgggcucgcccccgagaucagcccccuggaggugcuggagcgcgacaaggucacccagcuccugcugcagcaggacaaggugcccgagccggccucccucagcuccaaccacagccugacguccugcuucaccaaccagggcuacuucuucuuccaccuccccgacgcccuggagaucgaggccugccagguguacuucaccuacgaccccuacagcgaggaggaccccgacgagggggucgcgggcgccccgaccggcuccagcccccagccccugcagccgcuguccggggaggacgacgccuacugcacguuccccagccgggacgaccugcuccuguucucccccagccugcucggcgggcccagcccgcccuccaccgcccccggcgggagcggcgccggcgaggagcgcaugcccccgucccugcaggagcgggugccccgcgacugggacccccagccccuggggccgcccacccccggcgugcccgaccucgucgacuuccagccgccgcccgagcuggugcugcgggaggcgggggaggagguccccgacgccggcccccgcgagggggugagcuuccccuggucccgcccgcccggccagggcgaguuccgggcccucaacgcccgccugccccugaacaccgacgcguaccucagccugcaggagcugcaggggcaggaccccacgcaccucguguga

SEQ ID NO: 31566 - RNA, 1110 nt, Artificial Sequence
  derived and/or modified sequence opt1 from IL2RG__Homo_sapiens__NP_000197
augcugaagcccagccucccguucaccucccugcuguuccuccagcugccccugcucggcguggggcugaacaccacgauccugacccccaacggcaacgaggacaccaccgccgacuucuuccucacgaccaugcccaccgacagccuguccgucagcacccugccgcuccccgaggugcagugcuucguguucaacgucgaguacaugaacugcacguggaacuccagcuccgagccccagcccaccaaccugacccugcacuacugguacaagaacagcgacaacgacaaggugcagaagugcucccacuaccucuucagcgaggagaucaccuccgggugccagcugcagaagaaggagauccaccuguaccagacguucgugguccagcuccaggacccgcgcgagccccggcgccaggccacccagaugcugaagcugcagaaccucgugauccccugggcgcccgagaaccugacccugcacaagcucagcgagucccagcuggagcugaacuggaacaaccgguuccucaaccacugccuggagcaccuggugcaguaccgcaccgacugggaccacagcuggacggagcaguccgucgacuaccggcacaaguucagccucccguccguggacggccagaagcgcuacaccuuccgggugcgcagccgguucaacccccugugcggguccgcccagcacuggagcgaguggagccaccccauccacuggggcuccaacaccagcaaggagaaccccuuccuguucgcccucgaggccgucgugaucuccgugggcagcauggggcugaucaucucccugcucugcgucuacuucuggcuggagcgcaccaugccgcggauccccacgcugaagaaccucgaggaccuggugaccgaguaccacggcaacuucagcgccugguccggggugagcaagggccuggcggagucccuccagcccgacuacagcgagcgccugugccuggucuccgagaucccgcccaagggcggggcccucggcgaggggcccggcgccagccccugcaaccagcacucccccuacugggccccgcccugcuacacccugaagcccgagaccuga

SEQ ID NO: 31567 - RNA, 495 nt, Artificial Sequence
  derived and/or modified sequence opt1 from IL31__Homo_sapiens__XP_011536628
auggccagccacuccggccccagcaccuccgugcuguuccucuucugcugccucgggggcuggcuggccagccacacccugccgguccgccugcugcggcccuccgacgacgugcagaagaucguggaggagcuccagagccuguccaagaugcugcucaaggacgucgaggaggagaagggggugcuggugagccagaacuacacgcugcccugccucucccccgacgcgcagccgcccaacaacauccacagccccgccauccgcgccuaccugaagaccauccggcagcuggacaacaaguccgucaucgacgagaucaucgagcaccucgacaagcugaucuuccaggacgcccccgagaccaacaucagcgugccgaccgacacgcacgagugcaagcgcuucauccugaccaucucccagcaguucagcgagugcauggaccucgcccugaagucccugaccagcggcgcgcagcaggccaccacguga

SEQ ID NO: 31568 - RNA, 2238 nt, Artificial Sequence
  derived and/or modified sequence opt1 from IL31RA__Homo_sapiens__NP_001229565
augaagcugagcccccagccguccugcgugaaccucggcaugauguggaccugggcccuguggaugcugcccagccucugcaaguucucccuggccgcgcugcccgccaagcccgagaacaucagcugcgucuacuacuaccgcaagaaccugaccugcacgugguccccggggaaggagaccagcuacacccaguacaccgugaagcggacguacgccuucggcgagaagcacgacaacugcaccaccaacuccagcaccuccgagaaccgcgccagcugcuccuucuuccugccccggaucacgauccccgacaacuacaccaucgagguggaggccgagaacggggacggcgucaucaagagccacaugaccuacuggcgccuggagaacaucgcgaagaccgagcccccgaagaucuuccgggugaagcccgugcucgggaucaagcgcaugauccagaucgaguggaucaagcccgagcuggcccccgucuccagcgaccugaaguacacgcuccgguuccgcaccgugaacuccaccagcuggauggaggugaacuucgccaagaaccggaaggacaagaaccagaccuacaaccugacgggccugcagccguucaccgaguacgucaucgcccuccgcugcgcggugaaggaguccaaguucuggagcgacuggucccaggagaagaugggcaugaccgaggaggaggcccccugcgggcuggagcuguggcgggugcucaagcccgccgaggccgacggccgccggcccguccgccugcuguggaagaaggcccgcggggcgccggugcucgagaagacccugggcuacaacaucugguacuaccccgagagcaacacgaaccugaccgagaccaugaacaccacgaaccagcagcucgagcugcaccucgggggcgagagcuucuggguguccaugaucagcuacaacucccucggcaagagccccgucgccacccugcggauccccgccauccaggagaaguccuuccagugcaucgaggugaugcaggccugcguggccgaggaccagcuggucgugaaguggcagagcuccgcgcucgacgugaacaccuggaugaucgagugguucccggacgucgacagcgagcccaccacgcuguccugggagagcgugucccaggccaccaacuggaccauccagcaggacaagcugaagcccuucuggugcuacaacaucagcguguaccccaugcuccacgacaaggucggggagccguacuccauccaggccuacgccaaggagggcgugcccagcgaggggcccgagaccaaggucgagaacaucggcgugaagacggugaccaucaccuggaaggagauccccaaguccgagcggaagggcaucaucugcaacuacaccaucuucuaccaggccgagggcgggaagggguucagcaagacggucaacuccagcauccugcaguacggccuggagucccucaagcgcaagaccagcuacaucguccaggugauggcgagcaccuccgccgggggcaccaacggcaccagcaucaacuucaagacgcuguccuucagcguguucgagaucauccugaucaccucccucaucgggggcgggcugcugauccucaucauccugaccguggccuacggccugaagaagccgaacaagcucacccaccugugcuggcccacggugcccaacccggccgagagcuccaucgccaccuggcacggggacgacuucaaggacaagcugaaccucaaggagagcgacgacuccgucaacaccgaggaccggauccugaagcccugcagcacccccuccgacaagcuggugaucgacaagcugguggucaacuucggcaacgugcuccaggagaucuucacggacgaggcgcgcaccggccaggagaacaaccucgggggcgagaagaacggguacgugaccugccccuuccggccggacugcccccugggcaagagcuucgaggagcuccccgucucccccgagaucccgccccgcaagagccaguaccugcgcucccggaugcccgaggggacccgccccgaggccaaggagcagcugcuguucagcggccagucccuggugccggaccaccugugcgaggagggcgcccccaaccccuaccucaagaacagcgugacggcccgggaguuccuggucagcgagaagcugcccgagcacaccaagggggagguguga

SEQ ID NO: 31569 - RNA, 396 nt, Artificial Sequence
  derived and/or modified sequence opt1 from IL32__Homo_sapiens__NP_001012651
augugcuuccccaaggugcugagcgacgacaugaagaagcucaaggcccgcaugcaccaggccaucgagcgguucuacgacaagaugcagaacgcggaguccggccgcgggcaggucaugagcucccuggccgagcuggaggacgacuucaaggagggcuaccucgagaccguggccgccuacuacgaggagcagcacccggagcugaccccgcugcucgagaaggagcgggacgggcugcgcugccggggcaaccgcagccccgugcccgacgucgaggaccccgccaccgaggagcccggggaguccuucugcgacaagagcuacggcgcgccccggggcgacaaggaggagcugacgccccagaagugcuccgagccgcagagcuccaaguga

SEQ ID NO: 31570 - RNA, 687 nt, Artificial Sequence
  derived and/or modified sequence opt1 from IL33__Homo_sapiens__NP_001186569
augaagcccaagaugaaguacagcaccaacaagaucuccaccgccaaguggaagaacacggccagcaaggcgcugugcuucaagcucggcaagucccagcagaaggccaaggaggugugcccgauguacuucaugaagcugcgcagcgggcugaugaucaagaaggaggccugcuacuuccggcgcgagaccaccaagcggcccucccucaagaccggccgcaagcacaagcggcaccugguccuggccgccugccagcagcagagcacgguggagugcuucgcguucgggaucuccggcgugcagaaguacacccgcgcccuccacgacagcuccaucaccgacaagguccugcugagcuacuacgagucccagcaccccagcaacgaguccggggacggcguggacggcaagaugcucauggugacccugagccccacgaaggacuucuggcugcacgccaacaacaaggagcacuccgucgagcuccacaagugcgagaagccgcugcccgaccaggccuucuucgugcugcacaacaugcacagcaacugcguguccuucgagugcaagaccgaccccggggucuucaucggcgugaaggacaaccaccucgcgcugaucaagguggacagcuccgagaaccugugcaccgagaacauccucuucaagcugagcgagaccuga

SEQ ID NO: 31571 - RNA, 729 nt, Artificial Sequence
  derived and/or modified sequence opt1 from IL34__Homo_sapiens__XP_011521205
augccccgcggcuucaccuggcugcgguaccucgggaucuuccugggcguggcccuggggaacgagccccucgagauguggccccugacccagaacgaggagugcacggucaccggcuuccugcgcgacaagcuccaguaccggagccgccugcaguacaugaagcacuacuuccccaucaacuacaagaucuccgugcccuacgaggggguguuccggaucgccaacgucacccgccugcagcgggcccaggugagcgagcgcgagcuccgguaccugugggugcuggucucccucagcgcgaccgaguccgugcaggacgugcugcuggagggccacccgagcuggaaguaccuccaggaggucgagacgcugcugcucaacgugcagcagggccugaccgacguggaggucucccccaagguggagagcgugcugucccuccugaacgcccccgggcccaaccugaagcucguccgcccgaaggcccugcuggacaacugcuuccgggugauggagcuccuguacugcagcugcugcaagcaguccagcgugcugaacuggcaggacugcgagguccccagcccccaguccugcucccccgagccgagccuccaguacgccgcgacccagcuguacccgcccccgcccuggucccccagcuccccgccccacagcaccggcagcgugcgccccgugcgggcccagggggagggccugcuccccuga

SEQ ID NO: 31572 - RNA, 477 nt, Artificial Sequence
  derived and/or modified sequence opt1 from IL36A__Homo_sapiens__NP_055255
auggagaaggcccugaagaucgacacgccccagcagggcagcauccaggacaucaaccaccgcguguggguccuccaggaccagacccugaucgccgugccgcggaaggaccgcaugucccccgugaccaucgcgcugaucagcugccggcacgucgagacccucgagaaggaccgcgggaaccccaucuaccugggccugaacgggcucaaccugugccugaugugcgccaaggugggcgaccagcccacccuccagcugaaggagaaggacaucauggaccuguacaaccagccggagcccgugaaguccuuccucuucuaccacagccaguccgggcggaacagcaccuucgaguccgucgccuuccccggcugguucaucgccgugagcuccgagggcgggugcccccugauccugacgcaggagcucggcaaggccaacaccaccgacuucgggcugaccaugcuguucuga

SEQ ID NO: 31573 - RNA, 495 nt, Artificial Sequence
  derived and/or modified sequence opt1 from IL36B__Homo_sapiens__NP_055253
augaacccccagcgcgaggccgcccccaagagcuacgcgauccgggacucccgccagaugguguggguccugagcggcaacucccugaucgccgccccgcugagccgguccaucaagcccgugacccugcaccucaucgccugccgcgacaccgaguucagcgacaaggagaaggggaacaugguguaccugggcaucaaggggaaggaccugugccucuucugcgccgagauccagggcaagcccacccugcagcugaagcuccaggggucccaggacaacaucggcaaggacacgugcuggaagcuggucggcauccacacgugcaucaaccuggacgugcgggagagcugcuucauggggacccucgaccaguggggcaucggggugggccgcaagaaguggaaguccagcuuccagcaccaccaccuccggaagaaggacaaggacuucuccagcaugcgcaccaacaucgggaugccgggccggauguga

SEQ ID NO: 31574 - RNA, 510 nt, Artificial Sequence
  derived and/or modified sequence opt1 from IL36G__Homo_sapiens__NP_062564
augcgcggcacccccggggacgccgacggcgggggccgggccguguaccagagcaugugcaagccgaucaccgggacgaucaacgaccugaaccagcaggucuggacccuccagggccagaaccugguggcggugccccgcuccgacagcgucacccccgugaccguggccgucaucacgugcaaguaccccgaggcccuggagcagggccgcggggacccgaucuaccucggcauccagaaccccgagaugugccuguacugcgagaaggugggggagcagcccacccugcagcucaaggagcagaagaucauggaccuguacggccagcccgagccggugaagcccuuccuguucuaccgggccaagaccgggcggaccuccacgcucgagagcgucgccuuccccgacugguucaucgcguccagcaagcgcgaccagcccaucauccugaccuccgagcugggcaagagcuacaacaccgccuucgagcucaacaucaacgacuga

SEQ ID NO: 31575 - RNA, 468 nt, Artificial Sequence
  derived and/or modified sequence opt1 from IL36RN__Homo_sapiens__NP_775262
auggugcugagcggcgcccucugcuuccgcaugaaggacuccgcccugaagguccuguaccuccacaacaaccagcugcuggccgggggccuccacgcggggaaggugaucaagggcgaggagaucagcgugguccccaaccgguggcuggacgccucccugagcccggugauccucggggugcagggcggcucccagugccugagcugcggggucggccaggagcccacccugacccucgagcccgugaacaucauggagcuguaccugggggccaaggaguccaagagcuucacguucuaccgccgggacaugggccucaccuccagcuucgaguccgccgcguaccccgggugguuccugugcaccgugccggaggccgaccagcccguccgccugacccagcuccccgagaacggcggcuggaacgcccccaucacggacuucuacuuccagcagugcgacuga

SEQ ID NO: 31576 - RNA, 657 nt, Artificial Sequence
  derived and/or modified sequence opt1 from IL37__Homo_sapiens__NP_055254
augagcuucgugggcgagaacuccggggucaagaugggcagcgaggacugggagaaggacgagccccagugcugccuggaggacccggccgggagcccccucgagcccggccccucccugccgaccaugaacuucgugcacaccucccccaaggugaagaaccugaaccccaagaaguucagcauccacgaccaggaccacaagguccucgugcuggacuccgggaaccugaucgccgugcccgacaagaacuacauccgcccggagaucuucuucgcgcucgccagcucccugagcuccgccagcgccgagaagggcucccccauccugcucggcgucagcaagggggaguucugccuguacugcgacaaggacaagggccagucccaccccagccugcagcucaagaaggagaagcugaugaagcuggccgcgcagaaggaguccgcccggcgccccuucaucuucuaccgggcccagguggggagcuggaacaugcucgaguccgccgcgcacccgggcugguucaucugcacgagcugcaacugcaacgagcccgugggggucaccgacaaguucgagaaccgcaagcacaucgaguucagcuuccagcccgugugcaaggccgagaugucccccagcgagguguccgacuga

SEQ ID NO: 31577 - RNA, 459 nt, Artificial Sequence
  derived and/or modified sequence opt1 from IL3__Homo_sapiens__NP_000579
augagccgccugcccgugcuccugcugcuccagcugcugguccggccgggccuccaggcccccaugacccagaccacgccccugaagaccuccugggugaacugcagcaacaugaucgacgagaucaucacccaccugaagcagcccccgcucccccugcuggacuucaacaaccucaacggggaggaccaggacauccugauggagaacaaccugcgccggcccaaccucgaggccuucaaccgcgcggugaagucccugcagaacgccagcgccaucgaguccauccugaagaaccuccugcccugccugccgcucgccaccgccgcgcccacgcggcaccccauccacaucaaggacggcgacuggaacgaguuccgccggaagcugaccuucuaccugaagacccucgagaacgcccaggcccagcagaccacgcugagccuggccaucuucuga

SEQ ID NO: 31578 - RNA, 903 nt, Artificial Sequence
  derived and/or modified sequence opt1 from IL3RA__Homo_sapiens__NP_001254642
auggugcugcucuggcugacccugcuccugaucgcccugcccugccuccugcagaccaaggagggcgggaagccgugggccggcgcggagaaccugacgugcuggauccacgacgucgacuuccucagcugcuccugggccguggggcccggcgcccccgccgacgugcaguacgaccuguaccugaacgucgccaaccgccggcagcaguacgagugccuccacuacaagaccgacgcgcaggggacccgcaucggcugccgguucgacgacaucagccgccuguccagcggcucccagagcucccacauccuggugcgggggcgcagcgccgccuucggcauccccugcaccgacaaguucguggucuucucccagaucgagauccucacgccgcccaacaugaccgccaagugcaacaagacccacagcuucaugcacuggaagaugcggucccacuucaaccgcaaguuccgguacgagcugcagauccagaagcgcaugcagcccgugaucaccgagcagguccgggaccgcacgagcuuccagcugcucaaccccgggaccuacaccgugcagauccgggcgcgcgagcggguguacgaguuccuguccgccuggagcaccccgcagcgcuucgagugcgaccaggaggagggcgccaacacgcgggccuggcgcaccucccugcucaucgcccuggggacccugcucgcgcuggugugcgucuucgugaucugccggcgcuaccuggugaugcagcgccucuucccccggaucccccacaugaaggaccccaucggcgacagcuuccagaacgacaagcuggucgugugggaggccggcaaggccgggcuggaggagugccucgugaccgagguccagguggugcagaagacguga

SEQ ID NO: 31579 - RNA, 462 nt, Artificial Sequence
  derived and/or modified sequence opt1 from IL4__Homo_sapiens__NP_000580
augggccugaccagccagcuccugcccccgcuguucuuccuccuggccugcgccgggaacuucgugcacggccacaagugcgacaucacccugcaggagaucaucaagacgcucaacucccugaccgagcagaagacccugugcaccgagcucacggucaccgacaucuucgcggccagcaagaacaccaccgagaaggagacguucugccgcgccgccaccgugcugcggcaguucuacucccaccacgagaaggacacccgcugccugggggccaccgcgcagcaguuccaccggcacaagcagcucauccgcuuccugaagcggcuggaccgcaaccucuggggccuggccgggcugaacagcugccccgugaaggaggccaaccaguccacgcucgagaacuuccuggagcggcugaagaccaucaugcgcgagaaguacagcaagugcuccagcuga

SEQ ID NO: 31580 - RNA, 1770 nt, Artificial Sequence
  derived and/or modified sequence opt1 from IL4I1__Homo_sapiens__NP_001244947
augcccaacgacgacuucugcccgggccugaccaucaaggccaugggggccgagcgcgcgccccagcggcagcccugcacccuccaccuccuggugcugguccccauccugcugagccucguggccucccaggacuggaaggccgagcgcagccaggacccguucgagaagugcaugcaggaccccgacuacgagcagcugcugaagguggucacguggggccucaaccggacccugaagccccagcgcgugaucguggucggggccggcguggccgggcugguggcggccaagguccucuccgacgccggccacaaggugaccauccuggaggccgacaaccggaucggcgggcgcaucuucaccuaccgggaccagaacacgggcuggaucggggagcugggcgcgaugcgcaugcccagcucccaccggauccuccacaagcugugccaggggcugggccucaaccugaccaaguucacccaguacgacaagaacaccuggacggaggugcacgaggucaagcugcgcaacuacgugguggagaaggucccggagaagcucggcuacgcccugcggccccaggagaaggggcacagccccgaggacaucuaccagauggcccugaaccaggcccucaaggaccugaaggcccugggcugccgcaaggcgaugaagaaguucgagcggcacacccuccuggaguaccugcucggggagggcaaccugucccgccccgccgugcagcugcucggcgacgugaugagcgaggacggguucuucuaccuguccuucgccgaggcccugcgggcccacagcugccucuccgaccgccugcaguacagccggaucgucggcgggugggaccugcucccgcgcgcgcugcuguccagccucuccggccuggugcugcucaacgcccccguggucgccaugacccaggggccccacgacgugcacgugcagaucgagaccagcccgcccgcccggaaccugaagguccugaaggccgacgugguccuccugacggcguccggccccgccgugaagcgcaucaccuucagcccgccccugccccggcacaugcaggaggcccugcgccgccuccacuacgugcccgccaccaaggucuuccuguccuuccggcgccccuucuggcgggaggagcacaucgagggcgggcacagcaacaccgaccgccccagccggaugaucuucuacccgccgccccgcgagggcgcccugcuccuggcguccuacacguggagcgacgccgccgccgcguucgccgggcugucccgggaggaggcccuccgccuggcccuggacgacguggccgcgcuccacggccccgugguccggcagcugugggacgggaccggcguggugaagcgcugggccgaggaccagcacagccagggcggguucgucgugcagccgcccgcccuguggcagaccgagaaggacgacuggaccgugcccuacggccggaucuacuucgccggggagcacacggccuacccccacggcugggucgagaccgcggugaaguccgcccuccgcgccgccaucaagaucaacagccggaaggggcccgccuccgacaccgcgagccccgagggccacgccuccgacauggagggccaggggcacgugcacggcgucgccagcucccccagccacgaccuggccaaggaggaggggucccacccgcccgugcagggccagcugagccuccagaacaccacgcacacccgcaccucccacuga

SEQ ID NO: 31581 - RNA, 2433 nt, Artificial Sequence
  derived and/or modified sequence opt1 from IL4R__Homo_sapiens__NP_001244336
augcagaaggacgcccgccgggagggcaacaugaaggugcugcaggagcccaccugcgucagcgacuacauguccaucagcaccugcgaguggaagaugaacgggccgacgaacugcuccaccgagcuccgccugcuguaccagcucguguuccugcugagcgaggcccacaccugcauccccgagaacaacggcggggcgggcugcgugugccaccuccugauggacgacgucguguccgccgacaacuacacccuggaccucugggccgggcagcagcugcuguggaagggcagcuucaagcccuccgagcacgugaagccccgggccccgggcaaccucacgguccacaccaacgugagcgacacccugcugcucaccugguccaaccccuacccccccgacaacuaccuguacaaccaccugacguacgccgugaacaucuggagcgagaacgacccggcggacuuccgcaucuacaacgucaccuaccucgagcccucccugcggaucgccgccagcacccugaaguccgggaucagcuaccgcgcccgggugcgcgcgugggcccagugcuacaacaccacgugguccgaguggagccccuccaccaaguggcacaacagcuaccgggagcccuucgagcagcaccuccugcugggcguguccgucagcugcaucgugauccucgccgugugccugcugugcuacgucagcaucaccaagaucaagaaggaguggugggaccagaucccgaaccccgcccgcucccggcucguggccaucaucauccaggacgcgcaggggagccagugggagaagcgcucccggggccaggagcccgccaagugcccccacuggaagaacugccugaccaagcugcucccgugcuuccuggagcacaacaugaagcgcgacgaggacccccacaaggccgccaaggagaugcccuuccaggggagcggcaaguccgccuggugccccguggagaucagcaagacgguccuguggccggaguccaucagcguggugcggugcgucgagcucuucgaggcgcccguggagugcgaggaggaggaggagguggaggaggagaagggcuccuucugcgccagccccgaguccagccgcgacgacuuccaggaggggcgggagggcaucgucgcccgccugaccgagucccuguuccucgaccugcugggggaggagaacggcggcuucugccagcaggacaugggggagagcugccuccugcccccguccggcagcaccuccgcccacaugcccugggacgaguuccccagcgccgggcccaaggaggcgccgcccuggggcaaggagcagccccugcaccucgagccguccccccccgccagccccacccagagcccggacaaccugacgugcaccgagaccccccuggugaucgccgggaaccccgccuaccgguccuucagcaacucccucagccagucccccugcccgcgcgagcugggccccgacccccugcucgcccggcaccuggaggaggucgagcccgagaugccgugcgugccccagcugagcgagcccaccacggugccccagccggagcccgagaccugggagcagauccugcgccgcaacguccuccagcacggcgcggccgccgcccccguguccgcgcccaccagcggguaccaggaguucgugcacgccgucgagcagggcgggacccaggccuccgccguggugggccuggggccgcccggcgaggccggcuacaaggcguucagcucccugcucgccagcuccgccgucagccccgagaagugcggguucggcgccuccagcggggaggagggcuacaagcccuuccaggaccugaucccggggugccccggcgaccccgccccggugcccgugccccuguucacguucggccucgaccgggagcccccgcgcuccccccagagcagccaccugcccuccagcucccccgagcaccuggggcucgagccgggcgagaaggucgaggacaugcccaagcccccccugccgcaggagcaggcgaccgacccccugguggacagccucggguccggcaucguguacagcgcccugaccugccaccugugcggccaccucaagcagugccacgggcaggaggacggcgggcagacccccgucauggccucccccugcugcggcugcugcugcggggaccggagcuccccgcccacgaccccccugcgcgcccccgacccgagccccggcggcgugccccuggaggccucccucugccccgcgagccuggccccguccgggaucagcgagaaguccaagagcuccagcuccuuccaccccgcccccggcaacgcccagagcagcucccagacccccaagaucgugaacuucgucagcguggggccgaccuacaugcggguguccuga

SEQ ID NO: 31582 - RNA, 528 nt, Artificial Sequence
  derived and/or modified sequence opt1 from IL5__Homo_sapiens__XP_006714664
augggcguggucgugggguggaucggcgaccccgggagcggcaccgacaacaagcugaccggggacgccgugcucuacuacgcccugucccugccgaaggcgaacgccgagcgcuuccgggccaugcgcaugcuccugcaccugagccuccuggcccugggcgccgcguacgucuacgccauccccacggagauccccaccuccgcccucgugaaggagacccuggcccugcucagcacccaccggacgcugcugaucgcgaacgagacccuccgcauccccgugccgguccacaagaaccaccagcugugcaccgaggagaucuuccagggcaucgggacccuggagucccagacggugcagggcgggaccguggagcgccucuucaagaaccugagccugaucaagaaguacaucgacggccagaagaagaagugcggggaggagcggcggcgcgucaaccaguuccucgacuaccugcaggaguuccugggcgugaugaacaccgaguggaucaucgaguccuga

SEQ ID NO: 31583 - RNA, 1263 nt, Artificial Sequence
  derived and/or modified sequence opt1 from IL5RA__Homo_sapiens__NP_000555
augaucaucguggcccacguccugcucauccugcugggcgccaccgagauccuccaggcggaccugcugcccgacgagaagaucagccuccugccgcccgugaacuucaccaucaaggugacggggcuggcccagguccuccugcaguggaagcccaaccccgaccaggagcagcgcaacgugaaccuggaguaccaggugaagaucaacgccccgaaggaggacgacuacgagacccggaucaccgaguccaagugcgucaccauccuccacaagggcuucagcgccuccgugcgcacgauccugcagaacgaccacagccugcucgccuccagcugggcguccgccgagcugcacgccccgcccgggagccccggcaccuccaucgugaaccugaccugcaccacgaacaccaccgaggacaacuacagccggcuccgcuccuaccaggucagccugcacugcaccuggcugguggggacggacgcccccgaggacacccaguacuuccucuacuaccgguacggcuccuggaccgaggagugccaggaguacagcaaggacacccugggccgcaacaucgcgugcugguucccccggacguucauccuguccaaggggcgcgacuggcucgccgugcuggucaacggcagcuccaagcacagcgccauccggcccuucgaccagcuguucgcccuccacgccaucgaccagaucaacccgccccugaacgugaccgcggagaucgaggggacccgccuguccauccagugggagaagcccgugagcgccuuccccauccacugcuucgacuacgaggucaagauccacaacacccggaacggcuaccuccagaucgagaagcugaugacgaacgccuucaucagcaucaucgacgaccuguccaaguacgacguccaggugcgcgccgccgugagcuccaugugccgggaggcggggcucuggagcgaguggucccagcccaucuacgugggcaacgacgagcacaagccgcugcgcgagugguucgugaucgucaucauggccaccaucugcuucauccugcucauccugagccugaucugcaagaucugccaccucuggaucaagcuguucccgcccauccccgcccccaaguccaacaucaaggaccuguucgugaccaccaacuacgagaaggccggcagcuccgagacggagaucgaggugaucugcuacaucgagaagcccggggucgagacccucgaggacagcguguucuga

SEQ ID NO: 31584 - RNA, 639 nt, Artificial Sequence
  derived and/or modified sequence opt1 from IL6__Homo_sapiens__NP_000591
augaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagauguga

SEQ ID NO: 31585 - RNA, 1407 nt, Artificial Sequence
  derived and/or modified sequence opt1 from IL6R__Homo_sapiens__NP_000556
augcuggccgugggcugcgcccuccuggcggcccugcucgccgcccccggggccgcgcuggccccgcgccggugccccgcccaggaggucgcccgcggcgugcugaccagccuccccggggacuccgugacccugacgugccccggcgucgagccggaggacaacgcgaccgugcacugggugcugcggaagcccgccgccgggagccaccccucccgcugggccggcaugggccggcgccuccugcugcggagcguccagcuccacgacuccgggaacuacagcugcuaccgcgccggccggcccgcggggaccgugcaccuccugguggacgucccgcccgaggagccccagcuguccugcuuccgcaagagcccccuguccaacguggugugcgaguggggcccgcggagcacccccucccugacgaccaaggccguccuccuggugcgcaaguuccagaacagccccgccgaggacuuccaggagcccugccaguacucccaggagagccagaaguucuccugccagcuggccgugccggagggggacagcuccuucuacaucgucagcaugugcguggccuccagcgugggcagcaaguucuccaagacccagaccuuccagggcugcgggauccuccagcccgacccgcccgcgaacaucacggucaccgccguggcccggaacccccgcuggcugagcgugaccuggcaggacccccacuccuggaacagcuccuucuaccggcugcgcuucgagcuccgguaccgcgccgagcggagcaagaccuucacgaccuggauggucaaggaccugcagcaccacugcgugauccacgacgccugguccggccugcgccacgugguccagcuccgggcgcaggaggaguucgggcagggcgaguggagcgaguggucccccgaggccaugggcacccccuggaccgagagccgcuccccgcccgccgagaacgaggugagcacgcccaugcaggcccugaccaccaacaaggacgacgacaacauccuguuccgcgacuccgccaacgcgaccagccuccccguccaggacuccagcuccgugccgcugcccacguuccugguggccgggggcagccucgccuucgggacccugcugugcaucgccaucguccuccgguucaagaagaccuggaagcugcgcgcgcugaaggagggcaagaccuccaugcacccgcccuacagccucgggcagcuggugcccgagcggccccgccccacgccggugcuggucccccucaucagcccgcccgugucccccagcucccugggcagcgacaacaccuccagccacaaccggcccgacgcccgcgacccccggucccccuacgacaucagcaacaccgacuacuucuucccgcgcuga

SEQ ID NO: 31586 - RNA, 2574 nt, Artificial Sequence
  derived and/or modified sequence opt1 from IL6ST__Homo_sapiens__NP_001177910
augcugacccuccagaccuggcuggugcaggcccuguucaucuuccucacgaccgagagcaccggcgagcugcuggaccccugcggguacaucuccccggagagccccgucgugcagcuccacuccaacuucaccgccgugugcguccugaaggagaagugcauggacuacuuccacgugaacgcgaacuacaucguguggaagacgaaccacuucaccauccccaaggagcaguacaccaucaucaaccgcaccgccagcuccgucacguucaccgacaucgccagccugaacauccagcugaccugcaacauccucaccuucggccagcuggagcagaacguguacgggaucacgaucaucuccggccugcccccggagaagcccaagaaccucagcugcaucgugaacgaggggaagaagaugcggugcgagugggacggcggccgcgagacccaccuggagaccaacuucacccucaaguccgagugggccacgcacaaguucgccgacugcaaggcgaagcgggacacccccaccagcugcaccgucgacuacuccacgguguacuucgugaacaucgaggucuggguggaggccgagaacgcccuggggaaggugaccagcgaccacaucaacuucgaccccgucuacaaggugaagccgaacccgccccacaaccuguccgugaucaacagcgaggagcucuccagcauccugaagcugaccuggaccaaccccuccaucaagagcgucaucauccucaaguacaacauccaguaccgcacgaaggacgccuccaccuggagccagaucccgcccgaggacaccgcgagcacccgguccagcuucacggugcaggaccugaagcccuucaccgaguacguguuccgcauccggugcaugaaggaggacggcaagggguacugguccgacuggagcgaggaggccuccggcaucaccuacgaggaccgccccagcaaggcccccuccuucugguacaagaucgaccccagccacacccagggguaccggacgguccagcugguguggaagacccucccgcccuucgaggccaacggcaagauccuggacuacgaggugacccugacccgcuggaagucccaccuccagaacuacacggucaacgccaccaagcugaccgugaaccugaccaacgaccgguaccucgcgacccugacgguccgcaaccuggugggcaagagcgacgccgccgugcucaccauccccgccugcgacuuccaggggaaccuggccgaguccaagugcuaccugaucaccgucacccccguguacgcggacggccccgggagccccgaguccaucaaggccuaccucaagcaggccccgcccagcaagggccccacggugcggaccaagaaggucggcaagaacgaggccgugcuggagugggaccagcugcccguggacguccagaacggguucauccgcaacuacaccaucuucuaccggaccaucaucggcaacgagacggccgugaacguggacuccagccacaccgaguacacccucuccagccugaccuccgacacgcuguacaugguccgcauggcggccuacaccgacgagggcgggaaggacgggccggaguucaccuucaccacgcccaaguucgcccagggcgagaucgaggccaucguggugcccgucugccucgccuuccugcugaccacccuccugggcgugcuguucugcuucaacaagcgggaccucaucaagaagcacaucuggccgaacgugcccgaccccagcaagagccacaucgcgcaguggagcccccacaccccgccccgccacaacuucaacuccaaggaccagauguacuccgacgggaacuucacggacgucagcgugguggagaucgaggccaacgacaagaagcccuuccccgaggaccugaagucccuggaccuguucaagaaggagaagaucaacaccgagggccacagcuccgggaucggcgggagcuccugcaugagcuccagccggccguccaucagcuccagcgacgagaacgaguccagccagaacaccagcuccaccguccaguacagcacgguggugcacuccggcuaccgccaccagguccccagcguccagguguucucccggagcgaguccacccagccccuccuggacagcgaggagcgccccgaggaccugcagcucguggaccacguggacggcggggacggcauccugccgcgccagcaguacuucaagcagaacugcucccagcacgagagcucccccgacaucagccacuucgagcgguccaagcaggucagcuccgugaacgaggaggacuucgugcgccugaagcagcagaucagcgaccacaucucccagagcugcggguccggccagaugaagauguuccaggaggugagcgccgccgacgcguucgggcccggcaccgagggccaggucgagcgguucgagaccguggggauggaggccgccacggacgagggcaugcccaagagcuaccucccgcagaccgugcgccagggcggguacaugccccaguga

SEQ ID NO: 31587 - RNA, 402 nt, Artificial Sequence
  derived and/or modified sequence opt1 from IL7__Homo_sapiens__NP_001186815
auguuccacgugagcuuccgcuacaucuucggccugcccccgcucauccugguccugcuccccguggccuccagcgacugcgacaucgaggggaaggacggcaagcaguacgaguccgugcugauggucagcaucgaccagcugcucgacuccaugaaggagaucgggagcaacugccugaacaacgaguucaacuucuucaagcggcacaucugcgacgccaacaaggugaagggccgcaagcccgcggcccugggggaggcccagcccaccaagucccucgaggagaacaagagccugaaggagcagaagaagcugaacgaccucugcuuccugaagcggcugcuccaggagaucaagaccugcuggaacaagauccugaugggcacgaaggagcacuga

SEQ ID NO: 31588 - RNA, 1380 nt, Artificial Sequence
  derived and/or modified sequence opt1 from IL7R__Homo_sapiens__NP_002176
augaccauccugggcaccacguucgggaugguguucagccuccugcaggucguguccggcgagagcggguacgcccagaacggcgaccuggaggacgccgagcucgacgacuacuccuucagcugcuacucccagcuggaggugaacgggagccagcacucccugaccugcgcguucgaggaccccgacgucaacaucaccaaccucgaguucgagaucugcggcgcccugguggaggugaagugccugaacuuccgcaagcuccaggagaucuacuucaucgagaccaagaaguuccugcugaucggcaagagcaacaucugcgucaaggugggggagaagucccucacgugcaagaagaucgaccugaccaccaucgugaagcccgaggcccccuucgaccugagcgucguguaccgggagggcgccaacgacuucguggucaccuucaacacgucccaccuccagaagaaguacgugaaggugcugaugcacgacgucgccuaccgccaggagaaggacgagaacaaguggacccacgugaaccugagcuccaccaagcucacccugcugcagcggaagcuccagcccgcggccauguacgagaucaaggugcgcagcauccccgaccacuacuucaagggguucugguccgaguggagcccguccuacuacuuccggacgcccgagaucaacaacagcuccggcgagauggaccccauccugcugaccaucagcauccucagcuucuucuccgucgcccugcuggugauccucgccugcgugcuguggaagaagcgcaucaagcccaucgucuggccgagccugcccgaccacaagaagacccucgagcaccugugcaagaagccccggaagaaccugaacguguccuucaaccccgagagcuuccucgacugccagauccaccgcguggacgacauccaggcgcgggacgaggucgagggguuccugcaggacaccuucccgcagcagcuggaggaguccgagaagcagcgccucggcggcgacgugcagagccccaacugccccuccgaggacgucgugaucacgcccgagagcuucgggcgggacuccagccugaccugccuggccggcaacguguccgccugcgacgccccgauccucagcuccagccgcucccuggacugccgggagagcgggaagaacggcccccacgucuaccaggaccugcuccugucccugggcaccaccaacagcacgcucccgccgcccuucucccugcagagcgggauccugacccucaaccccguggcccagggccagcccauccugaccagccugggguccaaccaggaggaggcguacgugaccaugagcuccuucuaccagaaccaguga

SEQ ID NO: 31589 - RNA, 435 nt, Artificial Sequence
  derived and/or modified sequence opt1 from IL9__Homo_sapiens__NP_000581
augcugcucgccauggugcugaccagcgcccugcuccugugcuccgucgcgggccaggggugccccacccuggccggcauccucgacaucaacuuccugaucaacaagaugcaggaggacccggccagcaagugccacugcuccgccaacgugacgagcugccugugccucgggauccccuccgacaacugcacccgccccugcuucagcgagcggcugucccagaugaccaacaccacgaugcagacccgcuacccccugaucuucagccgggugaagaaguccgucgaggugcucaagaacaacaagugcccguacuucagcugcgagcagcccugcaaccagaccaccgccggcaacgcgcugacguuccugaagucccuccuggagaucuuccagaaggagaagaugcgcgggaugcggggcaagaucuga

SEQ ID NO: 31590 - RNA, 1566 nt, Artificial Sequence
  derived and/or modified sequence opt1 from IL9R__Homo_sapiens__NP_002177
augggccuggggcgcugcaucugggagggcuggacccucgagagcgaggcccugcggcgcgacauggggaccuggcugcucgccugcaucugcaucugcacgugcgugugccugggcgucuccgugaccggggagggccagggcccccggagccgcaccuucacgugccugaccaacaacauccuccggaucgacugccacugguccgcgccggagcuggggcagggcagcucccccuggcugcuguucaccagcaaccaggcccccgggggcacccacaagugcauccugcgcggguccgagugcaccgugguccugcccccggaggccgugcucgugcccagcgacaacuucacgaucaccuuccaccacugcauguccggccgggagcaggucagccugguggaccccgaguaccugccccgccggcacgugaagcucgacccgcccuccgaccugcagagcaacaucuccagcggccacugcauccugaccugguccaucagccccgcccucgagcccaugaccacgcugcuguccuacgagcucgccuucaagaagcaggaggaggcgugggagcaggcccagcaccgcgaccacaucgucggggugaccuggcugauccuggaggccuucgagcucgacccgggcuucauccacgaggcccggcugcgcgugcagauggcgacccuggaggacgacgucguggaggaggagcgguacaccgggcaguggagcgaguggucccagcccgugugcuuccaggcgccccagcgccagggcccccucaucccgcccuggggcuggcccgggaacacgcuggucgccgugagcaucuuccugcuccugaccggccccaccuaccuccucuucaagcugagcccgcgggugaagcgcaucuucuaccagaacguccccucccccgccauguucuuccagccccuguacagcgugcacaacgggaacuuccagaccuggaugggcgcccacggggccggcgugcuccugucccaggacugcgccggcacgccgcagggggcccuggagcccugcguccaggaggccaccgcccuccugaccugcggccccgcgcggcccuggaaguccguggcccuggaggaggagcaggaggggccgggcacccgccuccccgggaaccugagcagcgaggacgugcugcccgccggcugcacggaguggcggguccagacccucgccuaccugccgcaggaggacugggcccccaccucccugacccgccccgcgcccccggacagcgagggcucccggagcuccagcuccagcuccagcuccaacaacaacaacuacugcgcccucgggugcuacggcggguggcaccugagcgcccugcccggcaacacgcaguccagcgggcccauccccgcccuggccugcggccucagcugcgaccaccagggccuggagacccagcaggggguggcguggguccuggccggccacugccagcgcccggggcuccacgaggaccugcagggcaugcugcuccccuccgugcugagcaaggcccgcuccuggaccuucuga

SEQ ID NO: 31591 - RNA, 1641 nt, Artificial Sequence
  derived and/or modified sequence opt1 from ILDR1__Homo_sapiens__NP_001186728
auggccuggcccaagcugccggcccccuggcuccugcugugcaccuggcuccccgcgggcugccugagccugcucgugaccguccagcacacggagcgcuacgugacccuguucgccuccaucauccugaagugcgacuacaccaccagcgcccagcuccaggacguggucgugacguggcgguucaaguccuucugcaaggaccccaucuucgacuacuacagcgccuccuaccaggccgcgcugagccuggggcaggacccguccaacgacugcaacgacaaccagcgcgaggugcggaucgucgcccagcgccggggccagaacgagcccgugcucgggguggacuaccgccagcggaagaucaccauccagaaccgcgccgaccuggucaucaacgaggugauguggugggaccacggcguguacuacugcaccaucgaggcccccggggacaccagcggcgaccccgacaaggaggucaagcugaucgugcuccacuggcugacggugaucuucaucauccugggcgcgcuccugcugcuccugcugaucggggucugcuggugccagugcugcccgcaguacugcugcugcuacauccggugccccugcugccccgcccacugcugcugccccgaggaggcccucgcccgccaccgguacaugaagcaggcccaggcgcugggcccgcagaugauggggaagccccuguacuggggcgccgaccgcuccagccagguguccagcuaccccaugcacccccuccugcagcgggaccugucccucccgagcucccugccccagaugcccaugacccagaccaccaaccagcccccgaucgccaacggggugcuggaguaccucgagaaggagcugcgcaaccugaaccucgcccagccccugccgcccgaccugaagggccgguucggccacccgugcagcaugcucuccagccugggguccgaggucguggagcgccggaucauccaccucccgccccugauccgcgaccugagcagcucccggcgcacgagcgacucccugcaccagcaguggcucacccccauccccagccggcccugggaccugcgcgagggccgcucccaccaccacuaccccgacuuccaccaggagcugcaggaccgggggcccaagagcugggcccucgagcgccgggagcuggaccccuccuggagcggccgccaccgguccagccgccugaacggcucccccauccacuggagcgaccgggacucccugagcgacgugcccuccagcuccgaggcgcgcuggcggccgagccacccgcccuuccgcucccggugccaggagcgcccccggcgccccagcccccgggagagcacccagcgccacgggcggcgccggcgccaccgcuccuacagcccgccccuccccuccggccugagcuccuggagcuccgaggaggacaaggagcggcagccccagagcuggcgcgcccaccggcgcgggucccacagcccccacuggcccgaggagaagccgcccuccuaccggagccuggacaucacccccggcaagaacucccgcaagaaggggagcgucgagcggcgcuccgagaaggacagcucccacagcggccggagcguggugaucuga

SEQ ID NO: 31592 - RNA, 1920 nt, Artificial Sequence
  derived and/or modified sequence opt1 from ILDR2__Homo_sapiens__NP_955383
auggaccgcgugcugcuccgguggaucagccuguucuggcugaccgccauggucgagggccuccaggugaccgugcccgacaagaagaaggucgccaugcuguuccagccgacggugcugcgcugccacuucuccaccagcucccaccagcccgcggugguccaguggaaguucaagagcuacugccaggaccggaugggggagucccucggcaugagcuccacccgcgcccagagccuguccaagcggaaccuggagugggaccccuaccucgacugccuggacagccgccggaccgugcgcguggucgccuccaagcaggggagcacggugacccugggcgacuucuaccgggggcgcgagaucaccaucgugcacgacgccgaccuccagaucggcaagcugauguggggcgacuccgggcuguacuacugcaucaucaccacgcccgacgaccucgagggcaagaacgaggacagcgucgagcugcuggugcucgggcggaccggccugcuggccgaccuccugccguccuucgcgguggagaucaugcccgagugggucuucguggggcuggugcuccugggcgucuuccuguucuucgugcucgugggcaucugcuggugccagugcugcccccacagcugcugcugcuacguccgcugccccugcugcccggacuccugcugcugcccccaggcccuguacgaggccgggaaggccgcgaaggccggcuacccgcccagcguguccggggugcccggccccuacagcauccccagcgucccccugggcggggccccguccagcggcaugcucauggacaagccccacccgccgccccuggcccccuccgacagcaccgggggcucccacagcgugcggaagggguaccgcauccaggccgacaaggagcgggacuccaugaagguccuguacuacguggagaaggagcucgcgcaguucgaccccgcccgccggaugcgcggccgguacaacaacaccaucagcgagcuguccagccugcacgaggaggacuccaacuuccgccagagcuuccaccagaugcgguccaagcaguuccccgugagcggcgaccucgaguccaaccccgacuacuggagcggggucaugggcggguccagcggcgccucccgcgggcccagcgccauggaguacaacaaggaggaccgcgagagcuuccggcacucccagccccgcagcaaguccgagaugcugagccggaagaacuucgccacgggcgugcccgcgguguccauggacgagcuggccgccuucgccgacagcuacggccagcgcccgcggcgcgccgacgggaacucccacgaggcgcggggcgggagccgcuucgagcgguccgagagccgcgcccacuccggcuucuaccaggacgacagccucgaggaguacuacgggcagcggucccgcagccgggagccccugaccgacgccgaccgcggcugggccuucucccccgcccggcgccggccggcggaggacgcccaccucccccgccuggucagccggacccccggcaccgcccccaaguacgaccacuccuaccuggggagcgcccgcgagcgccaggcgcggccggagggcgccagccgcgggggcucccuggagacgcccagcaagcgguccgcccagcucggcccccgcagcgccuccuacuacgccuggagcccgcccgggaccuacaaggcgggcuccagccaggacgaccaggaggacgccuccgacgacgcccugccgcccuacagcgagcuggagcucacccgggggcccuccuaccgcggccgggaccugcccuaccacagcaacuccgagaagaagcgcaagaaggagcccgccaagaagaccaacgacuuccccacgcggaugagccuggugguguga

SEQ ID NO: 31593 - RNA, 1059 nt, Artificial Sequence
  derived and/or modified sequence opt1 from ILF2__Homo_sapiens__NP_001254738
auggccuucccccgcgugaagcccgcccccgacgagaccagcuucuccgaggcgcugcucaagcggaaccaggaccuggcccccaacagcgccgagcaggccuccauccugagccucgucaccaagaucaacaacgugaucgacaaccugaucguggcccccggcacguucgagguccagaucgaggaggugcgccaggugggguccuacaagaagggcaccaugaccaccgggcacaacgucgcggaccugguggugauccucaagauccugccgacgcuggaggccgucgccgcccucggcaacaaggugguggagagccugcgggcgcaggaccccuccgagguccugaccaugcucaccaacgagaccggguucgagaucagcuccagcgacgccacggugaagauccugaucaccaccgugccgcccaaccugcgcaagcucgaccccgagcugcaccuggacaucaagguccuccaguccgcccuggccgccauccggcacgcgcgcugguucgaggagaacgccagccaguccaccgugaaggugcugauccggcuccugaaggaccugcgcauccgguuccccggcuucgagccccucacgcccuggauccuggaccugcucggccacuacgccgucaugaacaacccgacccgccagccccuggcccugaacguggccuaccggcgcugccuccagauccuggcggccgggcuguuccuccccggcagcguggggaucaccgaccccugcgaguccggcaacuuccggguccacaccgugaugacgcuggagcagcaggacauggugugcuacaccgcccagacccugguccgcauccucagccacgggggcuuccggaagauccugggccaggagggggacgccuccuaccuggccagcgagaucuccaccugggacggcgugaucgucacgccgagcgagaaggcguacgagaagccgcccgagaagaaggagggggaggaggaggaggagaacaccgaggagccgccccagggcgaggaggaggagagcauggagacccaggaguga

SEQ ID NO: 31594 - RNA, 2121 nt, Artificial Sequence
  derived and/or modified sequence opt1 from ILF3__Homo_sapiens__NP_001131145
augcgccccaugcggaucuucgugaacgacgaccgccacgucauggccaagcacagcuccguguaccccacccaggaggagcuggaggccgugcagaacauggucagccacaccgagcgggcgcucaaggccguguccgacuggaucgacgagcaggagaagggcagcuccgagcaggccgagagcgacaacauggacgugccgcccgaggacgacuccaaggagggggccggcgagcagaagacggagcacaugacccgcacccugcgcggggucaugcgggugggccugguggccaaggggcuccugcugaagggcgaccucgaccuggagcugguccuccugugcaaggagaagcccaccacggcgcugcucgacaagguggccgacaaccuggccauccagcuggccgcggugaccgaggacaaguacgagauccuccagagcgucgacgacgccgccaucgugaucaagaacaccaaggagccgccccugucccugaccauccaccucacgagccccgugguccgggaggagauggagaaggugcuggccggcgagacccuguccgugaacgacccgcccgacguccucgaccgccagaagugccuggccgcgcuggccagccuccggcacgccaagugguuccaggcccgcgccaacgggcugaaguccugcgugaucgugauccggguccugcgcgaccucugcacccgggugcccaccuggggcccccugcgcggguggccccuggagcuccugugcgagaaguccaucggcacggcgaaccggcccaugggggccggcgaggcccugcgccgggugcucgagugccuggccagcggcaucgucaugcccgacgggagcggcaucuacgaccccugcgagaaggaggccaccgacgcgaucgggcaccuggaccgccagcagcgggaggacaucacccaguccgcccagcacgcccuccgccuggccgccuucggccagcugcacaaggugcucggcauggacccccugccgagcaagaugcccaagaagcccaagaacgagaaccccgucgacuacaccgugcagaucccgcccuccacgaccuacgcgaucacccccaugaagcggcccauggaggaggacggggaggagaaguccccgagcaagaagaagaagaagauccagaagaaggaggagaaggccgagccgccccaggccaugaacgcccugaugcgccucaaccagcugaagcccggccugcaguacaagcucgugagccagaccgggcccguccacgcgcccaucuucacgaugagcguggagguggacggcaacuccuucgaggccagcgggcccuccaagaagaccgccaagcugcacgucgccgugaaggugcugcaggacaugggccucccgaccggcgccgaggggcgcgacagcuccaagggcgaggacagcgcggaggagaccgaggccaagcccgccgucguggcccccgcccccguggucgaggcgguguccacgccgagcgccgccuuccccuccgacgccaccgccgagaacgugaagcagcaggggcccauccugaccaagcacggcaagaaccccgucauggagcugaacgagaagcggcgcgggcugaaguacgagcucaucagcgagaccggcggcucccacgacaagcgguucgugauggagguggaggucgacgggcagaaguuccagggcgcggggagcaacaagaagguggccaaggccuacgccgcgcuggccgcccuggagaagcuguucccggacacgccccucgcccuggacgccaacaagaagaagcgcgcgcccgugcccguccggggcgggccgaaguucgccgccaagccccacaaccccggcuucggcaugggcgggcccaugcacaacgaggugccgcccccgcccaaccuccgcgggcggggccgcggcggguccauccggggccgcgggcggggccgcggguucggcggcgccaaccacgggggcuacaugaacgccggggcgggcuacgggagcuacggcuacggcgggaacuccgccaccgccggcuacagcgacuucuucaccgacugcuacggguaccacgacuucggcuccagcuga

SEQ ID NO: 31595 - RNA, 1359 nt, Artificial Sequence
  derived and/or modified sequence opt1 from ILK__Homo_sapiens__NP_001014795
auggacgacaucuucacccagugccgcgagggcaacgccguggccguccggcuguggcucgacaacaccgagaacgaccugaaccagggggacgaccacggcuucagcccccugcacugggcgugccgcgaggggcgguccgccgugguggagaugcucaucaugcgcggcgcccggaucaacgucaugaaccgcggggacgacacgccccugcaccuggccgccagccacggccaccgggacaucgugcagaagcuccugcaguacaaggcggacaucaacgccgugaacgagcacggcaacgucccccugcacuacgccugcuucugggggcaggaccagguggccgaggaccucguggcgaacggcgcccuggucuccaucugcaacaaguacggggagaugcccguggacaaggccaaggcgccccugcgcgagcuccugcgggagcgcgccgagaagaugggccagaaccugaaccggaucccguacaaggacaccuucuggaaggggaccacccgcacgcggccccgcaacggcacccucaacaagcacagcggcaucgacuucaagcagcugaacuuccugaccaagcucaacgagaaccacuccggggagcuguggaagggccgguggcaggggaacgacaucguggucaaggugcugaaggugcgcgacuggagcacccggaagucccgcgacuucaacgaggagugcccccggcuccgcaucuucagccaccccaacguccugccggugcugggcgccugccaguccccgcccgcgccccaccccacgcucaucacccacuggaugcccuacggcagccuguacaacgugcugcacgaggggaccaacuucgucguggaccagucccaggccgugaaguucgcccucgacauggcccggggcauggccuuccugcacacccuggagccccucaucccccgccacgcccugaacagccgcuccgucaugaucgacgaggacaugacggcccggaucagcauggccgacgugaaguucuccuuccagugcccggggcgcauguacgcccccgcguggguggcccccgaggcccugcagaagaagcccgaggacaccaaccggcgcagcgccgacaugugguccuucgccguccuccugugggagcuggugacccgggaggucccguucgcggaccucagcaacauggagaucggcaugaagguggcccuggaggggcugcgccccaccaucccgcccggcaucuccccgcacgugugcaagcucaugaagaucugcaugaacgaggaccccgccaagcggcccaaguucgacaugaucguccccauccuggagaagaugcaggacaaguga

SEQ ID NO: 31596 - RNA, 501 nt, Artificial Sequence
  derived and/or modified sequence opt1 from IMMP1L__Homo_sapiens__NP_001291203
augcugcgcggcgugcucgggaagaccuuccggcuggucggcuacaccauccaguacgggugcaucgcccacugcgccuucgaguacgugggcgggguggucaugugcagcggccccuccauggagccgacgauccagaacagcgacaucguguucgcggagaaccugucccgccacuucuacggcauccagcgcggggacaucgugaucgccaagagccccuccgaccccaagagcaacaucugcaagcgggucaucggccucgagggggacaagauccugaccaccucccccagcgacuucuucaagucccacagcuacgugccgaugggccacguguggcuggagggggacaaccuccagaacuccaccgacagccggugcuacggccccauccccuacggccugauccgcgggcggaucuucuucaagaucuggccccuguccgacuucggcuuccuccgcgccagcccgaacgggcaccgguucuccgacgacuga

SEQ ID NO: 31597 - RNA, 528 nt, Artificial Sequence
  derived and/or modified sequence opt1 from IMMP2L__Homo_sapiens__XP_005250687
auggcccagagccagggcugggugaagcgcuacaucaaggccuucugcaagggguucuucgucgcggugcccguggccgucaccuuccuggaccggguggccugcguggcccgcgucgagggcgccuccaugcagcccagccucaaccccgggggcucccagagcuccgacguggugcugcugaaccacuggaagguccggaacuucgaggugcaccgcggggacaucgugagccucgucucccccaagaaccccgagcagaagaucaucaagcgggugaucgcgcuggagggcgacaucgugcgcaccaucggccacaagaaccgguacgucaaggugccgcgcgggcacaucuggguggagggcgaccaccacgggcacagcuucgacuccaacagcuucggccccgucucccuggggcuccugcacgcccacgccacgcacauccuguggccgcccgagcgguggcagaagcucgagagcgugcugccgcccgagcgccugcccgugcagcgggaggaggaguga

SEQ ID NO: 31598 - RNA, 2274 nt, Artificial Sequence
  derived and/or modified sequence opt1 from IMMT__Homo_sapiens__NP_001093639
augcugcgcgccugccagcucagcggcgugaccgccgcggcccaguccugccugugcgggaaguucguccugcggccccuccgccccugccggcgcuacagcaccuccggcagcuccgggcugacgaccggcaagaucgccggggccggccugcuguucgugggcgggggcaucgggggcaccauccuguacgccaagugggacagccacuuccgggaguccguggagaagaccauccccuacagcgacaagcuguucgagaugguccucgggcccgcggccuacaacgugccccugccgaagaaguccauccagagcggcccccugaagaucuccagcguguccgaggucaugaaggagagcaagcagcccgccucccagcuccagaagcagaagggcgacacgcccgccagcgcgaccgccccgaccgaggccgcccagaucaucuccgccgcgggggacacccugagcgugcccgcccccgccgugcagcccgaggagucccugaagacggaccacccggagaucggcgaggggaagcccacccccgcccucagcgaggccagcuccagcuccauccgcgagcggcccccggaggaggucgcggcccgccuggcccagcaggagaagcaggagcaggucaagaucgagagccuggccaagucccucgaggacgcccugcggcagaccgcgagcgugacccugcaggccaucgccgcccagaacgccgcggugcaggccgugaacgcccacuccaacauccucaaggccgcgauggacaacagcgagaucgccggcgagaagaaguccgcccaguggcgcacgguggagggcgcccugaaggagcggcgcaaggccgucgacgaggcggccgacgcccugcucaaggccaaggaggagcuggagaagaugaaguccgugaucgagaacgccaagaagaaggagguggcgggggccaagccccacaucaccgccgccgagggcaagcugcacaacaugaucgucgaccucgacaacguggugaagaagguccaggccgcgcagagcgaggccaagguggugagccaguaccacgagcuggucgugcaggcccgggacgacuucaagcgcgagcuggacuccaucacccccgagguccuccccggguggaagggcaugagcguguccgaccuggccgacaagcugagcaccgacgaccucaacucccugaucgcgcacgcccaccggcgcaucgaccagcugaaccgggagcucgccgagcagaaggccacggagaagcagcacaucacccuggcccuggagaagcagaagcucgaggagaagcgcgcguucgacagcgccguggccaaggcccuggagcaccaccgguccgagauccaggccgagcaggaccgcaagaucgaggagguccgggacgcgauggagaacgagaugcgcacccagcugcgccggcaggccgccgcccacaccgaccaccuccgcgacgugcugcgggugcaggagcaggagcucaagagcgaguucgagcagaaccucagcgagaagcuguccgagcaggagcugcaguuccgccggcucagccaggagcaggucgacaacuucacgcuggacaucaacaccgccuacgcgcgccugcgggggaucgagcaggccgugcagucccacgccguggccgaggaggaggcgcgcaaggcccaccagcuguggcucagcgucgaggcccugaaguacuccaugaagaccagcuccgccgagaccccgacgaucccccugggcagcgccguggaggcgaucaaggccaacugcuccgacaacgaguucacccaggcccucaccgccgccaucccgcccgagagccugacccggggcguguacuccgaggagacgcugcgcgcgcgguucuacgccguccagaagcucgcccgccggguggccaugaucgacgagacccgcaacagccuguaccaguacuuccuguccuaccuccagagccugcuccuguucccgccccagcagcugaagcccccgcccgagcugugccccgaggacaucaacaccuucaagcuccuguccuacgccagcuacugcaucgagcacggggaccuggagcucgcggccaaguucgugaaccagcugaagggcgagucccggcgcgucgcccaggacuggcugaaggaggcccggaugacccucgagacgaagcagaucguggagauccugaccgccuacgcgagcgccguggggaucggcaccacccagguccagcccgaguga

SEQ ID NO: 31599 - RNA, 555 nt, Artificial Sequence
  derived and/or modified sequence opt1 from IMP3__Homo_sapiens__NP_060755
auggugcgcaagcugaaguuccacgagcagaagcuccugaagcaggucgacuuccugaacugggaggugaccgaccacaaccuccacgagcugcgggugcugcgccgguaccgccuccagcggcgcgaggacuacacccgguacaaccagcugagccgcgccguccgggagcuggcccgccggcuccgcgaccugcccgagcgggaccaguuccgcgugcgggcguccgccgcccugcucgacaagcuguacgcccugggccucgugccgacgcgcgggagccuggagcugugcgacuucgucaccgccuccagcuucugccggcgccggcuccccaccgugcugcugaagcuccgcauggcgcagcaccuccaggccgccguggccuucgucgagcagggccacgugcggguggggcccgacgucgugaccgaccccgcguuccuggugacgcgcuccauggaggacuucgucaccuggguggacagcuccaagaucaagcgccacgugcuggaguacaacgaggagcgggacgacuucgaccuggaggccuga

SEQ ID NO: 31600 - RNA, 1011 nt, Artificial Sequence
  derived and/or modified sequence opt1 from IMPA1__Homo_sapiens__NP_001138350
augggccagcgccccgggccggugcugcccgccgucgccgugcucggccagguggcgaagcggaaggucgccuggcugcugcgcuggaaggccgugacgcggaccgagacggccgggaacagcuccggcguguacggguucggcaagaugaagaucuucgucaaguacuuccagaagauggccgaccccuggcaggagugcauggacuacgcggugacccucgcccgccaggccggcgagguggucugcgaggccaucaagaacgagaugaacgugaugcucaagagcucccccguggaccuggucaccgcgaccgaccagaagguggagaagaugcugaucagcuccaucaaggagaaguacccgagccacuccuucaucggggaggagagcguggccgccggcgagaaguccauccugacggacaaccccaccuggaucaucgaccccaucgacgggaccaccaacuucguccaccgguuccccuucguggccgugagcaucggcuucgccgucaacaagaagaucgaguucggggugguguacuccugcgucgagggcaagauguacacggcgcgcaagggcaagggggccuucugcaacggccagaagcuccaggugagccagcaggaggacaucaccaagucccugcuggugaccgagcuggggagcucccggaccccggagacgguccgcauggugcucagcaacauggagaagcuguucugcauccccguccacggcauccgguccgugggcaccgccgccgugaacaugugccuggucgccaccgggggcgcggacgccuacuacgagauggggauccacugcugggacguggccggcgccgggaucaucgugaccgaggccggcggcguccucauggacgugaccgggggccccuucgaccugaugagccgccgggugaucgcggccaacaaccgcauccuggccgagcggaucgccaaggagauccaggucaucccccuccagcgcgacgacgaggacuga

SEQ ID NO: 31601 - RNA, 867 nt, Artificial Sequence
  derived and/or modified sequence opt1 from IMPA2__Homo_sapiens__NP_055029
augaagcccagcggcgaggaccaggccgcccuggcggccgggccgugggaggagugcuuccaggccgccgugcagcucgcccugcgcgcgggccagaucauccggaaggcccugaccgaggagaagcgcgucuccaccaagacgagcgccgccgaccucgugaccgagaccgaccaccugguggaggaccugaucaucuccgagcuccgggagcgcuuccccagccaccgguucaucgcggaggaggccgccgccuccggggccaagugcguccugacccacagccccacguggaucaucgaccccaucgacgggaccugcaacuucgugcaccgcuucccgaccguggcggucuccaucggguucgccgugcggcaggagcuggaguucggcgugaucuaccacugcaccgaggagcgccucuacacgggccggcgcgggcggggcgccuucugcaacgggcagcgccugcgggucagcggcgagaccgaccuguccaaggcccucgugcugaccgagaucgggcccaagcgcgaccccgccacccugaagcuguuccucagcaacauggagcggcugcuccacgcgaaggcccacggcgugcgcgucaucggcuccagcacgcuggcccugugccaccucgccuccggggccgcggacgccuacuaccaguucggccugcacugcugggaccuggccgccgccaccgugaucauccgggaggcgggcggcaucgugaucgacaccagcggcgggccccucgaccugauggccugccgcgucguggccgccuccacccgggagauggcgaugcugaucgcccaggcccuccagacgaucaacuacggccgcgacgacgagaaguga

SEQ ID NO: 31602 - RNA, 963 nt, Artificial Sequence
  derived and/or modified sequence opt1 from IMPACT__Homo_sapiens__NP_060909
auggccgagggcgacgccgggagcgaccagcgccagaacgaggagaucgaggcgauggccgccaucuacggcgaggaguggugcgugaucgacgacugcgccaagaucuucugcauccggaucuccgacgacaucgacgaccccaaguggacccugugccuccaggucaugcugccgaacgaguaccccgggaccgccccgcccaucuaccagcugaacgcgcccuggcucaagggccaggagcgcgccgaccugagcaacucccuggaggagaucuacauccagaacaucggggagagcauccucuaccuguggguggagaagauccgggacgugcugauccagaagucccagaugacggagcccggccccgacgucaagaagaagaccgaggaggaggacguggagugcgaggacgaccucauccuggccugccagcccgagagcuccgugaaggcccuggacuucgacaucagcgagacccgcaccgaggucgagguggaggagcucccgcccaucgaccacggcauccccaucacggaccggcgcuccaccuuccaggcgcaccuggcccccguggucugcccgaagcaggucaagauggugcugagcaagcucuacgagaacaagaagaucgccuccgccacccacaacaucuacgccuaccggaucuacugcgaggacaagcagaccuuccugcaggacugcgaggacgacggggagacggcggccggcgggcgccugcuccaccugauggagauccugaacgugaagaacgugaugguggucgugagccggugguacggcgggauccuccugggccccgaccgcuucaagcacaucaacaacugcgcccggaacauccugguggagaagaacuacaccaacucccccgaggagagcuccaaggcccucggcaagaacaagaagguccgcaaggacaagaagcggaacgagcacuga

SEQ ID NO: 31603 - RNA, 1080 nt, Artificial Sequence
  derived and/or modified sequence opt1 from IMPAD1__Homo_sapiens__NP_060283
auggcccccaugggcauccgccugagcccgcucgggguggccgucuucugccugcugggccucggggugcuguaccaccuguacuccggcuuccucgcggggcgguucagccuguucggccugggcggggagcccggcgggggcgccgccgggcccgccgccgcggccgacggcggcaccguggaccuccgcgagaugcuggccgucuccgugcuggccgcggugcgcgggggcgacgagguccggcgggugcgcgagagcaacgugcuccacgagaaguccaaggggaagacccgggagggcgccgaggacaagaugacgagcggcgacguccuguccaaccgcaagauguucuaccugcucaagaccgccuuccccagcgugcagaucaacaccgaggagcacguggacgccgccgaccaggaggucauccugugggaccacaagaucccggaggacauccugaaggaggugaccacgcccaaggaggugcccgcggaguccgucaccguguggaucgacccccucgacgccacccaggaguacaccgaggaccugcggaaguacgugacgaccauggucugcguggccgugaacgggaagccgaugcugggcgucauccacaagcccuucagcgaguacaccgccugggccaugguggacgggggcuccaacgugaaggcgcgcagcuccuacaacgagaagacgccccggaucgucgugagccgcucccacagcgggauggucaagcaggucgcccuccagaccuucggcaaccagaccaccaucauccccgccggcggggccggcuacaaggugcuggcccugcucgacgugccggacaagucccaggagaaggcggaccuguacauccacgugaccuacaucaagaagugggacaucugcgccgggaacgccauccugaaggcccucggcgggcacaugacgacccugagcggcgaggagaucuccuacaccggcagcgacgggaucgagggcgggcugcucgccagcauccggaugaaccaccaggcgcuggugcgcaagcugcccgaccucgagaagaccggccacaaguga

SEQ ID NO: 31604 - RNA, 1800 nt, Artificial Sequence
  derived and/or modified sequence opt1 from IMPDH1__Homo_sapiens__NP_000874
auggagggcccccugaccccgccgccccuccagggcggcggggccgccgcggugcccgagcccggggcccgccagcaccccgggcacgagaccgccgcccagcgguacagcgcccgccugcugcaggcgggcuacgagcccgagagcccccggcucgaccuggccacgcacccgaccacgccccgcuccgagcuguccagcgucgugcuccuggccggcguggggguccagauggaccggcugcgccgggccuccauggcggacuaccucaucagcggcgggaccggcuacgugcccgaggacgggcugaccgcccagcagcuguucgccuccgccgacggccucaccuacaacgacuuccugauccugcccggcuucaucgacuucaucgccgacgagguggaccucaccagcgcgcugacccgcaagaucacgcugaagaccccgcucaucuccagccccauggacaccgucaccgaggccgacauggccaucgccauggcccugaugggcgggaucggguucauccaccacaacugcacgcccgaguuccaggcgaacgaggugcggaaggugaagaaguucgagcagggcuucaucaccgaccccgucgugcuguccccgagccacaccgugggcgacguccucgaggccaagaugcgccacggguucuccggcauccccaucaccgagacggggaccaugggcagcaagcugguggggaucgugaccucccgggacaucgacuuccuggccgagaaggaccacaccacgcuccugagcgaggucaugacgccccgcaucgagcuggugguggcccccgccggcgucacccucaaggaggcgaacgagauccugcagcgguccaagaagggcaagcugccgaucgugaacgacugcgacgagcucguggccaucaucgcccgcaccgaccugaagaagaaccgggacuacccccuggccagcaaggacucccagaagcagcuccugugcggggccgcggucggcacccgcgaggacgacaaguaccggcuggaccuccugacccaggccgggguggacgugaucguccuggacagcagccagggcaacuccguguaccagaucgccaugguccacuacaucaagcagaaguacccccaccuccaggugaucgggggcaacguggucaccgccgcgcaggccaagaaccugaucgacgccggcguggacgggcugcgcgugggcauggggugcggcagcaucugcaucacccaggaggucauggccugcgggcggccccagggcacggccguguacaagguggcggaguacgcccgccgguucggcgucccgaucaucgccgacgggggcauccagaccguggggcacguggucaaggcccucgcccugggcgcguccaccgugaugaugggcagccugcucgccgccaccacggaggcccccggggaguacuucuucuccgacggcgugcgccugaagaaguaccgcgggaugggcagccuggacgccauggagaaguccagcuccagccagaagcgguacuucuccgagggggacaaggucaagaucgcgcagggcgugagcggcuccauccaggacaaggggagcauccagaaguucgugcccuaccucaucgccggcauccagcacgggugccaggacaucggcgcccgcucccugagcguccugcgguccaugauguacagcggggagcugaaguucgagaagcgcaccauguccgcccagaucgagggcggcgugcacgggcuccacagcuacgagaagcggcuguacuga

SEQ ID NO: 31605 - RNA, 1545 nt, Artificial Sequence
  derived and/or modified sequence opt1 from IMPDH2__Homo_sapiens__NP_000875
auggccgacuaccugaucagcggcgggaccuccuacgugcccgacgacggccucaccgcccagcagcuguucaacugcggggacggccugacguacaacgacuuccucauccugccgggguacaucgacuucaccgcggaccaggucgaccugaccagcgcccucaccaagaagaucacgcugaagacgccccugguguccagccccauggacaccgugaccgaggccggcauggccaucgccauggcgcucaccggcgggaucggcuucauccaccacaacugcacccccgaguuccaggccaacgagguccggaaggugaagaaguacgagcagggguucaucaccgacccggugguccugucccccaaggaccgggugcgcgacguguucgaggccaaggcccggcacggcuucugcgggauccccaucaccgacacgggccgcaugggcagccggcuggucgggaucaucuccagccgcgacaucgacuuccucaaggaggaggagcacgacugcuuccuggaggagaucaugaccaagcgggaggaccuggugguggcgcccgccggcaucacccucaaggaggccaacgagauccugcagcgcuccaagaaggggaagcugccgaucgucaacgaggacgacgagcucguggccaucaucgcccggaccgaccugaagaagaaccgcgacuacccccuggcgagcaaggacgccaagaagcagcuccugugcggcgccgccaucggcacgcacgaggacgacaaguaccggcuggaccuccuggcccaggcggggguggacgucguggugcuggacuccagccagggcaacuccaucuuccagaucaacaugaucaaguacaucaaggacaaguaccccaaccuccaggucaucgggggcaacguggugaccgccgcccaggccaagaaccugaucgacgccggggucgacgcgcugcgcgugggcaugggcagcggguccaucugcaucacccaggaggugcucgccugcggccggccccaggccaccgccgucuacaaggugagcgaguacgcccgccgguucggggucccggugaucgcggacggcgggauccagaacgugggccacaucgccaaggcccuggcccugggcgcguccacggucaugauggggagccuccuggccgccaccaccgaggcccccggcgaguacuucuucuccgacgggauccgccugaagaaguaccggggcauggggagccucgacgccauggacaagcaccugagcucccagaaccgcuacuucagcgaggcggacaagaucaagguggcccagggcguguccggcgccguccaggacaaggggagcauccacaaguucgugcccuaccugaucgccggcauccagcacuccugccaggacaucggggccaagagccucacccaggugcgggcgaugauguacuccggcgagcugaaguucgagaagcgcacgagcuccgcccaggucgagggcggggugcacagccugcacuccuacgagaagcgccucuucuga

SEQ ID NO: 31606 - RNA, 2160 nt, Artificial Sequence
  derived and/or modified sequence opt1 from IMPG1__Homo_sapiens__NP_001269297
auguaccuggagacccgccgggccaucuucguguucuggaucuuccuccagguccagggcaccaaggugugccaggaggccgugugggaggcguaccgcaucuuccuggaccggauccccgacacgggggaguaccaggacugggucagcaucugccagcaggagaccuucugccuguucgacaucggcaagaacuucuccaacagccaggagcaccucgaccugcugcagcagcgcaucaagcagcgguccuucccggaccgcaaggacgagaucagcgccgagaagacccucggggagcccggcgagaccaucgugaucuccacggacguggccaacgucagccuggggcccuucccccugaccccggacgacacccuccugaacgagauccuggacaacacccucaacgacacgaagaugcccaccaccgagcgggagaccgaguucgccgugcuggaggagcagcgcguggagcuguccgucagccucgugaaccagaaguucaaggccgagcuggcggacucccagagccccuacuaccaggagcuggccggcaagucccagcuccagaugcagaagaucuucaagaagcugcccggcuucaagaagauccacgugcugggguuccggccgaagaaggagaaggacggcagcuccagcacggagaugcagcucaccgccaucuucaagcgccacuccgccgaggccaagagccccgcguccgaccugcugagcuucgacuccaacaagaucgagagcgaggaggucuaccacgggaccauggaggaggacaagcagcccgagaucuaccucaccgccacggaccugaagcggcugaucagcaaggcccucgaggaggagcagucccuggacgugggcaccauccaguucaccgacgagaucgccgggagccugcccgcguucggcccggacacccaguccgagcuccccacgagcuucgccgugaucaccgaggacgccacccugucccccgagcugcccccggucgagccccagcucgagaccguggacggcgccgagcacgggcugcccgacacgagcugguccccgcccgccauggcgagcaccucccugagcgaggccccgcccuucuucauggccuccagcaucuucucccucaccgaccagggcaccacggacaccauggccaccgaccagaccaugcuggugcccgggcugacgauccccaccagcgacuacuccgccaucagccagcucgcgcugggcaucucccacccgcccgccagcuccgacgacagccgcagcuccgccggcggggaggacaugguccggcaccuggacgagauggaccucagcgacacccccgcccccuccgaggugcccgagcugagcgaguacguguccguccccgaccacuuccuggaggacaccacgccggugagcgcccuccaguacaucaccaccuccagcaugaccaucgcgcccaagggccgcgagcugguggucuucuucucccugcggguggccaacauggccuucagcaacgaccucuucaacaaguccagccuggaguaccgcgcccuggagcagcaguucacccagcugcucguccccuaccugcgguccaaccugacgggguucaagcagcucgagauccugaacuuccgcaacggcagcgugaucgugaacuccaagaugaaguucgccaagagcguccccuacaaccugaccaaggcggugcacggggugcucgaggacuuccgguccgccgccgcccagcagcugcaccuggagaucgacagcuacagccucaacaucgagccggcggaccaggccgaccccugcaaguuccuggccugcggcgaguucgcccagugcgucaagaacgagcgcaccgaggaggccgagugccggugcaagcccggcuacgacucccaggggagccuggacggccucgagcccgggcugugcggcccggggaccaaggagugcgaggugcugcagggcaagggcgcgcccugccgccuccccgaccacuccgagaaccaggccuacaagacgagcgugaagaaguuccagaaccagcagaacaacaaggucaucuccaagcgcaacagcgagcugcugaccguggaguacgaggaguucaaccaccaggacugggaggggaacuga

SEQ ID NO: 31607 - RNA, 3726 nt, Artificial Sequence
  derived and/or modified sequence opt1 from IMPG2__Homo_sapiens__NP_057331
augaucauguucccccuguucggcaagaucagccucgggauccugaucuucgugcugaucgagggcgacuucccgucccucaccgcccagaccuaccugagcaucgaggagauccaggagcccaaguccgccgugagcuuccugcuccccgaggaguccacggaccugagccuggcgaccaagaagaagcagccccucgaccgccgggagaccgagcgccaguggcugauccggcgccggcgcuccauccuguucccgaacggggugaagaucugccccgacgagagcguggccgaggccgucgccaaccacgugaaguacuucaaggugcgggucugccaggaggccgugugggaggcguuccgcaccuucugggaccggcuccccggccgcgaggaguaccacuacuggaugaaccugugcgaggacggggugacguccaucuucgagaugggcaccaacuucagcgaguccgucgagcaccggagccugaucaugaagaagcucaccuacgccaaggagaccguguccagcuccgagcugagcucccccgugccggucggcgacacgagcacccugggggacaccacccucuccgugccccaccccgagguggacgccuacgagggcgccagcgagagcucccuggagcgccccgaggagagcaucuccaacgagaucgagaacgucaucgaggaggcgacgaagccggccggggagcagaucgccgaguucagcauccaccuccugggcaagcaguaccgggaggagcugcaggacuccagcuccuuccaccaccagcaccuggaggaggaguucaucagcgagguggagaacgccuucaccgggcuccccggcuacaaggagauccgcgugcuggaguuccggucccccaaggagaacgacagcggcgucgacguguacuacgccgugaccuucaacggggaggcgaucuccaacaccacgugggaccugaucagccuccacuccaacaaggucgagaaccacggccugguggagcuggacgacaagcccaccguggucuacaccaucagcaacuuccgcgacuacaucgccgagacccuccagcagaacuuccugcuggggaacuccagccucaacccggaccccgacucccugcagcugaucaacgugcggggcguccuccgccaccagacggaggaccugguguggaacacccagagcuccagccugcaggccacccccagcuccauccucgacaacaccuuccaggccgccuggcccagcgcggacgaguccaucacgagcuccaucccgccccuggacuucagcuccggcccgcccagcgccaccgggcgggagcugugguccgagagcccccucggcgaccugguguccacccacaagcuggccuuccccagcaagauggggcucuccagcucccccgagguccuggaggugagcucccugacccuccacagcgugacgcccgccguccugcagaccggccugccgguggccagcgaggagcgcaccuccgggagccaccugguggaggacggccucgcgaacgucgaggaguccgaggacuuccugagcaucgacucccugcccagcuccagcuucacccagcccgugccgaaggagacgauccccuccauggaggacagcgacgugucccucaccagcucccccuaccugaccagcuccauccccuucggccuggacagccucaccuccaaggucaaggaccagcugaaggugagcccguuccugcccgacgccuccauggagaaggagcucaucuucgacgggggccuggggagcggcagcgggcagaagguggaccugaucacguggcccugguccgagaccagcuccgagaaguccgccgagccccucagcaagccguggcuggaggacgacgacagccugcuccccgccgagaucgaggacaagaagcugguccugguggacaagauggacuccaccgaccagaucagcaagcacuccaaguacgagcacgacgaccggagcacccacuuccccgaggaggagccccucuccggcccggccgugcccaucuucgcggacaccgccgccgagagcgccucccugacgcugcccaagcacaucagcgagguccccggcguggacgacuacuccgugaccaaggcgccgcucauccugaccagcgucgccaucuccgccagcaccgacaaguccgaccaggccgacgccauccugcgcgaggacauggagcagaucacggagagcagcaacuacgagugguucgacuccgaggugagcauggugaagcccgacaugcagacccucuggaccauccugcccgaguccgagcgcgucuggacccggacgagcucccuggagaagcucagccgcgacauccuggcguccacgccccagagcgccgaccggcuguggcucuccgugacccagagcaccaagcugccgcccaccaccaucuccacccugcucgaggacgaggugaucauggggguccaggacaucagccuggagcuggaccgcaucggcaccgacuacuaccagcccgagcagguccaggagcagaacgggaaggugggcuccuacguggagaugagcacguccgugcacagcaccgagaugguguccgucgccuggcccaccgagggcggggacgaccucagcuacacccagacguccggcgcccuggugguguucuucagccugcgggucaccaacaugauguucagcgaggaccucuucaacaagaacucccuggaguacaaggcccuggagcagcgcuuccucgagcugcuggugccguaccuccagagcaaccugaccggguuccagaaccuggagauccucaacuuccggaacggcuccaucguggucaacagccgcaugaaguucgcgaacuccgugccgcccaacgugaacaacgccgucuacaugauccuggaggacuucugcaccacggccuacaacaccaugaaccuggccaucgacaaguacagccucgacguggaguccggggacgaggccaaccccugcaaguuccaggcgugcaacgaguucagcgagugccuggugaaccccugguccggcgaggccaagugccggugcuuccccggcuaccugagcgucgaggagcgccccugccagucccucugcgaccugcagccggacuucugccugaacgacgggaagugcgacaucaugcccggccacggggccaucugccggugccgcgugggcgagaacuggugguaccgggggaagcacugcgaggaguucgugagcgagcccgucaucaucggcaucaccaucgccuccguggugggccuccuggucaucuucagcgcgaucaucuacuucuucauccgcacccugcaggcccaccacgaccgguccgagcgcgagagccccuucuccgggagcucccggcagccggacagccucagcuccaucgagaacgccgugaaguacaaccccgucuacgagagccaccgcgccggcugcgagaaguacgaggggcccuacccccagcacccguucuacuccagcgccuccggcgacgugaucgggggccugagccgggaggagauccgccagauguacgaguccagcgagcugucccgcgaggagauccaggagcggaugcgcgugcucgagcuguacgcgaacgaccccgaguucgccgccuucguccgggagcagcaggucgaggagguguga

SEQ ID NO: 31608 - RNA, 5739 nt, Artificial Sequence
  derived and/or modified sequence opt1 from INADL__Homo_sapiens__XP_011538767
augcccgagaaccccgccaccgacaagcuccaggugcuccaggugcuggaccgccugaagaugaagcuccaggagaagggcgacaccagccagaacgagaagcuguccauguucuacgagacccucaagagcccccucuucaaccagauccugacccugcagcaguccaucaagcagcucaaggggcagcugaaccacauccccuccgacugcuccgccaacuucgacuucagccggaagggccugcucguguucaccgacggguccaucaccaacggcaacgugcaccgccccagcaacaacuccaccgugagcgggcuguuccccuggacccccaagcugggcaacgaggacuucaacuccgugauccagcagauggcgcagggccggcagaucgaguacaucgacaucgagcgccccagcaccgggggccucggguucuccguggucgcccugcggagccagaaccugggcaagguggacaucuucgugaaggacguccagcccggguccguggccgaccgcgaccagcggcucaaggagaacgaccagauccuggccaucaaccacacgccccuggaccagaacaucagccaccagcaggccaucgcgcuccugcagcagaccaccggcucccugcgccucaucguggcccgggagcccguccacaccaagagcuccaccagcagcucccugaacgacaccacccugcccgagaccgugugcuggggccacguggaggaggucgagcucaucaacgacgggagcggccugggguucggcaucgugggcgggaagaccuccggcguggucgugcgcacgaucgugcccgggggccuggccgaccgggacgggcgccuccagaccggcgaccacauccugaagaucggcgggaccaacguccagggcaugaccagcgagcaggucgcccaggugcugcggaacugcgggaacuccguccgcaugcucguggcgcgggaccccgccggcgacaucagcgucacgccgcccgcccccgccgcccugcccguggcgcugcccaccguggccuccaaggggcccggcagcgacuccagccucuucgagaccuacaacgucgagcuggugcgcaaggacggccagucccuggggauccggaucgugggcuacgucgggaccagccacacgggcgaggccuccgggaucuacgugaaguccaucauccccggcuccgccgccuaccacaacggccacauccaggugaacgacaagaucgucgcgguggacggggugaacauccagggcuucgccaaccacgacgucguggaggugcuccgcaacgccgggcaggucgugcaccugacccuggugcggcgcaagaccagcuccagcaccagcccccucgagccgcccuccgaccggggcacggucguggagccccugaagccgcccgcccuguuccucaccggcgccguggagaccgagaccaacgucgacggggaggacgaggagaucaaggagcgcaucgacacgcugaagaacgacaacauccaggcgcuggagaagcucgagaaggugcccgacagccccgagaacgagcugaagucccgcugggagaaccugcugggccccgacuacgaggugauggucgccacccucgacacccagaucgccgacgacgccgagcugcagaaguacagcaagcugcuccccauccacacccugcggcuggggguggagguggacuccuucgacggccaccacuacaucagcuccaucgucagcgggggccccguggacacgcucggccugcugcagccggaggacgagcuccuggaggugaacgggaugcagcuguacggcaagucccgccgggaggccgucagcuuccucaaggaggugccgccgcccuucacccuggugugcugccgccggcuguucgacgacgaggcguccgucgacgagccccgccggaccgagaccagccugcccgagaccgagguggaccacaacauggacgugaacacggaggaggacgacgacggggagcuggcccuguggucccccgaggucaagaucguggagcucgugaaggacugcaagggccugggguucagcauccuggacuaccaggacccccucgacccgacccgcuccgucaucgugauccggagccugguggccgacggcgucgccgagcgcuccggcgggcugcuccccggcgaccggcuggugagcgugaacgaguacugccuggacaacaccucccucgcggaggccgucgagauccugaaggccgugccgcccgggcuggugcaccucggcaucugcaagccgcuggucgaggacaacgaggaggagagcugcuacauccugcacagcuccagcaacgaggacaagaccgaguucuccgggacgauccacgacaucaacagcucccucauccuggaggcccccaagggcuuccgcgacgagcccuacuucaaggaggagcugguggacgagcccuuccucgaccugggcaagagcuuccacucccagcagaaggagaucgagcagagcaaggaggccugggagaugcacgaguuccugaccccgcggcuccaggagauggacgaggagcgcgagauccugguggacgaggaguacgagcuguaccaggaccccucccccagcauggagcucuacccccugucccacauccaggaggcgaccccgguccccagcgugaacgagcugcacuucgggacccaguggcuccacgacaacgagcccuccgagagccaggaggcccggacgggccgcaccgucuacucccaggaggcccagcccuacggguacugcccggagaacgugaugaaggagaacuucgugauggagagccugcccuccguccccagcaccgagggcaacucccagcaggggcgguucgacgaccuggagaaccucaacagccuggccaagaccagccuggaccucggcaugaucccgaacgacgugcagggccccucccugcugaucgaccuccccguggucgcccagcgccgggagcaggaggaccugccccuguaccagcaccaggcgacgcgcgugaucagcaaggccuccgccuacaccgggaugcucagcucccgcuacgccaccgacacgugcgagcugccggagcgggaggagggcgagggggaggagacgcccaacuucagccacugggggccgccccgcaucguggagaucuuccgggagccgaacgucucccugggcaucagcaucgugggcggccagaccgugaucaagcgccucaagaacggggaggagcugaagggcaucuucaucaagcagguccuggaggacucccccgccgggaagaccaacgcgcucaagaccggcgacaagauccuggaggugagcggcguggaccugcagaacgccucccacagcgaggccgucgaggccaucaagaacgcggggaaccccgugguguucaucguccagucccucagcuccacgccccgggugaucccgaacgugcacaacaaggccaacaagaucaccggcaaccagaaccaggacacccaggagaagaaggagaagcgccaggggaccgccccgccgcccaugaagcugcccccgcccuacaaggcccugacggacgacagcgacgagaacgaggaggaggacgccuucaccgaccagaagauccggcagcgcuacgcggaccuccccggcgagcugcacaucaucgagcuggagaaggacaagaacgggcucggccugucccuggccggcaacaaggaccggagccgcauguccaucuucgucguggggaucaacccggagggccccgccgccgccgacgggcggaugcgcaucggcgacgagcuccuggagaucaacaaccagauccuguacgggcggagccaccagaacgcgagcgccaucaucaagaccgcccccuccaaggugaagcucgucuucauccgcaacgaggacgccgugaaccagauggccgugacccccuucccgguccccagcuccagccccuccagcaucgaggaccaguccggcacggagcccaucagcuccgaggaggacggcagcguggagguggggaucaagcagcugccggaguccgagagcuucaagcuggcggucucccagaugaagcagcagaaguaccccaccaaggugagcuucuccagccaggagaucccccucgccccggccuccagcuaccacuccaccgacgccgacuucaccggcuacgggggcuuccaggcgccccugagcguggaccccgccacgugccccaucgucccgggccaggagaugaucaucgagaucagcaaggggcgguccggccuggggcucagcaucgugggcgggaaggacacgccccuguucuggcgccugggcagcccccgggccuggagccagcaccucgugcgcgccuucaugcugcaccaccccgucaccgagguggagggccagaacgccaucgugauccacgaggucuacgaggagggggcggccgcccgggacggccgccugugggccggggaccagauccucgaggugaacggcguggaccugcggaacuccagccacgaggaggccaucaccgcgcugcgccagacgccgcagaagguccgccucgugguguaccgggacgaggcccacuaccgcgacgaggagaaccuggagaucuuccccgucgaccugcagaagaaggccgggcggggccugggccucuccaucguggggaagcgcaacggcagcgggguguucaucuccgacaucgucaagggcggggccgccgaccuggacggccggcugauccagggcgaccagauccucagcgugaacggggaggacaugcgcaacgcgucccaggagaccguggccaccauccugaagugcgcccagggccugguccagcucgagaucgggcggcugcgcgccggcagcuggaccuccgcccggaccacgagccagaacucccaggggagccagcaguccgcgcacagcuccugccaccccagcuucgcccccgugaucaccggccugcagaaccucgucggcaccaagcgcgugagcgacccgucccagaagaacagcgggaccgacauggagccccggacgguggagaucaaccgcgagcuguccgacgcccugggcaucagcaucgccgggggccggggcagcccccugggggacauccccgucuucaucgcgaugauccaggccagcggcguggccgcccgcacccagaagcugaaggugggggaccggaucgucuccaucaacggccagccgcuggacgggcucagccacgccgacguggugaaccugcugaagaacgcguacggccgcaucauccuccaggucguggccgacaccaacaucuccgccaucgccgcccagcuggagaacaugagcaccggcuaccaccuggggucccccacggcggagcaccaccccgaggacaccgagacgcccccgcccaagaucaucacccucgagaagggcagcgaggggcugggcuucuccaucgucgggggcuacggcagcccccacggggaccugcccaucuacgucaagacgguguucgccaagggcgccgccgccgacgacgggcggcucaagcgcggcgaccagauccuggcggugaacggggagacccuggagggcgucacccacgagcaggccguggccauccucaagcaccagcggggcaccgugacgcugaccguccuguccuga

SEQ ID NO: 31609 - RNA, 1500 nt, Artificial Sequence
  derived and/or modified sequence opt1 from INA__Homo_sapiens__NP_116116
augagcuucggcuccgagcacuaccugugcagcuccagcuccuaccgcaagguguucggggacggcagccggcucuccgcccgccugagcggggccggcggggcgggcggcuuccggucccagagccugucccgcagcaacgucgccuccagcgccgccugcuccagcgccuccagccucgggcugggccuggcguaccggcgcccgcccgccuccgacgggcucgaccugagccaggccgccgcgcggaccaacgaguacaagaucauccgcaccaacgagaaggagcagcugcagggccucaacgaccgguucgccguguucaucgagaaggugcaccagcuggagacgcagaaccgcgcccuggaggccgagcucgccgcgcugcggcagcgccacgccgagcccagccgggucggggagcuguuccagcgcgagcuccgggaccugcgcgcccagcuggaggaggccuccagcgcccggucccaggcgcuccuggagcgcgacggccuggccgaggaggugcagcggcuccgcgcccggugcgaggaggagagccgcggccgcgagggggccgagcgggcccugaaggcgcagcagcgcgacguggacggcgccacccuggcccggcucgaccuggagaagaaggucgagucccugcucgacgagcuggccuucgugcgccaggugcacgacgaggaggucgccgagcugcucgcgacccugcaggccagcucccaggccgccgcggagguggacgugaccgucgccaagcccgaccugacgagcgcccuccgggagauccgcgcccaguacgagucccuggccgcgaagaaccugcagagcgccgaggagugguacaaguccaaguucgccaaccucaacgagcaggccgcccggagcaccgaggcgauccgcgccucccgggaggagauccacgaguaccgccggcagcugcaggcccgcaccaucgagaucgaggggcugcggggcgccaacgagagccucgagcgccagauccuggagcuggaggagcggcacuccgccgagguggcgggcuaccaggacagcaucgggcagcucgagaacgaccugcgcaacaccaaguccgagauggcccggcaccuccgcgaguaccaggaccugcugaacgugaagauggcccuggacaucgagaucgccgcguaccggaagcuccuggagggcgaggagacgcgcuucagcaccuccgggcugagcaucagcggccugaacccccuccccaaccccuccuaccugcugccgccccgcauccucagcgccaccaccuccaaggucagcuccacggggcugagccugaagaaggaggaggaggaggaggaggccuccaagguggccagcaagaagaccucccagaucggcgagagcuucgaggagauccucgaggagaccgugaucuccaccaagaagacggagaaguccaacaucgaggagaccaccaucagcagccagaagaucuga

SEQ ID NO: 31610 - RNA, 2757 nt, Artificial Sequence
  derived and/or modified sequence opt1 from INCENP__Homo_sapiens__NP_001035784
augggcaccaccgcccccgggcccauccaccuccuggagcugugcgaccagaagcugauggaguuccugugcaacauggacaacaaggaccugguguggcuggaggagauccaggaggaggccgagcgcauguucacgcgggaguucagcaaggagcccgagcucaugcccaagacccccucccagaagaaccgccggaagaagcgccggaucagcuacguccaggacgagaaccgcgacccgauccggcgccggcugucccgccgcaagagccgcuccagccagcuguccagccggcgccuccgguccaaggacagcguggagaagcuggcgaccguggucggcgagaacggguccgugcugcgccgggugacccgcgccgccgccgccgcggccgccgccacgauggcgcucgccgcccccagcucccccacccccgagagcccgaccaugcugaccaagaagcccgaggacaaccacacgcagugccagcugguccccgugguggagaucggcaucuccgagcggcagaacgccgagcagcacgucacccagcucaugagcaccgagccccugccgcgcacccugucccccacgcccgccagcgcgaccgcccccaccucccaggggaucccgaccagcgacgaggagagcacgcccaagaaguccaaggcccggauccucgagagcaucaccguguccagccugauggccacgccccaggaccccaagggccagggcguggggaccggccgcuccgccagcaagcugcgcaucgcgcaggucuccccggggccccgggacagccccgccuuccccgacuccccguggcgcgagcgggugcucgcccccauccugcccgacaacuucagcacccccaccggcucccgcaccgacagccaguccgugcggcacagcccgaucgcccccuccagccccuccccgcagguccucgcccagaaguacagccucguggcgaagcaggaguccgugguccggcgggccagccgccggcuggccaagaagaccgccgaggagcccgccgcgagcgggcgcaucaucugccacuccuaccuggagcggcuccugaacguggaggugccccagaaggucggcagcgagcagaaggagcccccggaggaggccgagcccguggccgccgcggagcccgaggugcccgagaacaacggcaacaacuccuggccgcacaacgacacggagaucgccaacagcacccccaaccccaagcccgccgccuccagcccggagacccccuccgccgggcagcaggaggcgaagaccgaccaggccgacggcccccgcgagcccccgcagagcgcccggcgcaagcgguccuacaagcaggccgucagcgagcuggacgaggagcagcaccucgaggacgaggagcugcagccgccccgcuccaagacgcccagcucccccugccccgccagcaaggugguccggccccugcgcaccuuccuccacaccgugcagcggaaccagaugcugaugacccccacguccgcgccgcgcagcgugaugaaguccuucaucaagcgcaacacgccccugcggauggaccccaagugcagcuucgucgagaaggagcgccagcggcucgagaaccugcgccggaaggaggaggccgagcagcugcgccggcagaagguggaggaggacaagcgccggcgccucgaggaggugaagcugaagcgggaggagcgccugcggaagguccuccaggcccgcgagcggguggagcagaugaaggaggagaagaagaagcagaucgagcagaaguucgcccagaucgacgagaagaccgagaaggccaaggaggagcgccuggcggaggagaaggccaagaagaaggccgccgcgaagaagauggaggagguggaggcccggcgcaagcaggaggaggaggcccggcgccugcgguggcuccagcaggaggaggaggagcgccgccaccaggagcugcugcagaagaagaaggaggaggagcaggagcggcuccgcaaggccgccgaggcgaagcggcuggccgagcagcgcgagcaggagcggcgcgagcaggagcggcgcgagcaggagcggcgcgagcaggagcggcgcgagcaggagcggcgcgagcaggagcggcagcuggccgagcaggagcgccggcgcgagcaggagcggcugcaggccgagcgcgagcuccaggagcgcgagaaggcccugcggcugcagaaggagcagcuccagcgcgagcuggaggagaagaagaagaaggaggagcagcagcggcuggcggagcgccagcuccaggaggagcaggagaagaaggccaaggaggccgccggggccagcaaggcgcugaacgucaccguggacgugcaguccccggccugcaccagcuaccagaugacgccccagggccaccgggccccgcccaagaucaaccccgacaacuacggcauggaccugaacuccgacgacagcaccgacgacgaggcccacccccgcaagcccauccccaccugggcgcgggggaccccgcucucccaggccaucauccaccaguacuaccacccgcccaaccugcuggagcuguucggcaccauccucccccuggaccucgaggacaucuucaagaaguccaagccccgcuaccacaagcggaccagcagcgccgucuggaacuccccgccccugcagggggcccgcgugcccagcucccuggccuacagccucaagaagcacuga

SEQ ID NO: 31611 - RNA, 3723 nt, Artificial Sequence
  derived and/or modified sequence opt1 from INF2__Homo_sapiens__NP_001026884
augagcgugaaggagggcgcccagcgcaagugggccgcccugaaggagaagcucgggccccaggacuccgaccccaccgaggccaaccuggagagcgccgaccccgagcugugcauccggcuccugcagaugcccuccgucgugaacuacagcggccugcgcaagcggcucgagggguccgacggcggguggauggugcaguuccuggagcagagcggccuggaccuccugcuggaggcccucgcccgccuguccggccgcgggguggcgcgcaucagcgacgcccugcuccagcugaccugcguguccugcgugcgggccgucaugaacagccgccagggcaucgaguacauccuguccaaccagggguacgugcggcagcucagccaggcccuggacacguccaacgugauggucaagaagcaggucuucgagcugcucgcggcccugugcaucuacagccccgagggccacgugcugacccucgacgcccuggaccacuacaagaccgucugcucccagcaguaccgcuucagcaucgugaugaacgagcuguccgggagcgacaacgugcccuacgucgugacccuccuguccgugaucaacgccgucauccugggccccgaggaccuccgggcccgcacgcagcugcggaacgaguucaucggccugcagcuccuggacgugcuggcgcgccuccgggaccuggaggacgccgaccugcucauccagcuggaggccuucgaggaggccaaggccgaggacgaggaggagcugcuccgcgugagcgggggcgucgacaugagcucccaccaggagguguucgcgagccuguuccacaagguguccugcagccccgucuccgcccagcugcucagcgugcugcaggggcugcuccaccuggagcccacccugcgguccagccagcugcucugggaggcccuggagucccuggucaaccgcgccgugcuccuggccagcgacgcgcaggagugcacccuggaggagguggucgagcggcuccuguccgugaagggccgcccccggcccagcccccuggugaaggcccacaaguccguccaggccaaccucgaccagagccagcgcggcuccagcccccagaacaccacgaccccgaagcccuccguggaggggcagcagcccgccgccgcggccgccugcgagcccguggaccacgcccagagcgaguccauccugaaggucagccagccccgcgcgcuggagcagcaggccagcacgcccccgcccccgcccccgccgccccuccugcccggcuccagcgccgagcccccgcccccgcccccgcccccgccccugcccuccgugggggccaaggcccuccccaccgcgcccccgcccccgccccugcccggccugggggccauggccccgcccgcgccgccccugcccccgccccuccccggcagcugcgaguuccugcccccgccgcccccgccccuccccggccuggggugcccgcccccgcccccgccccugcuccccggcaugggguggggcccgcccccgccgcccccgccccugcugcccugcacgugcagcccgcccguggccgggggcauggaggaggucaucguggcccagguggaccacggccucgggagcgccuggguccccucccaccggcgcgugaacccgcccacccugcggaugaagaagcugaacuggcagaagcuccccagcaacguggcccgcgagcacaacuccaugugggccagccuguccagccccgacgccgaggcggucgagcccgacuucuccagcaucgagcggcuguucuccuuccccgccgccaagcccaaggagcccaccaugguggcgccccgggcgcggaaggagcccaaggagaucaccuuccucgacgccaagaagucccugaaccugaacaucuuccucaagcaguucaagugcuccaacgaggagguggccgccaugauccgcgccggcgacaccaccaaguucgacgucgaggugcugaagcagcugcucaagcugcugcccgagaagcacgagaucgagaaccuccgggcguucaccgaggagcgcgccaagcuggccagcgccgaccacuucuaccugcuccugcuggccauccccugcuaccagcuccggaucgagugcaugcugcugugcgagggggcggccgccgugcucgacaugguccgccccaaggcccagcuggugcuggccgcgugcgagagccuccugaccucccggcagcugcccaucuucugccagcucauccugcgcaucggcaacuuccugaacuacgggagccacacgggcgacgccgacggcuucaagaucuccacccuccugaagcugaccgagaccaagagccagcagaaccgggugacgcuccugcaccacguccuggaggaggccgagaagucccaccccgaccuccugcagcugccccgcgaccucgagcagcccagccaggccgcggggaucaaccuggagaucauccgguccgaggccagcuccaaccugaagaagcuccuggagaccgagcgcaaggugagcgccuccguggccgagguccaggagcaguacaccgagcggcugcaggccagcaucuccgcguuccgcgcccucgacgagcuguucgaggccaucgagcagaagcagcgcgagcuggccgacuaccucugcgaggacgcccagcagcugagccuggaggacaccuucuccacgaugaaggcguuccgggaccucuuccugcgcgcccugaaggagaacaaggaccggaaggagcaggccgccaaggccgagcgccggaagcagcagcucgcggaggaggaggcccgccggccgcgcggcgaggacgggaagcccgugcggaagggccccggcaagcaggaggaggugugcgucaucgacgcccugcuggccgacauccgcaagggguuccagcuccggaagaccgcccgcggccgcggggacaccgacggcgggagcaaggcggccuccauggacccgccccgcgccaccgagcccguggccacgagcaaccccgcgggcgaccccgugggcuccacccggugccccgccagcgagcccgggcuggacgccaccaccgccagcgagucccgcggcugggaccuggucgacgccgugacgcccgggccccagccgacccucgagcagcuggaggagggcgggccccggccccuggagcgccggagcuccugguacguggacgcgagcgacguccucaccaccgaggacccccagugcccgcagccccuggagggcgccuggcccgugacccugggcgacgcccaggcccugaagccccucaaguucuccagcaaccagccgcccgccgcgggguccagccgccaggacgccaaggaccccacgucccugcugggcgugcuccaggccgaggccgacagcaccuccgaggggcuggaggacgccguccacagccggggcgcgcggccgcccgccgccgggcccggcggcgacgaggacgaggacgaggaggacaccgcccccgaguccgcgcuggacaccagccucgacaaguccuucagcgaggacgccgugacggacuccagcggguccggcacccugccccgcgcccgggggcgcgccagcaagggcaccgggaagcggcgcaagaagcggcccagccgcucccaggagggccugcggccccgccccaaggccaaguga

SEQ ID NO: 31612 - RNA, 789 nt, Artificial Sequence
  derived and/or modified sequence opt1 from ING1__Homo_sapiens__NP_001254657
augagcuucguggagugccccuaccacagcccggccgagcgccuggucgccgaggcggacgagggcgggcccagcgccaucaccgagauccucaaggagcuggacgagugcuacgagcgguucucccgcgagaccgacggcgcccagaagcggcgcaugcugcacugcgugcagcgggcccucauccgcagccaggagcugggggacgagaagauccagaucgugucccagauggucgagcugguggagaaccggacgcgccagguggacagccacgucgagcuguucgaggcccagcaggagcucggcgacaccgcggggaacuccggcaaggccggcgccgaccggcccaagggggaggccgcggcccaggccgacaagcccaacagcaagcgcucccggcgccagcggaacaacgagaaccgcgagaacgccagcuccaaccacgaccacgacgacggcgccagcgggaccccgaaggagaagaaggcgaagaccuccaagaagaagaagcggagcaaggccaaggccgagcgcgaggccucccccgccgaccugcccaucgaccccaacgagccgacguacugccucugcaaccaggugagcuacggcgagaugaucgggugcgacaacgacgagugccccaucgagugguuccacuucuccugcgugggccugaaccacaagcccaagggcaagugguacugccccaagugccgcggggagaacgagaagaccauggacaaggcgcuggagaaguccaagaaggagcgggccuacaaccgguga

SEQ ID NO: 31613 - RNA, 723 nt, Artificial Sequence
  derived and/or modified sequence opt1 from ING2__Homo_sapiens__NP_001278888
auggaccaggacggcgaccagcagcuggggcccagccgcauccucgccccgcagacccugaaggagaucgacgacguguacgagaaguacaagaaggaggacgaccugaaccagaagaagcggcuccagcagcugcugcagcgcgcccucaucaacucccaggagcugggcgacgagaagauccagaucgucacccagaugcuggagcucguggagaaccgggcgcgccagauggagcugcacagccagugcuuccaggaccccgccgaguccgagcgggccagcgacaaggccaagauggacuccagccagcccgagcgcuccagccggcgcccccggcgccagcggacguccgagagccgcgaccugugccacauggccaacgggaucgaggacugcgacgaccagccgcccaaggagaagaaguccaagagcgcgaagaagaagaagcgguccaaggccaagcaggagcgcgaggccagccccguggaguucgccaucgaccccaacgagccgaccuacugccucugcaaccaggucuccuacggcgagaugaucgggugcgacaacgagcagugccccaucgagugguuccacuucagcugcgugucccugaccuacaagcccaagggcaagugguacugccccaagugccggggcgacaacgagaagaccauggacaagagcacggagaagaccaagaaggaccgccggucccgcuga

SEQ ID NO: 31614 - RNA, 1257 nt, Artificial Sequence
  derived and/or modified sequence opt1 from ING3__Homo_sapiens__NP_061944
augcuguaccucgaggacuaccuggagaugaucgagcagcugcccauggaccuccgcgaccgguucaccgagaugcgcgagauggaccuccaggugcagaacgccauggaccagcuggagcagcgggucagcgaguucuucaugaacgccaagaagaacaagccggaguggcgcgaggagcagauggcguccaucaagaaggacuacuacaaggcccuggaggacgccgacgagaaggugcagcuggccaaccagaucuacgaccugguggaccggcaccuccgcaagcuggaccaggagcuggccaaguucaagauggagcucgaggcggacaacgccggcaucaccgagauccuggagcggcgcagccuggagcucgacacgcccucccagcccgucaacaaccaccacgcccacagccacacccccguggagaagcggaaguacaacccgaccucccaccacaccacgaccgaccacauccccgagaagaaguucaagagcgaggcccugcuguccacccucaccagcgacgcguccaaggagaacacgcuggggugccgcaacaacaacagcaccgccuccagcaacaacgccuacaacgugaacuccagccagccccugggcuccuacaacaucgggagccucuccagcggcaccggggccggcgccaucaccauggcggccgcccaggccguccaggccacggcgcagaugaaggagggccggcgcaccuccagccugaaggccagcuacgaggccuucaagaacaacgacuuccagcuggggaaggaguucuccauggcccgggagaccgugggcuacagcuccagcuccgcccucaugaccacgcugacccagaacgcgagcuccagcgccgccgacucccgcagcgggcggaaguccaagaacaacaacaagagcuccagccagcaguccagcuccagcuccagcagcuccagccuguccagcugcuccagcuccagcaccgugguccaggagaucucccagcagaccacgguggugcccgagagcgacuccaacagccaggucgacuggaccuacgacccgaacgagccccgcuacugcaucugcaaccagguguccuacggcgagaugguggggugcgacaaccaggacugccccaucgagugguuccacuacggcugcgucggccucaccgaggcccccaaggggaagugguacugcccgcagugcaccgccgcgaugaagcggcgcggcagccggcacaaguga

SEQ ID NO: 31615 - RNA, 750 nt, Artificial Sequence
  derived and/or modified sequence opt1 from ING4__Homo_sapiens__NP_001121054
auggccgccggcauguaccuggagcacuaccucgacagcaucgagaaccugcccuucgagcugcagcgcaacuuccagcucaugcgggaccuggaccagcgcaccgaggaccugaaggcggagaucgacaagcucgccaccgaguacauguccagcgcccggucccugagcuccgaggagaagcuggcccuccugaagcagauccaggaggccuacgggaagugcaaggaguucggcgacgacaaggugcagcuggcgaugcagacguacgagauggucgacaagcacauccgccggcucgacaccgaccuggcccgcuucgaggccgaccugaaggagaagcagaucgagagcuccgacuacgacagcuccagcuccaaggggaagaagaagggccggacccagaaggagaagaaggccgcgcgcgcccggagcaaggggaagaacuccgacgaggaggccccgaagaccgcccagaagaagcucaagcuggugcgcacgagccccgaguacggcaugcccuccgugaccuucggcagcguccaccccuccgacgugcuggacaugccgguggaccccaacgagcccaccuacugccucugccaccaggucagcuacggggagaugaucggcugcgacaaccccgacugcuccaucgagugguuccacuucgccugcguggggcugaccacgaagccgcggggcaagugguucugcccccgcugcagccaggagcggaagaagaaguga

SEQ ID NO: 31616 - RNA, 723 nt, Artificial Sequence
  derived and/or modified sequence opt1 from ING5__Homo_sapiens__NP_115705
auggccaccgccauguaccuggagcacuaccucgacagcaucgagaaccugcccugcgagcugcagcgcaacuuccagcucaugcgggagcuggaccagcgcaccgaggacaagaaggcggagaucgacauccuggccgccgaguacaucuccacggugaagacccucagcccggaccagcgggucgagcgccugcagaagauccagaacgccuacuccaagugcaaggaguacagcgacgacaaggugcagcuggccaugcagaccuacgagaugguggacaagcacauccggcgccucgacgcggaccuggcccgguucgaggccgaccugaaggacaagauggagggcuccgacuucgagagcuccgggggccgcgggcucaagaagggccgggggcagaaggagaagcgcggcagccggggccgcgggcggcgcaccuccgaggaggacacgcccaagaagaagaagcacaagggcgggagcgaguucaccgacaccauccuguccguccaccccagcgacgugcuggacaugcccguggacccgaacgagcccaccuacugccucugccaccaggucuccuacggcgagaugaucgggugcgacaaccccgacugccccaucgagugguuccacuucgccugcguggaccugacgaccaagccgaagggcaagugguucugcccccggugcgugcaggagaagcgcaagaagaaguga

SEQ ID NO: 31617 - RNA, 1101 nt, Artificial Sequence
  derived and/or modified sequence opt1 from INHA__Homo_sapiens__NP_002182
auggugcugcaccuccugcuguuccuccugcugacgccccagggcgggcacagcugccagggccucgagcuggcccgcgagcugguccucgccaaggugcgggcgcuguuccuggacgcccucgggccgcccgccgugacccgcgagggcggggaccccggcguccggcgccugccccggcgccacgcccugggcggguucacccaccggggcuccgagccggaggaggaggaggacgugagccaggccauccucuuccccgcgaccgacgccuccugcgaggacaagagcgccgcccgcgggcuggcgcaggaggccgaggagggccuguuccgguacauguuccgccccucccagcacacccggagccgccaggugaccuccgcccagcucugguuccacacggggcuggaccggcagggcaccgccgccagcaacuccagcgagccccugcucggccugcuggcgcucucccccgggggccccgucgccgugcccaugagccuggggcacgcgcccccgcacugggccgugcugcaccucgccaccuccgcccugagccugcucacccaccccguccuggugcugcuccugcgcugcccccugugcacgugcuccgcccggcccgaggccaccccguuccucguggcccacacccgcacccggccgcccagcggcggcgagcgcgcccggcgcuccacgccccugaugagcuggccguggucccccagcgcgcugcggcuccugcagcgcccgcccgaggagcccgccgcccacgccaacugccaccgcgucgcccugaacaucagcuuccaggagcucgggugggagcgguggaucguguacccgcccuccuucaucuuccacuacugccacggcgggugcggccugcacaucccgcccaaccugagccuccccgugcccggggcgccgcccacccccgcccagcccuacucccugcugcccggcgcccagcccugcugcgccgcgcuccccggcaccaugcgcccccugcacguccggaccacgagcgacgggggcuacuccuucaaguacgagaccgugccgaaccugcugacccagcacugcgccugcaucuga

SEQ ID NO: 31618 - RNA, 1281 nt, Artificial Sequence
  derived and/or modified sequence opt1 from INHBA__Homo_sapiens__NP_002183
augccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccuga

SEQ ID NO: 31619 - RNA, 1224 nt, Artificial Sequence
  derived and/or modified sequence opt1 from INHBB__Homo_sapiens__NP_002184
auggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccuga

SEQ ID NO: 31620 - RNA, 1059 nt, Artificial Sequence
  derived and/or modified sequence opt1 from INHBC__Homo_sapiens__NP_005529
augaccagcucccugcuccuggccuuccugcuccuggcccccaccacgguggcgaccccgcgcgccggcgggcagugccccgccugcggcgggcccacccuggagcucgagagccagcgggagcugcugcucgaccuggccaagcgcuccauccuggacaagcuccaccugacccagcggcccacgcugaaccgcccggucagccgggccgcgcuccgcaccgcccugcagcaccuccacggcgugccccagggggcccugcuggaggacaaccgggagcaggagugcgagaucaucuccuucgccgagaccggccugagcaccaucaaccagacgcgccucgacuuccacuucuccagcgaccggaccgcgggcgaccgcgaggugcagcaggccucccugauguucuucguccagcugcccagcaacaccaccuggacgcucaaggugcgggugcugguccuggggccccacaacaccaaccucacccuggccacccaguaccugcucgagguggacgccuccggcuggcaccagcugccgcuggggcccgaggcccaggcggccugcagccagggccaccucacgcuggagcuggugcucgaggggcaggucgcccaguccagcgugauccugggcggcgccgcccaccgccccuucguggcggcccggguccgcgucgggggcaagcaccagauccaccggcgcgggaucgacugccagggcggcucccggaugugcugccgccaggaguucuucguggacuuccgggagaucggguggcacgacuggaucauccagcccgagggcuacgccaugaacuucugcaucgggcagugcccgcugcacaucgccggcaugcccgggaucgccgcgagcuuccacaccgccgugcucaaccugcugaaggccaacaccgccgccggcaccacgggcgggggcuccugcugcgugcccaccgcgcgccggccccucagccugcuguacuacgaccgcgacuccaacaucgugaagaccgacaucccggacauggucguggaggccugcgggugcagcuga

SEQ ID NO: 31621 - RNA, 1053 nt, Artificial Sequence
  derived and/or modified sequence opt1 from INHBE__Homo_sapiens__NP_113667
augcgccugcccgacgugcagcucuggcugguccugcucugggcccuggugcgggcccagggcaccgggagcgugugcccguccugcggcgggagcaagcuggcgccccaggccgagcgcgcccucguccuggagcuggccaagcagcagauccucgacggccugcaccugaccucccggccccgcaucacgcacccgccgccccaggccgcgcucacccgggcccugcgccggcugcagcccgggagcguggcccccggcaacggcgaggaggugaucuccuucgccaccgucaccgacagcacguccgcguacagcucccuccugaccuuccaccugagcaccccgcgcucccaccaccucuaccacgcccggcuguggcugcacgugcuccccacccugcccgggacgcugugccuccgcaucuuccgguggggcccccgccggcgccggcaggggagccgcacccugcuggccgagcaccacaucaccaaccucggcuggcacacccugacgcugcccuccagcgggcuccggggcgagaaguccggcgugcugaagcugcagcucgacugccgcccccuggaggggaacagcaccgucaccggccagccccggcgccugcucgacaccgccgggcaccagcagcccuuccuggagcugaagauccgggccaacgagccgggcgcgggccgcgcccgccggcgcacgccgaccugcgagcccgccacgccccucugcugccggcgcgaccacuacguggacuuccaggagcugggguggcgggacuggauccugcagcccgagggcuaccagcucaacuacugcuccgggcagugcccgccccaccuggccggcagccccgggaucgccgcguccuuccacagcgccguguucagccugcucaaggccaacaaccccuggcccgccuccaccagcugcugcguccccaccgcccgccggccccugucccugcucuaccuggaccacaacggcaacguggugaagaccgacgucccggacauggugguggaggcgugcggcugcagcuga

SEQ ID NO: 31622 - RNA, 1071 nt, Artificial Sequence
  derived and/or modified sequence opt1 from INO80B__Homo_sapiens__NP_112578
auguccaagcuguggcgccggggcuccaccagcggggccauggaggcccccgagccgggcgaggcgcucgagcugucccuggccggggcccacggccacggggugcacaagaagaagcacaagaagcacaagaagaagcacaagaagaagcaccaccaggaggaggacgccggccccacccagcccagccccgccaagccgcagcucaagcugaagaucaagcugggcgggcagguccucggcacgaaguccgugcccaccuucaccgugauccccgaggggccccgcagcccgagcccccugauggucguggacaacgaggaggagcccauggagggcgugccccuggagcaguaccgggcguggcucgacgaggacuccaaccuguccccgagcccccugcgcgaccucuccgggggccugggcgggcaggaggaggaggaggagcagcgguggcuggacgcccucgagaagggcgagcuggacgacaacggggaccugaagaaggagaucaacgagcgccuccugaccgcccggcagcgcgcccugcuccagaaggcgcggagccagcccucccccaugcugccgcugcccgucgccgagggcugcccgcccccggcccucacggaggagaugcugcugaagcgcgaggagcgggcccgcaagcggcgccuccaggccgcgcggcgcgccgaggagcacaagaaccagaccaucgagcggcugaccaagaccgccgccacgagcggccgcgggggccggggcggcgcccgcggggagcggcgcggcggccgcgcggccgcccccgcccccauggugcgguacugcuccggggcccagggcagcacccuguccuucccgcccggggugcccgcgcccaccgccgucagccagcgccccuccccgagcgggcccccgccccggugcagcgugcccgggugcccccacccccgccgguacgccugcucccgcaccggccaggcccucugcagccugcagugcuaccggaucaaccugcagaugcgccucggcgggcccgagggccccgggagcccccugcuggccacguga

SEQ ID NO: 31623 - RNA, 3084 nt, Artificial Sequence
  derived and/or modified sequence opt1 from INO80D__Homo_sapiens__NP_060229
auguacgagggcaagcacauccacuucagcgagguggacaacaagccccugugcuccuacagcccgaagcucugcaagcagcgccggcugaacggguacgccuucugcauccgccacguccuggaggacaagaccgcccccuucaagcagugcgaguacguggcgaaguacaacucccagcggugcaccaaccccauccccaagagcgaggaccgccgguacugcaacucccaccuccaggugcugggcuucaucccgaagaaggagcgcaagaagaagaacgaccccaucgacgaggucaaggugcggcaccagauggacacgauggccuucagccugaccgugcccacccucgcccugaagaugcccaacgggcuggacggcaugucccucagcccgcccggggcccgcgucccccugcacuaccuggagaccgagcucgaggaccccuucgccuucaacgaggaggacgacgaccugaagaagggcgcgacggugcggaagaagcugcaguccaagcucgcccagaaccgccagcggcagcgcgagaccgagauccugaaggugcggcaggagcacuucagcccgccgcccgcccccucccagcagcagccgccccagcagcacagccaccugagcccccucuccaccucccugaagcccccggccccgccccagggcagcgucugcaagagcccccagccccagaacaccucccugcccaugcaggggguggcgcccacgacccacaccaucgcccaggcccgccagcucucccacaagcggccccugccgcugcuccccagcagccgcgcccccaccguggacccgccccggacggaccgcauccugaugaaggccaccgcguucagcccccacuucuccugcaucucccggcugcagcgccucgucaagcugugcacccagaagcaccagcuggacaccgaccucuucccccaccugggccuggacuggagcgaggaguccggggaggagccggaggacagcgagcaggccucccccuaccagguggccuggagcauccgggagacgcuccgcuaccagcgccacgccuccgacgacgacgacgccgagagccgguccagccgcgugacccagcugugcaccuacuuccagcagaaguacaagcaccugugccggcucgagcgcgcggagucccggcagaagaagugccgccacaccuuccggaaggcccugcugcaggccgccagcaaggagcccgagugcacgggccagcucauccaggagcugcgccgggccgcgugcucccgcaccagcaucucccggaccaagcugcgcgaggucgagcccgccgccugcagcgggaccgugaagggcgagcagugcgccaacaaggcccuccccuucacgcggcacugcuuccagcacauccugcugaaccacucccagcagcuguucagcagcugcaccgcgaaguucgccgacggccagcagugcuccgugcccgucuucgacaucacccaccagacgccccugugcgaggagcacgccaagaagauggacaacuuccugcgcggggacaacagccggaaggugcagcaccagcagcagcgcaagccccggaagaagaccaagccgcccgcccucaccaagaagcacaagaagaagcgccggcgcggcccccgccggccccagaagccgaucccgcccgcggugccccaggggaaccuguccaugcccgccagcgucucccugcccguggaggccagccacauccgcucccccagcacccccgagcuguccgccgacgagcucccggacgacaucgccaacgagaucaccgacaucccccacgaccuggagcugaaccaggaggacuucagcgacgugcucccccggcugccggacgaccugcaggacuucgacuucuucgagggcaagaacggcgaccuccugcccacgaccgaggaggcggaggagcuggagcgcgcccuccaggccgucaccucccuggagugccugagcaccaucggggugcucgcccaguccgacggcguccccgugcaggagcugagcgaccgggggaucggcguguucuccacggggaccggcgccagcggcauccagucccugagccgcgaggucaacaccgaccucggggagcugcugaacggccggaucgugcacgacaacuucagcucccucgagcuggacgagaaccugcuccgcagcgcgacccuguccaacccgcccacgccccuggccgggcagauccagggccaguucagcgcccccgccaacguggggcucaccuccgccacccugaucagccaguccgcgcugggcgagcgggccuuccccggccaguuccacgggcuccacgacggcagccacgccucccagcgcccgcaccccgcccagcugcugagcaaggcggacgaccucaucaccucccggcagcaguacagcuccgaccacagccacuccagcccccacgggucccacuacgacagcgagcacguccccuccccguacagcgaccacaucaccagcccccacacgaccuccuacagcggcgacaacauggccgccaccuucuccgccgagaugcccaucauggcccagcaccuccugcccacccagcucgaggugccgcucgggggcguggucaacccccgcacgcacuggggcaaccugcccgugaaccugggggaccccagcccguucuccaaccugcugggcgcggacgggcaccuccugagcaccucccugagcaccccgcccaccacguccaacagcgagaccacccagcccgccuucgccaccgugacgcccuccagcuccagcguccuccccggccugccccagaccuccuucagcggcauggggcccuccgccgagcugauggccagcaccuccccgaagcagcagcucccccaguucagcgcggccuucggccaccagcugagcucccacagcgggauccccaaggaccugcagccgucccacagcuccaucgccccgcccaccggcuucacggugaccggggccaccgccaccagcacgaacaacgcguccagccccuuccccucccccaacuga

SEQ ID NO: 31624 - RNA, 4671 nt, Artificial Sequence
  derived and/or modified sequence opt1 from INO80__Homo_sapiens__NP_060023
auggccagcgagcugggcgcccgcgacgacgggggcugcaccgagcucgcgaagccccuguaccugcaguaccucgagcgggcccugcgccuggaccacuuccuccggcagaccuccgccaucuucaaccgcaacaucagcuccgacgacagcgaggacgggcuggacgacuccaacccgcugcucccccagagcggcgacccccugauccaggugaaggaggagcccccgaacucccugcucggggagacgagcggcgccggcuccagcgggaugcugaacaccuacucccugaacggcguccuccagagcgaguccaagugcgacaaggggaaccuguacaacuucagcaagcugaagaagucccggaaguggcucaagagcauccugcuguccgacgagagcuccgaggccgacagccagagcgaggacgacgacgaggaggagcucaaccugucccgcgaggagcugcacaacaugcuccggcugcacaaguacaagaagcugcaccagaacaaguacagcaaggacaaggagcuccagcaguaccaguacuacuccgcgggccugcugagcaccuacgaccccuucuacgagcagcagcgccaccuccuggggcccaagaagaagaaguucaaggaggagaagaagcugaaggccaagcucaagaaggugaagaagaagcggcgccgggacgaggagcuguccagcgaggagagcccccgccggcaccaccaccagaccaagguguucgccaaguucucccacgacgccccgccgcccggcacgaagaagaagcaccuguccaucgagcagcucaacgcgcgccggcgcaaggucuggcugagcaucgugaagaaggagcugcccaaggccaacaagcagaaggccuccgcccggaaccucuuccugaccaacagccgcaagcuggcccaccagugcaugaaggaggugcggcgcgcggcccuccaggcccagaagaacugcaaggagacccugccccgggcccgccgccugaccaaggagaugcuccuguacuggaagaaguacgagaaggucgagaaggagcaccggaagcgcgccgagaaggaggcgcuggagcagcggaagcucgacgaggagaugcgcgaggccaagcggcagcagcgcaagcugaacuuccugaucacgcagaccgagcuguacgcccacuucaugucccggaagcgcgacaugggccacgacgggauccaggaggagauccuccggaagcuggaggacagcuccacccagcgccagaucgacaucggcgggggcgugguggucaacaucacccaggaggacuacgacagcaaccacuucaaggcccaggcccugaagaacgcggagaacgccuaccacauccaccaggcccggacgcgcuccuucgacgaggacgccaaggagagccgggccgcggcccuccgcgccgccaacaaguccggcaccggguucggcgagagcuacagccuggcgaaccccuccauccgggccggggaggacaucccccagcccaccaucuucaacggcaagcugaagggguaccagcucaagggcaugaacuggcuggccaaccuguacgagcagggcaucaacgggauccucgccgacgagaugggccuggggaagaccgugcagagcaucgcccugcucgcgcaccuggccgagcgcgagaacaucuggggcccguuccugaucaucucccccgccagcacgcucaacaacuggcaccaggaguucacccgguucgugcccaaguucaagguccugcccuacugggggaacccgcacgaccgcaaggugauccggcgcuucuggucccagaagacccuguacacccaggacgcccccuuccacguggucaucacgagcuaccagcucguggugcaggacgucaaguacuuccagcgcgugaaguggcaguacauggugcuggacgaggcccaggcgcugaaguccagcuccagcguccgguggaagauccuccugcaguuccagugccgcaaccggcugcuccugaccggcacccccauccagaacaccauggccgagcugugggcccuccugcacuucaucaugcccacgcuguucgacucccacgaggaguucaacgagugguucagcaaggacaucgagucccacgccgagaacaagagcgccaucgacgagaaccagcucucccgccugcacaugauccugaagccguucaugcuccggcgcaucaagaaggacguggagaacgagcugagcgacaagaucgagauccugauguacugccagcucaccucccggcagaagcugcuguaccaggcgcucaagaacaagaucagcaucgaggaccugcugcagagcuccaugggcagcacccagcaggcccagaacaccacguccagccucaugaaccuggugaugcaguuccgcaaggucugcaaccaccccgagcuguucgagcggcaggagaccuggucccccuuccacaucagccucaagcccuaccacaucuccaaguucaucuaccgccacgggcagauccggguguucaaccacagccgcgaccgguggcugcgcguccuguccccguucgcccccgacuacauccagcggagccucuuccaccgcaagggcaucaacgaggaguccugcuucagcuuccugcgguucaucgacaucucccccgccgagauggcgaaccugaugcuccaggggcugcuggcccgcuggcucgcccuguuccugagccucaaggccuccuaccggcugcaccagcugcgcagcuggggcgccccggagggggagucccaccagcgguaccuccgcaacaaggacuuccugcugggcgugaacuucccccucagcuuccccaaccugugcuccugcccccugcucaagagccugguguucagcucccacugcaaggcggucagcggcuacuccgaccagguggugcaccagcgccggagcgccaccuccagccugcgccggugccuccugaccgagcugccguccuuccucugcgucgccagcccccgcgugacggccgugccccuggacuccuacugcaacgaccggagcgccgaguacgagcgccggguccugaaggagggcgggucccucgcggccaagcagugccugcugaacggggcccccgagcucgccgccgacuggcugaaccgccggagccaguucuucccggagcccgcgggcggccugugguccauccgcccccagaacggguggagcuucauccggauccccggcaaggagucccucaucaccgacagcgggaagcuguacgcccuggacgugcuccugacccgccugaagucccagggccaccgggugcucaucuacagccagaugacccgcaugaucgaccugcuggaggaguacauggucuaccggaagcacacguacaugcgccucgacggguccagcaagaucagcgagcggcgcgacaugguggccgacuuccagaaccggaacgacaucuucguguuccugcuguccacccgcgccggcggccucgggaucaaccugaccgcggccgacaccgucaucuucuacgacagcgacuggaacccgaccguggaccagcaggccauggaccgcgcccaccggcugggccagacgaagcaggucaccguguaccgccugaucugcaaggggaccaucgaggagcggauccuccagcgcgccaaggagaaguccgagauccagcggauggugaucagcggcgggaacuucaagcccgacacccugaagcccaaggagguggucucccugcuccuggacgacgaggagcuggagaagaagcuccgccugcggcaggaggagaagcgccagcaggaggagacgaaccgggugaaggagcgcaagcggaagcgcgagaaguacgcggagaagaagaagaaggaggacgagcuggacggcaagcggcgcaaggagggcgugaaccucgucauccccuucgugccgagcgccgacaacuccaaccugagcgccgacggggacgacuccuucaucagcguggacuccgccaugcccagccccuucuccgagaucagcaucuccagcgagcugcacaccggcuccaucccccucgacgagagcuccagcgacaugcuggucaucguggacgacccggccagcuccgcgccccagagccgggccaccaacucccccgccagcaucaccggguccgugagcgacacggucaacggcaucuccauccaggagaugcccgccgccgggcgcggccacagcgcgcggucccgcggccggccgaaggggagcggcuccaccgccaagggggccggcaaggggcgcagccggaaguccaccgccggcagcgccgcggccauggccggcgccaaggcgggggccgccgccgccuccgcggccgccuacgccgccuacggcuacaacgugagcaaggggaucuccgcgagcagcccccugcagaccucccucgugcgccccgccggccuggccgacuucggcccgagcuccgccagcagcccccuguccagcccccucuccaaggggaacaacguccccggcaacccgaagaaccugcacaugacguccagccuggcccccgacucccucgugcgcaagcaggggaagggcaccaaccccagcgggggccgguga

SEQ ID NO: 31625 - RNA, 1200 nt, Artificial Sequence
  derived and/or modified sequence opt1 from INPP1__Homo_sapiens__NP_001122400
augagcgacauccugcgcgagcuccugugcguguccgagaaggccgccaacaucgcgcgggccugccgccagcaggaggcccuguuccagcuccugaucgaggagaagaaggagggcgagaagaacaagaaguucgccgucgacuucaagacccuggccgacgugcucgugcaggaggucaucaagcagaacauggagaacaaguuccccgggcuggagaagaacaucuucggcgaggagagcaacgaguucaccaacgacuggggcgagaagaucacgcugcggcucugcuccaccgaggaggagaccgcggagcugcugagcaaggugcucaacgggaacaagguggccuccgaggcccuggcccgcgucgugcaccaggacguggcguucaccgacccgacgcuggacagcaccgagaucaacgucccccaggacauccucgggaucuggguggaccccaucgacuccaccuaccaguacaucaagggcagcgccgacaucaaguccaaccagggcaucuuccccugcgggcugcagugcgugaccauccugaucggcgucuacgacauccagacgggggugccgcucaugggcgugaucaaccagcccuucgucagccgggaccccaacacccugcgcuggaaggggcagugcuacuggggccuguccuacaugggcaccaacaugcacagccuccagcugaccaucucccggcgcaacgggagcgagacgcacaccggcaacaccggguccgaggccgccuucagccccuccuucagcgccgugaucuccaccagcgagaaggagacgaucaaggcggcccugagccgggugugcggcgaccgcaucuucggcgccgccggggccggcuacaagucccucugcgucgugcaggggcugguggacaucuacaucuucagcgaggacaccaccuucaagugggacuccugcgcggcccacgccauccugcgggccaugggcgggggcaucgucgaccucaaggagugccuggagcgcaacccggagaccggccuggaccucccccagcugguguaccacguggagaacgagggggccgcgggcgucgaccggugggccaacaagggcgggcugaucgccuaccgcagccggaagcgccucgagacguuccugucccugcucgugcagaaccuggcccccgccgagacccacaccuga

SEQ ID NO: 31626 - RNA, 2934 nt, Artificial Sequence
  derived and/or modified sequence opt1 from INPP4A__Homo_sapiens__NP_001127696
augaccgcccgcgagcacagcccccggcacggcgcccgcgcgcgggccaugcagcgcgccuccaccaucgacguggccgccgacaugcuggggcucagccuggcgggcaacauccaggaccccgacgagcccauccuggaguucucccucgccugcagcgagcugcacacgcccucccuggaccggaagcccaacagcuucgucgccguguccgugaccaccccgccccaggccuucuggaccaagcacgcgcagacggagaucaucgaggggaccaacaaccccaucuuccucagcuccaucgccuucuuccaggacagccugaucaaccagaugacccaggucaagcuguccguguacgacgugaaggaccgcagccagggcaccauguaccuccugggguccggcacguucaucgucaaggaccugcuccaggaccggcaccaccgccugcaccugacccuccggagcgccgaguccgaccgcgugggcaacaucaccgugaucggguggcagauggaggagaaguccgaccagcggcccccggucacccgcagcguggacacggugaacggccggaugguccugcccguggacgagagccugaccgaggcccucgggauccgcuccaaguacgccagccugcggaaggacacccugcucaagagcguguucggcggggcgaucugccgcauguaccgguuccccaccacggacggcaaccaccuccgcauccuggagcagauggccgaguccguccugagccugcacgugccccggcaguucgugaagcugcuccuggaggaggacgccgcccgcgucugcgagcuggaggagcucggcgagcuguccccgugcugggagagccugcggcgccagaucgugacccaguaccagaccaucauccucaccuaccaggagaaccugacggaccugcaccaguaccgcgggcccuccuucaaggccagcucccucaaggcggacaagaagcuggaguucgugcccaccaaccugcacauccagcggaugcgcguccaggacgacggcgggagcgaccagaacuacgacaucgugaccaucggcgcccccgccgcccacugccagggcuucaaguccgggggccuccggaagaagcugcacaaguucgaggagaccaagaagcacuucgaggagugcugcacgagcuccgggugccagagcaucaucuacaucccgcaggacgugguccgcgccaaggagaucaucgcgcagaucaacacccugaagacccagguguccuacuacgccgagcggcucagccgcgccgccaaggaccgguccgccaccggccuggagcgcacgcuggcgauccucgccgacaagacccggcagcuggucaccgugugcgacugcaagcugcucgccaacagcauccacgggcugaacgccgcgcgccccgacuacaucgccuccaaggccagccccaccuccacggaggaggagcaggucaugcugcggaacgaccaggacacccugauggcccgcuggaccggccggaacagccgcagcucccuccagguggacuggcacgaggaggagugggagaagguguggcugaacguggacaagagccuggagugcaucauccagcgggucgacaagcuccugcagaaggagcgccugcacggcgaggggugcgaggacguguuccccugcgccggcuccugcaccagcaagaaggggaacccggacucccacgcguacuggauccggcccgaggaccccuucugcgacgugcccagcuccccgugccccagcacgaugcccuccaccgccugccacccccaccucaccacccacugcagcccgccgcccgaggaguccagccccggcgagugguccgaggcccuguacccccugcucaccacgcugaccgacugcgucgccaugaugagcgacaaggccaagaaggcgaugguguuccugcucaugcaggacuccgcccccaccaucgccaccuaccugagccugcaguaccgccgggacguggucuucugccagacgcucaccgcccugaucugcggguucaucaucaagcugcgcaacugccuccacgacgacggcuuccugcgccagcuguacaccaucggccuccuggcccaguucgagucccugcucagcaccuacggggaggagcuggcgaugcuggaggacaugagccucggcaucauggaccugcggaacgugacguucaaggugacccaggccaccuccagcgccuccgccgacaugcugcccgucaucaccgggaaccgcgacggcuucaacgugcgggugccgcuccccgggccccuguucgacgcgcugccccgcgagauccagagcggcaugcuccugcggguccagccggugcuguucaacgugggcaucaacgagcagcagacgcucgccgagcgcuucggggacaccucccugcaggaggucaucaacguggagagccuggugcggcucaacuccuacuucgagcaguucaaggagguccugcccgaggacugccugccccgcagccggucccagaccugccuccccgagcugcugcgcuuccucggccagaacgugcacgcccggaagaacaagaacguggacauccuguggcaggccgccgagaucugccgccggcugaacgggguccgcuucaccagcugcaaguccgcgaaggaccggacggccaugagcgugacccucgagcagugccugauccugcagcacgagcacggcauggccccgcaggucuucacccaggcccucgagugcaugcgcuccgagggcugccggcgcgagaacaccaugaagaacguggggagccggaaguacgccuucaacucccugcagcugaaggcguuccccaagcacuaccgcccgcccgagggcacguacgggaagguggagaccuga

SEQ ID NO: 31627 - RNA, 2775 nt, Artificial Sequence
  derived and/or modified sequence opt1 from INPP4B__Homo_sapiens__NP_001095139
auggagaucaaggaggagggcgccagcgaggaggggcagcacuuccugcccaccgcccaggcgaacgaccccggcgacugccaguucaccuccauccagaagacgcccaacgagccccagcucgaguucauccuggccugcaaggaccugguggcccccguccgcgaccggaagcucaacacccuggugcagaucagcgugauccacccggucgagcagucccugacccgcuacagcuccaccgagaucguggaggggacgcgggacccccucuuccugaccggcgugaccuuccccagcgaguaccccaucuacgaggagaccaagaucaagcugacggucuacgacgugaaggacaagucccacgacaccgugcgcaccagcguccucccggagcacaaggacccgccgcccgagguggggcgguccuuccugggcuacgccagcuucaaggugggcgagcugcucaaguccaaggagcagcugcugguccucagccugcgcaccuccgacgggggcaaggugguggggacgaucgaggucagcguggugaagaugggcgagaucgaggacggggaggccgaccacaucaccaccgacguccagggccagaagugcgcgcuggugugcgagugcaccgcccccgaguccgugagcggcaaggacaaccuccccuuccugaacuccguccugaagaaccccgugugcaagcucuaccgguuccccacgagcgacaacaaguggaugcgcauccgggagcagauguccgagagcauccugagcuuccacauccccaaggagcugaucucccuccacaucaaggaggaccugugccgcaaccaggagaucaaggagcugggggagcucagcccccacugggacaaccugcggaagaacgugcugacccacugcgaccagauggucaacauguaccaggacauccucaccgagcuguccaaggagaccggcagcuccuucaagagcuccagcuccaagggggagaagacgcuggaguucgugcccaucaaccuccaccuccagcgcaugcagguccacagcccccaccugaaggacgcccuguacgacgugaucaccgugggcgccccggcggcccacuuccagggcuucaagaacgggggccugcggaagcugcuccaccgcuucgagaccgagcggcgcaacaccggguaccaguucaucuacuacucccccgagaacacggccaaggccaaggagguccugagcaacaucaaccagcugcagccccucaucgccacccacgcggaccugcugcucaacuccgccagccagcacucccccgacagccugaagaacucccugaagaugcucagcgagaagaccgagcuguucgugcacgccuucaaggaccagcuggugcgguccgcccugcucgcccuguacaccgcgcgcccgggcgggauccugaagaagccgcccagccccaagagcuccacggaggagagcagcccccaggaccagccgcccgucaugcggggccaggacuccaucccccaccacuccgacuacgacgaggaggagugggaccgcgugugggccaacgugggcaagagccucaacugcaucaucgccauggucgacaagcugaucgagcgggacgggggcuccgaggggagcggcgggaacaacgacggcgagaaggagcccucccugaccgacgccauccccagccacccccgcgaggacugguacgagcagcucuacccgcugauccugacccucaaggacugcaugggcgagguggugaaccgcgccaagcagucccugaccuucguccugcuccaggagcuggcguacagccugccccagugccucaugcugacgcugcggcgcgacaucguguucucccaggcccucgccgggcuggugugcggcuucaucaucaagcugcagaccagccucuacgaccccggguuccugcagcagcugcacaccgucggccucaucgugcaguacgaggggcugcuguccaccuacagcgacgagaucggcaugcucgaggacauggccgugggcaucuccgaccugaagaaggucgccuucaagaucaucgaggccaagagcaacgacgugcugcccgugaucacggggcggcgcgagcacuacgucguggaggugaagcucccggcgcggauguucgagagccugccccugcagaucaaggagggccagcuccugcacgucuaccccgugcuguucaacguggggaucaacgagcagcagacccucgccgagcgcuucggcgacgucucccugcaggagagcaucaaccaggagaacuucgagcugcuccaggaguacuacaagaucuucauggagaagaugcccccggacuacaucucccacuuccaggagcagaacgaccugaaggcccugcucgagaaccugcugcagaacauccagagcaagaagcggaagaacguggagaucauguggcucgcggccaccaucugccgcaagcugaacggcauccgguucacgugcugcaaguccgccaaggaccgcaccagcauguccgugacccuggagcagugcagcauccuccgggacgagcaccagcugcacaaggacuucuucauccgcgcccuggacugcaugcggcgcgaggggugccggaucgagaacguccucaagaacaucaagugccgcaaguacgccuucaacaugcugcagcugauggcguuccccaaguacuaccggccgcccgagggcaccuacgggaaggccgacaccuga

SEQ ID NO: 31628 - RNA, 1239 nt, Artificial Sequence
  derived and/or modified sequence opt1 from INPP5A__Homo_sapiens__NP_005530
auggccggcaaggccgcggcccccgggaccgccgugcugcucgucaccgccaacgugggcagccuguucgacgacccggagaaccugcagaagaacuggcuccgcgaguucuaccaggugguccacacgcacaagccccacuucauggcccugcacugccaggaguucgggggcaagaacuacgaggcguccaugagccacguggacaaguucgugaaggagcugcucuccagcgacgccaugaaggaguacaaccgggcccgcgucuaccuggacgagaacuacaagucccaggagcacuucaccgcccuggggagcuucuacuuccuccacgagucccugaagaacaucuaccaguucgacuucaaggcgaagaaguaccggaagguggccggcaaggagaucuacagcgacacccuggaguccacccccaugcucgagaaggagaaguucccccaggacuacuucccggagugcaaguggagccgcaagggcuucauccggacgcgcuggugcaucgccgacugcgccuucgaccuggugaacauccaccuguuccacgacgccuccaaccucgucgcgugggagaccagccccuccguguacagcgggauccggcacaaggcccugggcuacgugcuggaccgcaucaucgaccagcgguucgagaaggucuccuacuucguguucggggacuucaacuuccgccucgacagcaaguccguggucgagacccugugcaccaaggccacgaugcagaccgugcgggccgccgacaccaacgagguggucaagcugaucuuccgcgagagcgacaacgaccggaaggugaugcuccagcuggagaagaagcuguucgacuacuucaaccaggagguguuccgcgacaacaacggcaccgcgcuccuggaguucgacaaggagcuguccgucuucaaggaccggcucuacgagcuggacaucagcuucccgcccagcuaccccuacuccgaggacgcccgccagggggagcaguacaugaacacgcggugccccgccuggugcgaccgcauccugaugagccccuccgccaaggagcucgugcugcggagcgaguccgaggagaagguggucaccuacgaccacaucggccccaacgugugcaugggcgaccacaagccggucuuccuggccuuccgcaucaugcccggggcgggcaagccccacgcccacgugcacaagugcugcgugguccaguga

SEQ ID NO: 31629 - RNA, 2250 nt, Artificial Sequence
  derived and/or modified sequence opt1 from INPP5B__Homo_sapiens__NP_001284363
augagcgccgccgcgggcucccgcgagcggaacaccgccgggggcagcaacuucgacgggcugcgccccaacggcaagggggugccgauggaccaguccagccggggccaggacaagcccgagucccuccagccccgccagaacaagagcaaguccgagaucaccgacauggugcggagcuccacgaucaccgugagcgacaaggcccacauccuguccaugcagaaguucggccugcgcgacaccaucgucaagagccaccuccugcagaaggaggaggacuacaccuacauccagaacuuccgguucuucgccgggacguacaacgugaacggccagucccccaaggagugccugcgccucuggcugagcaacgggauccaggccccggacguguacugcgugggcuuccaggagcuggaccucuccaaggaggcguucuucuuccacgacacccccaaggaggaggagugguucaaggccgucagcgaggggcugcaccccgacgccaaguacgccaaggugaagcugauccggcucgugggcaucaugcugcugcucuacgucaagcaggagcacgcggccuacaucuccgagguggaggccgagaccgugggcaccgggaucaugggccgcauggggaacaagggcggcgucgccauccgguuccaguuccacaacacgagcaucugcguggugaacucccaccuggccgcgcacaucgaggaguacgagcgccggaaccaggacuacaaggacaucugcagccgcaugcaguucugccagcccgacccgagccugccgccccucaccaucuccaaccacgacgucauccuguggcugggggaccucaacuaccggaucgaggagcuggacguggagaaggugaagaagcugaucgaggagaaggacuuccagaugcucuacgccuacgaccagcugaagauccaggucgccgccaagaccguguucgagggcuucaccgagggggagcugacguuccagcccaccuacaaguacgacaccggcagcgacgacugggacaccuccgagaagugccgcgcccccgcguggugcgaccggauccucuggaaggggaagaacaucacgcagcugagcuaccagucccacauggcccugaagaccagcgaccacaagcccguguccagcgucuucgacaucggcgugcgcguggucaacgacgagcucuaccggaagacccuggaggagaucgugcgcucccuggacaagauggagaacgccaacauccccagcgucucccucagcaagcgggaguucugcuuccagaacgugaaguacaugcagcugaagguggaguccuucaccauccacaacggccagguccccugccacuucgaguucaucaacaagccggacgaggagagcuacugcaagcaguggcugaacgccaaccccucccgcggguuccuccugcccgacagcgacguggagaucgaccuggagcuguucgugaacaagaugacggccaccaagcugaacuccggcgaggacaagaucgaggacauccugguccuccaccuggaccgcgggaaggacuacuuccugagcguguccggcaacuaccuccccagcugcuucgggagcccgauccacacccugugcuacaugcgggagcccauccuggaccucccccuggagaccaucuccgagcugacgcugaugcccguguggaccggcgacgacggcagccagcucgacuccccgauggagauccccaaggagcuguggaugauggucgacuaccuguaccgcaacgcggugcagcaggaggaccucuuccagcagcccgggcugcggagcgaguucgagcacauccgcgacugccuggacaccggcaugaucgacaaccucuccgccagcaaccacuccguggccgaggcccugcuccucuuccuggagagccugcccgagccggucaucugcuacuccaccuaccacaacugccucgagugcagcgggaacuacacggccuccaagcaggucaucagcacccugcccaucuuccacaagaacguguuccacuaccugauggcguuccuccgggagcugcugaagaacuccgccaagaaccaccucgacgagaacauccuggccagcaucuucggcucccugcuccugcgcaaccccgccgggcaccagaagcuggacaugaccgagaagaagaaggcgcaggaguucauccaccaguuccucugcaacccgcuguga

SEQ ID NO: 31630 - RNA, 3570 nt, Artificial Sequence
  derived and/or modified sequence opt1 from INPP5D__Homo_sapiens__NP_001017915
auggugcccugcuggaaccacggcaacaucacccgcagcaaggccgaggagcugcucucccggaccgggaaggacggcagcuuccugguccgcgccuccgagagcaucucccgggcguacgcccugugcgugcucuaccgcaacugcguguacaccuaccggauccugcccaacgaggacgacaaguucaccguccaggccagcgaggggguguccaugcgcuucuucaccaagcuggaccagcucaucgaguucuacaagaaggagaacaugggccuggugacccaccuccaguaccccgucccccucgaggaggaggacacgggggacgaccccgaggaggacaccguggagagcguggucuccccgcccgagcugccgccccggaacaucccccugaccgccagcuccugcgaggccaaggaggugcccuucagcaacgagaacccccgcgcgaccgagacgucccggcccagccucuccgagacccuguuccagcgccugcagagcauggacaccuccggccucccggaggagcaccugaaggccauccaggacuaccugagcacccagcucgcccaggacuccgaguucgugaagacgggcagcagcucccugccccaccugaagaagcucaccacccugcugugcaaggagcucuacggggaggucauccggacccugcccagccuggagucccuccagcgccuguucgaccagcagcugagccccggccuccggccgcgcccccaggugcccggggaggccaaccccaucaacaugguguccaagcugagccagcugacgucccuccugagcuccaucgaggacaaggucaaggcgcugcuccacgagggcccggagagcccccaccggcccucccugaucccgcccgugaccuucgaggugaaggccgagagccuggggaucccccagaagaugcagcucaaggucgacguggaguccggcaagcugaucaucaagaaguccaaggacggcuccgaggacaaguucuacagccacaagaagauccugcagcucaucaagucccagaaguuccugaacaagcuggugauccucgucgagaccgagaaggagaagauccugcgcaaggaguacguguucgccgacagcaagaagcgggagggguucugccagcugcuccagcagaugaagaacaagcacuccgagcagcccgagcccgacaugaucaccaucuucaucggcacguggaacauggggaacgccccgccgcccaagaagaucaccagcugguuccugagcaagggccagggcaagacccgcgacgacagcgccgacuacaucccccacgacaucuacgugaucgggacccaggaggacccccugagcgagaaggaguggcuggagauccugaagcacucccugcaggagaucacgagcgucaccuucaagaccguggcgauccacacccuguggaacauccggaucgucgugcucgccaagcccgagcacgagaaccgcaucucccacaucugcacggacaacgugaagaccggcaucgccaacacccuggggaacaagggcgccgucggggugagcuucauguucaacggcaccucccugggcuucgugaacagccaccucacguccgggagcgagaagaagcugcggcgcaaccagaacuacaugaacauccugcgcuuccucgcccugggcgacaagaagcugucccccuucaacaucacccaccgguucacccaccucuucugguucggggaccugaacuaccgcgucgaccugccgaccugggaggcggagacgaucauccagaagaucaagcagcagcaguacgccgaccuccugagccacgaccagcugcucaccgagcggcgcgagcagaagguguuccugcacuucgaggaggaggagaucaccuucgcccccaccuaccgguucgagcgccugacccgggacaaguacgccuacacgaagcagaaggccaccggcaugaaguacaaccuccccuccuggugcgaccgcgugcuguggaaguccuacccccugguccacguggugugccagagcuacgggagcaccuccgacaucaugaccagcgaccacagcccggucuucgcgacguucgaggccggcgugaccucccaguucgugagcaagaacggccccgggaccgucgacucccagggccagaucgaguuccuccggugcuacgccacccugaagaccaagagccagaccaaguucuaccuggaguuccacuccagcugccucgaguccuucgucaagagccaggagggggagaacgaggagggcuccgagggggagcugguggugaaguucggcgagacccugcccaagcucaagcccaucaucagcgacccggaguaccugcuggaccagcacauccucaucuccaucaagagcuccgacagcgacgaguccuacggcgaggggugcaucgcccugcgccuggaggccaccgagacgcagcuccccaucuacacgccccugacccaccacggcgagcugaccgggcacuuccagggcgagaucaagcuccagaccagccagggcaagacccgggagaagcuguacgacuucgugaagaccgagcgcgacgaguccagcgggcccaagacccugaagucccucacgagccacgacccgaugaagcagugggaggugaccagccgggcgccgcccugcuccggcagcuccaucaccgagaucaucaaccccaacuacaugggggucggccccuucgggccgcccaugccccugcacgugaagcagacccugagccccgaccagcagcccacggccugguccuacgaccagcccccgaaggacagcccccucggccccugccgcggcgagagcccgcccaccccgcccgggcagccgcccaucucccccaagaaguuccugcccuccaccgccaaccggggccugccgccccgcacccaggagagccggcccuccgaccucgggaagaacgccggcgacacgcugccccaggaggaccugccccucaccaagcccgagauguucgagaacccccuguacgggagccuguccagcuuccccaagcccgcgccgcgcaaggaccaggagucccccaagaugccccggaaggagcccccgcccugccccgagcccggcauccucagcccguccaucgugcugaccaaggcccaggaggccgaccgcggcgaggggcccggcaagcagguccccgccccgcgccugcggagcuucacgugcuccagcagcgccgaggggcgcgcggccggcggggacaagucccagggcaagcccaagacgcccgugagcucccaggcccccgugccggccaagcggcccaucaagcccagccgcuccgagaucaaccagcagacgcccccgacccccacgccccggcccccgcuccccgucaagagccccgccgugcugcaccuccagcacuccaagggccgcgacuaccgggacaacaccgagcugccccaccacgggaagcaccgcccggaggagggcccgcccgggccccugggccggaccgcgaugcaguga

SEQ ID NO: 31631 - RNA, 1935 nt, Artificial Sequence
  derived and/or modified sequence opt1 from INPP5E__Homo_sapiens__NP_063945
augcccagcaaggccgagaaccugcgcccguccgagcccgcgccccagcccccggagggccggacccuccaggggcagcugcccggcgcgccgcccgcccagcgcgccgggagcccgcccgacgcccccggcuccgagagccccgcccuggcgugcuccacccccgccacgcccagcggggaggacccgcccgcccgggccgcgcccaucgcgccccggccgcccgcccggccccgccucgagcgggcccugucccuggacgacaagggcuggcgccggcgccgguuccgcggcagccaggaggaccucgaggcccggaacgggaccucccccagccgcggcuccgugcagagcgaggggcccggcgcccccgcccacuccugcagcccgcccugccuguccaccagccugcaggagauccccaagucccgcgggguccucagcuccgagcgcggcagccccagcuccggcgggaacccgcugagcggcguggccuccagcucccccaaccugccccaccgggacgccgccguggcggggagcuccccgcgccuccccagccugcugccgccccggcccccgcccgcccucucccuggacaucgccagcgacucccugcgcaccgccaacaaggucgacagcgaccucgccgacuacaagcugcgggcgcagccccugcucgugcgcgcccacuccagccugggccccggccgcccccggagcccccuggccugcgacgacugcucccuccgcuccgccaagagcuccuucagccugcuggcccccauccggagcaaggacgugcgcucccggagcuaccucgaggggucccugcuggcgagcggcgcccuccugggggccgacgagcuggcccgcuacuucccggaccggaacgucgcccucuucguggccacguggaacaugcagggccagaaggagcugccgcccucccuggacgaguuccuccugcccgccgaggccgacuacgcccaggaccuguacgugaucgggguccaggagggcugcagcgaccgccgggagugggagacccgccuccaggagacccugggcccccacuacgugcugcucuccagcgcggcccacggggugcuguacaugucccuguucauccggcgcgaccucaucugguucugcagcgaggucgagugcuccaccgugacgacccggaucgugagccagaucaagaccaagggcgcccuggggaucuccuucaccuucuucggcacgagcuuccuguucaucaccucccacuucaccagcggggacggcaaggucgccgagcgccuccuggacuacacccggacggugcaggcccuggugcugccccgcaacguccccgacaccaaccccuaccgguccagcgcggccgacgugaccacccgcuucgacgagguguucugguucggcgacuucaacuuccggcucagcgggggccgcacggucguggacgcccugcugugccaggggcucguggucgacgugccggcccugcugcagcacgaccagcucauccgcgagaugcggaagggcuccaucuucaagggguuccaggagcccgacauccacuuccugcccagcuacaaguucgacaucggcaaggacaccuacgacuccaccagcaagcagcgcacccccuccuacacggaccggguccuguaccgcagccggcacaagggcgacaucugcccgguguccuacagcuccugccccgggaucaagaccagcgaccaccgccccguguacggccucuuccgggucaaggugcgcccggggcgggacaacaucccccuggccgcgggcaaguucgaccgcgagcuguaccuccugggcaucaagcggcgcaucuccaaggagauccagcggcagcaggcccugcagagccagaacuccagcaccaucugcuccgugagcuga

SEQ ID NO: 31632 - RNA, 1569 nt, Artificial Sequence
  derived and/or modified sequence opt1 from INPP5F__Homo_sapiens__NP_001230123
augugccacgacgugaucuucauggccuggcugaagcagcaguucagcgagugcacccucaucgacgccacccaccgcgacgucgacgugcugcugcuccugagcaacagcgcguacuacguggccuacuacgacgacgaggucgacaaggugaaccaguaccagcggcugucccucgagaaccuggagaagaucgagaucggccccgagccgacgcuguucgggaagcccaaguucagcugcaugcgccuccacuaccgguacaaggaggccuccggcuacuuccacacccugcgcgccgugaugcggaaccccgaggaggacgggaaggacacccugcagugcaucgccgagaugcuccagaucaccaagcaggcgaugggcagcgaccugcccaucaucgagaagaagcuggagcgcaaguccagcaagccgcacgaggacaucaucgggauccggucccagaaccagggcagccucgcccagggcaagaacuuccugauguccaaguucagcucccugaaccagaaggucaagcagaccaagagcaacgugaacaucgggaaccuccgcaagcugggcaacuucacgaagcccgagaugaaggugaacuuccugaagcccaaccucaaggucaaccuguggaaguccgacagcucccuggagaccauggagaacaccggggugauggacaaggugcaggccgagagcgacggcgacauguccagcgacaacgacagcuaccacuccgacgaguuccucacgaacagcaaguccgacgaggaccggcagcuggccaacagccuggaguccgucgggcccaucgacuacgugcucccgagcugcggcaucaucgcguccgcgccccgccugggcagccggucccagagccuguccagcaccgacuccagcgugcacgcccccuccgagaucaccgucgcccacgggagcggccucgggaagggccaggagagcccccugaagaaguccccguccgccggcgacgugcacauccugaccggguucgccaagcccauggacaucuacugccaccgcuucgugcaggacgcccagaacaaggucacgcaccucagcgagacccggagcgugucccagcaggccagccaggagcgcaaccagaugaccaaccagguguccaacgagacccagagcgaguccacggagcagacccccagccggcccucccagcuggacgucagccuguccgccaccggcccgcaguuccucagcguggagcccgcccacuccguggcgagccagaagacccccacguccgccagcuccaugcuggagcuggagaccgggcuccacgucacccccagcccguccgagagcagcuccagccgcgccgugucccccuucgccaagauccggagcuccaugguccagguggccagcaucacccaggcgggccugacgcacgggaucaacuucgccguguccaagguccagaaguccccgcccgagcccgagaucaucaaccaggugcagcagaacgagcugaagaagauguucauccagugccagacccgcaucauccagaucuga

SEQ ID NO: 31633 - RNA, 1347 nt, Artificial Sequence
  derived and/or modified sequence opt1 from INPP5K__Homo_sapiens__NP_057616
augagcucccgcaagcugagcggccccaaggggcggcgccucuccauccacguggucaccuggaacguggccagcgccgcgccgccccuggaccuguccgaccuccugcagcugaacaaccggaaccucaaccuggacaucuacgugaucggccugcaggagcucaacagcgggaucaucucccugcugagcgacgccgccuucaacgacuccuggagcuccuuccucauggacguccugagcccccuguccuucaucaaggugagccacgugcgcaugcagggcauccuccugcuggucuucgccaaguaccagcaccuccccuacauccagauccuguccaccaagagcacgccgaccgggcuguucggcuacuggggcaacaagggcggggugaacaucugccucaagcuguacggguacuacguguccaucaucaacugccaccucccgccccacaucagcaacaacuaccagcggcuggagcacuucgaccgcauccuggagaugcagaacugcgagggccgggacauccccaacauccuggaccacgaccucaucaucugguucggggacaugaacuuccgcaucgaggacuucggccugcacuucguccgggaguccaucaagaaccgcugcuacggcgggcugugggagaaggaccagcucagcaucgccaagaagcacgacccccugcugcgggaguuccaggagggccgccuccuguucccgcccaccuacaaguucgaccggaacagcaacgacuacgacaccuccgagaagaagcgcaagcccgcguggacggaccggauccuguggcgccucaagcggcagcccugcgccgggcccgacacccccaucccgcccgccagccacuucucccugagccugcgcggcuacuccagccacaugaccuacggcaucuccgaccacaagcccgugagcgggaccuucgaccucgagcugaagccccugguguccgcgccccucaucguccugaugccggaggaccuguggacgguggagaacgacaugauggugagcuacuccagcaccuccgacuuccccagcucccccugggacuggaucggccucuacaaggucgggcugcgggacgugaacgacuacgugagcuacgccugggucggcgacuccaaggugagcugcuccgacaaccugaaccagguguacaucgacaucagcaacauccccaccaccgaggacgaguuccuccugugcuacuacagcaacucccugcgcagcgucguggggaucucccggccguuccagaucccgcccggcagccugcgcgaggacccccucggcgaggcccagccccagaucuga

SEQ ID NO: 31634 - RNA, 3777 nt, Artificial Sequence
  derived and/or modified sequence opt1 from INPPL1__Homo_sapiens__NP_001558
auggccagcgccugcggcgcgcccgggccgggcggggcccugggcucccaggcccccagcugguaccaccgcgaccucucccgggccgccgcggaggagcugcuggcccgcgccgggcgggacggcagcuuccucgugcgcgacuccgagagcgucgccggcgcguucgcccugugcgugcuguaccagaagcacgugcacaccuaccggauccuccccgacggggaggacuuccuggccguccagaccucccagggcgugcccgugcgccgguuccagacgcugggggagcucaucggccuguacgcccagccgaaccaggggcuggucugcgcccuccugcugcccguggagggcgagcgcgagcccgaccccccggacgaccgggacgcgagcgacggcgaggacgagaagcccccccuccccccgcgcuccgggagcaccuccaucagcgcccccaccggccccuccagcccccugccggcccccgagacccccacggcccccgccgcggaguccgccccgaacgggcugagcaccgugucccacgacuaccucaagggcagcuacggccuggaccuggaggccguccgggggggcgccucccaccucccccaccugacccgcacccuggccacgagcugccggcgccuccacagcgagguggacaaggugcuguccgggcuggagauccucagcaaggucuucgaccagcaguccagccccauggugacccggcugcugcagcagcagaaccucccccagaccggcgagcaggagcuggagucccuggugcucaagcugagcguccugaaggacuuccucuccgggauccagaagaaggcgcugaaggcccugcaggacaugagcuccaccgccccgcccgccccccagcccagcacgcgcaaggccaagaccaucccggugcaggcguucgaggugaagcucgacgucacccugggcgaccugaccaagaucggcaagucccagaaguucacgcucagcguggacguggaggggggccggcugguccugcuccgccggcagcgcgacucccaggaggacuggaccaccuucacccacgaccggauccgccagcugaucaagagccagcgcgugcagaacaagcuggggguggucuucgagaaggagaaggaccggacgcagcgcaaggacuucaucuucguguccgcccggaagcgcgaggccuucugccagcuccugcagcugaugaagaacaagcacagcaagcaggacgagcccgacaugaucuccgucuucaucggcaccuggaacauggggagcgugcccccgcccaagaacgugaccuccugguucaccagcaagggccugggcaagacgcucgacgaggucaccgugaccaucccccacgacaucuacguguucgggacccaggagaacagcgucggcgaccgggaguggcuggaccugcuccgcgggggccugaaggagcugacggaccucgacuaccggcccaucgccaugcagucccuguggaacaucaagguggcggugcuggucaagccggagcacgagaaccgcaucagccacguguccaccagcuccgugaagaccgggaucgccaacacccucggcaacaagggcgccgucggggugagcuucauguucaacggcacguccuucggguucgugaacugccaccugaccagcggcaacgagaagaccgcccggcgcaaccagaacuaccuggacauccuccggcugcugucccucggcgaccgccagcugaacgccuucgacaucagccugcgguucacccaccucuucugguucggggaccugaacuaccgccuggacauggacauccaggagauccucaacuacaucucccggaaggaguucgagccccugcugcgcgucgaccagcucaaccuggagcgggagaagcacaagguguuccugcgcuucagcgaggaggagaucuccuucccccccacguaccgguacgagcgcggcagccgcgacaccuacgcguggcacaagcagaagccgaccggggugcggaccaacguccccuccuggugcgaccgcauccucuggaagagcuaccccgagacccacaucaucugcaacuccuacggcugcacggacgacaucgugaccagcgaccacagccccguguucgggaccuucgaggucggcgugaccucccaguucaucagcaagaagggccuguccaagacgagcgaccaggccuacaucgaguucgaguccaucgaggccaucgugaagaccgccagccggaccaaguucuucaucgaguucuacuccaccugccuggaggaguacaagaagagcuucgagaacgacgcccaguccagcgacaacaucaacuuccucaagguccagugguccagccgccagcugccgacgcugaagcccauccucgcggacaucgaguaccugcaggaccagcaccugcuccugaccgugaaguccauggacggguacgagagcuacggcgagugcguggucgcccugaaguccaugaucgggagcaccgcccagcaguuccucaccuuccugucccaccggggcgaggagacggggaacauccgcggcagcaugaaggugcgggugcccaccgagcgccugggcacccgggagcgccucuacgaguggaucuccaucgacaaggacgaggccggggccaagagcaaggcgcccagcgucucccggggcagccaggagccgcgcuccgggagccggaagcccgccuucaccgaggccuccugcccccugagccgccuguucgaggagcccgagaagccgccccccacgggccggcccccggcccccccccgcgcggccccgcgggaggagccccucaccccccgccugaagcccgagggggccccggagcccgagggcguggccgccccccccccgaagaacuccuucaacaaccccgcguacuacgugcuggagggcgucccccaccagcuccugcccccggagccccccagccccgcccgggccccggugcccuccgccaccaagaacaagguggccaucaccguccccgcgccccagcuggggcaccaccgccacccgcgggugggcgaggggagcuccagcgacgaggaguccggcgggacgcuccccccccccgacuucccgccccccccccugccggacagcgccaucuuccugccccccucccucgacccgcugcccggccccgugguccgcggccgcgggggcgccgaggcccgggggcccccgccccccaaggcccacccccgcccgccccugccccccggcccgagccccgcguccaccuuccucggcgagguggccagcggggacgaccgguccugcagcgugcugcagauggccaagacccugagcgaggucgacuacgcccccgcgggccccgcccgcuccgcccuccugccggggccccuggagcuccagcccccccggggccugccgagcgacuacgggcgcccccuguccuucccccccccgcggauccgcgagagcauccaggaggaccucgccgaggaggcccccugccugcagggcggccgggcguccgggcugggcgaggccgggaugagcgccuggcuccgcgccaucggccuggagcgguacgaggaggggcuggugcacaacggcugggacgaccucgaguuccuguccgacaucaccgaggaggaccuggaggaggccggcgugcaggaccccgcgcacaagcgccuccugcuggacacgcuccagcugagcaaguga

SEQ ID NO: 31635 - RNA, 1740 nt, Artificial Sequence
  derived and/or modified sequence opt1 from INSC__Homo_sapiens__NP_001027024
augcgccggcccccgggcaacggggaggccgccagcgagggccccgggggcugggggcuguggggcgugcaggagucccgccggcucugcugcgcgggccacgaccgcugcaagcaggcccugcugcagaucgggaucaacaugauggcccuccccggcgggcggcaccuggacagcgucacccugcccggccagcgccuccaccugaugcaggucgacuccgugcagcgguggauggaggaccugaagcucaugaccgagugcgagugcaugugcgugcugcaggccaagccgaucagccuggaggaggacgcccagggggaccucauccuggcgggcggccccgggcccggcgacccccugcagcuccugcugaagcgcgggugggugaucuccacggagcuccggcgcaucggccagaagcuggcccaggaccggugggcccgcgugcacagcauguccguccggcugaccugccacgcccgcagcaugguguccgaguacagcgcggugucccggaacagccucaaggagaugggcgagaucgagaagcugcugauggagaagugcuccgagcucagcgccgucaccgagcgcugccuccagguggagaacgagcacgugcugaaguccaugaaggccugcgucagcgagacccuguccaugcuggggcagcacuucggccagcugcucgagcuggcccugacgcgggaggugcaggcccucgugcgcaagaucgacgcgagcgacaacaucuacaccaccgaguccaccacggggaaccuguucagccugacccaggagggcgccccgcucugccggaucaucgccaaggagggcggggucguggcccuguucaaggugugccgccaggacagcuuccggugccuguacccccaggcccuccgcacccuggcguccaucugcugcgucgaggagggcgugcaccagcuggagaagguggacgggguccucugccuggccgacauccugaccgacaacagccacuccgaggccacgcgcgccgaggccgcggccgugguggcccaggucaccagcccccaccuccccgugacccagcaccuguccagcuuccuggaguccauggaggagaucgucaccgcccucgugaagcugugccaggaggccagcuccggcgagguguuccugcuggcgagcgccgcccucgccaacaucacguucuucgacaccauggcgugcgagaugcugcugcagcucaacgccauccggguccugcuggaggccugcuccgacaagcagcgcguggacaccccguacacccgggaccagaucgugacgauccucgccaacaugagcguccuggagcagugcgccuccgacaucauccaggagaacggggugcagcugaucaugggcaugcucagcgagaagccccgcuccgggacccccgcggagguggccgccugcgagcggguccagcagaaggccgccgugacccuggcgcgccugagccgggaccccgacguggcccgcgaggccguccggcucuccugcaugagccgccugaucgagcugugccgguccccgagcgagcgcaacagcuccgacgccgugcucguggccugccuggcggcccugcggcgccucgccggcgucugccccgagggccugcaggacagcgacuuccagcagcuggugcagccccggcucguggacuccuuccugcugugcagcaacauggaggaguccuucgucuga

SEQ ID NO: 31636 - RNA, 333 nt, Artificial Sequence
  derived and/or modified sequence opt1 from INS__Homo_sapiens__NP_001278826
auggcccuguggaugcgccuccugccccugcucgcccugcuggcgcucuggggcccggaccccgccgccgccuucgugaaccagcaccugugcgggagccaccuggucgaggcccucuaccuggugugcggcgagcggggguucuucuacacccccaagacccgccgggaggcggaggaccugcaggucggccagguggagcucgggggcggccccggggccggcucccugcagccgcuggcccucgaggggagccugcagaagcgcggcaucguggagcagugcugcacguccaucugcagccuguaccagcucgagaacuacugcaacuga

SEQ ID NO: 31637 - RNA, 834 nt, Artificial Sequence
  derived and/or modified sequence opt1 from INSIG1__Homo_sapiens__NP_005533
augccccgccugcacgaccacuucuggagcugcuccugcgcccacagcgcccggcgccggggcccgccccgcgcguccgccgccgggcucgccgccaaggugggcgagaugaucaacgucagcguguccgggcccagccugcuggcggcccacggcgcccccgacgccgacccggcgccccgggggcgcuccgccgccaugagcggccccgagcccggcuccccguaccccaacaccuggcaccaccggcuccugcagcgcagccugguccucuucuccgucgggguggugcuggcccugguccucaaccugcugcagauccagcggaacgugacccucuuccccgaggaggugaucgccacgaucuucagcuccgcguggugggugcccccgugcugcggcaccgccgccgccgugguggggcugcuguaccccugcaucgacagccaccucggcgagccccacaaguucaagcgcgagugggccuccgucaugcggugcaucgcgguguucguggggaucaaccacgccagcgccaagcuggacuucgccaacaacguccagcugucccucacccuggccgcgcugagccucggccugugguggaccuucgaccgcucccggagcggccuggggcucggcaucacgaucgccuuccuggccacccugaucacccaguuccucguguacaacgggguguaccaguacaccagccccgacuuccuguacauccgcuccuggcugccgugcaucuucuucagcggcggcgucacgguggggaacaucggccggcagcucgccaugggggugcccgagaagccccacuccgacuga

SEQ ID NO: 31638 - RNA, 678 nt, Artificial Sequence
  derived and/or modified sequence opt1 from INSIG2__Homo_sapiens__XP_011509594
auggccgagggcgagaccgagagccccgggccgaagaagugcggccccuacaucagcagcgugaccucccagagcgucaaccugaugauccgcggggugguccucuucuucaucggcguguuccuggcccuggugcucaaccugcugcagauccagcggaacgugacccucuucccgcccgacgucaucgcguccaucuucagcuccgccuggugggugccgcccugcugcgggacggccagcgccgugaucggccugcuguaccccugcaucgaccgccaccucggcgagccccacaaguucaagcgggagugguccagcgucaugcgcugcguggccguguucgucgggaucaaccacgcguccgccaagguggacuucgacaacaacauccagcugagccugacccucgccgcccuguccaucggccugugguggaccuucgaccggagccgcuccggguucggccucggggugggcaucgcguuccuggccacggucgugacccagcugcucguguacaacggcgucuaccaguacaccagccccgacuuccuguacgugcgguccuggcugcccugcaucuucuucgccgggggcaucaccauggggaacaucggccgccagcucgccauguacgagugcaaggugaucgccgagaagucccaccaggaguga

SEQ ID NO: 31639 - RNA, 603 nt, Artificial Sequence
  derived and/or modified sequence opt1 from INS-IGF2__Homo_sapiens__NP_001035835
auggcccuguggaugcgccuccugccccugcucgcccugcuggcccucuggggcccggaccccgccgccgccuucgugaaccagcaccugugcgggagccaccuggucgaggcccucuaccuggugugcggcgagcggggguucuucuacacccccaagacccgccgggaggcggaggaccugcaggccuccgcccucagccuguccagcuccacgagcaccuggcccgagggccuggacgccaccgcgcgcgccccgcccgcccucguggucaccgccaacaucgggcaggccggcggcuccagcucccggcaguuccgccagcgggcgcuggggacgagcgacucccccgugcuguucauccacugccccggcgccgccgggaccgcccagggccucgaguaccgcgggcggcgcgugaccaccgagcuggucugggaggagguggacagcuccccgcagccccagggcagcgagucccugcccgcccagcccccggcgcagcccgcgccccagcccgagccgcagcaggcccgggagcccagccccgagguguccugcugcggccucuggccccgccggccgcagcgcagccagaacuga

SEQ ID NO: 31640 - RNA, 474 nt, Artificial Sequence
  derived and/or modified sequence opt1 from INSL3__Homo_sapiens__NP_001252516
auggacccccgccugcccgccugggcccucgugcugcugggccccgcgcucgucuucgcccuggggcccgcccccaccccggagaugcgggagaagcugugcggccaccacuucgugcgcgcccucgugcgggucugcgggggcccccgcuggagcaccgaggcccggcgccccgcgaccgggggcgaccagcgggagucccacagcgugucccaggccggccugaagcugcucagcuccagcaacccgcccacgcugaccuuccaguccguggggaucagcgacgucuccugcuacagcggcuggcgcgacgacaucugcuccauggggugguggcccaccgugaucagccggugggaccuggccugcucccccugcccccgcccgcucacgaucaccgccaccaccgugcagcugccgcccacgcugcacgcgaccgccgccagcgucgccgugcccaacaagaccugcuga

SEQ ID NO: 31641 - RNA, 420 nt, Artificial Sequence
  derived and/or modified sequence opt1 from INSL4__Homo_sapiens__NP_002186
auggccagccuguuccgcuccuaccuccccgccaucuggcugcugcucagccagcugcugcgggagucccucgcggccgagcugcgcggcugcgggccgcgguucggcaagcaccuccugagcuacugccccaugcccgagaagaccuucaccacgacccccgggggcuggcugcuggaguccgggcgcccgaaggagauggugagcaccuccaacaacaaggacggccaggcccucggcaccacgagcgaguucauccccaaccugucccccgagcugaagaagccccucagcgaggggcagccgucccugaagaagaucauccugagccggaagaagcgcuccggccggcaccgcuucgaccccuucugcugcgaggucaucugcgacgacgggaccagcgugaagcucugcaccuga

SEQ ID NO: 31642 - RNA, 642 nt, Artificial Sequence
  derived and/or modified sequence opt1 from INSL6__Homo_sapiens__NP_009110
augccccgccugcuccggcugagccugcucuggcugggccugcuccuggugcgcuucucccgggagcugagcgacaucuccagcgcccgcaagcucugcgggcgguaccuggucaaggagaucgagaagcugugcggccacgccaacuggucccaguuccgcuucgaggaggagaccccguucagccggcucaucgcgcaggccuccgagaagguggaggccuacagccccuaccaguucgagagcccccagaccgccucccccgcccgcgggcggggcacgaacccgguguccaccagcugggaggaggcggucaacuccugggagaugcagagccugcccgaguacaaggacaagaagggguacagcccccugggcaagacccgcgaguucuccuccagccacaacaucaacguguacauccacgagaacgccaaguuccagaagaagcggcgcaacaagaucaagacccucuccaaccuguucuggggccaccacccccagcggaagcgccggggguacagcgagaagugcugccugacgggcugcaccaaggaggagcucagcaucgccugccugccguacaucgacuucaagcgccugaaggagaagcgguccagccucgugaccaagaucuacuga

SEQ ID NO: 31643 - RNA, 1533 nt, Artificial Sequence
  derived and/or modified sequence opt1 from INSM1__Homo_sapiens__NP_002187
augccccgcggcuuccuggugaagcggagcaagaaguccaccccggucagcuaccgcgugcgcgggggcgaggacggggaccgggcccuccugcugucccccagcugcggcggggcccgggcggagccgcccgccccgucccccgugcccggcccccucccgcccccgccgcccgccgagcgcgcccacgccgcgcuggccgccgcccuggcgugcgcccccggcccccagcccccgccccaggggccccgggccgcccacuucggcaaccccgaggccgcgcaccccgcgccccucuacagccccacccgccccgucucccgggagcacgagaagcacaaguacuucgagcgcagcuucaaccugggguccccggugagcgccgaguccuuccccacgcccgccgcccugcucggcgggggcggcgggggcggggccagcggcgccggcgggggcgggaccugcggcggggacccccugcuguucgccccggccgagcucaagaugggcaccgccuucuccgcgggcgccgaggccgcccgggggcccggccccgggccgccccugccgcccgccgcggcccugcgcccgcccggcaagcggccgccgccgcccaccgccgccgagccgcccgcgaaggccgugaaggcccccggggccaagaagcccaaggccauccgcaagcuccacuucgaggacgaggucacgaccagccccgugcugggccugaagaucaaggagggccccguggaggcgccccgggggcgcgccggcggggccgcccggccccucggcgaguucaucugccagcugugcaaggaggaguacgccgaccccuucgcgcuggcccagcacaagugcucccgcaucguccggguggaguaccgcugccccgagugcgccaagguguucagcugccccgccaaccucgccucccaccggcgcuggcacaagccccgccccgcgcccgccgccgcccgggcgcccgagcccgaggccgccgcccgcgccgaggcgcgggaggcccccgggggcggcagcgaccgcgacaccccgucccccgggggcgucagcgagagcggguccgaggacggccuguacgagugccaccacugcgccaagaaguuccggcgccaggccuaccugcggaagcaccuccuggcccaccaccaggcgcugcaggccaagggcgcgccccucgcgccgcccgccgaggaccugcuggcccucuaccccgggcccgacgagaaggcgccccaggaggccgccggcgacggggagggcgccggggugcugggccugagcgccuccgccgagugccaccucugccccgugugcggcgagagcuucgccuccaagggggcccaggagcgccaccuccggcugcugcacgccgcccaggucuuccccugcaaguacugccccgccaccuucuacagcucccccggccugacgcgccacaucaacaagugccacccgagcgagaaccgccaggugauccugcuccaggugcccguccggcccgccugcuga

SEQ ID NO: 31644 - RNA, 1701 nt, Artificial Sequence
  derived and/or modified sequence opt1 from INSM2__Homo_sapiens__NP_115983
augccccgcggcuuccuggugaagcggaccaagcgcaccgggggccucuaccggguccgccuggccgagcggguguucccgcugcucgggccccagggcgccccgcccuuccuggaggaggcgcccagcgccucccugcccggggccgagcgcgccacgccgcccacccgggaggagcccggcaagggccucaccgccgaggcggcccgcgagcagagcgggucccccugccgggccgccggcgugagccccgggaccggcgggcgcgagggcgcggaguggcgggccggcgggcgcgagggccccgggccgucccccagccccucccccagcccggccaagcccgccggcgccgagcugcggcgcgcguuccuggagcggugccucuccagccccgucuccgccgagagcuuccccggcggggccgccgccguggcggccuucuccugcagcguggccccggccgccgcgcccacgcccggcgagcaguuccugcugccccuccgcgccccguuccccgagcccgcccugcagcccgacccggcgccccuguccgccgcccuccagagccugaagcgggccgccgggggcgagcgccgggggaaggcccccaccgacugcgcguccggcccggccgccgccggcaucaagaagcccaaggccaugcgcaagcugagcuucgcggacgaggucaccaccucccccgugcucgggcugaagaucaaggaggaggagcccggcgccccgagccgggggcugggcgggagccgcacgccccucggcgaguucaucugccagcugugcaaggagcaguacgccgaccccuucgcccuggcccagcaccgcugcucccggaucgugcgcgucgaguaccggugccccgagugcgacaagguguucagcugcccggcgaaccucgccucccaccgccgguggcacaagccccgccccgccgccgccaacgcggccaccgugagcuccgccgacggcaagcccccgagcuccagcuccagcuccagccgggacuccggggccaucgcgagcuuccuggccgagggcaaggagaacucccgcaucgagcggaccgccgaccagcacccccaggcccgcgacagcuccggggccgaccagcaccccgacagcgcgccccggcagggccugcagguccucacccacccggagccgccccugccccaggggcccuacacggagggcgugcugggccgccgggugcccguccccggguccaccagcggcgggcgcggcagcgagaucuucgugugccccuacugccacaagaaguuccggcgccaggccuaccuccggaagcaccuguccacccacgaggccggcagcgcccgcgcccuggcgccgggguucggcuccgagcgcggggcgccccucgccuucgccugcccccugugcggcgcccacuucccgaccgccgacauccgggagaagcaccgccuguggcacgccgugcgggaggagcuccugcugcccgcccucgccggggcgccgcccgagacgagcggccccuccggccccagcgacggguccgcccagcagaucuucagcugcaagcacugccccuccaccuucuucagcucccccggccugacccgccacaucaacaagugccacccgagcgagucccggcagguccugcuccugcagaugccccugcgccccgggugcuga

SEQ ID NO: 31645 - RNA, 4149 nt, Artificial Sequence
  derived and/or modified sequence opt1 from INSR__Homo_sapiens__NP_000199
auggccaccggcgggcgccggggcgccgcggccgccccccugcucguggccgucgccgcgcugcugcucggggccgccggccaccuguacccgggggaggugugccccggcauggacauccgcaacaaccugacccggcuccacgagcuggagaacugcagcgugaucgagggccaccugcagauccuccugauguucaagacgcgccccgaggacuuccgggaccuguccuuccccaagcucaucaugaucaccgacuaccugcugcucuuccgcgucuacgggcuggagagccugaaggaccucuucccgaaccugaccgugauccggggcucccgccuguucuucaacuacgcccucgugaucuucgagaugguccaccugaaggagcuggggcucuacaaccugaugaacaucacccggggcagcgugcgcaucgagaagaacaacgagcugugcuaccucgcgacgaucgacuggucccggauccuggacagcguggaggacaacuacaucguccugaacaaggacgacaacgaggagugcggggacaucugccccggcaccgccaagggcaagaccaacugccccgccaccgugaucaacgggcaguucguggagcgcugcuggacgcacucccacugccagaaggucugccccaccaucugcaagagccacggcugcaccgccgaggggcucugcugccacuccgagugccugggcaacugcagccagccggacgaccccaccaagugcguggccugccggaacuucuaccuggacggccgcugcguggagacgugcccccccccguacuaccacuuccaggacuggcggugcgucaacuucuccuucugccaggaccuccaccacaagugcaagaacagccgccggcaggggugccaccaguacgugauccacaacaacaagugcauccccgagugccccuccggcuacaccaugaacagcuccaaccugcugugcacccccugccucgggccgugccccaaggugugccaccugcuggagggcgagaagaccaucgacagcgucacguccgcgcaggagcuccgcgggugcaccgugaucaacggcagccugaucaucaacauccggggcgggaacaaccuggccgccgagcucgaggccaaccugggccugaucgaggagaucuccggguaccucaagauccgccggagcuacgcccuggugagccuguccuucuuccgcaagcuccgccugauccggggcgagacccuggagaucgggaacuacagcuucuacgcgcuggacaaccagaaccuccgccagcugugggacugguccaagcacaaccugaccaucacgcagggcaagcucuucuuccacuacaaccccaagcugugccugagcgagauccacaagauggaggaggucuccggcaccaaggggcggcaggagcgcaacgacaucgcccucaagaccaacggcgaccaggccagcugcgagaacgagcugcugaaguucuccuacauccggaccagcuucgacaagauccuccugcgcugggagcccuacuggccgcccgacuuccgggaccugcucggguucaugcuguucuacaaggaggcccccuaccagaacgugacggaguucgacggccaggacgccugcggguccaacagcuggaccguggucgacaucgaccccccgcugcgcuccaacgaccccaagagccagaaccaccccggcuggcucaugcggggccugaagcccuggacccaguacgcgaucuucgugaagacccuggucacguucuccgacgagcgccggaccuacggggccaagagcgacaucaucuacgugcagaccgacgccaccaacccguccgugccccucgaccccaucagcgucuccaacagcuccagccagaucauccugaaguggaagccgcccagcgaccccaacggcaacaucacgcacuaccugguguucugggagcgccaggccgaggacuccgagcucuucgagcuggacuacugccugaaggggcucaagcugcccagccggaccugguccccgcccuucgagagcgaggacucccagaagcacaaccagagcgaguacgaggacuccgccggcgagugcugcagcugccccaagaccgacucccagauccugaaggagcucgaggagagcuccuuccgcaagaccuucgaggacuaccugcacaacguggucuucgugccccggaagacgagcuccggcaccggggcggaggacccgcgccccagccggaagcgccggucccugggcgacguggggaacgucaccguggccgugcccaccgucgccgccuuccccaacaccagcuccacgagcgugccgaccagccccgaggagcaccgccccuucgagaagguggucaacaaggagucccucgugaucagcggccugcgccacuucaccggguaccggaucgagcugcaggcgugcaaccaggacacccccgaggagcgcugcuccguggccgccuacgucagcgcccggacgaugccggaggccaaggcggacgacaucgugggccccgugacccacgagaucuucgagaacaacgucgugcaccucauguggcaggagcccaaggagcccaacggccugaucgugcuguacgaggucuccuaccgccgguacggggacgaggagcuccaccugugcgugagccgcaagcacuucgcccuggagcggggcugccgccuccgggggcuguccccgggcaacuacagcgugcgcauccgggccaccucccuggccgggaacggcagcuggaccgagcccacguacuucuacgucaccgacuaccucgacgugcccuccaacaucgccaagaucaucaucggcccccugaucuucguguuccuguucagcgucgugaucggguccaucuaccucuuccugcgcaagcggcagccggacggcccccuggggccccucuacgcgagcuccaacccggaguaccugagcgccuccgacguguuccccugcagcgucuacgugcccgacgagugggaggugucccgcgagaagaucacccugcuccgggagcugggccaggggagcuucggcauggucuacgagggcaacgcccgcgacaucaucaagggggaggccgagacccggguggccgugaagacggucaacgagagcgcgucccugcgcgagcggaucgaguuccucaacgaggccagcgugaugaagggcuucaccugccaccacgugguccgccugcugggggugguguccaagggccagcccacccucgucgugauggagcugauggcccacggggaccugaagagcuaccuccggucccugcgcccggaggccgagaacaaccccggccgcccccccccgacccugcaggagaugauccagauggcggccgagaucgccgacggcauggccuaccucaacgccaagaaguucgugcaccgggaccuggcggcccgcaacugcauggucgcccacgacuucacggugaagaucggggacuucggcaugacccgggacaucuacgagaccgacuacuaccgcaaggggggcaagggccugcuccccgugcgguggauggcccccgagagccugaaggacggggucuucaccacguccagcgacaugugguccuucggcgugguccugugggagaucaccagccucgccgagcagcccuaccaggggcuguccaacgagcaggugcugaaguucgugauggacggcggguaccucgaccagccggacaacugccccgagcgcgucaccgaccugaugcggaugugcuggcaguucaaccccaagaugcgccccaccuuccuggagaucgugaaccuccugaaggacgaccugcacccgagcuuccccgagguguccuucuuccacagcgaggagaacaaggcgcccgaguccgaggagcucgagauggaguucgaggacauggagaacgucccccuggaccggagcucccacugccagcgcgaggaggccggcggccgggacgggggcagcucccugggguucaagcgcagcuacgaggagcacaucccguacacgcacaugaacggcgggaagaagaacggccggauccucacccugccccgcagcaaccccuccuga

SEQ ID NO: 31646 - RNA, 3894 nt, Artificial Sequence
  derived and/or modified sequence opt1 from INSRR__Homo_sapiens__NP_055030
auggccgugcccagccuguggccguggggcgccugccuccccgucaucuuccugucccugggguucggccucgacaccguggaggugugccccagccuggacauccgcuccgaggucgcggagcugcggcagcucgagaacugcagcgugguggaggggcaccuccagauccugcucauguucaccgccacgggcgaggacuuccgcgggcuguccuucccccggcugacccaggucaccgacuaccuccugcuguuccgcguguacggccucgagagccugcgggaccuguucccgaaccucgccgugauccgcggcacccggcuguuccugggguacgcccucgucaucuucgagaugccccaccuccgggacguggcccugcccgcgcugggcgccgugcugcgcggggccguccggguggagaagaaccaggagcugugccaccucuccacgaucgacuggggccugcugcagcccgccccgggggcgaaccacaucgugggcaacaagcucggcgaggagugcgccgacgucugccccggggugcugggcgccgccggggagcccugcgccaagaccaccuucagcggccacaccgacuaccggugcuggacguccagccacugccagcgcgugugccccugcccgcacggcauggcgugcaccgcccgcggggagugcugccacaccgagugccugggcgggugcucccagcccgaggacccccgggccugcgucgccugccggcaccucuacuuccagggcgccugccugugggcgugcccgcccgggaccuaccaguacgagagcuggcgcugcgugacggccgagcggugcgccucccugcacagcgugcccggccgcgccuccaccuucggcauccaccaggggagcugccucgcccagugccccuccggcuucacccggaacagcuccagcaucuucugccacaagugcgaggggcugugccccaaggagugcaaggucggcaccaagacgaucgacagcauccaggcggcccaggaccugguggggugcacccacguggagggcucccucauccugaaccugcgccagggcuacaaccucgagccgcagcugcagcacagccuggggcucgucgagaccaucaccggcuuccugaagaucaagcacuccuucgcccuggugagccucggguucuucaagaaccugaagcugauccggggcgacgccauggucgacgggaacuacacgcuguacgugcucgacaaccagaaccugcagcagcugggcuccuggguggccgcgggccucaccauccccgucgggaagaucuacuucgccuucaacccccgccugugccuggagcacaucuaccgccuggaggaggugaccggcacccgcgggcgccagaacaaggccgagaucaacccccggacgaacggcgaccgcgccgcgugccagacccggacccugcgcuucgugagcaacgucaccgaggccgaccggauccugcuccgcugggagcgguacgagccgcuggaggcccgcgaccugcucuccuucaucguguacuacaaggagagccccuuccagaacgccacggagcacgugggccccgacgccugcgggacccaguccuggaaccugcuggacgucgagcucccccugagccggacccaggagccgggcgugacccuggcgucccucaagcccuggacgcaguacgccguguucguccgcgccaucacccugaccaccgaggaggacagcccccaccagggggcccaguccccgaucguguaccugcggacgcuccccgccgcgcccaccgugccccaggacgucaucagcaccuccaacagcuccagccaccuccuggugcgcuggaagccgcccacccagcggaacggcaaccugaccuacuaccuggugcuguggcagcgccucgccgaggacggggaccuguaccugaacgacuacugccaccggggccuccgccugcccacguccaacaacgacccccgguucgacggcgaggacggggacccggaggccgagauggagagcgacugcugccccugccagcacccgccgcccggccagguccugccgccccucgaggcccaggaggccagcuuccagaagaaguucgagaacuuccugcacaacgcgaucaccauccccaucucccccuggaaggugaccagcaucaacaagagcccccagcgcgacuccgggcgccaccggcgcgccgccggcccccugcggcucgggggcaacuccagcgacuucgagauccaggaggacaaggugccccgcgagcgggccguccuguccggccugcgccacuucaccgaguaccggaucgacauccacgcgugcaaccacgccgcccacacgguggggugcagcgccgccaccuucguguucgcgcgcaccaugccccaccgggaggccgacggcauccccgggaaggucgccugggaggccuccagcaagaacuccgugcuccugcgcuggcuggagccgcccgaccccaacggccucauccugaaguacgagaucaaguaccggcgccugggggaggaggccaccgugcucugcgucagccggcugcgcuacgcgaaguucggcggcgugcaccuggcccuccugccgcccgggaacuacuccgcccgggugcgcgccacgagccuggccggcaacggguccuggaccgacagcgucgcguucuacauccucggccccgaggaggaggacgccgggggccugcacgugcugcucaccgccacccccgugggccugacgcugcucaucguccuggccgcgcugggguucuucuacggcaagaagcggaaccgcacccucuacgccuccgugaaccccgaguacuucagcgccagcgacauguacgugcccgacgagugggaggucccgcgggagcagaucuccaucauccgcgagcuggggcagggcagcuucggcaugguguacgaggggcuggcccggggccucgaggccggggaggaguccacccccguggcgcugaagaccgucaacgagcuggccagcccccgcgagugcaucgaguuccucaaggaggccuccgugaugaaggccuucaagugccaccacgugguccgccugcugggcguggugagccaggggcagcccacgcucgucaucauggagcugaugacccggggcgaccugaagucccaccuccgcagccugcggccggaggccgagaacaaccccggccugccccagcccgcgcucggggagaugauccagauggccggcgagaucgccgacgggauggccuaccuggccgcgaacaaguucgugcaccgcgaccuggccgcccggaacugcauggugucccaggacuucaccgucaagaucggcgacuucgggaugacccgcgacguguacgagacggacuacuaccggaagggcggcaaggggcuccugccggugcgcuggauggcccccgagagccugaaggacggcaucuucaccacccacuccgacgucuggagcuucggggugguccucugggagaucgugacccuggccgagcagcccuaccagggccuguccaacgagcagguccucaaguucgugauggacgggggcgugcuggaggagcuggagggcugcccccuccagcugcaggagcugaugagccggugcuggcagccgaacccccgccuccggcccuccuucacgcacauccuggacagcauccaggaggagcugcgccccuccuuccggcuccugagcuucuacuacuccccggagugccgcggggcgcggggcagccugcccaccaccgacgccgagcccgacagcucccccaccccgcgcgacugcagcccccagaacgggggccccggccacuga

SEQ ID NO: 31647 - RNA, 1389 nt, Artificial Sequence
  derived and/or modified sequence opt1 from INTS12__Homo_sapiens__NP_001135943
auggccgccaccgugaaccuggagcucgaccccaucuuccugaaggcgcugggcuuccuccacagcaaguccaaggacagcgccgagaagcugaaggcccugcucgacgagucccuggcccgcgggaucgacagcuccuaccggccgagccagaaggacgucgagccgcccaagaucuccagcaccaagaacaucuccaucaagcaggagcccaagaucagcuccagccugcccuccggcaacaacaacgggaaggugcucacgaccgagaaggugaagaaggaggccgagaagcgccccgcggacaagaugaaguccgacaucaccgagggcgucgacauccccaagaagccccggcuggagaagccggagacccagagcagccccaucacggugcaguccagcaaggaccugcccauggccgaccucuccagcuucgaggagaccagcgccgacgacuucgccauggagauggggcuggcgugcguggucugccgccagaugaugguggccuccggcaaccagcugguggagugccaggagugccacaaccucuaccaccgggacugccacaagccccaggucaccgacaaggaggccaacgacccgcgccuggugugguacugcgcccggugcacccgccagaugaagcggauggcccagaagacgcagaagccgccccagaagcccgcgcccgccguggucagcgugacccccgccgugaaggacccccuggucaagaagcccgagaccaagcucaagcaggagaccacguuccuggccuucaagcgcaccgaggugaagaccuccaccgugaucagcggcaacuccagcuccgccagcgucuccagcuccgugacgagcgggcugaccggcugggcggccuucgccgccaagaccuccagcgccgggccguccaccgcgaagcucagcuccacgacccagaacaacaccggcaagcccgccaccagcuccgccaaccagaagcccguggggcugacgggccuggccaccagcagcaagggcgggaucggcuccaagaucgggagcaacaacuccaccacccccacggucccgcucaagcccccgccgccccugacccugggcaagaccggccucagccgguccgugagcugcgacaacguguccaaggucgggcugcccagccccuccagccuggugcccggcuccagcucccagcucagcgggaacggcaacuccgggaccagcggccccuccggcagcacgaccagcaagaccaccuccgagagcuccagcucccccagcgccucccugaaggggcccacgagccaggagucccagcugaacgcgaugaagcgccuccagauggucaagaagaaggccgcccagaagaagcugaagaaguga

SEQ ID NO: 31648 - RNA, 6573 nt, Artificial Sequence
  derived and/or modified sequence opt1 from INTS1__Homo_sapiens__NP_001073922
augaaccgggccaagcccaccaccgugcggcgccccuccgccgcggccaagcccuccggccacccgccgcccggggacuucaucgcccugggcagcaaggggcaggccaacgaguccaagaccgccagcacccuccugaagcccgcgcccuccggccugcccagcgagcggaagcgcgacgccgccgccgcgcucuccagcgccuccgcccugaccgggcugaccaagcggcccaagcucagcuccaccccgccccugagcgcccugggccgccucgccgaggcggccgucgccgagaagcgggccaucucccccagcaucaaggagcccuccguggugcccaucgagguccugcccaccgugcugcucgacgagaucgaggccgcggagcuggagggcaacgacgaccgcaucgagggggugcugugcggcgccgucaagcagcucaaggugacccgggccaagcccgacagcacccuguaccugucccucauguaccuggccaagaucaagccgaacaucuucgccaccgagggggugaucgaggcgcugugcagccuccugcgccgggacgccuccaucaacuucaaggccaagggcaacagccuggucagcgugcucgccugcaaccugcugauggccgcguacgaggaggacgagaacuggcccgagaucuucgugaaggucuacaucgaggacucccucggggagcgcaucuggguggacagcccccacugcaagaccuucguggacaacauccagaccgccuucaacacccggaugccgccccgcuccguccugcugcagggcgaggccggccggguggccggggaccucggcgcggggagcagcccccaccccagccugacggaggaggaggacucccagaccgagcugcucaucgccgaggagaagcugagccccgagcaggagggccagcugaugccccgcuacgaggagcucgccgaguccguggaggaguacguccuggacaugcugcgggaccagcucaaccgccggcagcccaucgacaacgugagccgcaaccugcugcggcuccugaccagcacgugcggcuacaaggaggugcgccugcucgccguccagaagcuggagauguggcugcagaaccccaagcucacccgccccgcccaggaccugcugaugagcgugugcaugaacugcaacacccacggguccgaggacauggacgugaucagccaccugaucaagauccggcucaagcccaagguccugcugaaccacuucaugcucugcauccgcgagcugcuguccgcgcacaaggacaaccucggcaccaccaucaagcuggugaucuucaacgagcugagcuccgcccggaaccccaacaacaugcagguccucuacacggcccugcagcacagcuccgagcuggcccccaaguuccucgccaugguguuccaggaccugcugaccaacaaggacgacuaccuccgcgcgagccgggcccugcugcgcgagaucaucaagcagaccaagcacgagaucaacuuccaggccuucugccucgggcugaugcaggagcggaaggagccgcaguaccuggagauggaguucaaggagcgcuucgugguccacaucaccgacgugcucgccgugagcaugaugcugggcaucacggcccaggucaaggaggcggggaucgccugggacaagggcgagaagcggaaccuggaggugcuccgcuccuuccagaaccagaucgccgccauccagcgggacgcggugugguggcugcacaccgucgugcccagcaucuccaagcuggcccccaaggacuacgugcacugccuccacaagguccuguucaccgagcagcccgagaccuacuacaagugggacaacuggccgcccgagagcgaccgcaacuucuuccugcggcucugcuccgaggugcccauccuggaggacacgcugaugcgcauccucgugaucggccugagccgggagcugccccucgggccggccgacgccauggagcuggccgaccaccuggucaagcgcgcggccgccgugcaggccgacgacguggagguccucaaggugggccggacccagcugaucgacgccgugcugaaccucugcaccuaccaccaccccgagaacauccagcugccgcccggguaccagccgcccaaccuggcgaucuccacccucuacuggaaggccuggccccugcugcucgucguggccgccuucaaccccgagaacaucggccuggccgcgugggaggaguacccgacgcugaagaugcucauggagauggugaugaccaacaacuacagcuacccgcccugcacccugaccgacgaggagacgcgcaccgagaugcugaaccgggagcuccagaccgcccagcgcgagaagcaggagauccuggccuucgaggggcaccuggccgcggccuccaccaagcagaccaucacggagagcuccagccuccugcugucccagcucaccagccuggacccccagggcccgccccgccggcccccgccccacauccuggaccaggucaagucccucaaccagagccugcgccugggccaccuccugugccggucccgcaaccccgacuuccugcuccacaucauccagcggcaggccagcagccaguccaugcccuggcuggccgaccuggugcagagcuccgaggggagccucgacgugcugcccguccagugccugugcgaguuccuccugcacgacgccguggacgacgcggccuccggcgaggaggacgacgagggggagagcaaggagcagaaggccaagaagcgccagcggcagcagaagcagcgccagcugcucggccggcugcaggaccugcuccuggggcccaaggccgacgagcagacgaccugcgaggugcuggacuacuuccuccgccggcugggcuccagccaggucgccucccgcgugcuggcgaugaagggccucagccuggugcuguccgaggggagccuccgggacggcgaggagaaggagccgcccauggaggaggacgucggggacacggacgugcugcagggcuaccaguggcugcuccgcgaccugccgcggcugccccuguucgacuccgugcgcagcaccaccgcccucgcccugcagcaggccauccacauggagaccgacccccagacgaucuccgccuaccugaucuaccucagccagcacacccccgucgaggagcaggcgcagcacuccgaccuggcccuggacguggcccggcucguggucgagcgcagcaccaucaugucccaccuguucagcaagcugagcccguccgccgccagcgacgcggugcucuccgcccugcugagcaucuucucccgguacgugcgccggaugcgccagagcaaggagggcgaggaggucuacuccuggagcgagucccaggaccagguguuccuccgcuggagcuccggggagaccgccacgaugcacauccuggugguccacgccauggugauccugcucacccuggggccgccccgggcggacgacagcgaguuccaggcccugcucgacaucugguuccccgaggagaagccgcugcccaccgccuuccugguggacaccuccgaggaggcccuccugcugcccgacuggcucaagcugcgcaugauccggagcgagguccugcgccucguggacgccgcgcugcaggaccuggagccccagcagcuccugcuguucgugcaguccuucgggaucccggucagcuccaugagcaagcuccugcaguuccuggaccaggccguggcccacgacccccagacgcucgagcagaacaucauggacaagaacuacauggcccaccuggucgaggugcagcacgagcggggcgccuccgggggccagaccuuccacagccugcucaccgcgagccugccgccccgccgggacuccaccgaggccccgaagcccaagagcucccccgagcagcccaucggccaggggcgcauccgggugggcacgcagcugcgcguccucgggccggaggacgaccuggccggcauguuccugcagaucuucccccucagccccgacccccgguggcaguccagcuccccgcgccccguggcccuggcccugcagcaggcgcucgggcaggagcuggcccgggugguccagggcagccccgaggugccgggcaucaccgugcgcguccugcaggcccucgccacccugcuguccagcccccacgggggcgcgcucgugauguccaugcaccggagccacuuccuggccugcccccugcuccgccagcugugccaguaccagcggugcgugccccaggacaccggguucuccagccuguuccucaagguccugcugcagaugcuccaguggcuggacuccccgggcguggagggcgggccccugcgcgcccagcuccggaugcuggccagccaggccuccgcgggccgccgccugagcgacgugcgcgggggccuccugcgccuggccgaggcccucgccuuccggcaggaccuggaggucguguccagcacggugcgcgccgucaucgcgacccugcggagcggggagcagugcuccguggagcccgaccucaucagcaaggugcugcagggccugaucgagguccgcagcccccaccucgaggagcugcugaccgccuucuucagcgccaccgccgacgccgcguccccguuccccgccugcaagcccgugguggucgugagcucccuccugcugcaggaggaggagccccucgccgggggcaagccgggcgccgacgggggcagccuggaggcggugcggcuggggcccuccagcggccuccuggucgacuggcuggagaugcucgaccccgaggugguguccagcugccccgaccugcagcugcgccuccuguucucccggcgcaagggcaaggggcaggcccaggucccgagcuuccggcccuaccugcucacgcuguucacccaccaguccagcuggcccacccugcaccagugcauccgcgugcuccugggcaagucccgggagcagcgcuucgaccccagcgccucccuggacuuccugugggccugcauccacgugccgcggaucuggcaggggcgcgaccagcggacgccccagaagcgccgggaggagcucguccugcgcgugcagggccccgagcugaucagccucguggagcugauccuggccgaggcggagacgcggagccaggacggggacaccgccgccugcucccucauccaggcccgccugccccugcuccugagcugcugcugcggcgacgacgaguccguccgcaaggugaccgagcaccugagcggcugcauccagcaguggggcgacuccgugcucggccggcgcugccgggaccugcugcuccagcuguaccugcagcgcccggagcuccggguccccgugcccgaggugcugcugcacagcgagggggccgcguccagcuccgucugcaagcucgacggccugauccaccgcuucaucacccugcucgccgacacgagcgacucccgggcccuggagaaccgcggggccgacgccagcauggcgugccggaagcuggccguggcccacccccuccugcugcuccgccaccuccccaugaucgccgcccugcugcacggccggacccaccugaacuuccaggaguuccgccagcagaaccaccuguccugcuuccuccacgugcugggccugcucgagcugcugcagccccacgucuuccggagcgagcaccagggggcgcucugggacugccugcuguccuucauccgccuccugcugaacuaccggaaguccucccgccaccucgccgccuucaucaacaaguucgugcaguucauccacaaguacaucaccuacaacgcccccgcggccaucagcuuccugcagaagcacgccgacccgcugcacgaccucuccuucgacaacagcgaccuggugaugcugaagucccuccuggccggccugucccuccccagccgggacgaccgcaccgaccgggggcuggacgaggagggcgaggaggaguccagcgccgggucccugccccucgucagcgugucccuguucacgccccugacggcggccgagauggccccguacaugaagcgccucagccgcggccagaccguggaggaccugcuggagguccucuccgacaucgacgagaugagccggcgccggcccgagauccuguccuucuucagcaccaaccugcagcgccucauguccagcgccgaggagugcugccggaaccuggccuucucccuggcgcuccgcagcaugcagaacucccccagcaucgccgccgccuuccugcccaccuucauguacugccugggcagccaggacuucgaggugguccagacggcccuccggaaccugccggaguacgcgcugcucugccaggagcacgccgccgugcugcugcaccgcgccuuccucguggggauguacggccagauggaccccuccgcgcagaucagcgaggcccugcggauccugcacauggaggccgucauguga

SEQ ID NO: 31649 - RNA, 3615 nt, Artificial Sequence
  derived and/or modified sequence opt1 from INTS2__Homo_sapiens__NP_065799
augaaggaccagcagaccgugaucaugaccgagugcacgagccugcaguucgucucccccuucgccuucgaggccaugcagaagguggacguggucugccucgcgagccuguccgacccggagcugcgccuccugcugcccugccucgugcggauggcccugugcgcccccgccgaccagagccaguccugggcccaggacaagaagcugauccuccgccugcugagcggcguggaggcggucaacuccaucguggcccuccugagcguggacuuccacgcccuggagcaggacgccuccaaggagcagcagcuccggcacaagcucgggggcgggagcggcgaguccauccuggucagccagcugcagcacgggcugacccuggaguucgagcacuccgacagcccccgccggcuccgccuggugcuguccgagcuccuggcgaucaugaacaaggugagcgaguccaacggcgaguucuucuucaagagcuccgagcuguucgagagcccggucuaccucgaggaggccgccgacgugcugugcauccugcaggccgagcuccccagccugcugcccaucguggacgucgccgaggcgcuccugcacgugcggaacggcgccugguuccugugccuccugguggccaacguccccgacuccuucaacgaggugugccgcgggcugaucaagaacggcgagcggcaggacgaggagagccucgggggccgccggcgcaccgacgcccugcgguuccugugcaagaugaacccgucccaggcccucaaggugcgcgggauggucguggaggagugccaccuccccggccugggcguggcgcugacccuggaccacacgaagaacgaggccugcgaggacggggucagcgaccuggugugcuucgucuccggccuccugcuggggaccaacgccaaggugcggaccugguucggcaccuucauccgcaacggccagcagcggaagcgcgagacgagcuccagcgugcuguggcagaugcggcgccagcuccugcuggagcucauggggauccugcccaccguccgguccacccgcaucguggaggaggccgacguggacauggagcccaacgucagcguguacuccggccugaaggaggagcacguggucaaggccagcgcgcuccugcgccuguacugcgcccucauggggaucgccggccugaagccgaccgaggaggaggccgagcagcugcuccagcugaugacgucccggccgcccgccacccccgcgggggugcgcuucgugagccuguccuucugcaugcuccuggccuucagcacccuggucuccacccccgagcaggagcagcucauggugguguggcugagcuggaugaucaaggaggaggccuacuucgaguccacgagcggcgucagcgccuccuucggcgagaugcugcuccugguggcgauguacuuccacagcaaccagcuguccgccaucaucgaccucgugugcagcacccuggggaugaagaucgucaucaagcccuccagccugucccggaugaagaccaucuucacccaggagaucuucacggagcaggucgugaccgcccacgccgugcgcgugcccgugaccagcaaccucuccgccaacaucaccggcuuccugcccauccacugcaucuaccagcugcuccggagccgcuccuucacgaagcacaaggucagcaucaaggacuggaucuaccggcagcugugcgagaccuccaccccgcugcacccccagcuccugccccugaucgacguguacaucaacagcauccucacccccgcguccaagagcaacccggaggccacgaaccagcccgugaccgagcaggagauccugaacaucuuccagggggucaucggcggggacaacauccgccugaaccagcgguucuccaucaccgcccagcuccuggugcuguacuacauccucagcuacgaggaggcccugcuggccaacaccaagacgcucgcggccaugcagcgcaagcccaagagcuacuccagcucccugauggaccagauccccaucaaguuccugauccggcaggcccagggccuccagcaggagcugggcgggcugcacagcgcccuccugcgccugcucgccaccaacuacccgcaccugugcaucguggacgacuggaucugcgaggaggagaucaccggcaccgacgcgcugcuccggcgcaugcugcugacgaacaacgccaagaaccacucccccaagcagcuccaggaggccuucagcgccguccccgugaaccacacccaggugaugcagaucaucgagcaccugacccugcucuccgcgagcgagcugaucccguacgccgagguccugaccuccaacaugagccagcuccugaacuccggggugccccggcgcauccugcagaccgugaacaagcucuggaugguccugaacacggugaugccccggcgccugugggugaugaccgucaacgcccuccagcccagcaucaaguucgugcggcagcagaaguacacccagaacgaccugaugaucgacccgcugaucgugcuccgcugcgaccagcgcguccaccggugcccgccccugauggacaucacccugcacaugcucaacggcuaccugcuggccuccaaggccuaccucagcgcgcaccugaaggagacggagcaggaccgccccucccagaacaacaccaucgggcuggugggccagaccgacgcccccgaggugacccgggaggagcucaagaacgcccugcuggccgcccaggacagcgcggccguccagauccuccuggagaucugccugcccacggaggaggagaaggccaacggcgugaaccccgacucccuccugcgcaacgugcagagcgucaucaccaccuccgcccccaacaaggggauggaggagggcgaggacaaccugcucugcaaccugcgggaggugcagugccugaucugcugccugcuccaccagauguacaucgccgacccgaacaucgcgaagcuggugcacuuccagggguaccccugcgagcugcucccccugaccgucgccggcauccccagcaugcacaucugccuggacuucaucccggagcucaucgcccagcccgagcuggagaagcagaucuucgccauccagcugcucagccaccugugcauccaguacgcgcugcccaagucccucagcguggcccgccuggccgucaacgugaugggcacgcugcucaccgugcugacccaggccaagcgguacgccuucuucaugcccacccugccgucccucgucagcuucugccgcgcguucccgccccuguacgaggacaucaugucccugcucauccagaucggccaggugugcgccagcgacguggccacgcagacccgggacaucgaccccaucaucacccgccugcagcagaucaaggagaagcccuccggguggagccagaucugcaaggacuccagcuacaagaacgggucccgggacaccggcagcauggaccccgacguccagcugugccacugcaucgagcgcacggugaucgagaucaucaacauguccgugagcgggaucuga

SEQ ID NO: 31650 - RNA, 3129 nt, Artificial Sequence
  derived and/or modified sequence opt1 from INTS3__Homo_sapiens__NP_075391
auggagcugcagaagggcaagggggccgccgcggccgccgccgccagcggcgcggccgggggcgggggcggcggggccggcgccggggcgcccggcgggggccgccuccugcuguccaccagccucgacgccaaggacgagcuggaggagcggcuggagcgcugcauguccaucgugaccagcaugacggccggcgucuccgagcgggaggccaacgacgcccucaacgcguacgugugcaaggggcugccgcagcacgaggagaucugccugggccucuucacccugauccugaccgagcccgcccaggcccagaagugcuaccgcgaccucgcccuggugagccgggacgggaugaacaucguccugaacaagaucaaccagauccucauggagaaguaccugaagcugcaggacacgugccgcacccagcucguguggcuggugcgggagcuggucaaguccggcgugcucggcgccgacggggugugcaugaccuucaugaagcagaucgcgggcggggacgucaccgccaagaacaucuggcuggccgagagcgugcuggacauccucaccgagcagcgcgagugggugcugaaguccagcauccugaucgccauggccgucuacacguaccuccggcugaucguggaccaccacggcaccgcgcagcugcaggcccuccgccagaaggagguggacuucugcaucucccugcugcgggagcgcuucauggagugccucaugaucgggcgggaccugguccgccugcuccagaacguggcccggauccccgaguucgagcugcuguggaaggacaucauccacaacccccaggcccucagcccgcaguucaccggcauccugcagcugcuccagucccgcaccagccggaaguuccuggccugccgccugacgcccgacauggagaccaagcuccuguucaugaccucccgggugcgcuucggccagcagaagcgguaccaggacugguuccagcgccaguaccugagcacccccgacucccagagccuccgcugcgaccugauccgguacaucugcggggucgugcaccccuccaacgaggugcugagcagcgacauccugccgcgcugggcgaucaucggcuggcuccugacgaccugcaccuccaacgucgccgccagcaacgccaagcuggcccucuucuacgacuggcuguucuucucccccgacaaggacagcaucaugaacaucgagcccgcgauccuggugaugcaccacuccaugaagccccacccggccaucaccgccacgcuccuggacuucaugugccggaucauccccaacuucuacccgccccuggaggggcacgugcgccagggcgucuucagcucccucaaccacaucguggagaagcggguccuggcccaccuggcgccccucuucgacaaccccaagcuggacaaggagcugcgcgccaugcuccgggagaaguuccccgaguucugcagcucccccagcccgcccguggaggugaagaucgaggagcccgucuccauggagauggacaaccacaugagcgacaaggacgaguccugcuacgacaacgccgaggccgccuucagcgacgacgaggaggaccugaacuccaaggggaagaagcgcgaguuccgguuccaccccaucaaggagaccgugguggaggagccggucgacaucacccccuaccuggaccagcucgacgagagccugcgcgacaaggugcugcagcuccagaagggcuccgacaccgaggcgcagugcgaggugaugcaggagaucgucgaccaggugcuggaggaggacuucgacagcgagcagcuguccgugcucgccagcugccugcaggagcuguucaaggcccacuuccggggcgagguccuccccgaggagaucacggaggagagccuggaggaguccguggggaagccccuguaccucaucuuccgcaaccugugccagaugcaggaggacaacagcuccuucagccugcuccuggaccugcucuccgagcuguaccagaagcagccgaagaucggcuaccaccuccucuacuaccugcgggccagcaaggccgcggccgggaagaugaaccuguacgaguccuucgcccaggccacccagcucggcgaccugcacacgugccugaugauggacaugaaggcgugccaggaggacgacgugcgccuccugugccaccugacccccagcaucuacaccgaguuccccgacgagacccuccgguccggggagcugcugaacaugaucgucgccgugaucgacagcgcccagcuccaggagcuggugugccacgucaugaugggcaaccuggugauguuccgcaaggacuccgugcucaacauccugauccagagccuggacugggagaccuucgagcaguacugcgccuggcagcuguuccuggcccacaacaucccgcuggagaccaucauccccauccuccagcaccugaaguacaaggagcaccccgaggcgcuguccugccuccugcugcagcuccggcgcgagaagcccagcgaggagauggucaagauggugcugucccggccgugccaccccgacgaccaguucacgaccagcauccugcgccacuggugcaugaagcacgacgagcuccuggccgagcacaucaagucccugcucaucaagaacaacagccugccccgcaagcggcagagccugcgcuccagcuccagcaagcucgcccagcugacccuggagcagauccucgagcaccuggacaaccugcggcucaaccugaccaacacgaagcagaacuucuucucccagacccccauccugcaggcccuccagcacgugcaggccagcugcgacgaggcgcacaagaugaaguucuccgaccuguucagccuggccgaggaguacgaggacuccagcaccaagccgcccaagucccgccggaaggccgcccucagcagcccccgcucccggaagaacgccacccagcccccgaacgcggaggaggaguccggcagcuccagcgccuccgaggaggaggacaccaagcccaagcccacgaagcgcaagcggaaggggagcagcgccgucggcuccgacagcgacuga

SEQ ID NO: 31651 - RNA, 2892 nt, Artificial Sequence
  derived and/or modified sequence opt1 from INTS4__Homo_sapiens__NP_291025
auggccgcccaccugaagaagcgcguguacgaggaguucaccaaggucgugcagccccaggaggagaucgcgaccaagaagcuccggcugacgaagccgagcaaguccgccgcccugcacaucgaccucugcaaggccaccagccccgccgacgcgcugcaguaccugcuccaguucgcccgcaagcccguggaggccgaguccgucgagggcguggugcggauccugcuggagcacuacuacaaggagaacgaccccagcguccgccucaagaucgccucccugcuggggcuccugagcaagaccgcgggcuucuccccggacugcaucauggacgacgccaucaacauccugcagaacgagaagucccaccaggugcucgcccagcugcuggacacccuccuggccaucgggacgaagcugcccgagaaccaggccauccagaugcggcucguggacgucgcgugcaagcaccugaccgacaccagccacggcgugcgcaacaagugccugcagcuccuggggaaccugggcagccucgagaaguccgugaccaaggacgccgagggccuggccgcccgggacguccagaagaucaucggggacuacuucagcgaccaggacccccgcgugcggacggccgcgaucaaggccaugcugcagcuccacgagcgcggccugaagcugcaccagaccaucuacaaccaggccugcaagcuccuguccgacgacuacgagcagguccggagcgccgccgugcagcugaucuggguggugucccagcucuaccccgagagcaucgucccgauccccuccagcaacgaggagauccgccugguggacgacgcguucgggaagaucugccacaugguguccgacggcagcugggucgugcgggugcaggccgccaagcugcucgggagcauggagcaggucuccagccacuuccuggagcagacccuggacaagaagcucauguccgaccugcgccggaagcgcaccgcccacgagcgggccaaggagcuguacagcuccggcgaguucagcuccggccgcaaguggggcgacgacgcgcccaaggaggagguggacacgggggccgucaaccucaucgagagcggggccugcggcgccuucgugcacggccuggaggacgagauguacgaggugcggaucgcggccgucgaggcccugugcaugcucgcccaguccagccccuccuucgccgagaagugccuggacuuccugguggacauguucaacgacgagaucgaggaggugcgccugcagagcauccacaccaugcggaagaucuccaacaacaucacccuccgcgaggaccagcuggacaccguccuggcggugcucgaggacagcucccgcgacauccgggaggcccugcacgagcugcucugcugcacgaacgugagcaccaaggaggggauccaccuggcccuggucgagcuccugaagaaccugaccaaguacccgaccgaccgcgacuccaucuggaagugccucaaguuccugggcagccggcaccccacgcuggugcucccccuggugcccgagcugcucuccacccacccguucuucgacaccgccgagcccgacauggacgaccccgccuacaucgcgguccuggugcugaucuucaacgccgccaagaccugccccacgaugccggcccucuucagcgaccacaccuuccgccacuacgccuaccugcgggacagccugucccaccucgugcccgcgcugcgccugcccgggcggaagcucgucagcuccgccgugagccccuccaucaucccgcaggaggaccccagccagcaguuccugcagcagucccuggagcgcguguacagccuccagcaccuggacccccagggcgcccaggagcugcucgaguucaccauccgggaccugcagcgccugggggagcuccaguccgagcuggccggcgucgcggacuucagcgccaccuaccugcggugccagcuccugcugaucaaggcccuccaggagaagcuguggaacguggccgccccgcuguaccucaagcaguccgaccuggcgagcgccgccgccaagcagaucauggaggagacguacaagauggaguucauguacuccggcguggagaacaagcaggucgugaucauccaccacaugcgccugcaggccaaggcgcuccagcugaucgugaccgcccggaccacccgcgggcuggacccccucuucggcaugugcgagaaguuccugcaggaggucgacuucuuccagcgguacuucaucgccgaccugccccaccuccaggacagcuucguggacaagcugcuggaccucaugccccgccugaugacguccaagccggccgagguggucaagauccugcagaccaugcuccggcagagcgccuuccugcaccucccccugcccgagcagauccacaaggcguccgccaccaucaucgagcccgccggggagagcgacaacccgcugcgcuucaccagcggccuggugguggcccucgacgucgacgcgacgcuggagcacgugcaggacccccagaacaccgugaagguccaggugcuguaccccgacgggcaggcccagaugauccaccccaagccggccgacuuccggaaccccggccccggccgccaccgccucaucacccagguguaccugucccacaccgccuggaccgaggccugccaggucgaggugcggcugcuccuggcguacaacagcuccgcccgcauccccaagugcccguggauggagggcggggagaugagcccccagguggagacguccaucgaggggaccauccccuucagcaagcccgucaagguguacaucaugccgaagcccgcccggcgcuga

SEQ ID NO: 31652 - RNA, 3060 nt, Artificial Sequence
  derived and/or modified sequence opt1 from INTS5__Homo_sapiens__NP_085131
augagcgcccugugcgaccccccgggcgcccccgggccccccggcccggcgcccgccacccacgggcccgccccccucuccgcccaggagcugagccaggagaucaaggccuuccugaccggcguggacccgauccucgggcaccagcuguccgcgcgcgagcacgcccggugcggccugcuccugcugcgcagccucccccccgcccgggccgcgguccuggaccaccugcgcggcguguucgacgaguccgugcgggcccaccucgccgcccuggacgagacgcccgucgccgggccgccccaccugcgcccccccccgcccagccacgugcccgcgggcgggcccggccucgaggacgugguccaggaggugcagcaggugcuguccgaguucauccgggccaacccgaaggccugggcccccgucaucagcgccugguccaucgaccugauggggcagcucagcuccaccuacagcggccagcaccagcgcgugccccacgcgaccggcgcccugaacgagcugcuccagcuguggauggggugccgggccacccgcacgcugauggacaucuacgugcagugccucuccgcccugaucggcagcugccccgacgccugcgucgacgcgcugcucgacaccuccgugcagcacagcccgcacuucgacuggguggucgcccacaucggguccagcuuccccggcaccaucaucucccgggugcugagcugcggccugaaggacuucugcgugcacgggggcgccgggggcggggccggcagcuccggcgggagcuccagccagacccccuccacggaccccuucccgggcagccccgccauccccgcggagaagcgcgucccgaagaucgccuccgugguggggauccucggccaccuggccagccggcacggggacuccauccgccgggagcugcuccgcauguuccacgacagccuggccggcggcuccgggggccggagcggggaccccucccugcaggcgaccguccccuuccuccugcagcuggccgugaugagccccgcccuccugggcaccguguccggggagcuggucgacugccucaagccgcccgccgugcugagccagcugcagcagcaccuccagggcuucccccgcgaggagcuggacaacaugcugaaccucgccguccaccuggugucccaggcgagcggcgccggggccuaccggcugcugcaguuccucguggacaccgccaugcccgccuccgucaucacgacccagggccuggcggugccggacaccgugcgcgaggccugcgaccggcugauccagcuccugcugcuccaccugcagaagcugguccaccaccgcgggggcagccccggcgagggggugcucggcccccccccgcccccccgccuggugcccuuccuggacgcccucaagaaccacgucggggagcugugcggcgagacccugcggcucgagcgcaagcgguuccuguggcagcaccagcugcucgggcugcugagcguguacacgcgcccguccugcggccccgaggcccucggccaccugcugagccgggcccgcucccccgaggagcucagccuggcgacccagcuguacgccgggcucguggucucccugagcggccugcucccccuggccuuccgguccugccuggcccgcgugcacgcggggacccuccagccgcccuucaccgcccgguuccugcgcaaccuggcccuccuggugggcugggagcagcaggggggcgagggccccgccgcccugggggcgcacuucggcgagagcgccuccgcccaccucagcgaccuggccccccugcuccugcacccggaggaggaggucgccgaggcggccgccucccugcucgccaucugccccuuccccagcgaggcccuguccccgagccagcugcucgggcuggugcgggcgggcgugcaccgcuucuucgccucccugcggcuccacgggccccccggcgucgccagcgccugccagcugcugacgcgccucucccagaccagccccgcgggccugaaggccgugcugcagcuccugguggagggggcccugcaccggggcaacaccgagcucuucgggggccaggucgacggggacaacgagacccugagcgugguguccgccagccuggccuccgcgagccuccuggacacgaaccgccggcacaccgccgccgucccgggccccggcgggaucugguccguguuccacgccggcgugaucgggcgcggccugaagccccccaaguucguccagagccggaaccagcaggaggugaucuacaacacccagucccuccugagccugcucgugcacugcugcuccgccccgggcgggaccgagugcggcgagugcuggggggcgcccauccugagccccgaggccgccaaggccgucgccgugacgcugguggaguccgucugccccgacgcggccggcgccgagcucgccuggccgcccgaggagcacgcccgcgcgaccguggagcgcgaccugcggaucgggcgccgguuccgcgagcagccccugcucuucgagcugcugaagcucguggccgccgcccccccggcgcugugcuacugcagcguccugcuccggggccugcuggccgcccuccugggccacugggaggccucccgccaccccgacaccacccacagccccuggcaccuggaggccuccugcacgcucguggcggugauggccgaggggagccugcugcccccggcccucggcaacaugcacgaggucuucucccagcuggcccccuucgaggugcggcugcuccugcugagcguguggggguuccugcgcgagcacggcccccucccccagaaguucaucuuccaguccgagcgggggcgcuucauccgggacuucagccgcgagggcggcggggagggcgggccgcaccuggccguccugcacagcgugcuccaccggaacaucgaccgccugggccuguucuccgggcgguuccaggcgcccagccccuccacccuccugcgccagggcaccuga

SEQ ID NO: 31653 - RNA, 2625 nt, Artificial Sequence
  derived and/or modified sequence opt1 from INTS6__Homo_sapiens__NP_001035026
augaaccagcgcagccaccugggcaccaccuaccucgacacggccaagggggccguggagaccuucaugaagcugcgggcgcgcgaccccgccucccggggcgaccgcuacaugcuggucaccuucgaggagccgcccuacgccaucaaggccggguggaaggagaaccacgccaccuucaugaacgagcucaagaaccugcaggcggagggccugacgacccucgggcagagccugcggaccgccuucgaccugcucaaccugaaccgccuggugaccggcaucgacaacuacggccaggggcggaaccccuucuuccucgagcccgccaucaucaucacgaucaccgacggcuccaagcugaccaccacgagcggggugcaggacgagcugcaccucccgcugaacagcccccugcccggcuccgagcucaccaaggagcccuuccgcugggaccagcggcuguucgcccugguccuccgccugccggggaccauguccguggagagcgagcagcugaccggcgugccccucgacgacuccgcgaucacgcccaugugcgaggucaccggcgggcggagcuacuccgugugcagcccccgcaugcugaaccagugccuggagucccucgugcagaagguccagagcggcguggugaucaacuucgagaaggccgggccggaccccucccccgucgaggacggccagcccgacaucagccggccguucggcucccagcccuggcacagcugccacaagcugaucuacgugcgccccaaccccaagaccggggugccgaucggccacuggcccguccccgaguccuucuggcccgaccagaacagcccgacccugccgccccggacgagccaccccguggugaaguucuccugcaccgacugcgagcccauggucaucgacaagcuccccuucgacaaguacgagcuggagcccagcccgcugacccaguucauccucgagcgcaagagcccccagaccugcuggcaggucuacguguccaacuccgccaaguacagcgagcuggggcaccccuucggcuaccugaaggccuccacggcccucaacugcgugaaccuguucgugaugcccuacaacuacccggugcugcucccccugcuggacgaccucuucaagguccacaaggcgaagcccacccugaaguggcggcagagcuucgaguccuaccugaagaccaugcccccguacuaccucgggccccugaagaaggccgugcgcaugaugggcgcccccaaccugaucgccgacagcauggaguacggccucuccuacagcgucaucuccuaccugaagaagcugagccagcaggccaagaucgaguccgaccgggugaucgggagcgugggcaagaaggucgugcaggagaccgggaucaaggugcgcucccggagccacggccuguccauggcguaccgcaaggacuuccagcagcuccugcaggggaucagcgaggacgucccccaccgccugcucgaccugaacaugaaggaguacacgggcuuccagguggcccugcucaacaaggaccugaagccgcagaccuuccggaacgccuacgacaucccccgccggaaccugcucgaccaccugacccgcaugcggagcaaccugcucaaguccacccgccgguuccugaagggccaggacgaggaccaggugcacagcguccccaucgcccagauggggaacuaccaggaguaccugaagcagguccccuccccgcuccgcgagcuggaccccgaccagccccggcgccugcacacguucggcaaccccuucaagcucgacaagaaggggaugaugaucgacgaggccgacgaguucguggcgggcccgcagaacaagcacaagcggcccggggagcccaacaugcagggcauccccaagcgccggcgcugcaugagcccgcugcugcggggccgccagcagaaccccguggugaacaaccacaucgggggcaaggggcccccggcccccaccacccaggcccagcccgaccucaucaagccccugccgcugcacaagaucuccgagaccacgaacgacagcaucauccacgacguggucgagaaccacguggccgaccagcucuccagcgacaucacccccaacgccauggacaccgaguucuccgcgagcucccccgccagccugcuggagcggcccaccaaccacauggaggcccucggccacgaccaccugggcaccaacgaccugacggucgggggcuuccucgagaaccacgaggagccgcgcgacaaggagcagugcgccgaggagaacauccccgcguccagccugaacaaggggaagaagcugaugcacugccggucccacgaggaggugaacaccgagcucaaggcccagaucaugaaggagauccgcaagcccggccgcaaguacgagcggaucuucacccugcugaagcacgugcaggggagccuccagacccgccugaucuuccugcagaacgugaucaaggaggccucccgguucaagaagcgcaugcucaucgagcagcuggagaacuuccuggacgagauccaccggcgcgccaaccagaucaaccacaucaacagcaacuga

SEQ ID NO: 31654 - RNA, 2742 nt, Artificial Sequence
  derived and/or modified sequence opt1 from INTS7__Homo_sapiens__NP_001186738
auggccagcaacuccaccaagagcuuccuggccgacgcgggcuacggggagcaggagcucgacgccaacuccgcccugauggagcuggacaagggccuccgcagcgggaagcugggcgagcagugcgaggccguggugcgguucccccgccuguuccagaaguacccguuccccauccucaucaacuccgccuuccugaagcuggcggacguguuccggguggggaugcucggcagccuggccuccaucauccccgagcgcaagaacgcccaccacagcauccggcagucccuggacagccacgacaacgucgagguggaggccgcgguguucgccgccgccaacuucuccgcccagagcaaggacuucgcggucggcaucugcaacaagaucuccgagaugauccaggggcucgccacccccguggaccugaagcugaagcucaucccgauccugcagcacaugcaccacgacgccauccuggccagcuccgcccgccagcuccugcagcagcuggugacgagcuaccccuccaccaagauggucaucgugagccuccacaccuucacccugcuggcggccuccagccucguggacacgcccaagcagauccagcugcugcuccaguaccugaagaacgacccccggaaggccgucaagcgccuggccauccaggaccucaagcugcuggccaacaagaccccgcacaccuggagccgggagaacauccaggcgcucugcgagugcgcccugcagacccccuacgacucccugaagcucggcaugcugagcgugcuguccacgcucagcgggaccaucgccaucaagcacuacuucuccaucgugcccggcaacgucagcuccagcccccgcuccagcgaccuggugaagcuggcccaggagugcugcuaccacaacaaccgggggaucgccgcgcacggcgugcgcguccucaccaacaucaccguguccugccaggagaaggaccugcuggcccucgagcaggacgccguguucggccuggagagccugcucguccugugcucccaggacgacagcccgggggcccaggcgacgcugaagaucgcccugaacugcauggugaagcucgccaagggccggccccaccugucccagagcguggucgagacccugcucacccagcugcacuccgcccaggacgccgcgcgcauccugaugugccacugccucgccgccaucgccaugcagcugcccgugcugggggacggcaugcucggcgaccugauggagcuguacaaggucaucgggcggagcgccaccgacaagcagcaggagcuccuggugucccuggcgacggugaucuucgucgccagccagaaggcccucagcguggaguccaaggccgugaucaagcagcagcuggagagcgucuccaacggcuggaccguguaccgcaucgcccggcaggcgagccgcauggggaaccacgacauggccaaggagcuguaccagucccuccugacccagguggccagcgagcacuucuacuucuggcugaacucccucaaggaguucagccacgccgagcagugccugaccggccugcaggaggagaacuacuccagcgcgcucuccugcaucgccgagagccugaaguucuaccacaaggggaucgccucccugacggccgccagcacgccccucaacccgcuguccuuccagugcgaguucgucaagcugcggaucgaccuccugcaggcguucagccagcugaucugcacgugcaacucccucaagaccagcccgccgcccgccaucgccaccaccaucgccaugacccugggcaacgaccugcagcgcugcggccggaucagcaaccagaugaagcaguccauggaggaguuccgcagccucgccucccgcuacggggaccuguaccaggcgagcuucgacgccgacuccgccacccugcggaacguggagcuccagcagcagagcugccugcugaucucccacgccaucgaggcccucauccuggaccccgagagcgcguccuuccaggaguacggcagcaccgggaccgcccacgccgacuccgaguacgagcgccggaugaugagcguguacaaccacguccuggaggagguggagucccucaaccgcaaguacacccccgugagcuacaugcacaccgccugccugugcaacgcgaucaucgcccugcucaaggucccccuguccuuccagcgguacuucuuccagaagcugcagagcacguccaucaagcucgcccugagccccagcccccgcaaccccgccgagcccaucgccgugcagaacaaccagcagcuggcgcucaagguggagggcgucgugcagcacggguccaagcccggccuguuccggaagauccagagcgugugccugaacgucuccagcacccuccaguccaagagcggccaggacuacaagaucccgaucgacaacaugaccaacgagauggagcagcgcguggagccccacaacgacuacuucuccacccaguuccugcugaacuucgccauccucgggacgcacaacaucaccguggagagcuccgucaaggacgccaacggcaucguguggaagaccgggccccggaccaccaucuucgucaagagccuggaggacccguacucccagcagauccgccugcagcagcagcaggcccagcagccccuccagcagcagcagcagcggaacgccuacacgcgcuucuga

SEQ ID NO: 31655 - RNA, 2988 nt, Artificial Sequence
  derived and/or modified sequence opt1 from INTS8__Homo_sapiens__NP_060334
augagcgccgaggccgcggaccgcgaggccgccaccuccagccggcccugcaccccgccccagacgugcugguucgaguuccugcucgaggagucccugcuggagaagcaccuccgcaagcccugccccgacccggcccccgugcagcugaucguccaguuccuggagcaggccagcaagcccuccgugaacgagcagaaccaggugcagcccccgcccgacaacaagcggaaccgcauccucaagcugcuggcgcucaaggucgccgcccaccugaagugggaccuggacauccucgagaagucccugagcgugcccgugcugaacaugcuccugaacgagcugcucugcaucagcaaggugcccccgggcaccaagcacgucgacauggaccuggccacccugccgcccaccacggcgauggccgugcuccuguacaaccggugggccauccgcaccaucguccaguccagcuuccccgugaagcaggccaagcccgggccgccccagcuguccgugaugaaccagaugcagcaggagaaggagcucaccgagaacauccugaagguccugaaggagcaggccgcggacagcauccucgugcuggaggccgcccugaagcucaacaaggaccuguacgugcacaccaugcggacgcuggaccuccuggccauggagcccggcauggucaacggggagaccgaguccagcaccgccggccugaaggugaagaccgaggagaugcagugccaggugugcuacgaccucggggcggccuacuuccagcagggcuccacgaacagcgccgucuacgagaacgcccgcgagaaguucuuccggaccaaggagcugaucgccgagaucggcucccugagccuccacugcaccaucgacgagaagcgccuggcgggguacugccaggccugcgacgugcuggugcccuccagcgacagcaccucccagcagcucacgcccuacagccagguccacaucugccugcgguccggcaacuaccaggaggugauccagaucuucaucgaggacaaccugacccucagccugcccgugcaguuccgccaguccguccugcgggagcuguucaagaaggcccagcaggggaacgaggcccucgacgagaucugcuucaaggugugcgccugcaacaccguccgcgacauccuggagggccggaccaucagcgugcaguucaaccagcuguuccuccgccccaacaaggagaagaucgacuuccugcuggaggugugcucccggagcgucaaccucgagaaggcguccgagagccugaaggggaacauggccgccuuccugaagaacgugugccucggccuggaggaccugcaguacguguucaugaucuccagccacgagcuguucaucacgcuccugaaggacgaggagcgcaagcuccuggucgaccagaugcggaagcgcuccccgcgggugaaccugugcaucaagcccgugaccagcuucuacgacauccccgccuccgcgagcgucaacaucggccagcucgagcaccagcugauccuguccguggaccccuggcgcauccgccagauccucaucgagcugcacgggaugaccagcgagcggcaguucuggaccguguccaacaagugggaggucccgagcguguacagcggcgugauccuggggaucaaggacaaccucacgcgcgaccuggucuacauccugauggccaagggccuccacugcuccaccgugaaggacuucagccacgccaagcagcuguucgccgccugccuggagcucgugaccgaguucucccccaagcugcggcaggucaugcugaacgagaugcuccugcuggacauccacacccacgaggcgggcacggggcaggccggcgagcggcccccgagcgaccucaucucccgcgugcgcggguaccuggagaugcggcugcccgacaucccccuccgccaggugaucgccgaggagugcgucgccuucaugcugaacuggcgggagaacgaguaccugacccuccaggugcccgccuuccugcugcagagcaacccguacgugaagcucggccagcugcuggcggcgaccugcaaggagcuccccgggcccaaggagucccgccggaccgccaaggaccugugggaggucguggugcagaucugcagcgucuccagccagcacaagcgcggcaacgacggccgggugucccugaucaagcagcgcgagagcacgcucgggaucauguaccgguccgagcugcugagcuucaucaagaagcuccgcgagccccuggugcugaccaucauccucucccuguucgucaagcugcacaacgugcgggaggacaucgugaacgacaucaccgccgagcacaucagcaucuggccguccagcauccccaaccuccagagcgucgacuucgaggccguggccaucaccgugaaggagcugguccgcuacacgcuguccaucaaccccaacaaccacagcuggcucaucauccaggccgacaucuacuucgccaccaaccaguacuccgccgcgcugcacuacuaccugcaggccggcgccgugugcagcgacuucuucaacaaggccgugcccccggacgucuacaccgaccaggugaucaagcggaugaucaagugcugcucccuccugaacugccacacccagguggccauccugugccaguuccuccgcgagaucgacuacaagaccgcguucaagagccugcaggagcagaacucccacgacgccauggacagcuacuacgacuacaucugggacgucacgauccuggaguaccucaccuaccugcaccacaagcgcggggagaccgacaagcggcagaucgccaucaaggccaucggccagaccgagcugaacgccuccaaccccgaggaggugcuccagcuggcggcccagcgccggaagaagaaguuccugcaggccauggccaagcucuacuucuga

SEQ ID NO: 31656 - RNA, 2829 nt, Artificial Sequence
  derived and/or modified sequence opt1 from INTU__Homo_sapiens__NP_056508
auggccagcguggccuccugcgacagccgccccuccagcgacgagcugccgggcgaccccuccagccaggaggaggacgaggacuacgacuucgaggaccgggucuccgacagcggguccuacagcuccgcgagcuccgacuacgacgaccucgagcccgaguggcuggacagcgugcagaagaacggcgagcuguucuaccucgagcuguccgaggacgaggaggagagccugcuccccgagaccccgaccgugaaccacguccgcuucuccgagaacgagaucaucaucgaggacgacuacaaggagcggaagaaguacgagcccaagcugaagcaguucacgaagauccugcgccggaagcgccuccugcccaagcggugcaacaagaagaacagcaacgacaacgggcccguguccauccugaagcaccagagcaaccagaagaccggcgugaucguccagcagcgcuacaaggacgugaacguguacgucaacccgaagaagcucaccgugaucaaggccaaggagcagcugaagcugcucgaggugcuggucgggaucauccaccagaccaaguggagcuggcggcgcacgggcaagcagggcgacggggagcggcugguggugcacggccuccugcccgggggcuccgccaugaaguccgggcagguccugaucggcgacgugcucguggccgucaacgacguggacgugaccaccgagaacaucgagcgcguccugagcugcauccccggccccaugcaggucaagcugaccuucgagaacgccuacgacgugaagcgggagacgagccacccgcgccagaagaagacccaguccaacaccagcgaccucgugaagcugcuguggggcgaggagguggaggggauccagcaguccgggcucaacacgccccacaucaucauguaccugacgcugcagcucgacagcgagaccuccaaggaggagcaggagauccuguaccacuaccccaugagcgaggcgucccagaagcucaagagcguccggggcaucuuccugacccugugcgacaugcuggagaacgugaccggcacccaggugaccuccagcucccuccugcugaacgggaagcagauccacgucgccuacuggaaggagagcgacaagcuccugcugaucggccuccccgccgaggaggugccgcugccccgccugcggaacaugaucgagaacgugauccagacccucaaguucauguacgggucccuggacagcgccuucugccagaucgagaacgucccccgccuggaccacuucuucaaccucuucuuccagcgggcgcugcagcccgccaagcugcacuccagcgccagcccguccgcccagcaguacgacgccagcuccgcggugcugcucgacaaccugcccggcgugcgcuggcugacccucccccuggagaucaagauggagcuggacauggcccucagcgaccuggaggccgccgacuucgccgagcuguccgaggacuacuacgacaugcggcgccucuacacgauccuggggagcucccuguucuacaagggcuaccucaucugcagccaccuccccaaggacgaccugaucgacaucgcggucuacugccgccacuacugccugcugccgcuggccgccaagcagcggaucggccagcucaucaucuggcgcgagguguucccccagcaccaccuccggccccuggccgacuccagcaccgagguguuccccgagccggaggggcgcuacuuccugcuggucgugggccugaagcacuacaugcucugcgugcugcuggaggccgggggcugcgcguccaaggccaucgggagccccggccccgacugcgucuacguggaccaggugaagaccacccuccaccagcuggacggcgucgacucccggaucgacgagcgccuggccagcuccccggugcccugccucagcugcgccgacugguuccugacggggucccgggagaagaccgacagccugaccaccagccccauccucucccgccugcagggcacgagcaagguggccaccuccccgaccugccggcgcacccuguucggggacuacagccucaagacgcggaagcccucccccagcugcuccagcggcggguccgacaacggcugcgagggcggggaggacgacggcuucagcccccacaccacccccgacgcgguccgcaagcagcgggagucccaggggagcgacggccuggaggaguccggcacccugcucaaggugacgaagaagaaguccacccugccgaaccccuuccaccuggggaaccucaagaaggaccugcccgagaaggagcuggagaucuacaacaccgugaagcucaccagcggccccgagaacacccuguuccacuacgucgcccuggagacggugcaggggaucuucaucaccccgacccucgaggagguggcccagcugagcggcuccauccacccccagcugaucaagaacuuccaccagugcugccucagcauccgcgccgucuuccagcagacccugguggaggagaagaagaaggggcugaacuccggcgaccacagcgacagcgcgaaguccgugagcucccucaaccccgucaaggagcacggcgugcuguucgagugcagccccgggaacuggacggaccagaagaaggccccgcccgugauggccuacugggucgugggccggcuguuccuccaccccaagccccaggagcuguacgugugcuuccacgacuccgucaccgagaucgccaucgagaucgccuucaagcuguucuucgggcucacccuguga

SEQ ID NO: 31657 - RNA, 3198 nt, Artificial Sequence
  derived and/or modified sequence opt1 from INVS__Homo_sapiens__NP_055240
augaacaagagcgagaaccugcuguucgccggcuccagccuggccucccaggugcacgcggccgccgucaacggggacaagggcgcccugcagcgccucaucguggggaacagcgcccugaaggacaaggaggaccaguucggccggacgccccugauguacugcgugcucgcggaccgccuggacugcgccgacgcccugcucaaggccggggcggacgucaacaagaccgaccacucccagcggaccgcccugcaccuggccgcccagaagggcaacuaccgcuucaugaagcuccugcugacccggcgcgccaacuggaugcagaaggaccucgaggagaugaccccgcugcaccugaccacgcggcaccgcagccccaagugccucgcgcugcugcucaaguucauggcccccggcgagguggacacccaggacaagaacaagcagaccgcccugcacugguccgccuacuacaacaaccccgagcacgugaagcugcucaucaagcacgacagcaacaucgggaucccggacgucgagggcaagaucccccugcacugggccgcgaaccacaaggaccccuccgccgugcacaccgugcggugcauccuggacgccgcccccacggagagccuccugaacuggcaggacuacgaggggcgcaccccgcugcacuucgccgucgcggacggcaacgugaccguggucgacgugcucaccuccuacgagagcugcaacaucacguccuacgacaaccuguuccggacgccccugcacugggccgcccuccuggggcacgcccagaucgugcaccuccuccuggagcgcaacaagagcggcaccauccccuccgacagccagggcgccacgccccugcacuacgcggcccaguccaacuucgccgagaccgucaagguguuccucaagcacccgagcgugaaggacgacuccgaccuggaggggcggaccagcuucaugugggccgcgggcaaggggagcgacgacguccugcgcaccaugcucucccugaaguccgacaucgacaucaacauggccgacaaguacggcggcaccgcccuccacgccgccgcgcugagcgggcacgugagcaccgugaagcugcugcucgagaacaacgcccaggucgacgccaccgacgugaugaagcacaccccgcuguuccgggccugcgagaugggccacaaggacgugauccagacccugaucaagggcggggcccgcgucgaccugguggaccaggacgggcacucccuccugcacugggcggcccugggcggcaacgccgacgucugccagauccucaucgagaacaagaucaaccccaacgugcaggacuacgccgggcggacgccccugcagugcgccgcguacggcggguacaucaacugcauggccgugcugauggagaacaacgccgaccccaacauccaggacaaggagggccgcaccgcccuccacuggagcugcaacaacggguaccuggacgcgaucaagcugcuccuggacuucgccgccuuccccaaccagauggagaacaacgaggagcgguacacgccccuggacuacgcccuccugggcgagcgccacgaggucauccaguucaugcuggagcacggcgcccucuccaucgcggccauccaggacaucgccgccuucaagauccaggccguguacaagggguacaaggugcggaaggcguuccgcgaccgcaagaaccugcugaugaagcacgagcagcuccggaaggacgccgccgccaagaagcgcgaggaggagaacaagcggaaggaggccgagcagcagaagggccgccggagccccgacuccugccgcccgcaggcgcugcccugccugcccagcacccaggacguccccucccggcagagccgcgccccguccaagcagccgcccgccgggaacguggcccagggccccgagccccgggacagccgcgggucccccggcggcagccucgggggcgcgcugcagaaggagcagcacguguccagcgaccugcaggggaccaacucccggcgccccaacgagaccgcccgggagcacagcaagggccagagcgccugcguccacuuccgcccgaacgagggcuccgacgggagccggcaccccggcgugcccuccguggagaagucccgcggggagaccgccggcgacgagcggugcgccaaggggaagggcuucgucaagcagcccagcugcauccgcguggcgggcccggacgagaagggggaggacagccggcgcgccgccgccucccucccgccccacgacagccacuggaagcccucccgccggcacgacaccgagcccaaggccaagugcgcgccccagaagcgccggacgcaggagcugcgcggcgggcggugcagccccgccggcuccagccgccccggguccgcccggggcgaggccgugcacgccggccagaacccgccccaccaccgcacgccccggaacaaggucacccaggcgaagcugaccgggggccucuacagccaccucccgcaguccaccgaggagcugcgcagcggggcccggcgccuggagaccuccacccugagcgaggacuuccaggugagcaaggagaccgaccccgcccccggcccccuguccgggcagagcgugaacaucgaccuccugcccgucgagcugcggcuccagaucauccagcgcgagcggcgccggaaggagcuguuccgcaagaagaacaaggccgccgcggugauccagcgggccuggcgcuccuaccagcugcggaagcaccucagccaccuccggcacaugaagcagcugggcgccggcgacguggaccgcuggcgccaggaguccaccgcccugcugcugcaggucuggcgcaaggagcucgagcugaaguucccgcagacgaccgcggugagcaaggcccccaagucccccagcaaggggaccuccggcaccaagagcacgaagcacuccgugcugaagcagaucuacgggugcagccacgagggcaagauccaccaccccacccgguccgucaaggccagcuccgugcuccgccugaacagcguguccaaccugcagugcauccaccuccuggagaacagcgggcgguccaagaacuucagcuacaaccugcagagcgccacccagccgaagaacaagaccaagcccuga

SEQ ID NO: 31658 - RNA, 831 nt, Artificial Sequence
  derived and/or modified sequence opt1 from IP6K1__Homo_sapiens__NP_001006115
augcuggacggcaacagcgggcucuccagcgagaagaucucccacaaccccuggagccugcgcugccacaagcagcagcugucccggaugcgcagcgaguccaaggaccggaagcucuacaaguuccugcugcucgagaacgugguccaccacuucaaguacccgugcgugcuggaccugaagaugggcacccgccagcacggggacgacgccagcgccgagaaggcggcccggcagaugcgcaagugcgagcaguccaccagcgccacgcucggcgugcgggucugcgggaugcaggucuaccagcuggacaccggccacuaccugugccgcaacaaguacuacggccgggggcucuccaucgagggcuuccgcaacgcccuguaccaguaccugcacaacgggcucgaccugcggcgcgaccuguucgagcccauccucagcaagcugcggggccugaaggccgugcucgagcgccaggcguccuaccgguucuacagcuccagccugcuggugaucuacgacgggaaggagugccgcgccgaguccugccucgaccggcgcagcgagaugcggcugaagcaccuggacauggugcuccccgagguggccuccagcugcggccccagcaccuccccgagcaacaccucccccgaggccggccccagcucccagcccaaggucgacgugcgcaugaucgacuucgcgcacagcacguucaagggguuccgggacgacccgaccgugcacgacggccccgaccgcggguacgucuucggccuggagaaccugaucuccaucauggagcagaugcgcgacgagaaccaguga

SEQ ID NO: 31659 - RNA, 294 nt, Artificial Sequence
  derived and/or modified sequence opt1 from IP6K2__Homo_sapiens__NP_001005911
augagccccgccuuccgcgccauggacguggagccgcgggcgaagggcguccugcucgagcccuucgugcaccaggucgggggccacuccugcgugcugcgcuucaacgagaccacccugugcaagccccucgugccccgggagcaccaguucuacgagacccugccggccgagaugcgcaaguucacgccccaguacaaggggcagagccagcggccccugguguccuggcccagccucccgcacuucuuccccugguccuucccccuguggccccagggcagcgucgccuga

SEQ ID NO: 31660 - RNA, 1233 nt, Artificial Sequence
  derived and/or modified sequence opt1 from IP6K3__Homo_sapiens__NP_001136355
auggugguccagaacagcgccgacgccggcgacaugcgcgccggggugcagcuggagcccuuccuccaccaggugggcgggcacauguccgucaugaaguacgacgagcacaccgugugcaagccgcuggugagccgggagcagcgcuucuacgagucccugccccucgccaugaagcgguucacgccccaguacaagggcaccgucaccgugcaccuguggaaggacagcaccgggcaccugucccucguggccaaccccgucaaggagagccaggagccguucaagguguccaccgagagcgccgccguggcgaucuggcagacgcugcagcagaccaccggcuccaacggcagcgacugcacccuggcccaguggccccacgcccagcucgcccgcucccccaaggagagccccgcgaaggcccugcugcgguccgagccgcaccucaacacgcccgccuucagccuggucgaggacaccaacgggaaccagguggagcgcaaguccuucaaccccuggggccugcagugccaccaggcccaccucacccggcugugcagcgaguaccccgagaacaagcgccaccgguuccugcuccuggagaacguggucucccaguacacccacccgugcgugcuggaccucaagauggggacgcgccagcacggcgacgacgccagcgaggagaagaaggcgcggcacaugcgcaagugcgcccaguccaccagcgccugccugggggugcggaucugcggcaugcaggucuaccagaccgacaagaaguacuuccugugcaaggacaaguacuacggccgcaagcucagcguggagggguuccggcaggcccuguaccaguuccugcacaacggcucccaccuccgccgggagcugcuggagcccauccuccaccagcugcgcgcccugcucagcgugauccggucccagagcuccuaccgcuucuacagcuccagccugcuggucaucuacgacgggcaggagccgcccgagcgggcgccgggcagcccccacccccacgaggcgccccaggccgcccacggcuccucccccgggggccucaccaagguggacauccgcaugaucgacuucgcccacacgaccuacaagggguacuggaacgagcacaccaccuacgacggccccgaccccggguacaucuucggccuggagaaccugauccgcauccuccaggacauccaggagggcgaguga

SEQ ID NO: 31661 - RNA, 1317 nt, Artificial Sequence
  derived and/or modified sequence opt1 from IPCEF1__Homo_sapiens__XP_005266979
augaccagcuacauggccaucgacggcuccgcccuccaggugccccugcgccagaagccgcggcgcaagacccagggguuccugaccaugagccggcgccggaucuccugcaaggaccugggccacgcggacugccagggguggcucuacaagaagaaggagaagggcagcuuccuguccaacaaguggaagaaguucugggucauccugaaggggagcucccucuacugguacagcaaccagauggccgagaaggccgacggcuucgugaaccugcccgacuucaccguggagcgcgccuccgagugcaagaagaagcacgccuucaagaucagccacccccagaucaagaccuucuacuucgcggccgagaacguccaggagaugaacguguggcugaacaagcucggcuccgccgugauccaccaggagagcaccacgaaggacgaggagugcuacuccgagagcgagcaggaggaccccgagaucgccgcggagaccccgcccccgccccacgccucccagacccagagccugaccgcccagcaggccuccagcuccagccccagccuguccgggacgagcuacuccuucagcucccucgagaacaccgucaagacccccagcuccuuccccagcucccugagcaaggagcggcagucccugcccgacaccgugaacagccucuccgccgcggaggacgagggccagccgaucacguucgccgugcagguccacagccccgugcccuccgaggccgggauccacaaggcccuggagaacagcuucgugaccuccgagagcggcuuccugaacucccucagcagcgacgacaccuccagccuguccagcaaccacgaccaccugaccguccccgacaagccggccggguccaagaucauggacaaggaggagacgaaggugagcgaggacgacgagauggagaagcucuacaagucccuggagcaggcgagccugagcccccucggcgaccgccggcccuccaccaagaaggagcugcgcaaguccuucgugaagcggugcaagaaccccagcaucaacgagaagcugcacaagauccgcacccucaacuccacccugaagugcaaggagcacgaccuggccaugaucaaccagcuccuggacgacccgaagcugacggcccggaaguaccgcgaguggaaggucaugaacacccuccugauccaggacaucuaccagcagcagcgggccagccccgcccccgacgacaccgacgacacgccccaggagcugaagaaguccccgagcucccccagcguggagaacagcaucuga

SEQ ID NO: 31662 - RNA, 1251 nt, Artificial Sequence
  derived and/or modified sequence opt1 from IPMK__Homo_sapiens__NP_689416
auggccaccgagcccccgagcccccugcgcguggaggcccccgggcccccggagaugcggaccucccccgcgaucgagagcacgcccgagggcacgccccagccggccggcgggcgccuccgguuccugaacggcugcgucccccugucccaccagguggccgggcacauguacggcaaggacaaggugggcauccuccagcaccccgacgggaccguccugaagcagcugcagcccccgccccgcggcccccgggagcucgaguucuacaacaugguguacgccgccgacugcuucgacggggugcugcuggagcuccgcaaguaccugcccaaguacuacggcaucuggagcccgcccaccgcgcccaacgaccuguaccucaagcuggaggacgucacccacaaguucaacaagcccugcaucauggacgugaagaucgggcagaaguccuacgacccguucgccagcuccgagaagauccagcagcaggucagcaaguacccccugauggaggagaucggcuuccucgugcugggcaugcggguguaccacgugcacuccgacagcuacgagaccgagaaccagcacuacgggcgcucccugaccaaggagaccaucaaggacggcgucagccgguucuuccacaacggguacugccuccgcaaggacgccguggccgcguccauccagaagaucgagaagauccugcagugguucgagaaccagaagcagcugaacuucuacgccagcucccuccuguucguguacgagggcagcucccagcccacgaccaccaagcugaacgaccggacccucgccgagaaguuccugagcaagggccagcuguccgacacggagguccucgaguacaacaacaacuuccacgugcugagcagcaccgccaacgggaagaucgaguccagcgugggcaagucccugagcaagauguacgcccgccaccggaagaucuacaccaagaagcaccacucccagaccagccucaaggucgagaaccuggagcaggacaacggguggaaguccaugagccaggagcaccugaacggcaacgugcucucccagcuggagaagguguucuaccaccuccccacggggugccaggagaucgcggaggucgaggugcgcaugaucgacuucgcccacguguucccgagcaacaccaucgacgagggcuacgucuacggccugaagcaccugaucuccgugcugcggagcauccucgacaacuga

SEQ ID NO: 31663 - RNA, 3048 nt, Artificial Sequence
  derived and/or modified sequence opt1 from IPO11__Homo_sapiens__NP_001128251
auggugcagcccaucauccaccugggcuacgucguguacagccuccuguaccugggguacaagcccgugcagcacgucaccgcccucaacaccguguccagcugccacaagaugguguccauggaccugaacagcgccuccacggucgugcuccaggugcucacccaggcgaccagccaggacaccgccguccugaagcccgccgaggagcagcugaagcagugggagacgcagcccggcuucuacuccgugcuccugaacaucuucaccaaccacacccuggacaucaacgugcgcuggcucgccguccuguacuucaagcacgggaucgaccgguacuggcgccggguggcgccccacgcccugagcgaggaggagaagaccacgcuccgcgccggccugaucaccaacuucaacgagccgaucaaccagaucgccacccagaucgccgugcugaucgcgaaggucgcccggcucgacugcccccgccaguggcccgagcugauccccacccugaucgaguccgugaaggugcaggacgaccuccggcagcaccgcgcccugcugacguucuaccacgucaccaagacccucgccagcaagcggcuggccgcggaccgcaagcuguucuacgaccucgccuccgggaucuacaacuucgccugcagccuguggaaccaccacaccgacacguuccugcaggagguguccagcggcaacgaggccgccauccucuccagccuggagcggacccugcucucccugaaggugcugcgcaagcucaccgucaacggcuucguggagccgcacaagaacauggaggugaugggguuccugcacggcaucuucgagcggcugaagcaguuccucgagugcagccgcuccaucgggaccgacaacgucugccgggaccgccuggagaagacgaucauccuguucaccaaggugcuccuggacuuccuggaccagcaccccuucagcuucacgccccucauccagcggagccuggaguucuccgucagcuacguguucaccgaggugggcgagggggucaccuucgagcgcuucaucgugcagugcaugaaccugaucaagaugaucgugaagaacuacgcguacaagcccuccaagaacuucgaggacagcuccccggagacccucgaggcccacaagaucaagauggccuucuucaccuaccccacccugacggagaucugccggcgccuggucagccacuacuuccugcucaccgaggaggagcugaccaugugggaggaggaccccgagggcuucaccguggaggagacgggcggggacuccuggaaguacagccugcggcccugcaccgaggugcuguucaucgacaucuuccacgaguacaaccagacccugaccccgguccugcucgagaugaugcagacgcugcagggccccaccaacguggaggacaugaacgcccugcucaucaaggacgccguguacaacgcggucgggcuggccgccuacgagcuguucgacuccguggacuucgaccagugguucaagaaccagcuccugcccgagcuccaggugauccacaaccgcuacaagccccuccgccggcgcgucaucuggcugaucggccaguggaucagcgugaaguucaaguccgaccugcggccgaugcucuacgaggccaucugcaaccugcugcaggaccaggaccucgugguccgcaucgagaccgccaccacccugaagcugacgguggacgacuucgaguuccggaccgaccaguuccuccccuaccuggagaccauguucacccugcuguuccagcugcugcagcaggucacggagugcgacaccaagaugcacgugcuccacgugcugagcugcgugaucgagcgcgucaacaugcagauccggcccuacgugggcugccuggugcaguaccucccccugcuguggaagcaguccgaggagcacaacaugcuccgcugcgcgauccugaccacccugauccaccucguccaggggcugggcgccgacagcaagaaccuguacccguuccuccugcccgugauccagcuguccacggacgugagccagccgccccacgucuaccuccuggaggacgggcuggagcucuggcuggugacccuggagaacucccccugcaucacccccgagcuccugcggaucuuccagaacaugagcccccugcucgagcuguccagcgagaaccugcggaccugcuucaagaucaucaacggcuacaucuuccucagcuccacggaguuccugcagaccuacgccguggggcugugccagagcuucugcgagcuccugaaggagaucaccaccgagggccagguccaggugcugaagguggucgagaacgcccucaaggugaacccgauccugggcccccagauguuccagcccauccugcccuacguguucaaggggaucaucgagggcgagcgcuacccggucgugauguccacguaccucggggugaugggccgcguccugcugcagaacaccagcuucuucuccagccuccugaacgagauggcgcacaaguucaaccaggagauggaccagcugcucgggaacaugaucgagauguggguggaccggauggacaacaucacccagcccgagcgccggaagcuguccgcccuggcccuccugagccugcuccccuccgacaacagcgugauccaggacaaguucugcggcaucaucaacaucuccgucgagggccugcacgacgugaugaccgaggaccccgagacggggaccuacaaggacugcaugcugaugagccaccucgaggagccgaaggugaccgaggacgaggagccgcccaccgagcaggacaagcgcaagaagaugcuggcccugaaggaccccguccacacggugucccuccagcaguucaucuacgagaagcugaaggcccagcaggagaugcugggcgagcagggguuccagagccucauggagaccguggacaccgagaucgucacccagcugcaggaguuccugcagggcuucuga

SEQ ID NO: 31664 - RNA, 1989 nt, Artificial Sequence
  derived and/or modified sequence opt1 from IPO13__Homo_sapiens__XP_011540763
auggagaccagccacggcaucugccgcaucgccguggcccugggggagaaccacucccgggcgcuccuggaccaggucgagcacuggcagagcuuccuggcccucgugaacaugaucauguucugcaccggcauccccgggcacuacccggugaacgagacgaccuccagccugacccugaccuucugguacacgcuccaggacgacauccuguccuucgaggccgagaagcaggccgucuaccagcaggucuaccgccccguguacuuccagcugguggacgugcuccugcacaaggcccaguuccccagcgacgaggaguacggcuucugguccagcgacgagaaggagcaguuccggaucuaccgcguggacaucuccgacacccugauguacgucuacgagaugcucggggcggagcugcugagcaaccucuacgacaagcugggccggcugcucaccuccagcgaggagcccuacuccuggcagcacaccgaggcccugcuguacggcuuccagagcaucgccgagacgaucgacgugaacuacuccgacguggucccggggcucaucggccugaucccccgcaucagcaucuccaacgugcagcuggccgacaccgugauguucaccaucggggcgcucagcgaguggcuggccgaccaccccgucaugaucaacuccgugcugccccucgugcugcacgcccugggcaacccggagcucagcgucagcuccgugagcacccugaagaagaucugccgggagugcaaguacgaccugccgcccuacgccgccaacaucguggcggucucccaggacgugcucaugaagcagauccacaagacgagccagugcauguggcugaugcaggcccugggguuccuccuguccgcccuccagguggaggagauccugaagaaccugcacagccugaucucccccuacauccagcagcucgagaagcuggccgaggagauccccaaccccagcaacaagcuggccaucguccacauccucggccugcuguccaaccucuucaccacccuggacaucagccaccacgaggacgaccacgagggccccgagcugcgcaagcugcccgugccgcaggggcccaaccccgucguggugguccuccagcaggucuuccagcugauccagaaggugcuguccaaguggcucaacgacgcccaggugguggaggcggugugcgccaucuucgagaaguccgucaagacccugcuggacgacuucgcccccauggugccgcagcucugcgagaugcugggccggauguacagcacgaucccccaggccagcgcgcuggaccucacccgccagcuggugcacaucuucgcccacgagcccgcccacuucccgcccaucgaggcccuguuccuccuggucaccuccgugacccugacccucuuccagcaggggccccgggaccaccccgacaucguggacagcuucaugcagcugcuggcccaggcgcucaagcgcaagcccgaccuguuccugugcgagcggcucgacgucaaggccguguuccagugcgccgugcuggcccugaaguucccggaggcgcccacggucaaggccuccugcggcuucuucaccgagcuccugccccgcugcggcgagguggagagcguggggaaggucgugcaggaggacggccggaugcugcucaucgccgugcuggaggccaucgggggccaggccucccgcagccugauggacugcuucgcggacauccucuucgcccugaacaagcacugcuucagccugcucuccauguggaucaaggaggcccugcagccgcccggguuccccagcgcccggcugucccccgagcagaaggacaccuucagccagcagauccuccgcgagcgggucaacaagcgccgggugaaggagauggugaaggaguucacgcugcugugccgcggccuccacggcaccgacuacaccgccgacuacuga

SEQ ID NO: 31665 - RNA, 3117 nt, Artificial Sequence
  derived and/or modified sequence opt1 from IPO7__Homo_sapiens__NP_006382
auggaccccaacaccaucaucgaggcccugcgcggcaccauggacccggcccuccgggaggcggccgagcgccagcugaacgaggcccacaagagccugaacuucguguccacgcuccugcagaucaccaugagcgagcagcuggaccuccccguccggcaggccggggugaucuaccugaagaacaugaucacccaguacuggcccgaccgcgagaccgcccccggcgacaucuccccguacacgauccccgaggaggaccggcacugcauccgcgagaacaucguggaggcgaucauccacagccccgagcugauccggguccagcucacgaccugcauccaccacaucaucaagcacgacuaccccucccgcuggaccgccaucguggacaagaucggguucuaccugcagagcgacaacuccgccugcuggcugggcauccuccugugccuguaccagcucgugaagaacuacgaguacaagaagccggaggagcggagcccccuggucgccgcgaugcagcacuuccugcccgugcucaaggaccgcuucauccagcugcuguccgaccagagcgaccaguccgugcucauccagaagcagaucuucaagaucuucuacgcccugguccaguacacccugccccucgagcugaucaaccagcagaaccugaccgaguggaucgagauccucaagaccguggugaaccgggacgucccgaacgagacccuccagguggaggaggacgaccgccccgagcugcccugguggaagugcaagaagugggcccuccacauccuggcccggcuguucgagcgcuacgggagccccggcaacguguccaaggaguacaacgaguucgccgaggucuuccucaaggcguucgccgugggcgugcagcagguccugcugaaggugcucuaccaguacaaggagaagcaguacauggccccgcgggugcugcagcagacgcugaacuacaucaaccagggggucagccacgcccucaccuggaagaaccugaagccccacauccagggcaucauccaggacgugaucuucccccugaugugcuacaccgacgccgacgaggagcucuggcaggaggaccccuacgaguacauccgcaugaaguucgacguguucgaggacuucaucuccccgaccacggcggcccagacccugcuguucaccgccugcagcaagcggaaggagguccuccagaagaccaugggguucugcuaccagauccugacggagcccaacgccgacccccgcaagaaggacggcgcccugcacaugaucgggucccucgcggagauccugcugaagaagaagaucuacaaggaccagauggaguacaugcugcagaaccacguguucccccucuucagcuccgagcugggcuacaugcgggcccgcgccugcuggguccugcacuacuucugcgaggugaaguucaagagcgaccagaaccuccagaccgcccuggagcugacccggcgcugccucaucgacgaccgcgagaugccggugaaggucgaggccgcgaucgcccuccaggugcugaucagcaaccaggagaaggccaaggaguacaucacccccuucauccggcccgugaugcaggcccuccugcacaucauccgcgagacggagaacgacgaccugaccaacgucauccagaagaugaucugcgaguacuccgaggaggugacccccaucgcgguggagaugacccagcaccucgccaugacguucaaccaggucauccagaccggcccggacgaggaggggagcgacgacaaggccgugaccgccaugggcauccugaacaccaucgacacgcugcucuccguggucgaggaccacaaggagaucacccagcagcuggaggggaucugccuccaggugaucggcaccgugcugcagcagcacguccuggaguucuacgaggagaucuucagccuggcccacucccugaccugccagcaggucagcccccagauguggcagcugcugccccucguguucgagguguuccagcaggacggcuucgacuacuucacggacaugaugccgcugcugcacaacuacgugaccguggacaccgacacccuccuguccgacaccaaguaccuggagaugaucuacagcaugugcaagaagguccucacggggguggcgggcgaggacgccgagugccacgccgccaagcugcuggaggugaucauccuccagugcaaggggcggggcaucgaccagugcaucccccuguucgucgaggccgcgcuggagcgccucacccgggaggugaagaccuccgagcugcgcaccaugugccuccagguggccaucgccgcccuguacuacaacccccaccuccugcugaacacgcuggagaaccugcgguuccccaacaacgucgagccggugaccaaccacuucaucacccaguggcucaacgacguggacugcuuccuggggcugcacgaccgcaagaugugcguccucggccugugcgcccugaucgacauggagcagaucccccaggugcucaaccaggugagcggccagauccugcccgcguucauccugcuguucaacgggcugaagcgggccuacgccugccacgccgagcacgagaacgacuccgacgacgacgacgaggcggaggacgacgacgagaccgaggagcugggcagcgacgaggacgacaucgacgaggacgggcaggaguaccucgagauccuggccaagcaggccggcgaggacggggacgacgaggacugggaggaggacgacgccgaggagacggcccuggagggcuacuccaccaucaucgacgacgaggacaaccccgucgacgaguaccagaucuucaaggcgaucuuccagaccauccagaaccgcaacccggugugguaccaggcccucacccacggccugaacgaggagcagcggaagcagcugcaggacaucgccacgcucgccgaccagcgccgggccgcgcacgagagcaagaugaucgagaagcacgggggcuacaaguucuccgcccccgugguccccagcuccuucaacuucgggggccccgccccggggaugaacuga

SEQ ID NO: 31666 - RNA, 2499 nt, Artificial Sequence
  derived and/or modified sequence opt1 from IPO8__Homo_sapiens__NP_001177924
auggagagccugacccucaagggcuacgcccugccccugcagcucgugaacaaccagaccaugacgaccuggauggagaucuuccgcaccaucaucgaccggaccgucccgcccgagacgcugcacaucgacgaggacgaccgccccgagcuggugugguggaagugcaagaagugggcccuccacaucguggcgcggcuguucgagcgcuacgggucccccggcaacgucaccaaggaguacuucgaguucagcgaguucuuccugaagaccuacgccguggggauccagcagguccuccugaagauccuggaccaguaccggcagaaggaguacguggccccgcgcgugcuccagcaggccuucaacuaccugaaccagggcgugguccacuccaucaccuggaagcagaugaagccccacauccagaacaucagcgaggacgugaucuucuccgugaugugcuacaaggacgaggacgaggagcuguggcaggaggaccccuacgaguacauccggaugaaguucgacaucuucgaggacuacgccagccccacgaccgcggcccagacccuccuguacaccgccgccaagaagcgcaaggagguccugccgaagaugauggcguucugcuaccagauccucacggaccccaacuucgacccccggaagaaggacggggcccugcacgugaucggcucccuggccgagauccuccugaagaagucccuguucaaggaccagauggagcuguuccugcagaaccacguguucccccugcuccuguccaaccugggcuaccuccgcgcccggagcugcuggguccugcacgccuucuccagccugaaguuccacaacgagcucaaccugcgcaacgcgguggagcuggccaagaagucccucaucgaggacaaggagaugccggugaaggucgaggccgcccuggcccugcagagccucaucuccaaccagauccaggcgaaggaguacaugaagccccacgugcggcccaucaugcaggagcugcugcacaucgugcgcgagaccgagaacgacgacgucaccaacgugauccagaagaugaucugcgaguacagccaggagguggccuccaucgccgucgacaugacccagcaccucgccgagaucuucgggaaggugcugcagagcgacgaguacgaggaggucgaggacaagacggugauggccaugggcauccugcacaccaucgacaccauccucaccguggucgaggaccacaaggagaucacgcagcagcuggagaacaucugccugcggaucaucgaccucgugcugcagaagcacgugaucgaguucuacgaggagauccugucccuggcguacagccugaccugccacagcaucagcccccagauguggcagcuccuggggauccucuacgaggucuuccagcaggacugcuucgaguacuucaccgacaugaugccgcugcugcacaacuacgugaccaucgacacggacacccuccugagcaacgccaagcaccuggagauccucuucaccaugugccgcaaggugcugugcggcgacgccggggaggacgccgagugccacgccgcgaagcugcucgaggucaucauccugcagugcaagggccggggcaucgaccagugcaucccccuguucgugcagcucgugcuggagcgccugacccgcggggucaagacguccgagcuccggaccaugugccuccagguggccaucgccgcccuguacuacaaccccgaccuccugcugcacacccucgagcggauccagcugccccacaacccgggccccaucaccgugcaguucaucaaccaguggaugaacgacacggacugcuuccuggggcaccacgaccgcaagaugugcaucaucggccucagcauccugcuggagcuccagaaccgcccgcccgcggucgacgccguggugggccagaucguccccuccauccuguuccuguuccucgggcugaagcaggucugcgccacccggcagcuggugaaccgcgaggaccggagcaaggccgagaaggccgacauggaggagaacgaggagaucuccagcgacgaggaggagaccaacgugaccgcgcaggccaugcaguccaacaacggccgcggggaggacgaggaggaggaggacgacgacugggacgaggaggugcucgaggagacggcccuggagggcuucagcacgccccuggaccucgacaacuccguggacgaguaccaguucuucacccaggcccugaucaccguccagagccgggacgccgcgugguaccagcugcucauggcgccccuguccgaggaccagcgcaccgcccugcaggagguguacacccucgccgagcaccggcgcaccguggccgaggccaagaagaagaucgagcagcagggcggguucaccuucgagaacaagggcguccugagcgccuucaacuucgggaccgugcccuccaacaacuga

SEQ ID NO: 31667 - RNA, 3126 nt, Artificial Sequence
  derived and/or modified sequence opt1 from IPO9__Homo_sapiens__NP_060555
auggccgccgcggccgccgccggcgccgcgagcgggcugcccggcccgguggcccaggggcucaaggaggcccuggucgacacccugaccggcauccucucccccgugcaggaggugcgcgccgcggccgaggagcagaucaagguccuggaggugacggaggaguucggggugcaccuggccgagcucaccgucgacccccagggcgcccuggccauccggcagcuggcgagcgugauccucaagcaguacguggagacccacuggugcgcccaguccgagaaguuccggcccccggagaccacggagcgcgccaagaucgucauccgcgagcugcugcccaacggccuccgggagagcaucuccaaggugcgcagcuccguggccuacgccgucagcgcgaucgcccacugggacuggcccgaggccuggccccagcuguucaaccugcucauggagaugcugguguccggggaccugaacgccgugcacggcgccaugcggguccucaccgaguucacccgcgaggugaccgacacgcagaugccgcugguggcgcccgucauccugcccgagauguacaagaucuucaccauggccgagguguacgggauccggacccgcagccgggccguggagaucuucaccacgugcgcccacaugaucugcaacauggaggagcucgagaagggcgccgcgaagguccugaucuuccccguggugcagcaguucaccgaggccuucguccaggcccugcagaucccggacgggcccaccuccgacagcggcuucaagauggaggugcucaaggccgucaccgcgcuggugaagaacuuccccaagcacaugguguccagcaugcagcagauccugcccaucgucuggaacacgcucaccgaguccgccgccuucuacgugcgcaccgaggugaacuacaccgaggaggucgaggacccgguggacagcgacggcgaggugcugggguucgagaaccuggucuucuccaucuucgaguucgugcacgcccuccuggagaacagcaaguucaaguccacggugaagaaggcccugcccgagcucaucuacuacaucauccuguacaugcagaucaccgaggagcagaucaaggucuggaccgcgaacccccagcaguucguggaggacgaggacgacgacaccuucagcuacacggugcggaucgccgcccaggaccugcuccuggccgucgccaccgacuuccagaacgagagcgcggccgcccuggccgccgcggccacccgccaccuccaggaggccgagcagaccaagaacuccggcacggagcacugguggaagauccacgaggccugcaugcuggcgcuggggagcgugaaggccaucaucaccgacuccgugaagaacggccggauccacuucgacaugcacggcuuccucaccaacgucauccuggccgaccugaaccucagcgugucccccuuccugcuggggcgcgcccucugggccgcgagccgguucaccguggccauguccccggagcugauccagcaguuccugcaggccacggucagcggccugcacgagacccagccgcccuccgugcgcaucagcgccgugcgggccaucuggggguacugcgaccagcucaaggucuccgagagcacccacgugcugcagcccuuccugcccuccauccucgacggccugauccaccuggcggcccaguucagcuccgaggugcucaaccuggucauggagacccugugcaucgugugcacgguggaccccgaguucaccgccagcauggaguccaagaucugccccuucaccaucgccaucuuccucaaguacagcaacgaccccgucguggccucccuggcgcaggacaucuucaaggagcugagccagaucgaggccugccaggggccgaugcagaugcgccucauccccacccuggugagcaucaugcaggcccccgccgacaagaucccggcgggccugugcgccaccgccaucgacauccucacgaccgucgugcggaacaccaagccgccccugucccagcugcucaucugccaggccuuccccgccguggcgcagugcacccugcacacggacgacaacgccaccaugcagaacggcggggagugccugcgcgccuacgucagcgugacccucgagcaggucgcccaguggcacgacgagcagggccacaacgggcugugguacgugaugcaggucgugucccagcugcucgacccccgcaccagcgaguucacggccgcguucgugggccggcugguguccacccugaucagcaaggccgggcgcgagcucggcgagaaccuggaccagauccugcgggccauccucuccaagaugcagcaggccgagacccugagcgugaugcagucccugaucauggucuucgcccaccucgugcacacccagcuggagccccugcucgaguuccugugcagccugcccggccccacggggaagccggcgcucgaguucgugauggccgaguggaccucccgccagcaccuguucuacggccaguacgaggggaaggucagcuccguggcccugugcaagcuccugcagcacggcaucaacgccgacgacaagcggcugcaggacauccgcgugaagggggaggagaucuacagcauggacgagggcauccggacccgcuccaagagcgccaagaaccccgagcgguggaccaacaucccccuccuggucaagauccugaagcucaucaucaacgagcuguccaacgugauggaggcgaacgccgcccgccaggccacgcccgcggaguggagccaggacgacagcaacgacaugugggaggaccaggaggaggaggaggaggaggaggaggacggccuggccgggcagcuccuguccgacauccuggccaccagcaaguacgaggaggacuacuacgaggacgacgaggaggacgacccggacgcccucaaggacccccuguaccagaucgaccugcaggccuaccucaccgacuuccugugccaguucgcgcagcagcccugcuacaucauguucuccggccaccugaacgacaacgagcggcgcguccuccagaccaucgggaucuga

SEQ ID NO: 31668 - RNA, 1797 nt, Artificial Sequence
  derived and/or modified sequence opt1 from IQCB1__Homo_sapiens__NP_001018864
augaagcccaccggcaccgacccccgcauccugagcaucgccgccgagguggcgaagucccccgagcagaacguccccgugauccuccugaagcugaaggagaucaucaacaucacgccccucgggagcuccgagcugaagaagaucaagcaggacaucuacugcuacgaccugauccaguacugccuccuggugcugagccaggacuacucccggauccagggcggguggaccaccaucagccagcucacccagauccugucccacugcugcgucggccuggagccgggggaggacgccgaggaguucuacaacgagcuccugcccagcgccgccgagaacuuccuggugcucggccgccagcugcagacgugcuucaucaacgccgcgaaggccgaggagaaggacgagcugcuccacuucuuccagaucgugaccgacucccuguucuggcugcucggcgggcacgucgagcugauccagaacgugcugcagagcgaccacuuccuccaccuccugcaggccgacaacgugcagaucggcuccgccgucaugaugaugcuccagaacauccugcagaucaacagcggggaccugcuccggaucggccgcaaggcgcuguacuccauccuggacgaggugaucuucaagcuguucagcacccccucccccgugauccggagcaccgccacgaagcugcugcuccugauggccgagucccaccaggagauccugauccuccugcgccagagcacgugcuacaaggggcugcggcgccuccuguccaagcaggagaccggcaccgaguucagccaggagcugcggcagcucgucggccugcugagcccgaugguguaccaggagguggaggagcagaagcuccaccaggccgccugccugauccaggcguacuggaagggguuccagacccgcaagcggcugaagaagcugcccuccgccgucaucgcccuccagcgcagcuuccgguccaagcgcagcaagaugcugcuggagaucaaccggcagaaggaggaggaggaccucaagcugcagcugcagcuccagcgccagcgggccaugcgccugucccgggagcugcagcucagcaugcuggagaucgugcaccccggccagguggagaagcacuaccgcgagauggaggagaaguccgcccugaucauccagaagcacuggcggggguaccgcgagcgcaagaacuuccaccagcagcggcagagccucaucgaguacaaggcggccgucacccugcagcgcgccgcccugaaguuccucgccaagugccggaagaagaagaagcuguucgcgcccuggcgcggccugcaggagcucaccgacgcccggcgcguggagcugaagaagcggguggacgacuacguccgccggcaccugggcuccccgaugagcgacguggugucccgcgagcuccacgcccaggcccaggagcggcugcagcacuacuucauggggcgcgcccuggaggagcgggcgcagcagcaccgcgaggcccucaucgcccagaucagcaccaacgucgagcagcugaugaaggcccccucccugaaggaggcggagggcaaggagcccgagcuguuccucagccggucccgccccguggccgccaaggccaagcaggcccaccugacgacccucaagcacauccaggcgccgugguggaagaagcugggggaggagagcggcgacgagaucgacguccccaaggacgagcuguccaucgagcucgagaaccuguucaucgggggcaccaagccgcccuga

SEQ ID NO: 31669 - RNA, 1332 nt, Artificial Sequence
  derived and/or modified sequence opt1 from IQCG__Homo_sapiens__NP_001127907
auggaggaggacagccuggaggacuccaaccugcccccgaagguguggcacagcgagaugaccgucuccgugaccggcgagccgcccagcacgguggaggaggaggggauccccaaggagaccgacaucgagaucauccccgagauccccgagacccuggagccccugucccuccccgacguccugcgcaucagcgccgugcuggaggacaccacggaccagcucuccauccugaacuacaucaugccggugcaguacgagggccggcagagcaucugcgucaagucccgcgagaugaaccuggaggggaccaaccucgacaagcugcccauggccagcaccaucaccaagauccccagcccccugaucacggaggagggcccgaaccuccccgagauccggcaccgcgggcgguucgcgguggaguucaacaagaugcaggaccugguguucaagaagcccacccgccagaccaucaugaccacggagacccugaagaagauccagaucgaccggcaguucuucagcgacgucaucgccgacaccaucaaggagcuccaggacuccgccaccuacaacagccugcugcaggcccucuccaaggagcgcgagaacaagaugcacuucuacgacaucaucgcccgggaggagaagggccgcaagcagaucaucagccugcagaagcagcugaucaacgugaagaaggaguggcaguucgaggugcagucccagaacgaguacaucgcgaaccucaaggaccagcugcaggagaugaaggccaagagcaaccuggagaaccgguacaugaagacgaacaccgagcuccagaucgcccagacccagaagaagugcaaccgcaccgaggagcugcuggucgaggagaucgagaagcuccggaugaagacggaggaggaggcccgcacccacaccgagaucgagauguuccugcggaaggagcagcagaagcuggaggagcgccucgaguucuggauggagaaguacgacaaggacaccgagaugaagcagaacgagcugaacgcgcugaaggccacgaaggccuccgaccucgcccaccuccaggaccuggccaagaugauccgggaguacgagcaggucaucaucgaggaccgcaucgagaaggagcggagcaagaagaaggugaagcaggaccuccuggagcugaaguccgugaucaagcuccaggcgugguggcgcggcaccaugauccggcgcgagaucgggggcuucaagaugcccaaggacaagguggacuccaaggacagcaaggggaagggcaaggggaaggacaagcgccggggcaagaagaaguga

SEQ ID NO: 31670 - RNA, 3084 nt, Artificial Sequence
  derived and/or modified sequence opt1 from IQCH__Homo_sapiens__NP_001026885
auggcccagaacaccgagaaccacgaccccgugggcagcauccugauccagauccacgaggaccucuaccagcugaaggagaagcugaccaaguucuccccggaggagaagggggagacgcucgacauccagagccuggagaccgccaucaagcgcaccgaggucggccugcggauccacaucgagaaguaccucaacguggugaaccagaacguccugaccacguccgugaacgacgagagccuguacacgccccaggcguccaaguggcuccugcccaccgugaucgaccagaaguccuucaucuucccccaggagagcgaggggaccuucuggcagccgcagcgccagcacagcuccagccugcccgucuucccccgggccaagaucaagguguccaagcucaucaagggcagcaacaucuccagccugaccgugcugcccuccagccacugcaccgacccguacuucacccccauccccguccuccaggccgacgcccacaaggggauccuguccaugaucgagcgcggccugaucccgcccaccgcccggaucacguuccagaacccgcccaucacgccccgcgcggcgccccuccacagcuucgacgaggcccggaagauccccaccguggccaccuucaccaucccccgcgagcccccgcccucccccgccgaggugaaguucuuccccaagaagcagcggagcaagggcaagagccgccggucccgcgggcaccacgaccggaaggccaugaaggucaagaccccgcugcgcgcccucaagagccugugggacuacgacuuccugaucuacgacggcgugaucgacaacaccgcccccgacuuccuggccuucaaggagcacuucucccucgcguggggcgggaucuucagccugcuggagcacguggagaaguuccuccggaacuacgccauccccgaggucaagaucaaggggaacaaccugguggcccugcuccccgaguucgagcugaccaacaagcugacgcgcuacgaccuccuguccgugcuggaggacccggcccacguccagaugcucaucaaccugcccggccagcgguacaagggccaggacgggaacagcgaggccgcgaugaagauccaggccaccuggaagugcuacaaggcccgcaaguucuuccuguucuaccggcagcagaagugggccuccggcgugaucgccaucgcguggcuccuguacugccacaagacccgccugaagaagauccucaaggagagccggcagcgccaccuggagaacuuccgcauccgggccaagcaccuggccgccaacuggaaccgcauccggaccucccgccggacgaucauccacauccccagccucggguacucccagccggugcgcgagcacaucgccgacuucaacacccagcagaacaugcagcugggccggcugugcgacauccucgacgcgaacgucaacgugaucuacaucugcagccaccacaugaacgacgagcuggugcuguacuacaagaagauccugucccuccacgccgccgucaagagcggcaaccuggaggaccgcuccgaccugcaggaccgguucaagaucaucacccccgaggccgugaacaucuuccccaagcaccacaugugccucgcgacccaccugauguacagccccaaggccaucaagcgcaucaagaaccugauccgggggacggaggccuacaucgucuccggccuccugcaccgcgacgaccuggccguggccgacaugcucgacaucccgauccuggggagcgagcccgagcuggcgcaccucuacuccaccaagagcggcgggaagcggguguucgacagcgccaacgucgccgugccgcccggcaucuacgacaucuacucccagcagcagaugaucgagcagcugagccagcugaucaccgaccaccuccagauccagcgcuggcuguucaagauggacuccgaguuccggggcaacgggaccgccuucugcgacauccccagcuaccugaagugcuacaagugggugcucaaggaguccagccgcuacggccuggaggacuggcggaagaagugggcccaggagcccgcgcuggucaagaucuccgaggagcucgccgggauccuggcccagcacgcccagcccgugaacgagaagcgcuuccccacguggcggaaguuccugcagaccuuccucagccagggcggggugaucgaggccuucccgcccgcggacaacgucaccaaccugaccguggacaugcugaucgagcccaacggcaagaucuccgugcucagcacgggcgaccagcugcacgccgagucccccuucaucagcuccgggaccaccgucccgcagaccagcguggacccccaggugcugaccuaccucugccugcagaucggcaaggccugccgcaugcgcgacgucgugggguacuucuccaucgaccuggugacguucaucgaccccagcacccucgagcagcaggucugggccaccggccugaaccuggcguacuccgaccagcucgcccugacccagcugacgcucuaccugaccaacgggcaccuggacugcagccucagcacccuggaggugccccgguucgugccgaaggagcgcaagaagaccaagugcauguccgcccugagcaugcccaugcucgccacgucccgguacgccgucaugaccacccagcugcgccacagcaaccugucccucguguuccacuacguguuccugcagaucugccgggcgcacggcaucggcuacgaccuggaggagcgccaggggaccgucuucauccucuacgagcaccugaagcggcacaagcugggcaugcucacgaucggggaggaccugcagggcgugcugaugaccuucgcccgccaccucuucaucauccaccaggagaucagcgcccccaacaugcagggcgagaccaacuucaagaccacgaucgccgacaucgagaccauccugcgggugaccaaggagaacaagaugcgcuucgaggaggagcagcaguccaaggacgacaagaaccugagcaagcccaagaaguga

SEQ ID NO: 31671 - RNA, 480 nt, Artificial Sequence
  derived and/or modified sequence opt1 from IQCJ__Homo_sapiens__NP_001036170
augcgccuggaggagcucaagcggcugcagaacccccuggagcaggucaacgacggcaaguacagcuucgagaaccaccagcucgccauggacgccgagaacaacaucgagaaguacccgcugaaccugcagccccucgaguccaaggugaagaucauccagcgcgcguggcgggaguaccugcagcgccaggagccccuggggaagcggagccccuccccgcccagcguguccagcgagaagcucuccagcuccgugagcaugaacaccuucuccgacagcuccacccccuucgcccgcgcccccgucggcaagauccacccguacaucagcuggcggcugcagucccccggggacaagcugcccggcgggcgcaaggugauccuccuguaccuggaccagcucgcccggcccacgggcuucauccacacccugaaggagccgcagaucgagcgccugggcuuccucacccugcaguga

SEQ ID NO: 31672 - RNA, 1692 nt, Artificial Sequence
  derived and/or modified sequence opt1 from IQCJ-SCHIP1__Homo_sapiens__NP_001184042
augcgccuggaggagcucaagcggcugcagaacccccuggagcaggucaacgacggcaaguacagcuucgagaaccaccagcucgccauggacgccgagaacaacaucgagaaguacccgcugaaccugcagccccucgaguccaaggugaagaucauccagcgcgcguggcgggaguaccugcagcgccaggagccccuggggaagcggagccccuccccgcccagcguguccagcgagaagcucuccagcuccgugagcaugaacaccuucuccgacagcuccacccccgacuaccgcgaggacggcauggaccuggggagcgacgccggcuccagcuccagcuccagccgggccagcucccagagcaacuccacgaaggucacccccugcagcgagugcaaguccagcuccagccccgggggcucccuggaccucgugagcgcccuggaggacuacgaggagcccuuccccguguaccagaagaaggucaucgacgagugggcccccgaggaggacggcgaggaggaggaggaggaggacgagcgcgaccagcggggguaccgcgacgaccgguccccggcgcgcgagcccggcgacgugagcgcccggacccgcuccgggggcgggggcggccggagcgccaccacggccaugccgcccccggugcccaacgggaaccugcaccagcacgacccccaggaccuccgccacaacggcaacgucgugguggcggggcggcccuccugcagccgcggcccgcggcgcgccauccagaagccccagcccgccggcgggcggcgcuccggccgcgggcccgccgccggcgggcugugccugcagccgcccgacggcgggaccugcguccccgaggagcccccggugccgcccauggacugggaggcgcucgagaagcaccuggccggccugcaguuccgggagcaggaggugcgcaaccagggccaggcccggaccaacagcaccuccgcccagaagaacgagcgcgagagcauccggcagaagcucgcccuggggagcuucuucgacgacggccccgggaucuacacguccugcagcaaguccggcaagcccagccuguccagccgccuccaguccggcaugaaccugcagaucugcuucgucaacgacagcggguccgacaaggacagcgacgcggacgacuccaagaccgagaccagccuggacacgccccucucccccaugagcaagcaguccagcuccuacagcgaccgggacaccaccgaggaggagagcgagucccuggacgacauggacuuccugacccgccagaagaagcuccaggccgaggccaagauggcccuggccauggcgaagccgauggccaagaugcaggucgagguggagaagcagaaccggaagaagucccccguggccgaccugcucccccacaugccccacaucagcgagugccugaugaagcgcagccugaagccgaccgaccuccgggacaugacgaucggccagcuccaggugaucgugaacgaccugcacucccagaucgagagccugaacgaggagcugguccagcugcuccugauccgcgacgagcugcacaccgagcaggacgccaugcucguggacaucgaggaccugacccggcacgccgagucccagcagaagcacauggcggagaagaugcccgccaaguga

SEQ ID NO: 31673 - RNA, 864 nt, Artificial Sequence
  derived and/or modified sequence opt1 from IQCK__Homo_sapiens__NP_694940
auggccgcgccccgccagaucccgagccacaucgugcggcugaagcccuccugcagcaccgacuccagcuucacccgcacgcccguccccaccgugucccucgccagccgggagcugccgguguccagcuggcaggucaccgagcccuccagcaagaaccugugggagcagaucugcaaggaguacgaggccgagcagccgcccuuccccgagggcuacaaggugaagcaggagcccgugaucaccgucgcccccguggaggagaugcuguuccacggguucuccgccgagcacuacuuccccgugagccacuucacgaugaucucccgcaccccgugcccccaggacaagagcgagaccaucaaccccaagaccugcucccccaaggaguaccucgagacguucaucuucccgguccugcuccccggcauggccagccugcugcaccaggcgaagaaggagaagugcuucgagcggaagcgcaccaaguucaucgccugcgacuuccucaccgaguggcuguacaaccagaaccccaagcgggccggggagcccuucaccgaguucuucuccaucccguucguggaggagcgccugaagcagcacccccggccgcccaucccccucagccugcugcucacggaggaggaggccgcgcuguacauccaguccuucuggcgcgccugcgugguccggugcgaccccgagauccaggagcugcgccaguggcagaagaagcuccgggaggccaagcacauccaccagcaggucaagaucuucugggccaagcaggagcagaaggugaagugcaagauggaggacgacgccgugcccgcggccaagaugaagauccccagcagcuga

SEQ ID NO: 31674 - RNA, 4974 nt, Artificial Sequence
  derived and/or modified sequence opt1 from IQGAP1__Homo_sapiens__NP_003861
augagcgccgccgacgagguggacggccugggggucgcgcgcccccacuacggcuccgugcucgacaacgagcggcugaccgccgaggagauggacgagcgccggcgccagaacguggccuacgaguaccugugccaccucgaggaggccaagcgguggauggaggccugccugggggaggaccugccgcccaccacggagcucgaggagggccugcgcaacggggucuaccuggcgaagcucggcaacuucuucagccccaagguggugucccugaagaagaucuacgaccgggagcagacccgcuacaaggccaccggccugcacuuccggcacaccgacaacgucauccaguggcucaacgccauggacgagaucgggcugcccaagaucuucuacccggagacgaccgacaucuacgaccgcaagaacaugccccggugcaucuacugcauccacgcccugagccucuaccuguucaagcugggccucgcgccccagauccaggaccuguacgggaagguggacuucaccgaggaggagaucaacaacaugaagaccgagcuggagaaguacggcauccagaugcccgccuucuccaagaucgggggcauccucgccaacgagcugagcguggacgaggccgcccugcacgcggccgucaucgccaucaacgaggccaucgaccgccggaucccggccgacacguucgcggcccucaagaaccccaacgccaugcuggugaaccuggaggagccccucgccuccaccuaccaggacauccuguaccaggccaagcaggacaagaugaccaacgcgaagaaccgcaccgagaacagcgagcgggagcgcgacguguacgaggagcugcucacgcaggccgagauccagggcaacaucaacaaggucaacaccuucuccgcccuggccaacaucgaccuggcccucgagcagggggacgcgcuggcccuguuccgggcccuccagagccccgcccugggccugcgcgggcuccagcagcagaacuccgacugguaccugaagcagcugcucagcgacaagcagcagaagcggcaguccggccagaccgacccgcugcagaaggaggagcugcagagcggcguggacgcggccaacuccgccgcccagcaguaccagcgccggcucgccgcgguggcccugaucaacgccgccauccagaagggggucgccgagaagaccgugcuggagcucaugaaccccgaggcgcagcugccccagguguaccccuucgccgccgaccuguaccagaaggagcuggccacgcuccagcgccagagcccggagcacaaccugacccaccccgagcuguccgucgccguggagaugcucagcuccguggcgcugaucaaccgcgcccuggagagcggcgacgucaacaccguguggaagcagcucagcuccagcgugaccgggcugacgaacaucgaggaggagaacugccagcgguaccuggacgagcucaugaagcugaaggcccaggcccacgcggagaacaacgaguucaucaccuggaacgacauccaggccugcgucgaccacgugaaccuggucgugcaggaggagcacgagcgcauccucgccaucggccugaucaacgaggcccuggacgagggggacgcccagaagacccuccaggcgcugcagauccccgccgccaagcuggagggcgugcucgccgaggucgcccagcacuaccaggacacccugauccgggcgaagcgcgagaaggcccaggagauccaggacgaguccgccgugcuguggcucgacgagauccagggcgggaucuggcagagcaacaaggacacgcaggaggcccagaaguucgcccugggcaucuucgcgaucaacgaggccguggaguccggggacgucggcaagacccugagcgcccuccggucccccgacguggggcuguacggcgugaucccggagugcggcgagaccuaccacagcgaccuggccgaggcgaagaagaagaagcucgccgucggggacaacaacuccaagugggugaagcacugggugaagggcggguacuacuacuaccacaaccuggagacccaggagggcgggugggacgagccgcccaacuucguccagaacagcaugcagcugucccgcgaggagauccagagcuccaucagcggcgugacggccgccuacaaccgggagcagcucuggcuggccaacgagggccugaucacccgccuccaggcgcggugccgcggguaccuggugcggcaggaguuccgcucccggaugaacuuccugaagaagcagauccccgccaucacgugcauccagagccaguggcgcggcuacaagcagaagaaggccuaccaggaccggcucgccuaccugcgcucccacaaggacgaggucgugaagauccagagccuggcccggaugcaccaggcgcgcaagcgguaccgcgaccgccuccaguacuuccgggaccacaucaacgacaucaucaagauccaggccuucauccgcgccaacaaggcccgggacgacuacaagacccugaucaacgccgaggacccgcccaugguggucgugcgcaaguucgugcaccuccucgaccaguccgaccaggacuuccaggaggagcuggaccugaugaagaugcgggaggaggucaucacccucauccgcagcaaccagcagcuggagaacgaccugaaccucauggacaucaagaucgggcugcuggugaagaacaagaucacccuccaggacguggucagccacuccaagaagcugaccaagaagaacaaggagcagcugagcgacaugaugaugaucaacaagcagaagggcggccucaaggcgcuguccaaggagaagcgggagaagcuggaggccuaccagcaccucuucuaccugcugcagaccaaccccacguaccucgccaagcugaucuuccagaugccccagaacaagagcaccaaguucauggacuccgugaucuucacccuguacaacuacgccagcaaccagcgcgaggaguaccuccugcugcgccucuucaagaccgcccugcaggaggagaucaaguccaagguggaccagauccaggagaucgucaccgggaaccccacggugaucaagaugguggucagcuucaaccggggcgcgcgggggcagaacgcccugcgccagauccucgcccccguggugaaggagaucauggacgacaagucccugaacaucaagaccgaccccgucgacaucuacaagagcugggugaaccagauggagucccagaccggcgaggccagcaagcugccguacgacgugacccccgagcaggcgcucgcccacgaggaggucaagacgcggcuggacuccagcauccgcaacaugcgggccgugaccgacaaguuccuguccgccaucgugagcuccgucgacaagauccccuacgggaugcgcuucaucgccaaggugcucaaggacagccugcacgagaaguuccccgacgcgggcgaggacgagcugcucaagaucaucggcaaccugcuguacuaccgguacaugaacccggccaucguggcccccgacgccuucgacaucaucgaccucagcgccgggggccagcugaccaccgaccagcgccggaaccugggguccaucgcgaagaugcuccagcacgccgccagcaacaagauguuccugggcgacaacgcccaccuguccaucaucaacgaguaccucagccaguccuaccagaaguuccgccgguucuuccagacggccugcgacguccccgagcugcaggacaaguucaacguggacgaguacagcgaccuggugacccucaccaagcccgucaucuacaucuccaucggggagaucaucaacacccacacgcugcugcucgaccaccaggacgcgaucgccccggagcacaacgaccccauccacgagcugcuggacgaccugggcgaggugcccaccaucgagagccucaucggcgaguccagcgggaaccugaacgaccccaacaaggaggcccuggccaagaccgaggugucccucacccugacgaacaaguucgacgucccgggcgacgagaacgcggagauggacgcccgcaccauccugcucaacaccaagcgccugaucguggacgugauccgguuccagcccggggagacccugacggagauccucgagacccccgccaccagcgagcaggaggccgagcaccagcgcgccaugcagcggcgcgcgauccgggacgccaagacccccgacaagaugaagaaguccaagagcgucaaggaggacuccaaccugacgcugcaggagaagaaggagaagauccagaccggccucaagaagcugaccgagcuggggaccguggacccgaagaacaaguaccaggagcucaucaacgacaucgcccgcgacauccggaaccagcgccgguaccgccagcggcgcaaggccgagcuggucaagcugcagcagacguacgccgcgcucaacagcaaggccaccuucuacggcgagcaggucgacuacuacaaguccuacaucaagaccugccuggacaaccuggccagcaagggcaagguguccaagaagccccgggagaugaaggggaagaaguccaagaagaucagccucaaguacaccgccgcccgccugcacgagaagggcgugcugcucgagaucgaggaccuccaggugaaccaguucaagaacgugaucuucgagaucagccccacggaggaggucggggacuucgaggugaaggcgaaguucaugggcgugcagauggagaccuucaugcugcacuaccaggaccugcugcagcugcaguacgagggggucgccgugaugaagcuguucgaccgggccaaggugaacgucaaccugcugaucuuccuccugaacaagaaguucuacggcaaguga

SEQ ID NO: 31675 - RNA, 3216 nt, Artificial Sequence
  derived and/or modified sequence opt1 from IQGAP2__Homo_sapiens__NP_001272390
augcacagccugcccggcguggucgccgugggguacaucaacgaggccaucgacgagggcaacccgcuccgcacccuggagacccugcuccugcccacggcgaacaucuccgacguggaccccgcccacgcccagcacuaccaggacguccuguaccacgccaagagccagaagcucggggacuccgagagcguguccaaggugcuguggcuggacgagauccagcaggccgucgacgacgcgaacguggacgaggaccgggccaagcagugggugacccucgucguggacgugaaccagugccuggagggcaagaaguccagcgacauccugagcguccucaaguccagcaccuccaacgccaacgacaucauccccgagugcgccgacaaguacuacgacgcgcuggugaaggccaaggagcucaagagcgagcgcguguccagcgacggguccuggcugaagcugaaccugcacaagaaguacgacuacuacuacaacaccgacagcaaggaguccagcugggucacgccggaguccugccucuacaaggagagcuggcugaccggcaaggagaucgaggccuucuggaagggcuacaagcagcggaaggaguacaugcaccgccggcagaccuucaucgacaacaccgacagcaucgugaagauccaguccugguuccgcauggccacggcccgcaagagcuaccugucccggcuccaguacuuccgggaccacaacaacgagaucgugaagauccagagccugcugcgcgcgaacaaggcccgggacgacuacaagacccucgucggguccgagaacccgccccugaccgugauccgcaaguucguguaccugcucgaccagagcgaccuggacuuccaggaggagcuggaggucgcccggcuccgcgaggagguggugaccaagauccgggccaaccagcagcuggagaaggaccugaaccucauggacaucaagaucggccugcuggucaagaaccgcaucacgcucgaggacgugaucucccacagcaagaagcugaacaagaagaagggcggggagauggagauccugaacaacaccgacaaccaggggaucaagucccucagcaaggagcggcgcaagacccuggagaccuaccagcagcuguucuaccuccugcagacgaacccccuguaccucgccaagcugaucuuccagaugccccagaacaaguccaccaaguucauggacaccgucaucuucacccuguacaacuacgcgagcaaccagcgggaggaguaccuccugcugaagcuguucaagacggcccucgaggaggagaucaaguccaagguggaccaggugcaggacaucgucaccggcaaccccaccgugaucaagaugguggucagcuucaaccgcggcgcccgggggcagaacacccugcgccagcugcucgcccccguggugaaggagaucaucgacgacaagucccugaucaucaacacgaaccccgucgagguguacaaggccugggugaaccagcuggagacccagaccggcgaggcgagcaagcucccguacgacgucaccacggagcaggcccugaccuaccccgaggugaagaacaagcuggaggccuccaucgagaaccuccgccgggugaccgacaagguccugaacagcaucaucuccagccuggaccuccugcccuacgggcugcgcuacaucgccaaggugcucaagaacagcauccacgagaaguuccccgacgccaccgaggacgagcugcugaagaucgugggcaaccuccuguacuaccgguacaugaacccggcgaucgucgcccccgacggcuucgacaucaucgacaugacggccgggggccagaucaacuccgaccagcgccggaaccuggggagcguggccaaggugcuccagcacgcggccuccaacaagcuguucgagggcgagaacgagcaccugagcuccaugaacaacuaccucagcgagaccuaccaggaguuccgcaaguacuucaaggaggccugcaacguccccgagcccgaggagaaguucaacauggacaaguacaccgaccuggugaccguguccaagccggucaucuacaucagcaucgaggagaucaucuccacgcacagccugcuccuggagcaccaggacgccaucgcccccgagaagaacgaccugcucuccgagcugcuggggagccucggcgaggugcccaccguggaguccuuccugggcgagggggcggucgaccccaacgacccgaacaaggccaacacccugagccagcucuccaagaccgagaucagccuggugcugaccuccaaguacgacaucgaggacggcgaggccaucgacagccggagccucaugaucaagacgaagaagcugaucaucgacgugauccgcaaccagcccgggaacacccugaccgagauccucgagacccccgccacggcccagcaggaggucgaccacgcgaccgacauggugucccgggccaugaucgacagccgcacccccgaggagaugaagcacucccagagcaugaucgaggacgcccagcugccgcuggagcagaagaagcggaagauccagcgcaaccuccggacccuggagcagacgggccacguguccagcgagaacaaguaccaggacauccugaacgagaucgccaaggacauccgcaaccagcggaucuaccgcaagcuccggaaggccgagcuggcgaagcugcagcagacccucaacgcccugaacaagaaggccgccuucuacgaggagcagaucaacuacuacgacaccuacaucaagaccugccuggacaaccucaagcgcaagaacacgcggcgcuccaucaagcuggacgggaagggcgagcccaagggcgcgaagcgcgccaagcccgucaaguacaccgccgccaagcugcacgagaagggggugcuccuggacaucgacgaccugcagaccaaccaguucaagaacgugaccuucgacaucaucgccacggaggacgucggcaucuucgacgugcggagcaaguuccucgggguggagauggagaagguccagcugaacauccaggaccugcuccagaugcaguacgagggcguggcggugaugaagauguucgacaaggucaaggugaacgugaaccugcugaucuaccuccugaacaagaaguucuacgggaaguga

SEQ ID NO: 31676 - RNA, 4896 nt, Artificial Sequence
  derived and/or modified sequence opt1 from IQGAP3__Homo_sapiens__NP_839943
auggagcgccgggccgccggccccgggugggcggccuacgagcgccugaccgccgaggagauggacgagcagcggcgccagaacguggccuaccaguaccucugccggcuggaggaggccaagcgcuggauggaggcgugccugaaggaggagcucccgagccccgucgagcuggaggagucccugcggaacggcgugcuccuggccaagcuggggcacugcuucgcccccagcguggucccccucaagaagaucuacgacguggagcagcugcgcuaccaggccaccggccugcacuuccggcacacggacaacaucaacuucuggcucuccgcgaucgcccacaucgggcugccgagcaccuucuuccccgagaccaccgacaucuacgacaagaagaacaugccccgcguggucuacugcauccacgcccugucccucuuccuguuccggcugggccucgcgccccagauccacgaccuguacggcaaggugaaguucacggccgaggagcugagcaacauggccuccgagcucgccaaguacgggcugcagcugccggccuucagcaagaucggcgggauccucgccaacgagcuguccguggacgaggccgcgguccacgccgccgugcuggccaucaacgaggccguggagcgcggcgucguggaggacacccucgcggcccugcagaaccccagcgcccugcucgagaaccugcgggagccccuggccgccguguaccaggagaugcucgcgcaggccaagauggagaaggccgccaacgcgcgcaaccacgacgaccgggagucccaggacaucuacgaccacuaccugacccaggccgagauccaggggaacaucaaccacgucaacgugcacggcgcccuggagguggucgacgacgcccucgagcgccagagccccgaggcccugcugaaggcgcuccaggacccggcccuggcccugcggggcgugcgccgggacuucgccgacugguaccucgagcagcugaacuccgaccgcgagcagaaggcccaggagcuggggcucguggagcugcuggagaaggaggagguccaggcgggcguggccgccgccaacaccaagggggaccaggagcaggccaugcuccacgcggugcagcggaucaacaaggccauccgccgcggcgucgccgccgacacggugaaggagcugaugugccccgaggcgcagcugccgcccgucuaccccguggccagcuccauguaccagcuggagcucgccgugcugcagcagcagcagggcgagcuggggcaggaggagcuguucgucgccguggagaugcugagcgccgugguccugaucaaccgggcgcucgaggcccgcgacgccuccggcuucuggagcucccuggugaaccccgccaccgggcuggccgagguggagggcgagaacgcgcagcgguacuucgacgcccuccugaagcugcgccaggagcgggggaugggcgaggacuuccucagcuggaacgaccugcaggccaccgucagccaggugaacgcccagacccaggaggagacggaccgcgugcuggccgucucccucaucaacgaggcgcuggacaagggcagccccgagaagacccuguccgcccuccugcugcccgccgccgggcucgacgacgugagccugccgguggcgccccgguaccaccuccuccuggucgccgccaagcgccagaaggcccaggugaccggcgaccccggggccgugcuguggcucgaggagauccggcagggcgucgugcgcgcgaaccaggacaccaacacggcccagcggauggcccuggggguggccgccaucaaccaggcgaucaaggagggcaaggccgcccagaccgagcgcguccugcggaaccccgccguggcccuccgcggcguggucccggacugcgcgaacggguaccagcgggcccuggaguccgccauggccaagaagcagcgccccgccgacaccgcguucugggugcagcacgacaugaaggacggcaccgccuacuacuuccaccuccagacguuccaggggaucugggagcagccgcccggcugcccccugaacaccagccaccugacccgggaggagauccaguccgccgugaccaaggucacggccgcguacgaccgccagcagcuguggaaggccaacgugggguucgugauccagcuccaggcccggcugcgcggcuuccugguccgccagaaguucgccgagcacagccacuuccuccggaccuggcugcccgccgugaucaagauccaggcgcacuggcgcggcuaccggcagcgcaagaucuaccuggaguggcuccaguacuucaaggccaaccuggacgccaucaucaagauccaggccugggcccggaugugggcggcccgccggcaguaccugcgccggcuccacuacuuccagaagaacgugaacuccaucgucaagauccaggccuucuuccgcgcccggaaggcccaggacgacuaccgcauccuggugcacgcgccccacccgccccugagcgugguccggcgcuucgcccaccuccugaaccagucccagcaggacuuccuggccgaggccgagcuccugaagcugcaggaggagguggugcggaagauccgcagcaaccagcagcucgagcaggaccugaacaucauggacaucaagaucgggcugcucgucaagaaccggaucacccugcaggagguggugucccacugcaagaagcugaccaagcgcaacaaggagcagcucagcgacaugaugguccuggacaagcagaagggccugaagucccucagcaaggagaagcggcagaagcuggaggcguaccagcaccuguucuaccuccugcagacgcagcccaucuaccuggccaagcucaucuuccagaugccccagaacaagaccaccaaguucauggaggccgugaucuucucccuguacaacuacgccagcucccgccgggaggccuaccugcuccugcagcuguucaagaccgcgcuccaggaggagaucaagagcaagguggagcagccgcaggacgucgugacggggaaccccaccgugguccgccugguggugcgcuucuaccggaacggccgcggccagagcgcccugcaggagauccucgggaaggucauccaggacgugcuggaggacaagguccuguccgugcacaccgaccccgugcaccucuacaagaacuggaucaaccagaccgaggcccagacgggccagcggagccaccuccccuacgacgucaccccggagcaggcccugucccaccccgaggugcagcgccggcuggacaucgcccugcgcaaccugcucgcgaugaccgacaaguuccugcuggccaucaccagcuccguggaccagauccccuacgggaugcgguacgucgccaaggugcucaaggccacccuggccgagaaguuccccgacgcgacggacagcgagguguacaaggucgugggcaaccugcucuacuaccgcuuccugaacccggccguggucgcccccgacgccuucgacaucguggcgauggccgccgggggcgcccuggccgcgccccagcggcacgcccugggcgccguggcccagcuccugcagcacgccgcggccgggaaggccuucuccggccagagccagcaccuccgcguccugaacgacuaccuggaggagacccaccugaaguuccggaaguucauccaccgcgccugccaggugcccgagccggaggagcgguucgccguggacgaguacuccgacauggucgcgguggccaagcccaugguguacaucaccgucggggagcucgugaacacccaccgccugcugcucgagcaccaggacugcaucgcccccgaccaccaggacccccugcacgagcugcucgaggaccugggcgagcugccgacgauccccgaccucaucggggagagcaucgccgccgacggccacaccgaccuguccaagcuggaggugagccucacccugaccaacaaguucgagggccuggaggcggacgccgacgacuccaacacgcggagccuccugcuguccaccaagcagcuccuggccgacaucauccaguuccaccccggggacacccugaaggagauccucagccuguccgccagccgcgagcaggaggcggcccacaagcagcugaugagccggcgccaggccugcaccgcccagacgcccgagccgcuccggcgccaccgcucccugaccgcccacagccugcucccccuggcggagaagcagcggcgcguccugcggaaccuccgccggcuggaggcccugggccucguguccgcccgcaacggguaccagggccugguggacgagcuggccaaggacauccggaaccagcaccgccaccggcaccgccggaaggccgagcucgucaagcugcaggcgacccugcaggggcucagcaccaagacgaccuucuacgaggagcagggcgacuacuacucccaguacauccgcgccugccuggaccaccuggcccccgacagcaaguccagcggcaaggggaagaagcagccgucccuccacuacaccgccgcccagcugcuggagaagggcgugcucguggagaucgaggaccugcccgcgagccacuuccggaacgucaucuucgacaucacccccggggacgaggccggcaaguucgaggugaacgccaaguuccuggggguggacauggagcgcuuccagcuccacuaccaggaccugcugcagcuccaguacgagggcgucgccgugaugaagcuguucaacaaggcgaaggugaacgucaaccugcucaucuuccugcugaacaagaaguuccuccggaaguga

SEQ ID NO: 31677 - RNA, 3345 nt, Artificial Sequence
  derived and/or modified sequence opt1 from IQSEC1__Homo_sapiens__NP_001127854
auggccugccgccggcgcuacuucguggagggcgaggcccccagcuccgagaccgggaccagccuggacucccccagcgcguacccccagggcccccucguccccggguccagccugucccccgaccacuacgagcacacgagcgugggcgccuacgggcuguacuccggcccgcccggccagcagcagcggacccgccggcccaagcuccagcacagcaccuccauccugcgcaagcaggccgaggaggaggccaucaagcggagccgcucccugagcgaguccuacgagcucagcuccgaccugcaggacaagcaggucgagaugcuggagcggaaguacgggggccgccucgucacccggcacgccgcgcgcacgauccagaccgccuuccggcaguaccagaugaacaagaacuucgagcgccugcggagcuccaugagcgagaaccgcaugagccggcgcaucgugcuguccaacaugcggaugcaguucagcuucgaggggcccgagaaggugcacuccagcuacuucgagggcaagcaggucuccgugaccaacgacgggagccagcucggcgcccuggugucccccgagugcggcgaccugagcgagcccaccacgcucaagucccccgcccccagcuccgacuucgcggacgccaucaccgagcuggaggacgccuucagccgccaggucaagucccuggccgagagcaucgacgacgcccucaacugccggucccugcacaccgaggaggcgcccgcccuggacgccgcccgcgcccgcgacaccgagccccagacggcgcuccacgggauggaccaccggaagcuggacgagaugaccgccagcuacuccgacgugacccuguacaucgacgaggaggagcucagcccgccccugccccugucccaggccggcgaccgccccagcagcaccgaguccgaccuccggcugcgcgccgggggcgccgcgcccgacuacugggcccuggcccacaaggaggacaaggccgacacggacaccagcugccgguccacccccagccucgagcgccaggagcagcggcugcgcguggagcaccucccccuccugaccaucgagccgcccuccgacagcuccguggaccugagcgaccgguccgagcgcggcagccugaagcggcaguccgccuacgagcgcagccucgggggccagcaggggucccccaagcacggcccccacagcggggcgcccaagucccugccccgggaggagcccgagcugcgcccccggcccccgcgcccccuggacagccaccuggccaucaacggcuccgccaaccggcagagcaagagcgaguccgacuacagcgacggcgacaacgacuccaucaacagcacguccaacagcaacgacaccaucaacugcuccagcgaguccagcucccgcgacagccuccgggagcagacccuguccaagcagaccuaccacaaggaggcccgcaacagcugggacucccccgcguucagcaacgacgugauccgcaagcggcacuaccgcaucgggcugaaccucuucaacaagaagcccgagaagggcgugcaguaccugaucgagcggggguucgucccggacacgcccgugggcguggcccacuuccugcuccagcgcaaggggcugucccggcagaugaucggcgaguuccugggcaaccgccagaagcaguucaaccgggacguccuggacugcgugguggacgagauggacuucagcaccauggagcucgacgaggcccugcgcaaguuccaggcccacauccggguccagggggaggcccagaagguggagcgccugaucgaggcguucucccagcgguacugcaucugcaaccccggcgugguccgccaguuccggaaccccgacaccaucuucauccucgccuucgccaucauccugcugaacaccgacauguacagcccgaacgugaagcccgagcgcaagaugaagcucgaggacuucaucaagaaccugcgcggggucgacgacggcgaggacaucccccgggagaugcugauggggaucuacgagcggauccgcaagcgggagcucaagacgaacgaggaccacgugagccaggugcagaaggucgagaagcugaucgugggcaagaagcccaucggcucccugcacccggggcucggcugcgugcugagccugccccaccgccggcucgucugcuacugccgccuguucgaggugcccgaccccaacaagccgcagaagcuggggcuccaccagcgcgagaucuuccuguucaacgaccugcucguggucaccaagaucuuccagaagaagaagaacuccgugaccuacagcuuccggcaguccuucagccuguacggcaugcagguccuccuguucgagaaccaguacuaccccaacggcauccgccugaccuccagcgugcccggggccgacaucaaggugcugaucaacuucaacgcccccaacccgcaggaccggaagaaguucacggacgaccuccgcgaguccaucgcggaggugcaggagauggagaagcaccggaucgagagcgagcuggagaagcagaagggcgucgugcgccccuccaugagccagugcuccagccugaagaaggaguccgggaacggcacccucagccgggccugccuggacgacuccuacgccagcggggagggccugaagcgcuccgcccucagcagcucccugcgggaccugagcgaggccggcaagcgcgggcggcgcuccagcgcgggcucccucgagagcaacguggagggguccaucaucagcagcccccacaugcggcgccgggccaccuccacccgcgagugccccucccggccgcaccagacgaugcccaacagcuccagccugcugggcucccucuucgggagcaagcgcggcaagcccccgccccaggcccaccuccccuccgcccccgcgcugccgccgccccacccgcccgucgugcugccccaccuccagcacagcguggccggccaccaccuggggccgcccgagggccugccccaggccgccaugcacgggcaccacacccaguacugccacaugcagaacccgccgcccuaccaccaccaccaccaccaccacccgccccagcacauccagcacgcccaccaguaccaccacggcccccacgggggccaccccgcguacggcgcccacgcccacgggcacccgccccugcccuccgcccacgucggccacaccgugcaccaccacgggcagccgcccgcgccgccgccgcccaccagcagcaaggccaagcccuccggcaucagcaccaucguguga

SEQ ID NO: 31678 - RNA, 4467 nt, Artificial Sequence
  derived and/or modified sequence opt1 from IQSEC2__Homo_sapiens__NP_001104595
auggaggccggcagcgggcccccgggcgggcccggcuccgagagccccaaccgcgccguggaguaccugcucgagcugaacaacaucaucgagucccagcagcagcugcucgagacccagcggcgccggaucgaggagcuggaggggcagcuggaccagcucacccaggagaaccgcgaccugcgggaggagagccagcugcaccgcggcgagcuccaccgggacccccacggcgcgcgcgacuccccggggcgggagagccaguaccagaaccugcgcgagacgcaguuccaccaccgggagcugcgcgagucccaguuccaccaggccgcccgggacgucggcuaccccaaccgcgagggggccuaccagaaccgggaggccguguaccgcgacaaggagcgggacgcgagcuacccccuccaggacaccaccggcuacaccgcccgcgagcgggacguggcccagugccaccugcaccacgagaaccccgcccuggggcgcgagcggggcggccgcgaggcggggccggcccaccccggccgcgagaaggaggccggguacuccgccgccgucggcgugggcccccggcccccgcgcgagcgggggcagcucagccgcggcgcgucccggagcuccagccccggggccggcgggggccacuccacgagcaccuccaccagccccgccaccacgcugcagcgcaaguccgacggcgagaacagccggaccgugagcgucgagggggacgcccccggcuccgaccugagcaccgccguggacuccccggggagccagccccccuaccgccucucccagcugcccccgagcuccagccacaugggcgggccccccgcgggcgugggccugcccugggcccagcgggcccgccuccagccggccuccgucgcccugcggaagcaggaggaggaggagaucaagcgcagcaaggcgcuguccgacagcuacgagcucuccaccgaccugcaggacaagaagguggagaugcuggagcggaaguacgggggcagcuuccucucccgccgggccgcccgcacgauccagaccgccuuccggcaguaccgcaugaacaagaacuucgagcggcugcgcagcuccgccagcgagucccgcaugagccggcgcaucauccugagcaacaugcggaugcaguucuccuucgaggaguacgagaaggcgcagaaccccgccuacuucgaggggaagcccgccagccucgacgagggcgccauggcgggggcccgcucccaccggcuggagcgcggccugcccuacggcgggagcugcggcgggggcaucgacggcgggggcuccagcgugaccaccuccggggaguucagcaacgacaucacggagcucgaggacuccuucagcaagcaggucaagucccuggccgagagcaucgacgaggcccugaacugccacccguccggccccaugagcgaggagcccggguccgcccagcucgagaagcgggagagcaaggagcagcaggaggacuccagcgcgaccagcuucuccgaccugccgcuguaccucgacgacaccgugccccagcagagccccgagcgccugcccuccaccgagccgcccccccagggccggcccgaguucugggccccggccccccugccccccgugccgccccccguccccagcggcacgcgcgaggacgggucccgggaggagggcacccgccgggggccgggcugccucgagugccgcgacuuccggcugcgcgccgcccaccugccccuccugaccaucgagccccccagcgacuccagcguggaccuguccgaccggagcgaccgcggguccgugcaccggcagcucgucuacgaggcggacggcugcagcccgcacggcacccugaagcacaaggggccccccggccgcgcccccaucccgcaccggcacuaccccgcccccgaggggccggcccccgccccccccggcccgcugccccccgcgcccaacuccgggacgggcccgagcggcguggccgggggccgccgccuggggaagugcgaggccgccggcgagaacuccgacgggggcgacaacgagagccucgaguccagcuccaacagcaacgagaccaucaacugcagcuccggcagcuccagccgggacucccugcgcgagccccccgcgaccgggcugugcaagcagaccuaccagcgggagacgcgccacagcugggacucccccgccuucaacaacgacgugguccagcggcgccacuaccggaucggccucaaccuguucaacaagaagccggagaaggggauccaguaccugaucgagcgcggcuuccucagcgacacccccgugggcguggcccacuucauccuggagcggaaggggcugucccgccagaugaucggcgaguuccucgggaaccggcagaagcaguucaaccgcgacguccuggacugcguggucgacgagauggacuucagcuccauggaccuggacgacgcccuccggaaguuccagagccacauccgcgugcagggcgaggcccagaagguggagcggcugaucgaggcguucucccagcgcuacugcgucugcaaccccgcccuggugcggcaguuccgcaaccccgacaccaucuucauccucgccuucgccaucauccugcugaacaccgacauguacagcccguccgugaaggccgagcggaagaugaagcucgacgacuucaucaagaaccugcgcggggucgacaacggcgaggacaucccccgcgaccugcucgugggcaucuaccagcggauccaggggcgcgagcugcggacgaacgacgaccacgugagccagguccaggcgguggagcgcaugaucgugggcaagaagcccguccugucccucccccaccggcgccuggugugcugcugccagcuguacgaggugccggaccccaaccggccccagcgccucgggcugcaccagcgggaggucuuccuguucaacgaccuccugguggugaccaagaucuuccagaagaagaagauccuggucaccuacagcuuccgccaguccuucccccucguggagaugcacaugcagcuguuccagaacagcuacuaccaguucggcaucaagcugcucagcgccgugccggggggcgagcggaagguccugaucaucuucaacgcccccucccugcaggaccgccuccgguucaccagcgaccugcgcgaguccaucgccgaggugcaggagauggagaaguaccggguggagagcgagcuggagaagcagaagggcaugaugcgccccaacgccucccagcccgggggcgcgaaggacagcgucaacgggacgauggcccgguccagccucgaggacaccuacggcgccggggacggccugaagcgcggcgcccuguccagcucccuccgggaccugagcgacgcggggaagcgcggccggcgcaacuccguggggagccuggacuccaccaucgagggcagcgugaucuccagcccgcgcccccaccagcggaugcccccgcccccccccccgcccccccccgaggaguacaagucccagcgcccggucagcaacagcuccagcuuccucggcucccuguucgggagcaagcggggcaaggggcccuuccagaugccccccccgcccaccggccaggccuccgccagcuccagcuccgccagcuccacccaccaccaccaccaccaccaccaccacgggcacagccacggcggccugggggugcuccccgacggccaguccaagcugcaggcccugcacgcgcaguacugccaggggcccggcccggcccccccccccuaccucccgccccagcagcccagccugcccccgcccccccagcagcccccgccccugccccagcucggguccaucccgcccccccccgccagcgccccgcccgugggcccccaccgccacuuccacgcccacggccccgucccggggccccagcacuacacgcugggccggcccgggcgcgcgccccggcgcggcgccgggggccacccgcaguucgccccccacggccggcacccccugcaccagcccaccuccccgcucccccuguacagccccgccccccagcacccgcccgcccacaagcaggggcccaagcacuucaucuucucccaccacccccagaugaugccggcggccggcgccgccgggggccccgggagccgccccccgggcggcagcuacucccacccccaccacccccagagcccccuguccccgcacagccccauccccccccacccguccuaccccccccuccccccgcccagcccccacaccccccacuccccgcugccccccaccagcccccacgggccgcugcacgccuccggcccccccgggacggcgaaccccccgagcgccaaccccaaggccaagcccucccggaucagcaccgugguguga

SEQ ID NO: 31679 - RNA, 3549 nt, Artificial Sequence
  derived and/or modified sequence opt1 from IQSEC3__Homo_sapiens__NP_001164209
auggagagccugcucgagaaccccgugcgcgccguccuguaccugaaggagcucaccgccaucgugcagaaccagcagagccugauccacacccagcgggagcgcaucgacgagcuggagcggcgccucgacgagcugagcgccgagaaccggucccugugggagcaccagcagcuccugcaggcccagcccccgcccggccuggugccgcccagcuccgcgccccuccccgccgcccccgcgaccgcccccgccgccgcggcccgcgcccaggagccccugcaggaccaggggcagcggagcgccgccgcgccccaccccgcccccgaccggccgccccgccagcaccacggccagcugcucgagcagccccagcgcgggcccggcucccgggcccacacgccccagagcccccacaagcaccuggggacccagggcgccgucaccgacaaggagaaggagcggccgcccuccugcugcgccgcggccggcgcccugcuccagcacaagagccccuccgcccuggggaagggcgugcugagccggcgccccgagaacgagacggugcuccaccaguucugcugccccgccgcggacgccugcuccgaccuggccagccaguccgacgggagcugcacccaggccggcgggggcauggaggacuccgucguggccgcggccgccguggccgcgggccggcccagcgcccacgcccccaaggcccaggcccaggagcugcaggaggaggaggagcgccccggggcgggcgccgccagcccccgggccgggccccagcacaaggccagccccggccgccagcagcccgcgcucgccaccgcccugugcccccacgcccccgccgcgagcgacuacgagcugucccucgaccugaagaacaagcagaucgagaugcuggagcacaaguacggcgggcaccucgucagccggcgcgccgccugcaccauccagaccgccuuccggcaguaccagcuguccaagaacuucgagaagauccgcaacagccugcucgagucccgccugccccggcgcaucagccugcggaaggugcgcucccccaccgcggagagccucgccgccgagaaggcccugauggagggcuacgggcuggugggccucccccugguccggucccccagccugccgcccaccuucgccgggacccucacggagcuggaggacuccuucaccgagcagguccagagccuggcgaaguccaucgacgacgcccucagcaccuggucccugaagaccaugugcagccugcgcgaguccggcgccuaccagcuccaccaggcccugcaggccgcggccggcccgcccgggcuggaggccgagggccgggcccccgagagcgccgggcccggccccggggacgacgcggccgagacgcccggccugccgcccgcccacuccggcacccucaugauggccuuccgcgacgugaccgugcagaucgcgaaccagaacaucagcgugagcuccagcaccgcccuguccguggccaacugccugggggcccagaccguccaggcccccgcggagcccgccgccggcaaggccgagcagggggagaccagcggccgggaggcccccgaggcgcccgccguggggcgcgaggacgccuccgccgaggacagcugcgccgaggcggccgccuccggcgccgccgacggcgcgaccgcccccaagaccgaggaggaggaggaggaggaggagaccgccgagguggggcggggcgccgaggcggaggccggggaccucgagcagcugagcuccagcuccaccagcaccaaguccgccaagagcggcuccgaggccagcgccuccgcgagcaaggacgcccugcaggccaugauccucagccugccccgcuaccacugcgagaaccccgccuccugcaagagccccacccuguccaccgacacccuccggaagcgccuguaccggaucggccugaaccucuucaacaucaacccggacaaggggauccaguuccugaucagccgcggcuucauccccgacacccccaucggggucgcccacuuccugcuccagcggaagggccugucccgccagaugaucggggaguuccugggcaacagcaagaagcaguucaaccgggacgugcucgacugcguggucgacgagauggacuucuccagcauggagcuggacgaggcgcugcgcaaguuccaggcccacauccgcgugcagggcgaggcccagaaggucgagcggcucaucgaggccuucucccagcgcuacugcaugugcaacccggagguggugcagcaguuccacaaccccgacaccaucuucauccuggccuucgcgaucauccugcucaacacggacauguacagccccaacaucaagcccgaccggaagaugaugcuggaggacuucauccgcaaccugcgcggggucgacgacggcgccgacaucccgcgcgagcucgugguggggaucuacgagcggauccagcagaaggagcugaaguccaacgaggaccacgucaccuacgugaccaagguggagaaguccaucgucggcaugaagaccgugcuguccgugccccaccgccggcucgucugcugcagccgccuguucgaggugacggacgugaacaagcugcagaagcaggccgcccaccagcgggaggucuuccucuucaacgaccugcuggugauccucaagcugugccccaagaagaaguccagcuccaccuacaccuucugcaagagcguggggcugcucggcaugcaguuccagcuguucgagaacgaguacuacucccacggcaucacccuggucacgccccucagcgggagcgagaagaagcagguccugcacuucugcgcgcugggcuccgacgagaugcagaaguucguggaggaccucaaggagagcaucgccgaggucacggagcuggagcagauccgcaucgagugggagcuggagaagcagcaggggaccaagacccucuccuucaagccgugcggcgcccagggggacccccagagcaagcagggcucccccaccgccaagcgggaggccgcgcugcgcgagcggcccgccgagagcacgguggagguguccauccacaaccgccugcagaccagccagcacaacuccggccucggggccgagcggggcgccccggugccgccgcccgaccugcagccguccccgccccgccagcagacgccgccccugcccccgcccccgcccacgccgcccgggacgcucgugcagugccagcagaucgugaaggucaucgugcuggacaagcccugccuggcccggauggagccccuccugucccaggcgcugagcugcuacaccuccagcuccagcgacuccugcggcagcacgccccucgggggcccgggcucccccgugaaggucacccaccagccgccccugccgccgccgcccccgcccuacaaccacccccaccaguucugcccgcccgggagccugcuccacggccaccgcuacagcuccgggagccggucccugguguga

SEQ ID NO: 31680 - RNA, 783 nt, Artificial Sequence
  derived and/or modified sequence opt1 from IRAK1BP1__Homo_sapiens__NP_001010844
augagccugcagaagacgcccccgacccgcguguucgucgagcucgugcccugggccgaccggucccgcgagaacaaccuggccagcggccgggagacccugcccgggcuccgccacccccuguccagcacccaggcgcagaccgccacccgggaggugcaggucuccggcacgagcgagguguccgccgggccggaccgcgcccagguggucgugcgggugagcuccaccaaggaggccgcggccgaggccaagaaguccgucugccgccggcuggacuacaucacccagagccuccagcagcagggcgugcaggccgagaacaucaccgugacgaaggacuuccgccgggucgagaacgcguaccacauggaggccgaggugugcaucaccuucaccgaguucgggaagaugcagaacaucugcaacuuccugguggagaagcuggacagcuccgucgugaucagcccgccccaguucuaccacacccccggcuccguggagaaccuccgccggcaggccugccuggucgccguggagaacgccuggcgcaaggcgcaggaggugugcaaccuggucggccagacgcucgggaagccccugcugaucaaggaggaggagaccaaggagugggagggccagaucgacgaccaccagagcucccggcucagcuccagccugaccgugcagcagaagaucaagagcgccaccauccacgccgccuccaagguguucaucacguucgaggucaaggggaaggagaagcgcaagaagcaccuguga

SEQ ID NO: 31681 - RNA, 2049 nt, Artificial Sequence
  derived and/or modified sequence opt1 from IRAK1__Homo_sapiens__NP_001020413
auggccggcgggcccggcccgggggagcccgccgcgcccggcgcccagcacuuccuguacgaggugcccccgugggucaugugccgcuucuacaaggugauggacgcccucgagcccgccgacuggugccaguucgccgcgcugaucgugcgggaccagaccgagcugcgccucugcgagcggagcgggcagcgcaccgccuccguccuguggcccuggaucaaccggaacgcccgcguggccgaccuggugcacauccucacgcaccuccagcugcugcgggcgcgcgacaucaucaccgccuggcacccgcccgcgccccugcccagccccggcaccaccgccccgcggcccuccagcauccccgcccccgccgaggccgaggccugguccccgcgcaagcugcccagcuccgccagcacguuccucucccccgccuuccccggcagccagacccacuccgggccggagcugggccugguccccagccccgcgucccucuggcccccgccgcccagccccgcccccuccagcaccaagcccgggcccgaguccagcgugucccugcugcagggcgcccggccguuccccuucugcuggccccucugcgagaucagccgcgggacccacaacuucagcgaggagcugaagaucggcgagggcggguucggcugcguguaccgggccgucaugcgcaacacgguguacgccgugaagcggcugaaggagaacgcggaccucgaguggaccgccgucaagcaguccuuccugaccgagguggagcagcugagccgcuuccggcaccccaacaucguggacuucgccggguacugcgcccagaacggcuucuacugccucgucuacggcuuccugccgaacgggucccuggaggaccgccuccacugccagacccaggccugcccgccccugagcuggccccagcggcuggacauccuccugggcacggcgcgcgccauccaguuccugcaccaggacucccccagccucauccacggggacaucaaguccagcaacgugcugcuggacgagcggcucacccccaagcugggcgacuucgggcuggcccgcuucucccgcuucgccggcagcucccccagccaguccagcaugguggcgcggacccagaccguccgcggcacgcucgccuaccugcccgaggaguacaucaagaccgggcggcuggccguggacaccgacaccuucuccuucggcguggucgugcucgagacgcuggccgggcagcgcgccgugaagacccacggcgcgcggaccaaguaccugaaggaccucgucgaggaggaggccgaggaggccgggguggcccugcgcagcacccaguccacgcugcaggccggccucgcggccgacgccugggccgccccgaucgcgaugcagaucuacaagaagcaccuggacccccggcccggccccugcccgcccgagcuggggcugggccucgggcagcuggccugcugcugccugcaccgccgggccaagcgccggccgcccaugacccaggagaacagcuacgucuccagcaccggccgcgcccacagcggggcggcccccuggcagccccucgccgcccccuccggcgccagcgcgcaggccgccgagcagcugcagcggggccccaaccagccgguggaguccgacgagagccucgggggccuguccgccgcccugcgcagcuggcaccugacccccuccugcccccucgacccggcgccccugcgggaggccgggugcccccagggcgacacggccggcgagagcuccugggggagcggccccgggucccgcccgaccgccguggagggccuggcccucgggagcuccgcgagcuccagcuccgagccgccccagaucaucaucaaccccgcccggcagaagaugguccagaagcuggcccuguacgaggacggcgcccucgacagccugcagcugcucagcuccagcucccugcccggccuggggcucgagcaggaccgccagggccccgaggagagcgacgaguuccaguccuga

SEQ ID NO: 31682 - RNA, 1878 nt, Artificial Sequence
  derived and/or modified sequence opt1 from IRAK2__Homo_sapiens__NP_001561
auggccugcuacaucuaccagcugcccagcugggugcucgacgaccugugccgcaacauggacgcccuguccgagugggacuggauggaguucgcgagcuacgucaucaccgaccucacccagcugcggaagaucaaguccauggagcgcgugcagggcgugagcaucacgcgggagcugcucugguggugggggaugcgccaggccaccguccagcagcugguggaccugcucugccggcuggagcuguaccgcgccgcccagaucauccucaacuggaagccggcccccgagauccggugccccauccccgcguucccggacuccgugaagcccgagaagccccuggccgccagcguccgcaaggccgaggacgagcaggaggagggccagcccgugcggauggcgaccuucccggggcccggcuccagccccgcccgcgcccaccagcccgccuuccugcagccgcccgaggaggacgcgccccacucccuccggagcgaccugcccaccuccagcgacuccaaggacuucagcacguccaucccgaagcaggagaagcugcucagccuggccggggacucccuguucuggagcgaggccgacgugguccaggccaccgacgacuucaaccagaaccgcaagaucucccagggcaccuucgccgacguguaccggggccaccgccacgggaagcccuucguguucaagaagcuccgggagaccgccugcagcagccccggcuccaucgagcgcuucuuccaggcggagcugcagaucugccugcggugcugccaccccaacguccucccggugcugggguucugcgccgcccgccaguuccacagcuucaucuaccccuacauggccaacggcucccugcaggaccggcuccaggggcagggcggcagcgacccccugcccuggccgcagcgcguguccaucugcagcgggcugcucugcgccgucgaguaccugcacggccuggagaucauccacuccaacgucaagagcuccaacgugcuccuggaccagaaccugacgcccaagcucgcgcaccccauggcccaccugugccccgugaacaagcggagcaaguacaccaugaugaagacccaccuccuccgcaccuccgccgccuaccugccggaggacuucauccgcguggggcagcugacgaagcggguggacaucuucagcugcggcaucguccucgccgaggugcugaccggcauccccgcgauggacaacaaccgcucccccguguaccugaaggaccuccugcugagcgacaucccguccagcaccgccucccucugcagccggaagaccggggucgagaacgugauggccaaggagaucugccagaaguaccuggagaagggcgccgggcgccugcccgaggacugcgcggaggcccuggccacggccgccugccucugccugcggcgccggaacaccucccugcaggaggucugcggcagcguggcggccguggaggagcgccuccgggggcgcgagacccugcugcccuggagcggccucuccgagggcaccgggagcuccagcaacacgcccgaggagaccgacgacgucgacaacuccagccuggacgccuccagcuccaugagcguggccccgugggccggcgcggccacgccccugcuccccaccgagaacggggagggccggcugcgcgugaucgucgggcgggaggccgacuccagcuccgaggccugcgugggccuggagcccccgcaggacgugaccgagaccagcuggcagaucgagaucaacgaggccaagcgcaagcucauggagaacauccugcuguacaaggaggagaaggucgacuccaucgagcuguucggccccuga

SEQ ID NO: 31683 - RNA, 1608 nt, Artificial Sequence
  derived and/or modified sequence opt1 from IRAK3__Homo_sapiens__NP_001135995
auggccggcaacugcggggcccgcggcgcgcugagcgcccacacccuccuguucgaccugcccccggcccuccugggggagcugugcgccgugcucgacuccugcgacggcgcccugggguggcggggccugggcgcgguccucagccccuccgagaaguccuaccaggagggcggguuccccaacauccuguucaaggagaccgccaacgugacgguggacaacguccugauccccgagcacaacgagaaggggauccuccugaaguccagcaucuccuuccagaacaucaucgagggcacccgcaacuuccacaaggacuuccugaucggggagggcgagaucuucgagguguaccggguggagauccagaaccucaccuacgccgucaagcuguucaagcaggagaagaagaugcagugcaagaagcacuggaagcgcuuccugagcgagcucgaggugcugcuccucuuccaccacccgaacauccuggagcuggccgcguacuucaccgagacggagaaguucugccucaucuaccccuacaugcggaacggcacccuguucgaccgccugcagugcgugggggacaccgcgccccuccccuggcacauccggaucggcauccugaucgggaucuccaaggccauccacuaccugcacaacguccagccgugcagcgugaucugcggcuccaucagcuccgccaacauccuccuggacgaccaguuccagcccaagcugaccgacuucgccauggcccacuuccgcagccaccucgagcaccaguccugcacgaucaacaugaccagcuccagcuccaagcaccugugguacaugcccgaggaguacauccggcagggcaagcugagcaucaagaccgacguguacagcuucgggaucgucaucauggaggugcucaccggcugccgcgugguccuggacgaccccaagcacauccagcugcgggaccuccugcgcgagcugauggagaagcgggggcucgacuccugccugagcuuccuggacaagaaggugccgcccugcccccgcaacuucuccgccaagcuguucugccuggccggccggugcgccgccacgcgcgcgaagcugcggcccagcauggacgaggugcucaacacccuggaguccacccaggccagccuguacuucgccgaggacccgcccaccucccucaagagcuuccgcugccccagcccccuguuccuggagaacgucccgagcauccccguggaggacgacgagucccagaacaacaaccugcuccccagcgacgaggggcugcggaucgaccgcaugacgcagaagacccccuucgagugcucccagagcgaggugauguuccugucccucgacaagaagccggagagcaagcggaacgaggaggccugcaacaugcccuccagcuccugcgaggagagcugguuccccaaguacaucguccccagccaggaccugcgcccguacaaggugaacaucgaccccuccagcgaggcccccggccacuccugccgcagccggccgguggaguccagcugcuccagcaaguucuccugggacgaguacgagcaguacaagaaggaguga

SEQ ID NO: 31684 - RNA, 1011 nt, Artificial Sequence
  derived and/or modified sequence opt1 from IRAK4__Homo_sapiens__NP_001138728
augcccuucugcgacaaggaccgcacccugaugaccccggugcagaaccucgagcagagcuacaugccgcccgacuccagcucccccgagaacaagagccuggaggucuccgacacgcgguuccacagcuucuccuucuacgagcugaagaacgugaccaacaacuucgacgagcgccccaucagcgugggcgggaacaagaugggcgagggcggguucggggucguguacaagggcuacgugaacaacaccaccgucgccgugaagaagcucgccgcgaugguggacaucacgaccgaggagcugaagcagcaguucgaccaggagaucaaggucauggccaagugccagcacgagaaccugguggagcuccugggcuucuccagcgacggggacgaccugugccucguguacgucuacaugcccaacggcucccugcuggaccggcucagcugccuggacgggaccccgccccuguccuggcacaugcgcugcaagaucgcccagggcgccgccaacgggaucaacuuccuccacgagaaccaccacauccaccgggacaucaagagcgcgaacauccugcuggacgaggccuucaccgccaagaucuccgacuucggccucgcccgcgcgagcgagaaguucgcccagacggugaugaccucccggaucgugggcaccaccgccuacauggcccccgaggcccugcgcggggagaucacgcccaagagcgacaucuacuccuucggcgucgugcugcucgagaucaucaccgggcugcccgcgguggacgagcaccgggagccccagcugcuccuggacaucaaggaggagaucgaggacgaggagaagaccaucgaggacuacaucgacaagaagaugaacgacgccgacagcaccagcgucgaggccauguacuccguggccagccagugccugcacgagaagaagaacaagcgcccggacaucaagaaggugcagcagcuccugcaggagaugacggccuccuga

SEQ ID NO: 31685 - RNA, 2892 nt, Artificial Sequence
  derived and/or modified sequence opt1 from IREB2__Homo_sapiens__NP_004127
auggacgcccccaaggccggcuacgcguucgaguaccugaucgagacccucaacgacagcucccacaagaaguucuucgacgugagcaagcuggggaccaaguacgacguccugccguacuccauccgcgugcuccuggaggccgccgugcggaacugcgacggcuuccugaugaagaaggaggacgucaugaacauccucgacuggaagacgaagcagagcaacguggaggugcccuucuuccccgcccgcguccugcugcaggacuucaccgggauccccgccaugguggacuucgcggccaugcgggaggccgugaagacccucggcggggacccggagaagguccaccccgccugccccaccgaccugacgguggaccacucccugcagaucgacuucagcaagugcgcgauccagaacgcccccaacccgggcggcggggaccuccagaaggccggcaagcugagcccccugaaggugcagcccaagaagcuccccugccgcgggcagacgaccugccggggcuccugcgacuccggggagcugggccgcaacagcggcaccuucuccagccagaucgagaacaccccgauccugugccccuuccaccuccagcccguccccgagccggagaccgugcugaagaaccaggagguggaguucgggcggaaccgcgagcggcugcaguucuucaagugguccagccgcgucuucaagaacguggccgugaucccgcccggcaccgggauggcccaccagaucaaccucgaguaccugucccgggucguguucgaggagaaggaccuccuguuccccgacagcguggucggcaccgacucccacaucacgauggugaacggccuggggauccugggcuggggcgucggcgggaucgagaccgaggcggugaugcucgggcugcccgugagccugacccuccccgaggucgugggcugcgagcugaccggguccagcaaccccuucgugacgagcaucgacgucgugcugggcaucaccaagcaccuccgccaggugggggucgccggcaaguucguggaguucuucggguccggcgugagccagcuguccaucgucgaccggaccaccaucgccaacaugugccccgaguacggcgccauccugagcuucuucccgguggacaacgugacgcucaagcaccuggagcacaccggguucuccaaggccaagcuggagagcauggagaccuaccucaaggcggucaagcuguuccgcaacgaccagaacuccagcggcgagcccgaguacucccaggugauccagaucaaccugaacagcaucgugcccuccgucagcgggcccaagcggccgcaggaccgcguggccgugaccgacaugaaguccgacuuccaggccugccucaacgagaaggucggcuucaagggguuccagaucgccgccgagaagcagaaggacaucgugagcauccacuacgagggcuccgaguacaagcugagccacggcuccguggucaucgcggccgugaucagcugcacgaacaacugcaaccccuccgugaugcuggccgccgggcuccuggccaagaaggcggucgaggccggccugcgggugaagcccuacauccgcaccagccucagcccgggguccggcauggugacccacuaccugagcuccagcggcguccugcccuaccuguccaagcucggguucgagaucgugggcuacgggugcagcacgugcgugggcaacaccgcgccccuguccgacgccguccugaacgccgugaagcagggggaccucgugaccugcggcauccugagcggcaacaagaacuucgaggggcggcugugcgacugcguccgcgccaacuaccucgccagcccgccccuggugguggccuacgccaucgcgggcaccgucaacaucgacuuccagaccgagccccuggggacggaccccaccggcaagaacaucuaccuccacgacaucuggcccucccgggaggaggugcaccgcguggaggaggagcacgucauccuguccauguucaaggcccugaaggacaagaucgagauggggaacaagcgcuggaacagccucgaggccccggacuccgugcuguuccccugggaccucaagagcaccuacauccggugccccuccuucuucgacaagcugaccaaggagcccaucgcccugcaggccaucgagaacgcgcacgugcugcucuaccugggcgacagcgucacgaccgaccacaucuccccggccggcagcaucgcccgcaacagcgccgccgcgaaguaccugaccaaccgggggcucacgccccgcgaguucaacuccuacggcgcccggcgcgggaacgacgccgugaugacccggggcaccuucgccaacaucaagcuguucaacaaguucaucgggaagcccgcgcccaagaccauccacuucccgagcggccagacccuggacguguucgaggccgccgagcucuaccagaaggagggcaucccccugaucauccuggccgggaagaaguacggcuccgggaacagccgcgacugggccgcgaagggccccuaccuccugggggucaaggccgugcuggccgaguccuacgagaagauccacaaggaccaccucaucggcaucggcaucgcgccccugcaguuccugccgggggagaacgccgacagccucggccuguccgggcgggagaccuucagccugacguuccccgaggagcucucccccggcaucacccugaacauccagaccagcaccggcaagguguucuccgucaucgccagcuucgaggacgacguggagaucacgcuguacaagcacgggggccuccugaacuucguggcccgcaaguucuccuga

SEQ ID NO: 31686 - RNA, 978 nt, Artificial Sequence
  derived and/or modified sequence opt1 from IRF1__Homo_sapiens__NP_002189
augcccaucacccgcaugcggaugcgcccguggcuggagaugcagaucaacagcaaccagauccccggccucaucuggaucaacaaggaggagaugaucuuccagauccccuggaagcacgccgccaagcacgggugggacaucaacaaggacgcgugccuguuccgguccugggccauccacaccggccgcuacaaggccggggagaaggagcccgacccgaagacguggaaggccaacuuccggugcgccaugaacagccugcccgacaucgaggaggugaaggaccagucccgcaacaagggcagcuccgcgguccggguguaccgcaugcucccgccccugaccaagaaccagcggaaggagcgcaagagcaaguccagccgggacgccaaguccaaggccaagcgcaagagcugcggggacuccagccccgacaccuucuccgacggccugagcuccagcacccuccccgacgaccacuccagcuacacggugcccggcuacaugcaggaccuggaggucgagcaggcccugacccccgcgcucuccccgugcgccgugagcagcacccugcccgacuggcacauccccguggaggucgugcccgacuccaccagcgaccuguacaacuuccagguguccccgaugcccagcacguccgaggccaccaccgacgaggacgaggaggggaagcuccccgaggacaucaugaagcugcuggagcagagcgaguggcagcccaccaacgucgacggcaagggguaccuccugaacgagccgggcgugcagcccacguccguguacggggacuucagcugcaaggaggagcccgagaucgacucccccggcggcgacaucgggcugagccuccagcgggucuucaccgaccugaagaacauggacgccaccuggcuggacucccuccugaccccggugcgccugcccagcauccaggccauccccugcgcgcccuga

SEQ ID NO: 31687 - RNA, 1716 nt, Artificial Sequence
  derived and/or modified sequence opt1 from IRF2BP2__Homo_sapiens__NP_001070865
auggccgccgcgguggccgucgccgccgccagccgccggcaguccugcuaccugugcgaccucccccgcaugccgugggcgaugaucugggacuucaccgagcccgugugccggggcugcgugaacuacgagggggccgaccgcgucgaguucgugaucgagaccgcccggcagcugaagcgcgcccacggcugcuuccccgaggggcggagcccgcccggcgcggccgccuccgccgccgcgaagcccccgccccugagcgccaaggacauccuccugcagcagcagcagcagcuggggcacggcggccccgaggccgcgccccgcgcgccccaggcccucgagcgguacccccuggccgccgccgccgagcgcccgccccggcugggguccgacuucggcagcucccgccccgccgccagccucgcccagcccccgacgccccagccgccgcccgugaacgggauccugguccccaacggcuucuccaagcuggaggagccgcccgagcucaaccggcagagccccaacccccgccgggggcacgccgugccgcccacccuggugccccugaugaacggcuccgccacgccccuccccaccgcgcugggccucgggggccgcgccgccgccagccuggcggccgucuccgggaccgccgccgccagccugggcuccgcgcagcccaccgaccugggcgcccacaagcggcccgccagcguguccagcuccgccgccguggagcacgagcagcgcgaggcggccgccaaggagaagcagccgccgccgcccgcccaccgggggcccgccgacagccucagcaccgcggccggcgccgccgagcuguccgcggagggggccggcaagagccgcggguccggcgagcaggacugggucaaccggcccaagaccgugcgcgacacgcugcucgcccugcaccagcacggccacagcgggcccuucgaguccaaguucaagaaggagcccgcccugaccgccguggcgcgcaccgcccggaagcgcaagcccagccccgagcccgagggcgaggucgggccgcccaagaucaacggcgaggcccagcccuggcucuccaccagcacggaggggcugaagauccccaugacccccaccuccagcuucguguccccgcccccgcccaccgccagcccccacuccaaccggacgacgccgcccgaggccgcgcagaacggccagagccccauggccgcccugauccucguggccgacaacgccggcgggucccacgcgagcaaggacgccaaccagguccacuccaccacccgccggaacagcaacagcccgcccucccccagcuccaugaaccagcgccggcugggcccccgcgaggucgggggccagggggccggcaacaccggcgggcuggagcccgugcaccccgccagccuccccgacuccagccuggcgaccuccgcgccccugugcugcacccucugccacgagcggcuggaggacacccacuucgugcagugccccagcgugccgucccacaaguucugcuuccccugcagccgccaguccaucaagcagcagggcgccagcggggagguguacugccccuccggcgagaagugcccccuggucggcagcaacgugccgugggccuucaugcagggggagaucgccacgauccucgccggcgacgucaaggugaagaaggagcgggacuccuga

SEQ ID NO: 31688 - RNA, 2391 nt, Artificial Sequence
  derived and/or modified sequence opt1 from IRF2BPL__Homo_sapiens__NP_078772
augagcgccgcccagguguccagcucccgccggcagagcugcuaccugugcgaccucccccgcaugccgugggcgaugaucugggacuucuccgagcccgucugccggggcugcgugaacuacgagggggccgaccgcaucgaguucgugaucgagaccgcccggcagcugaagcgcgcccacggcugcuuccaggacgggcggagccccggccccccgccccccgucggggugaagaccguggcccuguccgcgaaggaggccgccgccgcggccgccgccgccgcggccgccgccgccgcggcccagcagcagcagcagcagcagcagcagcagcagcagcagcagcagcagcagcagcagcagcagcagcagcagcagcucaaccacgucgacggcagcuccaagcccgccgugcuggccgccccgagcggccuggagcgcuacgggcucuccgcggccgccgccgccgcggccgccgccgcggccgccguggagcagcggagccgcuucgaguaccccccccccccggucucccugggcagcuccagccacacggcccggcugcccaacgggcucggcgggcccaacggcuuccccaagccgacccccgaggagggcccccccgagcugaaccgccaguccccgaacagcuccagcgccgcggccagcguggccucccggcgcgggacccacggcgggcuggugaccggccuccccaaccccggcgggggcgggggcccccagcugacggucccgcccaaccugcucccccagacccugcugaacgggcccgccagcgccgcggugcucccgccccccccgccccacgcccugggcucccggggcccccccaccccggccccccccggggcccccggcgggccggccugccugggcgggacccccggcgugagcgcgacguccagcuccgccagcuccagcaccuccagcuccgucgccgaggugggcgugggggccggcgggaagcgccccggcagcgucuccagcaccgaccaggagcgggagcucaaggagaagcagcgcaacgcggaggcccuggccgagcuguccgagagccuccggaaccgcgccgaggagugggccuccaagcccaagauggugcgggacacccugcugacgcucgcggggugcaccccguacgaggugcgcuucaagaaggaccacagccugcugggccgcgucuucgccuucgacgccgugagcaagcccggcauggacuacgagcucaagcuguucaucgaguaccccaccggguccggcaacguguacagcuccgccagcggggucgccaagcagauguaccaggacugcaugaaggacuucggccggggccuguccagcggguucaaguaccucgaguacgagaagaagcacggcuccggggacuggcgccugcugggcgaccuccugcccgaggcggugcgguucuucaaggagggggucccgggcgccgacaugcugccccagcccuaccucgacgccagcugccccaugcugccgaccgcccuggugucccucagccgcgcccccuccgcgccccccggcacgggggcccugccgcccgccgcccccagcggccggggggcggccgccucccugcgcaagcggaaggccagcccggagccccccgacuccgccgagggcgcgcucaagcugggggaggagcagcagcgccagcaguggauggccaaccagagcgaggcccugaagcucaccauguccgccggcggcuucgccgcgcccgggcacgccgccggcgggccgcccccccccccgcccccccugggcccccacagcaaccggaccaccccgcccgagagcgccccccagaacgggcccuccccgauggccgcgcugaugagcguggccgacacgcugggcaccgcccacucccccaaggacggcagcuccguccacagcaccaccgccuccgcccgccggaacagcuccagccccgugucccccgcgagcgugccggggcagcgccggcucgccucccgcaacggcgaccugaaccugcaggucgcccccccccccccgagcgcccaccccgggauggaccaggugcacccccagaacauccccgacuccccgauggcgaacagcggcccccucugcugcacgaucugccacgagcggcuggaggacacccacuucgugcagugccccuccgucccgagccacaaguucugcuuccccugcucccgcgagagcaucaaggcccagggggccaccggcgagguguacugccccagcggcgagaagugcccccuggugggguccaacgucccgugggccuucaugcagggcgagaucgccaccauccucgcgggggacgugaaggugaagaaggagcgggaccccuga

SEQ ID NO: 31689 - RNA, 1050 nt, Artificial Sequence
  derived and/or modified sequence opt1 from IRF2__Homo_sapiens__NP_002190
augcccguggagcgcaugcggaugcgcccguggcuggaggagcagaucaacagcaacaccauccccggccucaaguggcugaacaaggagaagaagaucuuccagauccccuggaugcacgccgcccggcacgggugggacgucgagaaggacgcgccccuguuccgcaacugggccauccacaccggcaagcaccagccggggguggacaagcccgaccccaagacguggaaggccaacuuccggugcgccaugaacucccuccccgacaucgaggaggugaaggacaagagcaucaagaagggcaacaacgccuuccgcgucuaccggaugcugccgcuguccgagcgccccagcaagaaggggaagaagcccaagaccgagaaggaggacaaggugaagcacaucaagcaggagcccguggaguccagccucggccuguccaacggcgucagcgaccuguccccggaguacgcggugcucaccagcaccaucaagaacgagguggacuccacggucaacaucaucgugguggggcagagccaccuggacuccaacaucgagaaccaggagaucgucaccaacccgcccgacaucugccaggugguggaggucaccaccgagagcgacgagcagcccguguccaugagcgagcuguacccccuccagaucucccccgugagcuccuacgccgagagcgagacgaccgacagcguccccuccgacgaggagagcgccgagggccggccccacuggcgcaagcggaacaucgaggggaagcaguaccuguccaacaugggcacccgcgggagcuaccugcucccgggcauggccuccuucgugaccagcaacaagcccgaccuccaggugacgaucaaggaggaguccaaccccguccccuacaacagcuccuggccgcccuuccaggaccugccccugagcuccagcaugacccccgcguccagcuccagccggccggaccgcgagacccgggccuccgugaucaagaagaccagcgacaucacgcaggcccgcgugaaguccugcuga

SEQ ID NO: 31690 - RNA, 1179 nt, Artificial Sequence
  derived and/or modified sequence opt1 from IRF3__Homo_sapiens__NP_001184052
auggugggccgcaagcagggguggagcugccgggucaccggcaucaagcccgggaagcccgccugggccgaggcgaccggcgccuacgugcccgggcgcgacaagcccgaccugcccacguggaagcggaacuuccgcuccgcccucaaccggaaggagggccugcgccuggccgaggaccggagcaaggacccgcacgacccccacaagaucuacgaguucgugaacuccggcgucggggacuucagccagcccgacaccucccccgacaccaacggcgggggcagcaccuccgacacgcaggaggacauccucgacgagcugcuggggaacauggugcucgccccgcugcccgaccccgggcccccgagccuggcgguggcccccgagcccugcccccagccgcuccgcucccccagccuggacaaccccacccccuucccgaaccugggccccuccgagaacccccucaagcggcugcugguccccggggaggagugggaguucgaggugaccgccuucuaccgcggccgccagguguuccagcagaccaucagcugcccggaggggcuccggcuggucggcuccgaggugggcgaccggacgcugcccggguggcccgugacccuccccgacccgggcaugagccugaccgaccgcggggucauguccuacgugcggcacgugcugagcugccucggcgggggccuggcccuguggcgcgcgggccaguggcucugggcccagcggcuggggcacugccacaccuacugggccgucuccgaggagcugcuccccaacagcggccacgggcccgacggcgaggugccgaaggacaaggagggcggcguguucgaccugggccccuucaucgucgaccugaucacguucaccgagggguccggccgcagcccccgguacgcccucugguucugcgugggggagagcuggccccaggaccagccguggaccaagcgccuggugauggucaagguggugccgaccugccugcgggcccucgucgagauggcgcgcgugggcggggccuccagccuggagaacacggucgaccugcacaucuccaacagccacccccucucccugaccagcgaccaguacaaggccuaccugcaggaccucguggagggcauggacuuccagggccccggggaguccuga

SEQ ID NO: 31691 - RNA, 1353 nt, Artificial Sequence
  derived and/or modified sequence opt1 from IRF4__Homo_sapiens__NP_001182215
augaaccuggagggcgggggccgcgggggcgaguucgggaugagcgccguguccugcggcaacggcaagcuccggcaguggcugaucgaccagaucgacagcgggaaguaccccggccuggucugggagaacgaggagaaguccaucuuccgcaucccguggaagcacgccgggaagcaggacuacaaccgggaggaggacgcggcccucuucaaggccugggcccuguucaagggcaaguuccgcgaggggaucgacaagcccgacccgcccaccuggaagacccggcugcgcugcgcccucaacaagagcaacgacuucgaggagcugguggagcggucccagcuggacaucagcgaccccuacaagguguaccgcaucguccccgagggcgcgaagaagggcgccaagcagcucacgcuggaggacccccagauguccaugagccaccccuacaccaugaccaccccguaccccucccugcccgcccaggugcacaacuacaugaugcccccgcucgaccggagcuggcgcgacuacgugcccgaccagccccaccccgagaucccguaccagugccccaugacguucgggccccggggccaccacuggcaggggcccgccugcgagaacggcugccaggucaccggcaccuucuacgcgugcgccccgcccgagucccaggcccccggggugcccaccgagccgagcauccgcuccgccgaggcccuggcguucagcgacugccggcugcacaucugccucuacuaccgcgagauccuggugaaggagcugacgaccuccagccccgagggcugccggaucucccacgggcacaccuacgacgccagcaaccucgaccagguccuguuccccuaccccgaggacaacggccagcgcaagaacaucgagaagcugcucucccaccuggagcgcgggguggugcuguggauggccccggacggccucuacgccaagcggcugugccagagccggaucuacugggacggcccccuggcccucugcaacgaccgccccaacaagcuggagcgggaccagaccugcaagcuguucgacacgcagcaguuccucagcgagcugcaggcguucgcccaccacgggcgcucccugccgcgcuuccaggucacccucugcuucggcgaggaguuccccgacccccagcggcagcgcaagcugaucaccgcccacguggagccccugcucgcccggcagcuguacuacuucgcccagcagaacagcgggcacuuccugcgcggcuacgaccucccggagcacaucuccaaccccgaggacuaccaccggagcauccgccacuccagcauccaggaguga

SEQ ID NO: 31692 - RNA, 1497 nt, Artificial Sequence
  derived and/or modified sequence opt1 from IRF5__Homo_sapiens__NP_001092097
augaaccagagcauccccguggccccgacccccccccgccggguccgccugaagcccuggcucguggcccaggugaacuccugccaguacccgggccugcagugggucaacggggagaagaagcuguucugcauccccuggcggcacgcgacccgccacggccccagccaggacggggacaacacgaucuucaaggccugggccaaggagaccggcaaguacaccgaggggguggacgaggccgaccccgccaaguggaaggcgaaccuccggugcgcccugaacaagucccgcgacuuccggcugaucuacgacggcccgcgcgacaugcccccccagcccuacaagaucuacgaggugugcagcaacggcccggcccccaccgacucccagccccccgaggacuacagcuucggggccggcgaggaggaggaggaggaggaggagcuccagcggaugcugccgucccugagccucacggaggacgucaaguggccccccacccugcagcccccgacccugcgcccccccacccuccagcccccgacgcugcagccccccguggugcuggggcccccggcgcccgaccccuccccgcucgcccccccccccggcaacccggccggguuccgggagcugcugagcgagguccucgagcccggcccccugcccgccucccugccgcccgccggcgagcagcuccugcccgaccugcucaucagcccccacaugcugccgcugaccgaccucgagaucaaguuccaguaccgcgggcggcccccccgcgcgcugaccaucuccaacccccacggcugccggcuguucuacagccagcucgaggccacccaggagcagguggagcuguucgggccgaucucccuggagcaggugcgcuuccccagccccgaggacauccccuccgacaagcagcgguucuacacgaaccagcuccuggacguccuggaccgcggccucauccugcagcugcagggccaggaccucuacgccauccggcugugccagugcaagguguucuggagcgggccgugcgccuccgcccacgacagcugccccaaccccauccagcgcgaggugaagaccaagcuguucagccucgagcacuuccugaacgagcugauccucuuccagaagggccagaccaacacccccccgcccuucgagaucuucuucugcuucggggaggaguggcccgaccggaagccgcgcgagaagaagcugaucacgguccagguggugcccgucgcggcccgccugcuccuggagauguucuccggcgagcugagcugguccgccgacagcauccggcugcagaucuccaaccccgaccucaaggaccgcaugguggagcaguucaaggagcugcaccacaucuggcagagccagcagcggcugcagcccguggcccaggccccgcccggggcgggccucggcgucgggcagggccccuggcccaugcacccggccgggaugcaguga

SEQ ID NO: 31693 - RNA, 1119 nt, Artificial Sequence
  derived and/or modified sequence opt1 from IRF6__Homo_sapiens__NP_001193625
auguacgacggcaccaaggaggugcccaugaaccccgucaagaucuaccaggugugcgacaucccccagccccaggggagcaucaucaaccccggcuccaccgggagcgccccgugggacgagaaggacaacgacguggacgaggaggacgaggaggacgagcuggaccagucccagcaccacguccccauccaggacacguuccccuuccucaacaucaacggcagccccauggccccggcguccguggggaacugcagcgugggcaacugcucccccgaggccgucuggcccaagaccgagccccuggagauggaggugccgcaggcccccauccagcccuucuacagcucccccgagcuguggaucagcucccucccgaugaccgaccuggacaucaaguuccaguaccgcggcaaggaguacgggcagaccaugacggugagcaacccccagggcugccggcuguucuacggggaccucggccccaugcccgaccaggaggagcuguucgggccggucucccuggagcaggucaaguuccccggccccgagcacaucaccaacgagaagcagaagcuguucaccagcaagcuccuggacgugauggaccgcggccucauccuggagguguccgggcacgccaucuacgccauccggcugugccagugcaagguguacuggagcggccccugcgcgccgucccucguggcccccaaccugaucgagcgccagaagaaggucaagcuguucugccucgagaccuuccugagcgaccugaucgcccaccagaaggggcagaucgagaagcagccgcccuucgagaucuaccucugcuucggcgaggaguggcccgacggcaagccccuggagcggaagcugauccucguccaggugauccccgugguggcccgcaugaucuacgagauguucuccggggacuucacgcggagcuucgacagcggcuccgugcgccugcagaucagcaccccggacaucaaggacaacaucgucgcgcagcugaagcagcucuaccggauccugcagacccaggaguccuggcagcccaugcagcccacccccagcaugcagcugccgcccgcccucccgccccaguga

SEQ ID NO: 31694 - RNA, 1512 nt, Artificial Sequence
  derived and/or modified sequence opt1 from IRF7__Homo_sapiens__NP_001563
auggcccuggcccccgagcgcgcggccccgcggguccucuucggcgaguggcugcugggggagaucagcuccggcugcuacgaggggcuccaguggcuggacgaggcccggaccugcuuccgcgugcccuggaagcacuucgcccgcaaggaccugagcgaggccgacgcgcggaucuucaaggccugggccguggcccgcggccgguggccgcccuccagccgcgggggcgggcccccgcccgaggcggagaccgccgagcgggccggcuggaagacgaacuuccgcugcgcccuccgguccacccgccgguucgugaugcugcgcgacaacagcggcgaccccgccgacccccacaaggucuacgcgcugucccgggagcucugcuggcgcgaggggcccggcaccgaccagaccgaggccgaggcccccgccgccgugcccccgccccagggcgggccgcccggccccuuccuggcgcacacgcacgccgggcugcaggcccccggcccccuccccgccccggccggggacaagggcgaccugcugcuccaggcggugcagcagagcugccuggccgaccaccuccugaccgccuccuggggcgccgaccccguccccaccaaggcccccggggagggccaggaggggcugccgcugaccggcgcgugcgccgggggccccggccuccccgccggggagcuguacggcugggccguggagacgacccccagcccggggccccagcccgcggcccugaccaccggcgaggccgccgccccggagagcccccaccaggcggagcccuaccucagccccuccccgagcgccugcacggccgugcaggagcccucccccggggcccuggacgucaccaucauguacaagggccggaccgugcugcagaagguggucggccaccccagcugcaccuuccucuacgggccgcccgaccccgccgugcgcgcgacggacccccagcaggucgccuucccgucccccgccgagcugcccgaccagaagcagcugcgguacaccgaggagcuccugcgccacguggcccccggccugcaccucgagcugcgggggccgcagcugugggcccgccgcaugggcaagugcaagguguacugggaggucgggggcccgcccggcagcgcgucccccagcacccccgccugccuccugccccggaacugcgacacccccaucuucgacuuccgcguguucuuccaggagcugguggaguuccgggcccgccagcggcgcgggagcccccgguacacgaucuaccucggcuucgggcaggaccuguccgccggccgcccgaaggagaagucccuggugcucgucaagcuggagcccuggcugugccgggugcaccucgagggcacccagcgcgaggggguguccagccuggacuccagcucccugagccucugccuguccagcgcgaacucccuguacgacgacaucgagugcuuccugauggagcucgagcagcccgccuga

SEQ ID NO: 31695 - RNA, 1281 nt, Artificial Sequence
  derived and/or modified sequence opt1 from IRF8__Homo_sapiens__NP_002154
augugcgaccgcaacggcgggcggcgccugcggcaguggcucaucgagcagaucgacagcuccauguaccccggccugaucugggagaacgaggagaaguccauguuccgcauccccuggaagcacgccgggaagcaggacuacaaccaggagguggacgccagcaucuucaaggcgugggccgucuucaagggcaaguucaaggagggggacaaggccgagcccgccaccuggaagacccggcugcgcugcgcccucaacaagagccccgacuucgaggaggugacggaccggucccagcuggacaucagcgagcccuacaagguguaccgcaucgucccggaggaggagcagaagugcaagcugggcguggcgaccgccggcugcgugaacgaggucaccgagauggagugcgggcgguccgagaucgacgagcucaucaaggagcccagcguggacgacuacaugggcaugaucaagcgcucccccagcccgcccgaggccugccggucccagcugcugcccgacuggugggcccagcagcccagcaccggggugccccucgucacgggcuacaccaccuacgacgcgcaccacuccgccuucagccagauggugaucuccuucuacuacgggggcaagcuggugggccaggccaccacgaccugcccggaggggugccgccugagccucucccagcccggccugcccgggaccaagcuguacggccccgagggccucgagcugguccgguucccgcccgccgacgccauccccagcgagcgccagcgccaggugacccggaagcuguucgggcaccucgagcggggcgugcugcugcacuccagccgccagggggucuucgugaagcggcucugccagggccgcguguucugcagcgggaacgcggucgugugcaagggccggcccaacaagcuggagcgcgacgaggugguccagguguucgacacgucccaguucuuccgcgagcugcagcaguucuacaacagccagggccggcucccggacgggcgcgugguccugugcuucggcgaggaguuccccgacauggcgccccugcgguccaagcucauccuggugcagaucgagcagcuguacguccgccagcucgccgaggaggccggcaagagcugcggggccggguccgugaugcaggcccccgaggagccgccgcccgaccagguguuccggauguuccccgacaucugcgccagccaccagcgcuccuucuuccgggagaaccagcagaucaccgucuga

SEQ ID NO: 31696 - RNA, 1182 nt, Artificial Sequence
  derived and/or modified sequence opt1 from IRF9__Homo_sapiens__NP_006075
auggccagcggccgcgcccggugcacccgcaagcugcggaacuggguggucgagcaggucgaguccgggcaguuccccggcgugugcugggacgacaccgcgaagacgauguuccgcaucccguggaagcacgccgggaagcaggacuuccgggaggaccaggacgccgccuucuucaaggccugggcgaucuucaagggcaaguacaaggagggggacaccggcggccccgccguguggaagacccgccuccggugcgcccugaacaagagcuccgaguucaaggaggugcccgagcgcgggcggauggacguggccgagcccuacaaggucuaccagcugcucccgcccggcaucgugagcgggcagcccggcacccagaaggugcccuccaagcgccagcacagcuccgucagcuccgagcggaaggaggaggaggacgcgaugcagaacugcacgcugagcccguccgugcugcaggacagccucaacaacgaggaggagggggccuccggcggcgccgugcacagcgacaucggguccagcuccagcuccagcagccccgagccccaggaggucaccgacaccaccgaggcccccuuccagggcgaccagcgcucccuggaguuccugcucccgcccgagcccgacuacagccugcugcucacguucaucuacaacgggcggguggugggcgaggcccagguccagucccuggacugccgccugguggcggagcccagcggcuccgagagcuccauggagcagguccucuucccgaagcccgggccccuggagcccacccagcggcugcucagccagcuggagcgcggcauccugguggccuccaacccgcggggccucuucgugcagcgccugugccccauccccaucagcuggaacgcgccccaggccccgcccggccccgggccccaccuccugccguccaacgagugcguggagcuguuccggaccgccuacuucugccgcgaccugguccgguacuuccagggccucgggcccccgcccaaguuccaggugacccugaacuucugggaggagagccacggguccagccacacgccccagaaccugaucaccgugaagauggagcaggccuucgcccgcuaccuccuggagcagacccccgagcagcaggccgccauccugucccucgucuga

SEQ ID NO: 31697 - RNA, 1446 nt, Artificial Sequence
  derived and/or modified sequence opt1 from IRG1__Homo_sapiens__NP_001245335
augaugcucaagagcaucaccgaguccuucgccaccgccauccacggccugaagguggggcaccugacggaccgcgucauccagcggagcaagcgcaugauccuggacacccucggcgcgggguuccugggcaccaccacggagguguuccacaucgccucccaguacagcaagaucuacuccagcaacaucuccagcaccgugugggggcagcccgacauccggcugccgcccaccuacgccgccuucgucaacggcguggccauccacuccauggacuucgacgacaccuggcaccccgcgacgcaccccagcggcgccgugcucccgguccugaccgcccuggccgaggcgcucccccgcucccccaaguucagcgggcuggaccugcuccuggccuucaacgugggcaucgaggugcaggggcggcugcuccacuucgccaaggaggccaacgacaugcccaagcgcuuccacccgcccuccgucgugggcacccuggggagcgccgcggccgccuccaaguuccugggccucagcuccaccaagugccgggaggcccuggccaucgcggugagccacgccggcgcccccauggccaacgccgcgacgcagaccaagccccugcacaucgggaacgccgccaagcacggcaucgaggccgccuuccucgcgaugcuggggcugcagggcaacaagcagguccucgaccuggaggccggcuucggggccuucuacgccaacuacuccccgaaggugcugcccagcaucgcgagcuacuccuggcuccuggaccagcaggacguggccuucaagcgcuuccccgcccaccugagcacccacugggucgccgacgccgcggccuccgugcggaagcaccucguggccgagcgcgcccugcugcccaccgacuacaucaagcggaucguccuccgcaucccgaacgugcaguacgugaaccggcccuuccccgucagcgagcacgaggcccgccacuccuuccaguacguggcgugcgccaugcugcuggacggcgggaucacggugcccagcuuccacgagugccagaucaaccggccgcagguccgcgagcuccuguccaagguggagcuggaguacccgcccgacaaccuccccagcuucaacauccuguacugcgagaucuccgucacccugaaggacggcgccaccuucaccgaccggagcgacacguucuacgggcacuggcgcaagccccucucccaggaggaccuggaggagaaguuccgggccaacgccagcaagaugcuguccugggacaccguggagagccucaucaagaucgugaagaaccuggaggaccuggaggacugcuccguccucaccacccugcugaagggccccagcccgcccgagguggcguccaacagccccgccugcaacaacuccaucacgaaccugagcuga

SEQ ID NO: 31698 - RNA, 546 nt, Artificial Sequence
  derived and/or modified sequence opt1 from IRGM__Homo_sapiens__NP_001139277
auggaggccaugaacguggagaaggccagcgcggacggcaaccugcccgaggucaucuccaacaucaaggagacccucaagaucgugagccgcaccccggugaacaucacgauggccggggacuccggcaacgggaugagcaccuucaucuccgcccugcggaacaccggccacgaggggaaggccagcccgcccaccgagcuggucaaggccacgcagcgcugcgcguccuacuucagcucccacuucagcaacguggugcucugggaccugcccggcaccggcuccgccaccaccacgcuggagaacuaccucauggagaugcaguucaaccgguacgacuucaucauggucgccagcgcccaguucuccaugaaccacgugaugcuggcgaagaccgccgaggacauggggaagaaguucuacaucguguggaccaagcuggacauggaccucagcaccggcgcccugcccgagguccagcugcuccagauccgcgagaacgugcuggagaaccugcagaaggagcgggugugcgaguacuga

SEQ ID NO: 31699 - RNA, 3729 nt, Artificial Sequence
  derived and/or modified sequence opt1 from IRS1__Homo_sapiens__NP_005535
auggccagccccccggaguccgacggcuucagcgacgugcgcaaggucggguaccugcggaagcccaaguccaugcacaagcgcuucuucgugcuccgggccgcgagcgaggccggcgggcccgcccgccuggaguacuacgagaacgagaagaaguggcggcacaaguccagcgcccccaagcgcuccaucccgcuggagagcugcuucaacaucaacaagcgggccgacuccaagaacaagcaccucguggcgcuguacacccgcgacgagcacuucgccaucgccgccgacagcgaggcggagcaggacuccugguaccaggcccugcuccagcugcacaaccgggccaagggccaccacgacggggccgccgcgcugggcgccggcgggggcgggggcagcugcuccgggagcuccggccucggcgaggccggggaggaccugagcuacggcgacgucccccccgggcccgccuucaaggagguguggcaggugauccugaagccgaagggccucggccagaccaagaaccugaucgggaucuaccgccugugccucacguccaagaccaucagcuucgucaagcugaacuccgaggccgcggccguggugcugcagcucaugaacauccggcgcugcggccacagcgagaacuucuucuucaucgaggucgggcggagcgccgugaccggccccggggaguucuggaugcagguggacgacuccgucguggcccagaacaugcacgagaccauccuggaggccaugcgcgcgaugagcgacgaguuccggccccgcuccaagagccaguccagcuccaacugcagcaaccccaucuccgugccgcugcggcgccaccaccucaacaaccccccccccagccaggucggccugacgcggcgcucccggaccgagagcaucaccgccaccuccccggccagcauggugggcgggaagcccggcuccuuccgcgugcgcgccagcuccgacggggagggcacgaugagccggcccgccuccgucgacgggagccccgugagcccguccaccaaccgcacccacgcgcaccggcaccgcggcagcgcccggcugcaccccccccucaaccacucccgcagcauccccaugccggccucccggugcagccccuccgccaccagccccgugucccugagcuccagcuccacgagcggccacggguccaccagcgacugccuguucccccgccgguccagcgcgagcgucuccggcagcccguccgacgggggcuucaucagcuccgacgaguacgggagcucccccugcgacuuccgcagcuccuuccggagcgugacccccgacucccucggccacaccccgcccgcccgcggcgaggaggagcugagcaacuacaucugcauggggggcaaggggcccuccacgcugaccgcccccaacggccacuacauccucagccggggcgggaacggccaccgcugcaccccggggaccggccuggggacgucccccgcccuggccggcgacgaggcggccagcgccgccgaccucgacaaccgguuccgcaagcggacccacuccgccggcaccagccccaccaucacgcaccagaagacccccucccagagcagcguggcguccaucgaggaguacaccgagaugaugccggccuacccccccgggggcgggagcggcgggcgccugcccggccaccggcacuccgccuucgucccgacccgcagcuaccccgaggagggccuggagaugcacccccucgagcgccgggggggccaccaccgccccgacuccagcacgcugcacaccgacgacggguacaugccgaugucccccggcguggcccccguccccagcgggcggaagggcuccggcgacuacaugccgaugagccccaaguccgugagcgccccccagcagaucaucaaccccauccgccggcacccgcagcgcguggaccccaacggguacaugaugaugucccccagcggcgggugcuccccggacaucggcgggggccccagcuccagcuccagcagcuccaacgcgguccccagcggcaccuccuacgggaagcuguggaccaacggcguggggggccaccacagccacgugcucccccacccgaagccccccgucgaguccagcggcgggaagcugcugcccugcacgggcgacuacaugaacauguccccggugggggacagcaacaccuccagccccuccgacugcuacuacggccccgaggacccccagcacaagccggugcucagcuacuacucccugccccggagcuucaagcacacccagcgccccggggagcccgaggagggcgcccggcaccagcaccugcgccucuccaccagcuccggccggcugcuguacgccgccacggcggacgacagcuccagcagcaccuccagcgacucccucgggggcggguacugcggcgcccgccuggagccgagccugccccacccccaccaccagguccugcagccccaccucccgcggaagguggacaccgccgcccagaccaacucccgccuggcccggcccacccgccugagccucggggaccccaaggcguccacgcugccccgggcccgcgagcagcagcagcagcagcagccgcugcuccacccccccgagcccaagagcccgggcgaguacgugaacaucgaguucggcuccgaccagagcggguaccuguccggccccgucgccuuccacagcucccccagcgugcggugcccgucccagcugcagcccgccccccgcgaggaggagaccgggaccgaggaguacaugaagauggaccucggccccgggcggcgcgccgcguggcaggagagcaccggcguggagaugggccgccuggggccggccccccccggcgccgccuccaucugccggcccacgcgcgccgucccgagcucccggggggacuacaugaccaugcagaugagcugcccccgccagagcuacguggacaccucccccgcggcccccgugagcuacgccgacaugcggaccggcaucgccgcggaggaggucucccugccgcgcgccacgauggccgccgccagcuccagcuccgcggccagcgccucccccaccggcccccagggggccgccgagcucgcggcccacagcucccugcugggcgggccccagggcccggggggcaugagcgccuucacccgggugaaccucucccccaaccgcaaccagagcgccaaggugauccgggccgacccccagggcugccgccggcgccacuccagcgagaccuucuccagcacgcccuccgcgacccgggucgggaacaccgugccguucggcgccggggccgccgugggcgggggcggcgggagcagcuccagcuccgaggacgucaagcgccacagcuccgccagcuucgagaacguguggcugcggcccggcgagcuggggggcgcgcccaaggagcccgccaagcucugcggggccgccggcggccuggagaacgggcugaacuacaucgaccucgaccuggugaaggacuucaagcagugcccgcaggagugcacccccgagccccagcccccgccccccccgcccccccaccagccccugggcuccggggagagcuccagcacgcgccgguccagcgaggaccucuccgcguacgccagcaucuccuuccagaagcagccggaggaccgccaguga

SEQ ID NO: 31700 - RNA, 4017 nt, Artificial Sequence
  derived and/or modified sequence opt1 from IRS2__Homo_sapiens__NP_003740
auggccagcccgccccgccacggcccgcccgggcccgccuccggcgacgggcccaaccugaacaacaacaacaacaacaacaaccacagcgugcggaagugcggcuaccuccgcaagcagaagcacgggcacaagcgguucuucgugcugcgcggccccggcgccgggggcgacgaggccaccgccgggggcgggagcgcgccccagccgccccggcuggaguacuacgagagcgagaagaaguggcgcuccaaggccggcgcccccaagcgggugaucgcccucgacugcugccugaacaucaacaagcgcgccgacgccaagcacaaguaccugaucgcccucuacaccaaggacgaguacuucgccguggccgccgagaacgagcaggagcaggagggcugguaccgggcccugaccgaccuggucagcgaggggcgcgccgccgccggcgacgcgccgcccgccgcggcccccgccgccuccugcagcgccucccuccccggggcgcugggcggcagcgccggggccgccggcgccgaggacuccuacgggcugguggcccccgccaccgccgccuaccgggagguguggcaggucaaccucaagcccaagggccuggggcagagcaagaaccugaccggcguguaccgccucugccuguccgcgcggaccaucggcuucgugaagcugaacugcgagcagcccagcgucacccuccagcugaugaacauccgccggugcgggcacuccgacagcuucuucuucaucgaggugggccgcuccgccgugaccgggcccggcgagcuguggaugcaggccgacgacagcgucguggcccagaacauccacgagaccauccucgaggccaugaaggcgcugaaggagcuguucgaguuccggccccgcuccaagagccagagcuccgggagcuccgccacccaccccaucagcgugcccggcgcccggcgccaccaccaccucgucaaccugccgcccucccagaccggccuggugcggcgcagccgcaccgacucccucgccgccacgccgcccgcggccaagugcagcuccugccgggugcgcaccgccagcgagggggacggcggggccgccgcgggcgccgccgccgcgggggcccggcccgucuccguggccggcagcccccugucccccggccccgugcgcgcgccccucagccggucccacacccucagcgggggcugcgggggccgcggcuccaaggucgcccugcugcccgccgggggcgcccuccagcacagccgguccaugagcaugcccguggcccacuccccgcccgccgccaccucccccgggagccuguccagcuccagcggccacggguccggcagcuacccgcccccgcccggcccccacccgccccugccccacccccuccaccacgggcccggccagcgccccuccagcggguccgcgagcgccuccggcagccccuccgacccgggguucaugagccuggacgaguacggcuccagccccggcgaccugcgggccuucugcagccaccgcuccaacacccccgagagcaucgccgagacgccgcccgcccgggacgggggcgggggcggggaguucuacggcuacaugacgauggaccgcccccucucccacugcggccggagcuaccgccggguguccggggacgcggcccaggaccuggaccgcggccugcggaagcgcaccuacagccucaccacccccgcccggcagcgccccgucccccagcccuccagcgccucccuggacgaguacacgcugaugcgcgcgaccuucagcggguccgccggccggcucugccccagcugcccggccuccagccccaagguggccuaccaccccuaccccgaggacuacggggacaucgagaucggcucccaccgcagcuccagcuccaaccugggcgccgacgacggguacaugccgaugacccccggcgcggcccuggccgggagcggcagcggcuccugccggagcgacgacuacaugcccaugucccccgccagcgucuccgccccgaagcagauccuccagccccgcgcggccgccgccgccgcggccgccgugcccagcgccgggcccgccggcccggcgcccaccuccgccgccgggcggacguuccccgccagcggcgggggcuacaaggcguccagccccgccgaguccagcccggaggacuccggcuacaugcgcauguggugcgggagcaagcuguccauggagcacgccgacggcaagcugcugcccaacggggacuaccucaacgugagccccuccgacgccgucaccaccggcacgccgcccgacuucuucagcgccgcgcugcaccccgggggcgagccccugcggggcgugcccgggugcugcuacuccagccucccccgcagcuacaaggcccccuacacgugcggcggggacuccgaccaguacgugcugaugagcucccccgucggccggauccuggaggaggagcgccucgagccccaggccaccccggggcccagccaggccgccuccgcguucggcgccggccccacccagccgccccaccccguggugcccagcccgguccggcccuccgggggccgccccgagggguuccugggccagcggggccgcgccgugcggcccacccgccugagccucgaggggcugccgucccugcccagcaugcacgaguacccccucccgcccgagcccaagucccccggcgaguacaucaacaucgacuucggggagcccggcgcccggcugagcccgcccgcgccgccccugcucgcguccgccgccagcuccagcucccugcugagcgccuccagccccgcgagcucccucgggagcggcacgcccggcaccuccagcgacucccgccagcggagcccccuguccgacuacaugaaccuggacuucagcucccccaagagcccgaagcccggggcccccuccggccaccccguggggagccucgacggccugcuguccccggaggccagcucccccuacccgccccugccgccccgccccagcgccucccccagcuccagccugcagccgccgccgcccccgcccgcccccggggagcuguaccggcucccgcccgcgagcgccgucgccaccgcccagggccccggcgccgcguccagccuguccagcgacaccggggacaacggcgacuacacggagauggccuucgggguggccgccacgccgccccagcccaucgccgcgccgcccaagcccgaggccgcccgcguggccucccccaccagcggcgucaagcgccugucccucauggagcaggucagcgggguggaggcguuccugcaggccucccagccgcccgacccccaccggggcgccaaggucauccgcgccgacccccagggcgggcggcgccggcacagcuccgagaccuucagcuccaccacgaccgugacccccgugagcccguccuucgcccacaaccccaagcgccacaacagcgcguccgucgagaacgugagccugcggaaguccagcgagggcggggugggcgucgggcccggcggcggggacgagcccccgaccagcccccgccagcuccagcccgcgccgccccuggcgccccagggccggcccuggacgcccgggcagcccggcggccugguggggugccccggcuccgggggcagccccaugcgccgggagaccuccgccggguuccagaacggccucaacuacaucgccaucgacgugcgcgaggagcccggccugccgccccagccccagcccccgccgccgccccugccgcagcccggggacaagagcuccuggggccggacccgcagccucgggggccugaucuccgcggucggggugggcagcaccggcgggggcugcgggggccccgggcccggcgcccugccgcccgccaacacguacgccuccaucgacuuccucagccaccaccugaaggaggccaccaucgugaaggaguga

SEQ ID NO: 31701 - RNA, 3774 nt, Artificial Sequence
  derived and/or modified sequence opt1 from IRS4__Homo_sapiens__NP_003595
auggccagcugcuccuucacccgcgaccaggccacccggcgccugcggggcgcggccgccgccgccgcggccgcccucgccgcgguggucacgaccccccugcugagcuccgggaccccgaccgcccucaucggcacggggagcuccugccccggcgccauguggcugagcaccgccaccgggucccgcagcgacuccgagagcgaggaggaggaccugcccgugggcgaggaggugugcaagcggggcuaccuccgcaagcagaagcacgggcaccggcgcuacuucguccugaagcuggagaccgccgacgcgcccgcccggcucgaguacuacgagaacgcccgcaaguuccggcacuccgugcgcgccgccgcggccgccgccgccgcggccgccagcggcgccgccaucccgccccugauccccccccggcgcgugaucacgcuguaccagugcuucuccgucagccagcgggcggacgcccgcuaccggcaccucaucgcccuguucacccaggacgaguacuucgccaugguggcggagaacgaguccgagcaggagagcugguaccugcuccugucccgccugauccucgagagcaagcggcgccggugcgggacccugggcgcccagccggacggggagcccgccgcccuggccgcggccgccgccgccgagccccccuucuacaaggacguguggcaggucaucgugaagccgcgcggccucggccaccgcaaggagcuguccgggguguuccggcugugccucaccgacgaggaggucguguucgugcgccugaacacggaggucgcgagcguggugguccagcugcucagcauccggcgcugcggccacuccgagcaguacuucuuccuggagguggggcggagcaccgugaucggccccggcgagcuguggaugcaggucgacgacugcgugguggcccagaacaugcacgagcucuuccuggagaagaugcgcgcccugugcgccgacgaguaccgggcccgcugccgguccuacagcaucuccaucggggcgcaccuccugacccugcucagcgcccgccggcaccugggccuggucccccucgagcccgggggcuggcugcgccggucccgcuucgagcaguucugccaccugcgggccaucggggacggcgaggacgagaugcucuucacccgccgguucgugacgccgagcgagcccgucgcccacucccgccggggccgccugcaccugccccgcgggcggcgcagccggcgcgcgguguccgugcccgccagcuucuuccggcgccucgccccgucccccgcccggccccgccaccccgccgaggcgccgaacaacggcgcccggcugagcuccgaggucagcggguccggcagcgggaacuucggcgaggagggcaacccccaggggaaggaggaccaggagggcuccgggggcgacuacaugcccaugaacaacugggggagcggcaacggccgcgggagcggcgggggccagggcuccaacgggcagggcagcuccagccacuccagcgggggcaaccagugcuccggggagggccagggcagccgggggggccagggguccaacggccaggggagcggcggcaaccagugcucccgcgacgggcagggcaccgccgggggccacgggagcggcggcgggcagcggcccggcgggggccacggguccggcggcgggcagggcccgggggacggccacggcagcgggggcgggaagaacuccggcgggggcaagggcagcggguccggcaaggggagcgacggcgacggggagcgcggcaagagccugaagaagcgguccuacuucggcaagcucacccagagcaagcagcagcagaugccccccccgcccccccccccgcccccccccccgcccgccgggggcaccgggggcaaggggaaguccggcggccgcuuccggcuguacuucugcguggaccgcggggccacgaaggagugcaaggaggcgaaggaggugaaggacgccgagauccccgagggcgccgcccgggggccccaccgcgcccgggcguucgacgaggacgaggacgacccguacguccccaugcgccccggcguggccaccccccuggugagcuccagcgacuacaugccgauggccccccagaacgucuccgccagcaagaagcgccacucccggagccccuucgaggacucccgcggcuacaugaugauguucccccgggugagcccgccccccgcgcccuccccgcccaaggcccccgacaccaacaaggaggacgacagcaaggacaacgacuccgagagcgacuacauguucauggccccgggggccggcgccauccccaagaacccccgcaacccccaggggggcuccagcuccaagagcuggagcuccuacuucagccugccgaaccccuuccgguccagcccccucgggcagaacgacaacuccgaguacgugcccaugcugccgggcaaguuccugggccgcgggcucgacaaggaggucagcuacaacugggaccccaaggacgcggccuccaagcccagcggcgagggguccuucagcaagcccggcgacgggggcuccccgagcaagcccuccgaccacgagccccccaagaacaaggccaagcggccgaaccgccugagcuucaucaccaagggcuacaagaucaagcccaagccccagaagcccacgcacgagcagcgggaggccgacuccagcuccgacuacgugaacauggacuucaccaagcgcgagagcaacaccccggcccccuccacccaggggcugcccgacagcuggggcaucaucgcggagccccggcagagcgccuucuccaacuacgugaacgucgaguucggggugccguuccccaaccccgccaacgaccucagcgaccugcugcgcgccaucccccgggccaacccgcucucccuggacagcgcgcgcuggccccugcccccgcucccccuguccgccacgggcagcaacgccaucgaggaggagggggacuacaucgaggugaucuucaacuccgccaugacccccgccauggcgcuggccgacagcgccauccgguacgacgccgagaccggccgcaucuacgucguggaccccuucuccgagugcugcauggacaucagccucuccccgagccggugcuccgagcccccccccguggcgcgccugcugcaggaggaggagcaggagcggcgccgcccgcagagccggucccagagcuucuucgccgccgcccgcgccgcggucuccgccuuccccaccgacagccucgagcgggaccugucccccagcagcgcccccgccguggccuccgcggccgagccgacgcuggcccucagccagguggucgccgccgcguccgcccuggccgccgcgcccggcaucggggccgccgccgccgcggccggcuucgacagcgccuccgcccgcugguuccagcccguggccaacgcggccgacgccgaggccgugcggggggcccaggacgucgcgggcgggagcaaccccggcgcccacaacccguccgccaaccuggcccgcggcgacaaccaggcggggggcgccgccgccgccgcggccgcccccgagccccccccgcggagccgccgggugccccgcccccccgagcgggaggacuccgacaacgacgacgacacccacgugcgcauggacuucgcccggcgcgacaaccaguucgacagcccgaagcgggggcgcuga

SEQ ID NO: 31702 - RNA, 1443 nt, Artificial Sequence
  derived and/or modified sequence opt1 from IRX1__Homo_sapiens__NP_077313
augagcuucccccagcugggcuacccgcaguaccucuccgccgccgggcccggcgcguacgggggcgagcgccccggggugcuggccgccgccgccgcggccgccgccgcggccagcuccggccggcccggcgccgccgagcucgggggcggggccggcgcggccgccgucaccagcgugcuggggauguacgccgccgcgggcccguacgccggcgcccccaacuacuccgccuuccugcccuacgccgcggaccugagccucuucucccagauggggagccaguacgagcugaaggacaaccccggcgugcacccggccaccuucgccgcccacaccgcccccgcguacuaccccuacgggcaguuccaguacggcgaccccggccgcccgaagaacgccacccgggaguccaccagcacccugaaggccuggcucaacgagcaccgcaagaaccccuaccccacgaagggggagaagaucaugcuggccaucaucaccaagaugacccugacccaggucuccacgugguucgcgaacgcccggcgccggcucaagaaggagaacaaggugaccuggggcgcccgcagcaaggaccaggaggacggggcccuguucggcuccgacaccgagggggaccccgagaaggccgaggacgacgaggagaucgaccuggagagcaucgacaucgacaagaucgacgagcacgacggcgaccaguccaacgaggacgacgaggacaaggcggaggccccgcacgcccccgccgcccccagcgcgcucgcccgggaccagggcagcccccuggccgccgccgacgugcugaagccgcaggacagcccccucgggcuggcgaaggaggcccccgagcccggcuccacccgccugcucagcccgggggccgccgcgggcgggcugcagggcgcgccccacggcaagcccaagaucuggagccuggccgagacggccaccucccccgacggggccccgaaggccuccccgcccccgcccgccggccaccccggggcccacggccccuccgccggggccccgcuccagcaccccgcguuccugcccagccacggccuguacacgugccacaucggcaaguucuccaacuggaccaacagcgccuuccucgcccaggggucccugcugaacaugcggagcuuccucggcgucggggcgccccacgccgccccgcacggcccccaccuccccgccccgcccccgccccagccgcccguggccaucgcccccggcgcgcugaacggggacaaggccuccgugcgcagcucccccacccugcccgagcgggaccuggucccccgccccgacagccccgcccagcagcugaagucccccuuccagcccgugcgggacaacagccucgcgccccaggagggcacgccccgcauccuggccgcccugccguccgccuga

SEQ ID NO: 31703 - RNA, 1416 nt, Artificial Sequence
  derived and/or modified sequence opt1 from IRX2__Homo_sapiens__NP_150366
augagcuacccccagggcuaccuguaccaggcccccgggucccucgcccuguacagcugccccgcguacggcgccuccgcccuggccgcgccccgcagcgaggagcucgcccgguccgccagcggguccgccuucagccccuacccgggcuccgccgcguucaccgcccaggccgccaccggguucggcagcccccugcaguacuccgccgacgcggccgccgccgccgcgggcuuccccagcuacaugggggcccccuacgacgcccacacgaccggcaugaccggggccaucuccuaccacccguacggcagcgccgcguaccccuaccagcugaacgaccccgccuaccgcaagaacgccacccgggacgccacggccacccucaaggcguggcugaacgagcaccgcaagaaccccuacccgaccaagggggagaagaucaugcuggccaucaucaccaagaugacgcucacccagguguccaccugguucgccaacgcccggcgccggcugaagaaggagaacaagaugaccugggcgccccgcaacaagagcgaggacgaggacgaggacgagggcgacgccacgcgguccaaggacgagagccccgacaaggcccaggagggcaccgagaccuccgccgaggacgaggggaucagccugcacgucgacagccucaccgaccacuccugcagcgccgaguccgacggcgagaagcugcccugccgcgcgggggacccgcugugcgagagcggcuccgagugcaaggacaaguacgacgaccucgaggacgacgaggacgacgacgaggagggcgagcgggggcuggccccgcccaagcccgugacgagcuccccgcugaccggccucgaggccccgcugcugagcccgccgcccgaggccgccccgcgcgggggccggaagacgccccaggggucccgcaccagccccggcgcgcccccgcccgccuccaagcccaagcucuggagccuggccgagaucgccaccuccgaccugaagcagcccagccucggccccgggugcggcccgcccgggcugcccgccgcggccgcccccgccuccaccggcgcgccgcccgggggcagccccuaccccgccagcccccugcucggccggccccuguacuacaccucccccuucuacgggaacuacaccaacuacggcaaccugaacgccgcccuccaggggcagggccugcugcgcuacaacuccgccgcggccgcccccggggaggcccuccacacggcccccaaggcggccagcgacgccggcaaggccggcgcccacccccuggagagccacuaccggucccccgggggcggguacgagcccaagaaggacgcgagcgagggcugcaccguggucggcgggggcgugcagcccuaccuguga

SEQ ID NO: 31704 - RNA, 1506 nt, Artificial Sequence
  derived and/or modified sequence opt1 from IRX3__Homo_sapiens__NP_077312
augagcuucccccagcugggcuaccaguacauccgcccgcucuaccccuccgagcggcccggggccgccggcgggagcggcggguccgcgggcgcccgcggcgggcugggcgccggggccagcgagcugaacgccuccggcagccucuccaacgugcugagcuccgucuacggggcgcccuacgccgccgccgcggccgccgccgccgcgcagggcuacggcgccuuccugccguacgccgccgagcuccccaucuucccccagcugggggcccaguacgagcugaaggacagccccggcgugcagcacccggcggccgccgccgccuucccccacccccaccccgcguucuacccguacgggcaguaccaguucggcgaccccucccggcccaagaacgccacccgcgagagcaccuccacgcucaaggccuggcugaacgagcaccggaagaaccccuacccgaccaagggcgagaagaucaugcuggccaucaucaccaagaugacccucacccaggugagcacgugguucgccaacgcgcgccggcgccugaagaaggagaacaagaugaccugggcgccccggucccgcaccgacgaggaggggaacgccuacggcagcgagcgggaggaggaggacgaggaggaggacgaggaggacgggaagcgcgagcuggagcucgaggaggaggagcugggcggggaggaggaggacacgggcggcgaggggcuggccgacgacgacgaggacgaggagaucgaccucgagaaccuggacggcgccgccaccgagcccgagcugucccucgccggggccgcccggcgcgacggcgaccuggggcugggccccaucagcgacuccaagaacagcgacagcgaggacuccagcgagggccucgaggaccggccgcugcccguccugucccucgcgcccgcgcccccgcccguggccguggccagccccucccugcccagcccgcccgucucccuggaccccugcgccccggcccccgcccccgccagcgcccuccagaagcccaagaucuggucccuggccgagaccgcgaccagcccggacaacccccgccgguccccgcccggggccggcgggagcccgcccggcgccgccguggcgcccuccgcccugcagcucagccccgccgccgccgcggccgccgcccaccgccugguguccgcgccccuggggaaguuccccgccuggacgaaccggcccuuccccggcccgccgcccggcccccgccuccacccccugagccugcucggguccgccccgccccaccuccugggccugcccggggccgccggccaccccgccgcggccgccgccuucgcgcggcccgccgagcccgagggcgggaccgaccgcugcagcgcccuggaggucgagaagaagcugcucaagaccgccuuccagccggugccccgccggccccagaaccaccuggacgccgcgcuggugcucuccgcccugagcagcuccuga

SEQ ID NO: 31705 - RNA, 1560 nt, Artificial Sequence
  derived and/or modified sequence opt1 from IRX4__Homo_sapiens__NP_057442
augagcuacccccaguucggcuacccguacuccagcgcgccccaguuccugauggccaccaacucccucagcacgugcugcgaguccgggggccgcacccuggccgacagcgggcccgccgccuccgcccaggcccccguguacugcccggucuacgagagccggcugcucgcgaccgcccgccacgagcugaacuccgccgccgcgcugggcguguacgggggccccuacggcgggagccagggcuacgggaacuacgugaccuacggcuccgaggccagcgccuucuacucccucaacagcuucgacuccaaggacgggagcggcuccgcccacggcgggcuggcccccgcggccgccgccuacuaccccuacgagccggcccugggccaguaccccuacgaccgguacgggaccauggacagcggcacgcgccggaagaacgcgacccgcgagaccaccuccacgcucaaggccuggcugcaggagcaccggaagaaccccuaccccaccaagggcgagaagaucaugcuggccaucaucaccaagaugacccucacgcaggucagcaccugguucgccaacgcccgccggcgccugaagaaggagaacaagaugaccuggccgccccggaacaagugcgcggacgagaagcgccccuacgccgagggggaggaggaggagggcggggaggaggaggcccgggaggagccccucaagagcuccaagaacgccgagccggugggcaaggaggagaaggagcuggagcugagcgaccuggacgacuucgacccccucgaggccgagccgcccgcgugcgagcugaagccgcccuuccacucccuggacgggggccucgagcgcgugcccgccgcccccgacggcccggucaaggaggccagcggggcgcugcggaugucccuggccgccggcgggggcgccgcccucgacgaggaccuggagcgcgcgcggagcugccugcgcuccgccgccgccgggcccgagccccuccccggcgccgagggcgggccccaggugugcgaggcgaagcugggcuucgugcccgccggggccagcgccggccuggaggccaagccccggaucuggucccucgcgcacaccgccacggccgccgcggccgccgccaccagccugucccagaccgaguucccgagcugcaugcugaagcgccaggggcccgccgcgcccgccgccgucuccagcgcccccgccaccuccccgagcguggcgcucccccacuccggcgcccuggaccggcaccaggacagccccgugacgucccugcgcaacugggucgacggcguguuccacgaccccauccuccgccacagcacccugaaccaggccugggccaccgccaagggggcgcugcucgacccgggcccccuggggcggagccugggcgccggcgccaacgugcucaccgcgccccuggcccgcgccuucccgcccgccgucccccaggacgcccccgccgcgggggccgcccgggagcugcucgcccugcccaaggccggcgggaagccguucugcgcguga

SEQ ID NO: 31706 - RNA, 1449 nt, Artificial Sequence
  derived and/or modified sequence opt1 from IRX5__Homo_sapiens__NP_001239126
augagcuacccccagggcuaccuguaccagccguccgccagccucgcccuguacuccugccccgcguacagcaccuccgugaucagcgggccccgcaccgacgagcugggccgguccagcuccgggagcgccuucucccccuacgccggcagcacggccuucaccgccccgucccccggguacaacagccaccuccaguacggcgcggaccccgccgccgccgcggccgccgccuucuccagcuacgucggcucccccuacgaccacaccccggggauggccggcagccugggguaccaccccuacgcggcgccccugggcuccuaccccuacggggacccggccuaccgcaagaacgccacccgggacgccacggccacccucaaggccuggcugaacgagcaccgcaagaaccccuaccccaccaagggcgagaagaucaugcuggccaucaucaccaagaugacgcucacccaggugagcaccugguucgccaacgcccggcgccggcugaagaaggagaacaagaugaccuggacgccccgcaaccggagcgaggacgaggaggaggaggagaacaucgaccuggagaagaacgacgaggacgagccgcagaagcccgaggacaagggcgaccccgaggggcccgaggcgggcgccgagcagaaggccgccuccgggugcgagcgccuccagggcccgcccacccccgccggcaaggagaccgaggggagccuguccgacagcgacuucaaggagcccccguccgagggccggcuggacgcgcuccaggggccgccccgcaccggcgggcccagccccgccggccccgccgccgcgcggcuggccgaggaccccgccccgcacuaccccgccggcgcccccgcgcccgggccgcaccccgccgccggcgaggugccgcccgggcccggcgggcccuccgucauccacagcccgccgcccccgcccccgcccgccgugcuggccaagcccaagcucuggucccuggcggagaucgccacgagcuccgacaaggugaaggacggcggcgggggcaacgaggggagccccugcccgcccugccccggccccaucgccgggcaggcccugggcggcucccgcgccagccccgcgcccgcccccucccggagccccuccgcccagugccccuuccccgggggcaccguccucagccgcccccuguacuacaccgcccccuucuacccgggguacaccaacuacggcuccuucggccaccuccacgggcaccccggccccgggcccggcccgacgaccgggcccggcagccacuucaacggccugaaccagaccgugcugaaccgggcggacgcccuggccaaggaccccaagaugcuccgcagccagucccagcuggaccugugcaaggacagccccuacgagcucaagaaggggauguccgacaucuga

SEQ ID NO: 31707 - RNA, 429 nt, Artificial Sequence
  derived and/or modified sequence opt1 from ISCU__Homo_sapiens__NP_055116
auggugcugaucgacaugagcgucgaccucuccacccaggugguggaccacuacgagaacccccgcaacgucggcagccuggacaagaccuccaagaacguggggacgggccuggugggggcccccgccugcggcgacgucaugaagcuccagauccagguggacgagaaggggaagaucguggacgcgcgguucaagaccuucggcugcggcagcgccaucgccuccagcucccuggccaccgagugggucaaggggaagaccguggaggaggcccugacgaucaagaacaccgacaucgcgaaggagcucugccugccgcccgugaagcugcacugcagcaugcucgccgaggacgccaucaaggccgcgcuggccgacuacaagcugaagcaggagcccaagaagggcgaggccgagaagaaguga

SEQ ID NO: 31708 - RNA, 546 nt, Artificial Sequence
  derived and/or modified sequence opt1 from ISG20__Homo_sapiens__NP_001290163
auggccggcagccgcgagguggucgccauggacugcgagaugguggggcugggcccccaccgggaguccgggcucgcgcgcugcagccuggugaacguccacggcgccgugcuguacgacaaguucauccggccggagggggagaucaccgacuaccgcacccggguguccggcgucacgccccagcacauggugggcgccacccccuucgccguggcccgccucgagauccugcagcugcucaaggggaagcuggucgugggccacgaccugaagcacgacuuccaggcgcucaaggaggacaugagcggguacaccaucuacgacaccuccacggaccggcugcuguggcgcgaggccaagcucgaccacugccggcgcgugagccugcggguccuguccgagcgccuccugcacaagagcauccagaacucccugcucggccacagcuccguggaggacgcccgggccaccauggagcuguaccagaucagccagcgcauccgggcgcgccgggggcugccccgccucgccguguccgacuga

SEQ ID NO: 31709 - RNA, 1050 nt, Artificial Sequence
  derived and/or modified sequence opt1 from ISL1__Homo_sapiens__NP_002193
augggcgacaugggggacccgcccaagaagaagcgccugaucagccucugcgugggcugcgggaaccagauccacgaccaguacauccugcgggucucccccgaccuggaguggcacgccgccugccucaagugcgcggagugcaaccaguaccuggacgagagcugcacgugcuucgugcgcgacggcaagaccuacugcaagcgggacuacauccgccuguacgggaucaagugcgccaagugcuccaucggcuucagcaagaacgacuucgugaugcgggcccgcuccaaggucuaccacaucgagugcuuccggugcguggccugcagccgccagcucauccccggcgacgaguucgcccugcgggaggacgggcuguucugccgcgcggaccacgacguggucgagcgggccucccucggcgccggggacccccugagcccgcugcaccccgcccgcccccuccagauggcggccgagcccaucuccgcccggcagccggcccugcgcccccacgugcacaagcagcccgagaagaccacccgggugcgcaccguccugaacgagaagcagcuccacacccugcggacgugcuacgccgcgaacccccgcccggacgcccugaugaaggagcagcucguggagaugaccggccugagcccccgggugauccgcgucugguuccagaacaagcggugcaaggacaagaagcgcuccaucaugaugaagcagcugcagcagcagcagcccaacgacaagaccaacauccaggggaugaccggcacgcccaugguggccgccagcccggagcgccacgacggcgggcuccaggccaaccccguggagguccaguccuaccagccgcccuggaaggugcugagcgacuucgcgcugcaguccgacaucgaccagcccgccuuccagcagcucgugaacuucagcgagggcgggcccggcuccaacagcaccggcuccgaggucgccagcaugagcucccagcugcccgacacccccaacagcaugguggccuccccgaucgaggccuga

SEQ ID NO: 31710 - RNA, 1395 nt, Artificial Sequence
  derived and/or modified sequence opt1 from ISM1__Homo_sapiens__NP_543016
auggugcgccuggccgccgagcuccugcugcuccugggccugcuccugcugacccuccacaucaccguccugcgggggagcggcgcggccgacgggcccgacgccgccgccggcaacgcgucccaggcccagcugcagaacaaccucaacguggggagcgacacgaccuccgagaccagcuucucccugagcaaggaggccccgcgcgagcaccuggaccaccaggccgcgcaccagcccuucccccggccccgcuuccggcaggagaccggccacccgucccuccagcgcgacuucccccggagcuuccugcuggaccuccccaacuuccccgaccuguccaaggccgacaucaacggccagaacccgaacauccaggugacgaucgaggucguggacgggcccgacagcgaggccgacaaggaccagcaccccgagaacaagcccuccuggagcgugccgucccccgacuggcgcgccugguggcagcggagccugucccucgcccgcgcgaacagcggcgaccaggacuacaaguacgacuccaccagcgacgacuccaacuuccugaacccgccccgggggugggaccacaccgcccccggccaccgcaccuucgagacgaaggaccagcccgaguacgacagcaccgacggggagggcgacuggagccugugguccgucugcagcgugaccugcggcaacgggaaccagaagcggacccgcuccugcggcuacgccugcacggccaccgagagccggaccugcgaccgccccaacugccccgggaucgaggacaccuuccggacggccgcgaccgaggugucccuccuggccggcagcgaggaguucaacgccaccaagcuguucgaggucgacaccgacuccugcgagcgcuggaugagcugcaaguccgaguuccucaagaaguacaugcacaaggugaugaacgaccugccgagcugccccugcuccuaccccacggagguggccuacagcaccgccgacaucuucgaccggaucaagcgcaaggacuuccgguggaaggacgcguccggccccaaggagaagcuggagaucuacaagccgaccgcccgcuacugcauccgcagcaugcucucccuggagagcaccacgcuggccgcccagcacugcugcuacggggacaacaugcagcucaucacccggggcaagggggccggcacccccaaccugaucuccaccgaguucagcgcggagcugcacuacaaggucgacgugcuccccuggaucaucugcaagggggacuggucccgcuacaacgaggcccggcccccgaacaacggccagaagugcacggagagccccagcgacgaggacuacaucaagcaguuccaggaggcccgcgaguacuga

SEQ ID NO: 31711 - RNA, 879 nt, Artificial Sequence
  derived and/or modified sequence opt1 from ISM2__Homo_sapiens__NP_872315
augcgcgcccugcgggaccgcgccggccuccugcugugcgugcuccugcuggcggcccuccuggaggccgcccuggggcuccccgucaagaagccgcggcugcgcggcccccggcccgggagccugacccgccucgccgagguguccgcgagccccgacccgcggccccugaaggaggaggaggaggcgccccugcucccccgcacccaccuccaggccgagccgcaccagcacggcugcuggacggugaccgagcccgccgccaugacccccgggaacgccacgcccccgcggacccccgaggucacgccccugcgccuggagcugcagaagcugcccggccucgccaacaccacccuguccaccccgaaccccgacacccaggccagcgccucccccgacccccggccgcugcgcgaggaggaggaggcgcggcuccugccccgcacccaccuccaggccgagcugcaccagcacggcugcuggaccgugacggagcccgccgcccugacccccgggaacgccaccccgccccggacccaggaggugacgccccugcuccuggagcugcagaagcuccccgagcugguccacgcgacccugagcaccccgaaccccgacaaccagaccaugucccuccgccggagcggcgugcccgggcugccggccgugggcacggccgcccuggccuccagccgcgggcucggccccgucgcgauggccgcccugccgccccggcccgugcccgugaccugcccgcccguccuggcccuccgcacccggacccccugggccucccccgugcgcagcggcuccagcuggcccgcgaugcugcgcacgugcaugaucaagauguggaccgccgugcgguccggguga

SEQ ID NO: 31712 - RNA, 1356 nt, Artificial Sequence
  derived and/or modified sequence opt1 from ISPD__Homo_sapiens__NP_001094896
auggaggccgggcccccgggcagcgcccgccccgcggagcccggccccugccuguccgggcagcggggcgccgaccacaccgccagcgccucccuccagagcguggccgggaccgagccgggccgccacccccaggcggucgccgccgugcugcccgccggcgggugcggcgagcggaugggggugcccacgccgaagcaguucugccccauccuggagcgcccccucaucuccuacacccugcaggcgcuggagcgggucugcuggaucaaggacaucgugguggccgucaccggcgagaacauggaggugaugaaguccaucauccagaaguaccagcacaagcgcaucagccucguggaggccggggucacccggcaccgcagcaucuucaacggccugaaggcccuggccgaggaccagaucaacuccaagcucagcaagcccgagguggugaucauccacgacgcgguccggccguucguggaggagggcgugcugcugaaggucgugacggccgccaaggagcacggggccgccggcgcgauccgcccccucguguccaccgucgugagccccuccgccgacgggugccuggacuacagccuggagcgggcccgccaccgggccuccgagaugccccaggccuuccucuucgacgugaucuacgaggcguaccagcagugcagcgacuacgaccuggaguucggcaccgagugccugcagcucgcccugaaguacugcugcaccaaggccaagcuggucgagggcuccccggaccucuggaaggugacguacaagcgcgaccuguacgccgccgagagcaucaucaaggagcggaucucccaggagaucugcguggucauggacaccgaggaggacaacaagcacguggggcaccuccuggaggagguccucaagagcgagcugaaccacgugaaggugaccagcgaggcgcugggccacgccgggcgccaccuccagcagaucauccuggaccagugcuacaacuucgucugcgugaacgugaccacguccgacuuccaggagacccagaagcugcugagcaugcuggaggaguccagccucugcauccuguaccccgucgugguggucuccgugcacuuccuggacuucaagcucgugccgcccagccagaagauggagaaccugaugcagauccgggaguucgccaaggaggucaaggagcgcaacauccugcucuacggccugcugaucuccuacccccaggacgaccagaagcuccaggagagccugcggcagggggccaucaucaucgcgucccugaucaaggagcgcaacagcggccucaucggccagcugcugaucgccuga

SEQ ID NO: 31713 - RNA, 1101 nt, Artificial Sequence
  derived and/or modified sequence opt1 from IST1__Homo_sapiens__NP_001257904
augcugggcagcggguucaaggccgagcgccuccgggugaaccugcgccuggucaucaaccggcucaagcugcuggagaagaagaagaccgagcucgcccagaaggcgcgcaaggagaucgccgacuaccuggccgccggcaaggacgagcgggcccgcauccggguggagcacaucauccgcgaggacuaccugguggaggcgauggagauccucgagcuguacugcgaccugcuccuggcccgguucgggcugauccaguccaugaaggagcucgacagcggccuggccgaguccgucagcacccugaucugggccgcgccccgccuccaguccgagguggccgagcugaagaucguggccgaccagcugugcgccaaguacagcaaggaguacgggaagcucugccggacgaaccagaucggcaccgucaacgaccgccugaugcacaagcuguccguggaggccccgcccaagauccucguggagcgguaccugaucgagaucgcgaagaacuacaacguccccuacgagcccgacagcguggugauggccgaggccccgcccggcgucgagaccgaccugaucgacgugggguucaccgacgacgugaagaagggcgggcccggccgcgggggcuccggcggguucacggcccccgucggcgggccggacggcaccgugcccaugcccaugcccaugccgaugcccaugcccagcgccaacacccccuucuccuacccgcuccccaagggccccagcgacuucaacgggcugcccaugggcaccuaccaggcguucccgaacauccacccgccccagauccccgccacgccgcccuccuacgagagcguggacgacaucaacgccgacaagaacaucuccagcgcccagaucgucgggcccggccccaagcccgaggccuccgcgaagcugcccagccggcccgccgacaacuacgacaacuucgugcucccggagcugcccuccgugcccgacacccugcccaccgccagcgccggggccagcaccuccgcgagcgaggacaucgacuucgacgaccucucccgccgguucgaggagcugaagaagaagacguga

SEQ ID NO: 31714 - RNA, 738 nt, Artificial Sequence
  derived and/or modified sequence opt1 from ISX__Homo_sapiens__NP_001290437
augugcgccgaggugggccccgcccugugccgcgggauggagcggaacagccucggcugcugcgaggcgccgaagaagcugucccugagcuucuccaucgaggccauccucaagcgccccgcccggcgcagcgacauggaccggcccgaggggcccggcgaggaggggccgggcgaggccgccgcguccggcagcgggcuggagaagccgcccaaggaccagccccaggagggccgcaaguccaagcggcgcguccggaccaccuucacgaccgagcagcugcacgagcucgagaagaucuuccacuucacccacuaccccgacgugcacauccgcagccagcuggccgcccggaucaaccugcccgaggcccgcgugcagaucugguuccagaaccagcgggcgaaguggcgcaagcaggagaagaucgggaaccucggcgcgccccagcagcuguccgaggccagcgucgcccugcccaccaaccucgacguggccgggccgacguggaccuccaccgcccugcggcgccuggccccgcccaccagcugcugccccuccgcccaggaccagcucgccagcgccugguuccccgcguggaucacgcugcugcccgcccaccccugggagacccagcccgugccgggccuccccauccaccagaccugcauccccguccugugcauccugcccccgccccaccccaaguggggcuccaucugcgccaccagcacguga

SEQ ID NO: 31715 - RNA, 1515 nt, Artificial Sequence
  derived and/or modified sequence opt1 from ISYNA1__Homo_sapiens__NP_001164409
auggaggccgccgcgcaguucuucguggagagccccgacgucguguacggcccggaggccaucgaggcccaguacgaguaccgcaccacccgggugucccgcgagggcgggguccugaaggaggccaacuacuacgggagccugacgcaggccggcaccgugucccuggggcuggacgcggagggccaggagguguucguccccuucagcgccgugcuccccaugguggcccccaacgaccuggucuucgacggcugggacaucuccagccugaaccucgccgaggcgaugcggcgcgccaaggugcuggacugggggcugcaggagcagcucuggccgcacauggaggcccugcggccccgccccuccguguacauccccgaguucaucgccgccaaccagagcgcgcgggccgacaaccugaucccgggcucccgcgcccagcagcucgagcagauccggcgcgacauccgggacuuccgcagcuccgccgggcuggacaaggucaucgugcuguggaccgccaacaccgagcgguucugcgaggugauccccggccucaacgacacggcggagaaccugcugcgcaccaucgagcucgggcuggaggucagccccuccacccuguucgccguggccagcauccucgagggcugcgccuuccugaacggcagcccccagaacacccuggugccgggggcccucgagcuggcguggcagcaccgggucuucgugggcggggacgacuucaaguccggccagacgaaggugaaguccguccugguggacuuccucaucggcagcgggcugaagaccauguccaucgugagcuacaaccaccugggcaacaacgacggggagaaccucagcgcgccccugcaguuccgcuccaaggaggucagcaaguccaacguggucgacgacauggugcagagcaaccccgugcuguacacccccggcgaggagccggaccacugcgucgugaucaaguacgugcccuacgucggggacuccaagcgggcccucgacgaguacaccagcgagcugaugcugggcggcacgaacacccucgugcugcacaacacgugcgaggacucccugcucgccgcccccaucaugcuggaccuggcccuccugaccgagcugugccagcgcgugagcuucugcaccgacauggaccccgagccgcagaccuuccaccccguccucucccugcugagcuuccucuucaaggcgccccuggugcccccggggucccccguggucaacgcccuguuccggcagcgcagcugcaucgagaacauccugcgggccugcgugggccucccgccccagaaccacaugcugcuggagcacaagauggagcgccccgggcccucccucaagcgcgugggccccgucgccgccaccuacccgaugcugaacaagaaggggcccgugcccgccgccaccaacggcugcacgggcgacgccaacgggcaccuccaggaggagcccccgaugcccaccaccuga

SEQ ID NO: 31716 - RNA, 2712 nt, Artificial Sequence
  derived and/or modified sequence opt1 from ITCH__Homo_sapiens__NP_001244066
augagcgacuccggcagccagcugggguccaugggcagccucaccaugaagucccagcugcagaucaccgugaucagcgccaagcugaaggagaacaagaagaacugguucgggcccucccccuacguggaggugacgguggacggccagagcaagaagaccgagaagugcaacaacaccaacucccccaaguggaagcagccccucaccgucaucgugacgcccgugagcaagcugcacuuccgcgucuggucccaccagacccucaagagcgacgugcugcuggggaccgccgcgcuggacaucuacgagacccucaaguccaacaacaugaagcuggaggagguggucgugacgcugcagcucggcggcgacaaggagccgaccgagaccaucggggaccugagcaucugccuggacggccuccagcuggaguccgagguggucaccaacggggagacgaccugcagcgagaacggcgugucccugugccucccccggcuggagugcaacagcgccaucuccgcccacugcaaccugugccuccccgggcugagcgacagccccaucuccgccagccgcguggccggcuucaccggcgcgucccagaacgacgacgggagccgguccaaggacgagacccgcgucagcacgaacggcuccgacgacccggaggacgccggggccggcgagaaccggcgcgugagcggcaacaacucccccagccuguccaacgggggcuucaagcccagccggcccccgcgccccucccggccgccgccgcccacgccccgccggcccgccagcgugaacgggucccccagcgcgaccuccgagagcgacggcuccagcaccgggagccucccgcccaccaacaccaacaccaacaccuccgagggcgccacgagcggccugaucaucccccugaccaucuccgggggcagcgggccccgcccccucaaccccgucacccaggcgccccugccgcccggcugggagcagcggguggaccagcacgggcgcguguacuacgucgaccacguggagaagcggaccacgugggaccgccccgagccccugccgcccggcugggagcggcgcguggacaacaugggccggaucuacuacgucgaccacuucacccgcaccaccacguggcagcggcccacccucgaguccgugcgcaacuacgagcaguggcagcugcagcgcagccagcugcagggggccaugcagcaguucaaccagcgguucaucuacggcaaccaggaccucuucgccaccucccagagcaaggaguucgacccccuggggccccugccgcccggcugggagaagcgcaccgacuccaacgggcgggucuacuucgugaaccacaacacgcgcaucacccagugggaggacccccggagccagggccagcucaacgagaagccccugcccgagggcugggagaugcgcuucaccguggacgggauccccuacuucgucgaccacaaccggcgcaccaccacguacaucgacccgcggaccggcaaguccgcccuggacaacgggccccagaucgccuacgugcgcgacuucaaggccaaggugcaguacuuccgguucuggugccagcagcucgccaugccccagcacaucaagaucaccgucacccgcaagacgcuguucgaggacagcuuccagcagaucauguccuucagcccccaggaccugcggcgccggcucugggugaucuucccgggcgaggagggccuggacuacgggggcguggcccgcgagugguucuuccugcucucccacgagguccugaaccccauguacugccuguucgaguacgcggggaaggacaacuacugccuccagaucaaccccgccagcuacaucaaccccgaccaccugaaguacuuccgguucaucggccgcuucaucgccauggcccuguuccacgggaaguucaucgacaccggcuucucccugccguucuacaagcggauccucaacaagcccgugggccugaaggaccuggagagcaucgaccccgaguucuacaacagccucaucugggugaaggagaacaacaucgaggagugcgaccuggagauguacuucuccgucgacaaggagauccugggggagaucaagagccacgaccucaagcccaacggcgggaacauccuggugaccgaggagaacaaggaggaguacauccgcaugguggccgaguggcgccugucccggggcgucgaggagcagacccaggcguucuucgagggguucaacgagauccucccgcagcaguaccugcaguacuucgacgccaaggagcuggaggugcuccugugcggcaugcaggagaucgaccugaacgacuggcagcgccacgccaucuaccggcacuacgcccgcacgagcaagcagaucaugugguucuggcaguucgugaaggagaucgacaacgagaagcggaugcgccuccugcaguucgucaccgggaccugccggcugcccgucggcggcuucgccgaccucaugggguccaacggcccccagaaguucugcaucgagaagguggggaaggagaacuggcugccgcgcagccacacgugcuucaaccggcuggaccucccgcccuacaaguccuacgagcagcugaaggagaagcuccuguucgcgaucgaggagaccgagggcuucggccaggaguga

SEQ ID NO: 31717 - RNA, 1395 nt, Artificial Sequence
  derived and/or modified sequence opt1 from ITFG1__Homo_sapiens__NP_001291931
auggacgugcugcucaccuaccugcccaagaacuacgccaagagcgagcugggcgccgucaucuucugggggcagaaccagacccucgacccgaacaacaugacgauccugaaccgcaccuuccaggacgagccccugaucauggacuucaacggcgaccucauccccgacaucuucgggaucaccaacgaguccaaccagccccagauccugcugggcgggaaccucagcuggcacccggcgcugaccacgaccuccaagaugcggaucccccacagccacgccuucaucgaccugaccgaggacuucaccgccgaccucuuccugacgacccugaacgccaccaccuccacguuccaguucgagaucugggagaaccucgacggcaacuucagcguguccaccauccuggagaagccccagaacaugaugguggucggccagagcgccuucgcggacuucgacggggacggccacauggaccaccuccugcccgggugcgaggacaagaacugccagaaguccaccaucuaccuggugcgcagcggcaugaagcagugggugccgguccugcaggacuucuccaacaaggggacccucuggggcuucgugcccuucguggacgagcagcagcccacggagauccccaucccgaucacccugcacaucggcgacuacaacauggacggguaccccgacgcccuggucauccucaagaacaccagcggcuccaaccagcaggccuuccugcuggagaacgugcccugcaacaacgccagcugcgaggaggcgcggcgcauguucaagguguacugggagcucaccgaccugaaccagaucaaggacgccauggucgccacguucuucgacaucuacgaggacgggauccuggacaucguggugcucuccaagggcuacaccaagaacgacuucgccauccacacccugaagaacaacuucgaggccgacgcguacuucgucaaggugaucgugcugagcggccucugcuccaacgacugcccccggaagaucaccccguucggggucaaccagcccggccccuacaucauguacacgaccguggacgccaacggguaccugaagaacggcagcgccgggcagcugucccagagcgcccaccucgcccugcagcugcccuacaacgugcucggccugggccgcagcgcgaacuuccuggaccaccucuacgucgggaucccgcggcccuccggcgagaaguccauccgcaagcaggaguggaccgccaucauccccaacagccagcugaucgugauccccuacccgcacaacgugccccggagcucccaccgcugccugugcuuccaccucgggaacaacuggcacuucacccuggccggcaaggagagccgguga

SEQ ID NO: 31718 - RNA, 1659 nt, Artificial Sequence
  derived and/or modified sequence opt1 from ITFG3__Homo_sapiens__NP_114428
augcuggaccacaaggaccucgaggccgagauccacccccugaagaacgaggagcgcaagagccaggagaaccugggcaacccguccaagaacgaggacaacgucaagagcgccccgccccagucccggcucagccgcugccgggcggccgccuucuuccugucccuguuccucugccuguucgugguguucguggucagcuucgugauccccugccccgaccgccccgccucccagcggauguggcgcaucgacuacagcgccgcggugaucuacgacuuccuggccgucgacgacaucaacggggaccggauccaggacguccucuuccuguacaagaacaccaacuccagcaacaacuucucccgcagcugcguggacgagggcuucuccagccccugcaccuucgccgccgcgguguccggggccaacggcagcacgcugugggagcggcccguggcccaggacguggcccucgucgagugcgccgugccgcagccccgcggguccgaggcgcccagcgccugcauccuggugggccggcccuccagcuucaucgccgucaaccuguucaccggcgagacccucuggaaccacagcuccagcuucuccgggaacgccagcauccuguccccgcugcuccaggugcccgacguggacggcgacggggcccccgaccugcugguccucacccaggagcgcgaggaggugagcggccaccuguacuccgggagcacgggccaccagaucggccugcgggggucccucggcguggacggggagagcggcuuccugcugcacgucacccgcaccggcgcgcacuacauccucuuccccugcgccuccagccugugcgggugcuccgugaagggccuguacgagaaggugaccgggagcggcgggccguucaaguccgacccccacugggagagcaugcucaacgccacgacccggcgcaugcugucccacagcuccggcgccguccgguaccugaugcacgugcccggcaacgccggggcggacguccuccuggugggcagcgaggccuucgugcugcucgacgggcaggagcugacgccccgcuggaccccgaaggccgcccacguccugcggaagcccaucuucggccgcuacaagcccgacacccucgccguggcgguggagaacgggaccggcaccgaccggcagauccuguuccuggaccucggcaccggggccguccugugcagccuggcccuccccucccugccgggcgggccccugagcgccucccuccccacggcggaccaccgcagcgccuucuucuucuggggccugcacgagcugggguccaccagcgagaccgagaccggcgaggcccgccacucccuguacauguuccaccccacgcucccgcgggugcugcuggagcucgccaacgugagcacccacaucgucgccuucgacgcggugcuguucgagcccucccgccacgccgccuacauccugcucaccggccccgccgacagcgaggccccggggcugguguccgucaucaagcacaaggugcgggaccuggugcccagcucccgcgucgugcggcucggcgagggcgggcccgacagcgaccaggcgauccgcgaccgguucucccgccugcgguaccagagcgaggccuga

SEQ ID NO: 31719 - RNA, 3111 nt, Artificial Sequence
  derived and/or modified sequence opt1 from ITGA10__Homo_sapiens__NP_001289969
augaacaucacccacgccuacagccagggccaccagaagcugaaccucgacaccguguccuacaacaugcugggggucgacagcgacggcugccccacguacauggacguggugaucguccuggacggguccaacagcaucuacccgugguccgaggugcagaccuuccuccgccggcuggugggcaagcuguucaucgaccccgagcagauccaggucgggcucgugcaguacggcgagagccccgugcacgaguggucccugggcgacuuccgcaccaaggaggaggucgugcgggccgcgaagaaccugagccgccgggaggggcgcgagaccaagacggcccaggccaucaugguggccugcaccgagggcuucucccagagccacgggggccggcccgaggccgcgcgccuccuggucguggugaccgacggggagucccacgacggcgaggagcugccggccgcccucaaggccugcgaggcgggccgggucacccgcuacgggaucgccgugcugggccacuaccugcggcgccagcgggaccccagcuccuuccuccgcgagauccggacgaucgccagcgaccccgacgagcgcuucuucuucaacgugaccgacgaggccgcccugaccgacaucgucgacgcgcugggggaccggaucuucggccucgagggcucccacgccgagaacgagagcuccuucgggcuggagaugagccagaucggcuucuccacccaccgccugaaggacgggauccucuucggcauggugggggccuacgacuggggcggcagcgugcuguggcuggagggcgggcaccgccucuucccgccccggauggcccuggaggacgaguucccgcccgcccugcagaaccacgcggccuaccucggguacagcgucuccagcaugcugcugcggggcgggcgccgccucuuccuguccggcgcgccccgguuccgccaccggggcaaggugaucgccuuccagcugaagaaggacggggccgugcgcgucgcccagagccuccagggcgagcagaucggguccuacuucggcagcgagcugugcccccuggacacggaccgggacgggaccaccgacgugcuccuggucgccgcccccauguuccugggcccccagaacaaggagaccggccgcguguacguguaccucgucgggcagcagucccugcugacgcuccagggcacccugcagcccgagccgccccaggacgcccgguucggguucgccaugggcgcgcugcccgaccucaaccaggacggcuucgccgacguggccgugggggcgccccuggaggacggccaccagggggcccuguaccucuaccacggcacccagagcgggguccgcccgcaccccgcccagcggaucgccgccgccuccaugccccacgcgcugagcuacuucggccgcuccguggacggccggcuggaccuggacggggacgaccucguggacgucgccgugggcgcccagggggccgccauccugcugagcucccgccccaucgugcaccucaccccgagccuggaggucacgccccaggcgaucuccguggugcagcgggacugccgccggcgcggccaggaggccgucugccugaccgccgcccucugcuuccaggugaccagccggacccccgggcgcugggaccaccaguucuacaugcgguucacggccucccuggacgaguggaccgcgggcgcccgcgccgccuucgacggcagcgggcagcgccugagcccccggcgccuccggcuguccgugggcaacgugaccugcgagcagcugcacuuccacguccucgacaccagcgacuaccugcgcccgguggcgcugacggucaccuucgcccucgacaacaccaccaagcccgggcccgugcugaacgagggcuccccgacgagcauccagaagcuggugcccuucuccaaggacugcgggcccgacaacgagugcgucaccgaccucgugcuccaggugaacauggacauccggggcagccgcaaggcccccuucgucgugcggggcgggcgccggaaggugcuggucuccaccacccuggagaaccgcaaggagaacgccuacaacacgagccugucccugaucuucagccggaaccuccaccuggccucccugaccccgcagcgcgagagccccaucaagguggagugcgcggcccccuccgcccacgcccggcucugcagcgugggccaccccgucuuccagaccggggccaaggugaccuuccugcuggaguucgaguucuccugcagcucccuccugagccagguguucgucaagcugaccgcguccagcgacagccucgagcgcaacggcacgcugcaggacaacaccgcccagaccuccgccuacauccaguacgagccgcaccuccuguucagcuccgagagcacccugcaccgguacgaggugcaccccuacgggacgcugcccgugggccccggcccggaguucaagaccacccuccgcguccagaaccuggggugcuacgugguguccggccugaucaucagcgcccuccugcccgccgucgcgcacgggggcaacuacuuccugucccucagccaggugaucaccaacaacgccuccugcaucgugcagaaccugacggagccgcccggcccgcccguccaccccgaggagcugcagcacaccaaccggcucaacgggagcaacacccagugccagguggugcgcugccaccugggccagcuggccaaggggaccgaggucuccgugggccuccugcggcuggugcacaacgaguucuuccgccgggccaaguucaagagccucacggucguguccaccuucgagcuggggaccgaggagggcagcguccugcagcucaccgaggcgucccgcuggagcgagucccugcuggagguggugcagacgcgccccauccucaucagccuguggauccugaucggcuccguccucgggggccugcugcuccuggcccugcucguguucugccuguggaagcugggguucuucgcccacaagaagauccccgaggaggagaagcgggaggagaagcucgagcaguga

SEQ ID NO: 31720 - RNA, 3567 nt, Artificial Sequence
  derived and/or modified sequence opt1 from ITGA11__Homo_sapiens__NP_001004439
auggaccugccccgcggccucguggucgccugggcccugagccuguggccgggguucaccgacaccuucaacauggacacgcggaagccccgcgugauccccggcucccggaccgcguucuucggguacaccgugcagcagcacgacaucagcggcaacaaguggcucgucgugggggcgccccuggagaccaacggcuaccagaagacgggcgacguguacaagugcccggucauccacgggaacugcaccaagcugaaccucggccgcgugacccuguccaacgugagcgagcggaaggacaacaugcgccuggggcucucccuggccaccaaccccaaggacaacagcuuccuggccugcagcccccucuggucccacgagugcggcuccagcuacuacacgaccgggaugugcucccgggucaacagcaacuuccgcuucuccaagaccguggcccccgcccugcagcggugccagaccuacauggacaucgugaucguccuggacggcagcaacuccaucuacccguggguggaggugcagcacuuccucaucaacauccugaagaaguucuacaucggccccgggcagauccaggucggcguggugcaguacggggaggacgucgugcacgaguuccaccugaacgacuaccgcagcgugaaggacgucguggaggccgccucccacaucgagcagcggggcggcacggagacccgcaccgccuucgggaucgaguucgcgcggagcgaggccuuccagaagggcgggcgcaagggcgccaagaaggugaugaucgucaucaccgacggggagucccacgacagccccgaccucgagaaggugauccagcagagcgagcgggacaacgucacgcgcuacgccguggccgugcugggcuacuacaaccggcgcggcaucaaccccgagaccuuccugaacgagaucaaguacaucgcguccgacccggacgacaagcacuucuucaacgucaccgacgaggccgcccucaaggacaucguggacgcccugggggaccggaucuucagccuggagggcaccaacaagaacgagacguccuucgggcucgagaugagccagaccggcuucuccagccacguggucgaggacggggugcugcugggcgccgugggcgcguacgacuggaacggggccguccucaaggagaccuccgccggcaaggugaucccccugcgcgagagcuaccugaaggaguuccccgaggagcucaagaaccacggggccuaccugggcuacaccgugacguccgucgugagcucccggcaggggcgcguguacgucgccggcgcgccccgcuucaaccacaccggcaaggugauccuguucaccaugcacaacaaccggagccucaccauccaccaggccaugcgcgggcagcagaucggcuccuacuucgggagcgagaucacguccguggacaucgacggcgacggcgucaccgacgugcugcuggugggggccccgauguacuucaacgagggccgggagcgcgggaaggucuacguguacgagcuccggcagaaccuguucguguacaacggcacccugaaggacagccacuccuaccagaacgcccgcuucgggagcuccaucgccagcguccgggaccucaaccaggacagcuacaacgacgugguggucggcgcgccccuggaggacaaccacgccggcgccaucuacaucuuccacggguuccgcggcuccauccugaagacccccaagcagcggaucacggccagcgagcucgcgaccgggcugcaguacuucggcugcuccauccacgggcagcuggaccucaacgaggacggccugaucgaccuggccgugggcgcccucgggaacgccgugauccuguggagccgccccgucgugcagaucaacgccucccugcacuucgagccgagcaagaucaacaucuuccaccgggacugcaagcgcuccggccgggacgcgaccugccuggccgccuuccucugcuucacccccaucuuccuggcgccccacuuccagacgaccaccguggggauccgcuacaacgccaccauggacgagcggcgcuacacgccccgggcccaccuggacgagggcggggaccgcuucaccaaccgggccguccuccugagcuccggccaggagcugugcgagcgcaucaacuuccacgugcucgacaccgccgacuacgugaagccggucaccuucagcguggaguacucccuggaggaccccgaccacggccccaugcuggacgacggguggcccaccacgcuccgcgugagcgucccguucuggaacggcugcaacgaggacgagcacugcgugcccgaccuggugcuggacgcccgguccgaccuccccaccgccauggaguacugccagcgcguccugcggaagccggcgcaggacugcagcgccuacacccuguccuucgacaccacgguguucaucaucgagagcacccgccagcggguggccgucgaggccacccucgagaaccgcggggagaacgcguacuccaccgugcugaacaucagccagagcgccaaccugcaguucgccucccucauccagaaggaggacagcgacggcuccaucgagugcgugaacgaggagcggcgccugcagaagcaggucugcaacgugagcuaccccuucuuccgggccaaggccaagguggcguuccgccuggacuucgaguucuccaagagcaucuuccuccaccaccuggagaucgagcuggccgccggguccgacagcaacgagcgggacuccacgaaggaggacaacgucgcgccccuccgcuuccaccugaaguacgaggccgacgugcuguucacccggagcuccagccucucccacuacgaggucaagcccaacagcucccuggagcgcuacgacggcaucggcccgcccuucagcugcaucuuccggauccagaaccuggggcuguuccccauccacggcaugaugaugaagaucaccauccccaucgccacccgcuccgggaaccggcugcugaagcuccgcgacuuccugacggacgaggccaacaccagcugcaacaucuggggcaacuccaccgaguaccggccgacccccguggaggaggaccugcgccgggcgccccagcucaaccacagcaacagcgacguggucuccaucaacugcaacauccgccuggugcccaaccaggagaucaacuuccaccuccucggcaaccuguggcugcgcagccucaaggcccugaaguacaaguccaugaagaucauggugaacgccgcccugcagcggcaguuccacagcccguucaucuuccgcgaggaggaccccucccggcagaucgucuucgagaucagcaagcaggaggacuggcagguccccaucuggaucaucgugggguccacgcucggcgggcugcugcuccuggcccugcucgugcuggcccuguggaagcucggcuucuuccgcagcgcccggcgccggcgcgagcccgggcuggacccgacccccaaggugcuggaguga

SEQ ID NO: 31721 - RNA, 3540 nt, Artificial Sequence
  derived and/or modified sequence opt1 from ITGA1__Homo_sapiens__NP_852478
auggcgccccgcccgcgggcccgccccggcguggccgucgccugcugcuggcugcucaccguggugcugcggugcugcgucagcuucaacguggacgugaagaacuccaugaccuucagcgggcccgucgaggacauguucggcuacaccgugcagcaguacgagaacgaggaggggaagugggugcugaucggcagcccccucgucgggcagccgaagaaccgcaccggcgacguguacaagugccccgugggccgcggggagucccugcccugcgucaagcuggaccuccccgugaacaccuccaucccgaacgugaccgaggucaaggagaacaugacguucggcagcacccuggugaccaaccccaacgggggcuuccuggccugcgggccccucuacgccuaccggugcggccaccuccacuacaccacgggcaucugcuccgacgugagccccaccuuccaggucgugaacuccaucgccccggugcaggagugcagcacccagcuggacaucgucaucgugcuggacggguccaacagcaucuaccccugggacuccgugaccgcguuccugaacgaccugcucgagcggauggacaucggccccaagcagacgcaggucgggaucgugcaguacggcgagaacgucacccacgaguucaaccugaacaaguacagcuccaccgaggaggugcugguggccgccaagaagaucguccagcgcggcgggcggcagaccaugacggcccucggcaucgacaccgcgcgcaaggaggccuucaccgaggcccgcggggcccggcggggcgugaagaaggugauggucaucgugaccgacggggagagccacgacaaccaccgccugaagaaggugauccaggacugcgaggacgagaacauccagcgguucuccaucgccauccugggcagcuacaaccgcggcaaccucuccacggagaaguucgucgaggagaucaagagcaucgcgagcgagcccaccgagaagcacuucuucaacguguccgacgagcuggcccuggugaccaucgucaagacccucggggagcggaucuucgcccuggaggccacggccgaccagagcgcggccuccuucgagauggagaugagccagaccggcuucuccgcccacuacagccaggacugggugaugcugggggccgugggcgccuacgacuggaacgggaccgucgugaugcagaaggcgucccagaucaucaucccgcgcaacaccacguucaacguggagagcaccaagaagaacgagccccucgccuccuaccugggcuacaccgucaacagcgccaccgccuccagcggcgacgugcuguacaucgccgggcagccccgguacaaccacacgggccaggugaucaucuaccgcauggaggacgggaacaucaagauccuccagacccuguccggcgagcagaucgggagcuacuucggcuccauccugaccaccacggacaucgacaaggacagcaacaccgacauccuccuggucggcgcgcccauguacauggggaccgagaaggaggagcagggcaagguguacguguacgcccugaaccagacccgguucgaguaccagaugucccucgagccgaucaagcagaccugcugcagcucccgccagcacaacagcugcacgaccgagaacaagaacgagcccugcggggcccgcuucggcaccgccaucgcggccgucaaggaccugaaccuggacggcuucaacgacaucgugaucggggcgccccucgaggacgaccacggcggggccguguacaucuaccacggcagcgggaagaccauccggaaggaguacgcccagcgcauccccuccggcggcgacgggaagacgcugaaguucuucggccagagcauccacggggagauggaccugaacggcgacgggcucaccgacgucaccaucggcggccugggcggggccgcccuguucuggucccgggacguggccguggucaaggugaccaugaacuucgagccgaacaaggugaacauccagaagaagaacugccacauggaggggaaggagacggucugcaucaacgccaccgugugcuucgacgugaagcucaagagcaaggaggacaccaucuacgaggccgaccugcaguaccgcgucacccuggacucccuccggcagaucagccgcuccuucuucagcggcacgcaggagcggaaggugcagcgcaacaucaccgugcggaaguccgagugcaccaagcacagcuucuacaugcuggacaagcacgacuuccaggacuccguccgcaucacccuggacuucaaccugacggaccccgagaacgggcccgugcucgacgacagccugcccaacuccgugcacgaguacaucccguucgcgaaggacugcggcaacaaggagaagugcaucagcgaccugucccuccacgucgccaccaccgagaaggaccugcugaucgugcggagccagaacgacaaguucaacgugucccucaccgucaagaacacgaaggacagcgccuacaacacccgcaccaucgugcacuacagccccaaccugguguucuccggcaucgaggccauccagaaggacagcugcgaguccaaccacaacaucacgugcaaggucggguaccccuuccugcggcgcggcgagauggugaccuucaagauccucuuccaguucaacaccagcuaccugauggagaacgugaccaucuaccuguccgccaccagcgacuccgaggagccgcccgagacgcucagcgacaacgucgugaacaucuccauccccgucaaguacgagguggggcugcaguucuacagcuccgcgagcgaguaccacaucuccaucgccgccaacgagaccgugcccgaggucaucaacagcaccgaggacaucggcaacgagaucaacaucuucuaccugauccggaaguccgggagcuucccgaugcccgagcucaagcuguccaucagcuuccccaacaugaccuccaacggcuaccccgugcuguacccgacgggccucagcagcuccgagaacgccaacugccgcccccacaucuucgaggaccccuucagcaucaacuccgggaagaagaugaccaccagcaccgaccaccugaagcggggcacgauccuggacugcaacacgugcaaguucgcgaccaucacgugcaaccucaccuccagcgacaucucccaggugaacgucagccugauccuguggaagcccaccuucaucaaguccuacuucagcucccucaaccugaccauccgcggggagcugcggagcgagaacgccucccucgugcugagcuccagcaaccagaagcgcgagcuggccauccagaucuccaaggacggccucccgggccgcgugccccugugggucauccugcucagcgccuucgccgggcugcugcuccugaugcugcucauccuggcgcuguggaagaucggcuucuucaagcggccccucaagaagaagauggagaaguga

SEQ ID NO: 31722 - RNA, 3120 nt, Artificial Sequence
  derived and/or modified sequence opt1 from ITGA2B__Homo_sapiens__NP_000410
auggcccgcgcccugugcccccuccaggcgcuguggcugcucgagugggugcugcugcuccugggcccgugcgccgccccgcccgccugggcccugaaccucgaccccguccagcugaccuucuacgcggggcccaacggcagccaguucggguucucccuggacuuccacaaggacagccacggccggguggccaucguggucggggcgccccgcacccucggccccucccaggaggagacgggcgggguguuccugugccccuggcgggccgagggcgggcagugcccgagccuccuguucgaccugcgcgacgagacccggaacgugggcucccagacccugcagaccuucaaggcccgccaggggcucggcgccagcgucguguccuggagcgacgugaucgucgccugcgcccccuggcagcacuggaacgugcuggagaagacggaggaggccgagaagacccccgugggcuccugcuuccuggcgcagcccgagagcgggcggcgcgccgaguacuccccgugccggggcaacacccucagccgcaucuacgucgagaacgacuucuccugggacaagcgguacugcgaggccggguucagcuccguggugacccaggccggcgagcugguccugggcgcccccgggggcuacuacuuccucgggcugcuggcgcaggcccccguggccgacaucuucagcuccuaccgccccggcauccuccuguggcacgugagcucccagagccugagcuucgacuccagcaacccggaguacuucgacggguacuggggcuacuccgucgccgugggcgaguucgacggggaccucaacacgaccgaguacguggucggcgcccccaccuggagcuggacccugggggcgguggagauccuggacuccuacuaccagcggcuccaccgccugcggggcgagcagauggccagcuacuucgggcacuccguggccgucacggacgugaacggcgacggccgccacgaccugcucgucggggcgccccuguacauggagagccgggccgaccgcaagcuggccgaggugggccggguguaccucuuccugcagccccgcgggccgcacgcccugggcgcccccucccuccugcugaccgggacccagcucuacggccgguucggcagcgccaucgcgccccugggggaccuggaccgcgacggcuacaacgacaucgccgucgccgcccccuacgggggcccguccggccgcggccaggugcucguguuccuggggcagagcgaggggcugcggucccgccccagccagguccuggacucccccuuccccaccggcagcgccuucggguucucccuccggggcgcgguggacaucgacgacaacggcuacccggaccugaucgugggggccuacggcgccaaccaggucgccguguaccgcgcccagcccguggucaaggcgagcgugcagcugcucgugcaggacucccugaaccccgccgucaagagcugcgugcugccgcagacgaagacccccgugagcugcuucaacauccagaugugcgucggggccaccggccacaacaucccccagaagcucucccugaacgccgagcugcagcucgaccggcagaagccccgccaggggcggcgcgugcugcugcucggcagccagcaggccggcaccacgcugaaccuggaccucgggggcaagcacuccccgaucugccacaccaccauggcguuccugcgggacgaggccgacuuccgcgacaagcugagccccaucgugcucucccugaacgucagccugccgcccaccgaggccgggauggcccccgcgguggugcuccacggcgacacgcacguccaggagcagacccggaucgugcuggacugcggggaggacgacgugugcgucccccagcugcagcucaccgccuccgugaccggcagcccccugcuggugggcgccgacaacguccucgagcugcagauggacgccgccaacgagggggagggcgcguacgaggccgagcuggccgugcaccucccccagggggcccacuacaugcgcgcccuguccaacguggagggcuucgagcggcugaucugcaaccagaagaaggagaacgagacgcgcgucgugcucugcgagcuggggaacccgaugaagaagaacgcgcagaucggcaucgccaugcuggugagcgucggcaaccucgaggaggccggggaguccgugagcuuccagcugcagauccgguccaagaacagccagaaccccaacuccaagaucgugcugcucgacguccccgugcgcgccgaggcccagguggagcugcggggcaacagcuuccccgcgucccuggucguggccgccgaggagggggagcgcgagcagaacagccucgacagcuggggcccgaagguggagcacaccuacgagcugcacaacaacggccccgggaccgucaacggccugcaccucuccauccaccuccccgggcagagccagcccuccgaccugcuguacauccuggacauccagccgcagggcgggcugcagugcuucccccagccgcccgugaacccccucaagguggacuggggccugcccauccccagcccgucccccauccaccccgcccaccacaagcgggaccgccgccagaucuuccugcccgagccggagcagcccagccggcuccaggaccccguccugguguccugcgacagcgcgcccugcaccgugguccagugcgaccugcaggagauggcccgcggccagcgggccauggugacgguccucgccuuccuguggcugccgucccucuaccagcgcccccuggaccaguucgugcugcagagccacgccugguucaacguguccagccuccccuacgcggugcccccgcugucccugccccgcggggaggcccaggucuggacccagcuccugcgggcccuggaggagcgggccauccccaucuggugggugcucgucggcgugcucgggggccugcugcugcugaccauccucgugcuggccauguggaaggucggguucuucaagcgcaaccggcccccgcuggaggaggacgacgaggagggcgaguga

SEQ ID NO: 31723 - RNA, 3546 nt, Artificial Sequence
  derived and/or modified sequence opt1 from ITGA2__Homo_sapiens__NP_002194
augggccccgagcgcaccggggccgccccgcugccccuccugcuggugcucgcgcugagccagggcauccugaacugcugccucgccuacaacgucgggcugcccgaggccaagaucuucuccggccccagcuccgagcaguucggguacgccgugcagcaguucaucaacccgaagggcaacuggcugcucgugggcagccccugguccggguuccccgagaaccggaugggcgacgucuacaagugccccguggaccugagcaccgccacgugcgagaagcugaaccuccagaccuccaccagcaucccgaacgugaccgagaugaagacgaacaugucccuggggcugauccucacccgcaacaugggcaccgggggcuuccugaccugcggcccccugugggcgcagcagugcgggaaccaguacuacacgaccggcgucugcagcgacaucucccccgacuuccagcucagcgccuccuucagccccgccacccagccgugccccucccugaucgacgugguggucgugugcgacgagagcaacuccaucuaccccugggacgccgugaagaacuuccuggagaaguucguccaggggcucgacaucggccccaccaagacccaggugggccugauccaguacgcgaacaacccgcggguggucuucaaccugaacacguacaagaccaaggaggagaugaucguggccaccagccagacgucccaguacgggggcgaccucaccaacaccuucggggccauccaguacgcccgcaaguacgccuacagcgcggccagcggcgggcggcgcuccgccaccaaggugauggucguggugacggacggcgagagccacgacggcuccaugcugaaggccgucaucgaccagugcaaccacgacaacauccugcgguucgggaucgccgugcucggcuaccugaaccgcaacgcgcuggacaccaagaaccucaucaaggagaucaaggccaucgccagcauccccaccgagcgguacuucuucaacguguccgacgaggccgcccugcuggagaaggcggggacccucggcgagcagaucuucagcaucgaggggacgguccagggcggcgacaacuuccagauggagaugucccaggugggguucagcgccgacuacuccagccagaacgacauccugaugcugggcgccgucggggccuucggcugguccgggaccaucgugcagaagaccagccacggccaccucaucuuccccaagcaggccuucgaccagauccugcaggaccgcaaccacuccagcuaccugggcuacuccguggcggccaucagcaccggggaguccacgcacuucgucgccggcgcgccccgggccaacuacaccgggcagaucgugcucuacagcgugaacgagaacggcaacaucaccgucauccaggcccaccgcggcgaccagaucggguccuacuucggcagcgugcugugcagcguggacgucgacaaggacaccaucacggacgugcugcucgugggggccccgauguacauguccgaccugaagaaggaggagggccgggucuaccuguucaccaucaaggaggggauccucggccagcaccaguuccuggagggccccgaggggaucgagaacacccgcuucggcagcgccaucgccgcgcuguccgacaucaacauggacggguucaacgacgugaucgugggcagcccccucgagaaccagaacuccggggccgucuacaucuacaacggccaccagggcaccauccggacgaaguacagccagaagauccugggguccgacggcgccuuccgcagccaccuccaguacuucgggcggucccuggacggcuacggggaccucaacggcgacagcaucaccgacguguccaucggcgccuucggccaggugguccagcuguggagccaguccaucgccgacguggcgaucgaggccagcuucacccccgagaagaucacccuggugaacaagaacgcccagaucauccucaagcugugcuucuccgccaaguuccgcccgaccaagcagaacaaccaggucgccaucguguacaacaucacgcuggacgcggacggguucagcucccgggugaccagccgcgggcuguucaaggagaacaacgagcggugccugcagaagaacauggucgugaaccaggcccagagcugccccgagcacaucaucuacauccaggagcccuccgacguggucaacagccuggaccuccgcguggacaucucccuggagaaccccggcaccagcccggcccuggaggccuacuccgagaccgcgaagguguucagcauccccuuccacaaggacugcggggaggacggccucugcaucuccgaccugguccuggacgugcgccagauccccgccgcccaggagcagccguucaucgugagcaaccagaacaagcggcucacguucuccgucacccugaagaacaagcgcgagagcgccuacaacaccggcaucgugguggacuucuccgagaaccuguucuucgccagcuucucccuccccgucgacgggaccgaggugacgugccagguggcggccagccagaaguccgucgccugcgacgugggcuaccccgcccugaagcgggagcagcaggucaccuucaccaucaacuucgacuucaaccugcagaaccuccagaaccaggccagccuguccuuccaggcgcugagcgagucccaggaggagaacaaggccgacaaccucgugaaccugaagaucccccugcucuacgacgccgagauccaccugacccgcagcacgaacaucaacuucuacgagaucagcuccgacgggaacgugccgagcaucgugcacuccuucgaggacgucggccccaaguucaucuucagccugaaggugaccaccggcuccgugcccgucagcauggccaccgugaucauccacaucccccaguacacgaaggagaagaacccgcucauguaccugaccggggugcagaccgacaaggccggcgacaucuccugcaacgcggacaucaacccccugaagaucgggcagaccagcuccagcgucuccuucaagagcgagaacuuccggcacacgaaggagcucaacugccgcaccgccuccugcagcaacgugaccugcuggcugaaggacguccacaugaagggcgaguacuucgugaacgugaccacgcggaucuggaacgggaccuucgccuccagcaccuuccagaccguccagcugacggccgcggccgagaucaacaccuacaaccccgagaucuacgugaucgaggacaacaccgugaccaucccccucaugaucaugaagccggacgagaaggccgagguccccacgggcgugaucaucggcuccaucaucgccgggauccugcugcuccuggcccugguggcgauccucuggaagcugggcuucuucaagcgcaaguacgagaagaugaccaagaaccccgacgagaucgacgagaccaccgagcugagcuccuga

SEQ ID NO: 31724 - RNA, 3156 nt, Artificial Sequence
  derived and/or modified sequence opt1 from ITGA3__Homo_sapiens__NP_002195
augggccccgggccgagccgcgcgccccgggcgccccgccugaugcucugcgcccuggcccugaugguggccgccggcgggugcgucguguccgccuucaaccucgacacccgguuccugguggucaaggaggcgggcaaccccgggagccuguucggcuacuccguggcccuccaccgccagaccgagcggcagcagcgcuaccugcugcucgccggcgccccgcgggagcuggcggugcccgacggguacacgaaccgcaccggcgccgucuaccugugcccccucaccgcccacaaggacgacugcgagcggaugaacaucaccgugaagaacgaccccgggcaccacaucaucgaggacauguggcugggcgugacggucgccagccaggggccggccggccgcgugcuggugugcgcgcaccgguacacccagguccucugguccggcagcgaggaccagcgccggaugguggggaagugcuacgugcgcggcaacgaccuggagcuggacuccagcgacgacuggcagaccuaccacaacgagaugugcaacuccaacaccgacuaccucgagacggggaugugccagcugggcaccagcggcggguucacccagaacaccgucuacuucggcgcccccggggccuacaacuggaagggcaacuccuacaugauccagcggaaggagugggaccugagcgaguacuccuacaaggaccccgaggaccaggggaaccucuacaucggcuacacgaugcaggucggcagcuucauccugcaccccaagaacaucaccaucgugaccggggccccgcgccaccggcacaugggcgccgucuuccugcucucccaggaggccgggggcgaccugcgccggcgccaggugcuggaggggagccaggugggcgccuacuucggcuccgccaucgcccucgccgaccugaacaacgacggguggcaggaccugcucgucggcgcgcccuacuacuucgagcggaaggaggaggucgggggcgccaucuacguguucaugaaccaggccgggaccagcuuccccgcccaccccucccugcugcuccacggcccgagcggcagcgccuucgggcuguccguggcgagcaucggcgacaucaaccaggacggguuccaggacaucgccgugggcgcccccuucgagggccuggggaagguguacaucuaccacuccagcuccaagggccuccugcgccagccccagcaggucauccacggggagaagcugggccuccccgggcuggccacguucggcuacagccuguccggccagauggacguggacgagaacuucuacccggaccuccugguggggagccuguccgaccacaucgugcuccugcgcgcgcggcccgugaucaacaucguccacaagacccuggugccccgccccgccgugcucgacccggcccugugcaccgccaccagcugcguccagguggagcugugcuucgccuacaaccaguccgcgggcaaccccaacuaccggcgcaacaucacgcuggccuacacccucgaggccgaccgggaccgccggccgccccgccugcgguucgccgggagcgaguccgccguguuccacggcuucuucagcaugcccgagaugcgcugccagaagcuggagcuccugcugauggacaaccuccgggacaagcugcgccccaucaucaucuccaugaacuacagccugccccuccggaugccggaccgcccccggcuggggcugcgcucccucgacgcguaccccauccugaaccaggcccaggcccuggagaaccacaccgagguccaguuccagaaggagugcggccccgacaacaagugcgagagcaaccuccagaugcgggccgccuucguguccgagcagcagcagaagcugagccgccugcaguacagccgggacgugcgcaagcuccugcuguccaucaacgucaccaacacgcgcaccagcgagcgguccggcgaggacgcgcacgaggcccuccugacccugguggugccgcccgcccuccugcugagcuccguccgcccgcccggggccugccaggcgaacgagaccaucuucugcgagcucggcaaccccuucaagcggaaccagcgcauggagcugcugaucgccuucgaggugaucggggugacgcuccacacccgggaccugcagguccagcugcagcucagcaccuccagccaccaggacaaccuguggcccaugauccugacccuccugguggacuacacgcugcagaccucccucagcauggugaaccaccgccugcaguccuucuucggcgggaccgucaugggcgagagcggcaugaagaccguggaggacguggggagcccccugaaguacgaguuccaggucggccccaugggggagggccucguggggcugggcacgcuggugcucggccuggaguggccguacgaggucuccaacgggaaguggcugcucuaccccaccgagaucaccgugcacggcaacggguccuggcccugccggcccccgggcgaccugaucaacccccugaaccucacccugagcgaccccggcgaccgccccuccagcccgcagcggcgccggcgccagcuggaccccgggggcgggcagggcccgccgcccgugacccucgccgccgccaagaaggccaagagcgagacgguccugaccugcgcgaccgggcgggcccacugcguguggcuggagugccccauccccgacgcccccguggucaccaacgugacggugaaggcccgcgucuggaacuccaccuucaucgaggacuaccgggacuucgaccgcgugcgggugaacggcugggcgacccucuuccugcgcaccagcauccccacgaucaacauggagaacaagaccaccugguucuccgucgacaucgacagcgagcugguggaggagcuccccgccgagaucgagcuguggcuggugcucgucgccgugggcgccgggcugcugcuccugggccugaucauccuccugcuguggaagugcggguucuucaagcgggcccgcacccgggcgcucuacgaggccaagcgccagaaggccgagaugaagucccagcccagcgagacggagcgccugaccgacgacuacuga

SEQ ID NO: 31725 - RNA, 3099 nt, Artificial Sequence
  derived and/or modified sequence opt1 from ITGA4__Homo_sapiens__NP_000876
auggccugggaggcccgccgggagcccggcccgcgccgggcggccgugcgcgagaccgucaugcugcuccugugccugggggugcccaccggccggcccuacaacguggacacggagagcgcccuccuguaccaggggccccacaacacccuguucggcuacuccgucgugcuccacagccacggggccaaccgcuggcugcuggugggcgccccgaccgcgaacuggcucgccaacgccuccgucaucaaccccggcgccaucuaccggugccgcaucgggaagaaccccggccagaccugcgagcagcugcagcuggggagccccaacggcgagccgugcgggaagacgugccucgaggagcgggacaaccaguggcugggcgugacccugucccgccagcccggcgagaacgggagcaucgugaccugcggccaccgguggaagaacaucuucuacaucaagaacgagaacaagcuccccaccgggggcugcuacggcgugcccccggaccugcgcacggagcuguccaagcggaucgcgcccugcuaccaggacuacgugaagaaguucggggagaacuucgccagcugccaggccggcaucuccagcuucuacaccaaggaccucaucgugaugggggcccccggcuccagcuacuggaccgggucccuguucgucuacaacaucaccacgaacaaguacaaggccuuccuggacaagcagaaccaggugaaguucggcagcuaccucggcuacuccgugggggcgggccacuuccgcagccagcacaccaccgaggucgucgggggcgcgccccagcacgagcagaucgggaaggccuacaucuucuccaucgacgagaaggagcugaacauccugcacgagaugaagggcaagaagcucggcagcuacuucggggccuccgugugcgccgucgaccugaacgccgacggcuucagcgaccugcucgugggggccccgaugcagagcaccauccgggaggagggccgcguguucgucuacaucaacuccgggagcggcgccgugaugaacgccauggagacgaaccuggugggcuccgacaaguacgccgcgcgguucggggagagcaucgucaaccugggcgacaucgacaacgacggguucgaggacguggccaucggcgcgccccaggaggacgaccuccagggcgccaucuacaucuacaacgggcgcgccgacggcaucuccagcaccuucucccagcggaucgaggggcugcagaucagcaagucccugagcauguucggccaguccaucagcgggcagaucgacgccgacaacaacggcuacgucgacguggccgugggcgccuuccgcuccgacagcgccguccuccugcggacccgccccguggugaucgucgacgcgucccugagccaccccgaguccgugaaccgcaccaaguucgacugcguggagaacggguggccgagcgucugcaucgaccucacgcugugcuucuccuacaagggcaaggaggugcccggguacaucgugcuguucuacaacaugagccucgacgucaaccggaaggccgagagcccgccccgcuucuacuucuccagcaacggcaccuccgacgugaucaccgggagcauccagguguccagccgggaggccaacugccgcacccaccaggccuucaugcggaaggacguccgcgacauccugacgcccauccagaucgaggccgcguaccaccugggcccccacgugaucuccaagcggagcaccgaggaguucccgccccuccagcccauccugcagcagaagaaggagaaggacaucaugaagaagaccaucaacuucgcccgcuucugcgcccacgagaacugcuccgccgaccuccaggugagcgccaagaucggcuuccugaagccccacgagaacaagaccuaccuggcggucggguccaugaagacgcugaugcucaacgugagccuguucaacgccggcgacgacgccuacgagaccacccugcacgugaagcugcccgucgggcucuacuucaucaagauccuggagcuggaggagaagcagaucaacugcgaggugaccgacaacuccggcgugguccagcucgacugcagcaucggguacaucuacguggaccaccugucccggaucgacaucagcuuccugcucgacguguccagccugagccgcgccgaggaggaccuguccaucacgguccacgcgaccugcgagaacgaggaggagauggacaaccucaagcacagccgggugaccguggccaucccgcugaaguacgaggucaagcugaccgugcacggcuucgugaaccccacguccuucgucuacggcagcaacgacgagaacgagcccgagaccugcaugguggagaagaugaaccucaccuuccacgugaucaacaccgggaacuccauggcccccaacgucagcguggagaucauggugccgaacuccuucagcccccagaccgacaagcuguucaacauccuggacguccagacgaccaccggcgagugccacuucgagaacuaccagcgcgugugcgcccucgagcagcagaaguccgccaugcagacccugaaggggaucgugcgguuccugagcaagacggacaagcgccuccuguacugcaucaaggcggacccccacugccugaacuuccucugcaacuucggcaagauggaguccgggaaggaggccagcguccacauccagcuggagggccggcccuccauccuggagauggacgagaccagcgcccucaaguucgagauccgcgccaccggcuucccggagcccaacccccgggugaucgagcugaacaaggacgagaacguggcccacguccugcucgaggggcugcaccaccagcgccccaagcgguacuucaccaucgugaucaucuccagcucccugcuccugggccugaucgugcuccugcugaucagcuacgucauguggaaggcgggguucuucaagcgccaguacaaguccauccuccaggaggagaaccgccgggacagcuggagcuacaucaacuccaagagcaacgacgacuga

SEQ ID NO: 31726 - RNA, 3150 nt, Artificial Sequence
  derived and/or modified sequence opt1 from ITGA5__Homo_sapiens__NP_002196
augggcagccgcacccccgaguccccgcugcacgccgugcagcuccggugggggccccgccggcgccccccccugcugccgcuccugcugcuccugcugcccccccccccgcgggucggcggguucaaccucgacgccgaggcgcccgccgugcugagcggcccccccggguccuucuucggcuucagcguggaguucuaccgcccgggcaccgacggggucuccgugcuggugggcgcccccaaggccaacacgagccagcccgggguccuccagggcggggccguguaccugugccccuggggcgcguccccgacccagugcacccccaucgaguucgacagcaagggcucccggcugcucgagagcucccugagcuccagcgagggggaggagcccguggaguacaagucccugcagugguucggcgccaccguccgcgcccacgggagcuccauccucgccugcgcgccccuguacagcuggcggacggagaaggagccgcuguccgaccccgugggcaccugcuaccucagcaccgacaacuucacccgcauccuggaguacgcccccugccggagcgacuucuccugggccgccggccagggguacugccagggcggguucagcgccgaguucacgaagaccggccgcgugguccuggggggccccggcuccuacuucuggcaggggcagauccucagcgcgacccaggagcagaucgccgaguccuacuacccggaguaccugaucaaccuggugcagggccagcuccagacccggcaggccagcuccaucuacgacgacagcuaccugggguacuccguggccgucggcgaguucagcggggacgacacggaggacuucguggccggcgugcccaagggcaaccugaccuacggguacgucaccauccucaacggcuccgacauccgcagccuguacaacuucuccggggagcagauggcgagcuacuucggcuacgccguggccgccaccgacgugaacggggacggccuggacgaccuccuggucggcgccccccugcucauggaccggacgcccgacgggcgcccgcaggaggugggccggguguacgucuaccugcagcaccccgcggggaucgagcccaccccgacccugacccucacgggccacgacgaguucggccgcuucggguccagccugaccccccugggcgaccucgaccaggacggguacaacgacguggccaucggcgcccccuucgggggcgagacccagcagggcgucguguucguguuccccgggggcccggggggccugggguccaagcccagccagguccugcagccccucugggccgccucccacacccccgacuucuucggcagcgcgcugcggggcgggcgcgaccuggacggcaacggguacccggaccucaucgugggcagcuucgggguggacaaggccgucguguaccggggccgccccaucguguccgccagcgccucccugacgaucuuccccgcgauguucaaccccgaggagcgcagcugcucccuggagggcaacccggucgccugcaucaaccugagcuucugccucaacgccuccgggaagcacguggccgacagcaucggcuucaccguggagcugcagcuggacuggcagaagcagaaggggggcguccggcgcgcccucuuccuggcgucccggcaggccacccugacccagacgcuccugauccagaacggggcccgcgaggacugccgggagaugaagaucuaccugcgcaacgagagcgaguuccgggacaagcucucccccauccacaucgcccugaacuucagccuggacccccaggcccccguggacucccacggccuccgcccggcgcugcacuaccagagcaagucccggaucgaggacaaggcccagauccugcucgacugcggcgaggacaacaucugcgugcccgaccugcagcuggaggucuucggggagcagaaccacguguaccucggcgacaagaacgcccugaaccugaccuuccacgcccagaacgugggggagggcggcgccuacgaggcggagcuccgcgucaccgccccccccgaggccgaguacagcgggcuggugcggcacccgggcaacuucuccagccugagcugcgacuacuucgccgugaaccagucccgccuccuggucugcgaccuggggaaccccaugaaggcgggcgccagccucugggggggccugcgguucaccgugccccaccugcgcgacacgaagaagaccauccaguucgacuuccagauccucuccaagaaccugaacaacagccaguccgacguggucagcuuccggcuguccguggaggcccaggcccaggugacccucaacggcgucagcaagcccgaggccgugcuguucccgguguccgacuggcacccccgcgaccagccccagaaggaggaggaccuggggccggcgguccaccacguguacgagcucaucaaccagggccccagcuccaucagccagggggugcuggagcuguccugcccccaggcccucgagggccagcagcugcuguacgucacccgggugacggggcucaacugcaccaccaaccaccccaucaacccgaagggccuggagcuggaccccgagggcagccuccaccaccagcagaagcgcgaggcccccucccggagcuccgccagcuccgggccccagauccugaagugcccggaggccgagugcuuccgccugcgcugcgagcucggcccccugcaccagcaggagagccagagccugcagcuccacuuccgggugugggcgaagaccuuccugcagcgcgagcaccagcccuucucccugcagugcgaggccgucuacaaggcccucaagaugcccuaccggauccugccgcgccagcugccccagaaggagcggcagguggccaccgccgugcaguggacgaaggcggaggggagcuacggcgucccccucuggaucaucauccuggccauccuguucgggcuccugcugcucggccugcugaucuacauccucuacaagcugggcuucuucaagcgcucccugcccuacgggaccgccauggagaaggcccagcucaagccgcccgcgaccagcgacgccuga

SEQ ID NO: 31727 - RNA, 3222 nt, Artificial Sequence
  derived and/or modified sequence opt1 from ITGA6__Homo_sapiens__NP_000201
auggccgccgcgggccagcugugccuccuguaccugagcgccgggcuccugucccgccugggcgccgccuucaaccucgacacccgggaggacaacgugauccgcaaguacggggaccccggcagccuguucggguucucccuggccaugcacuggcagcuccagccggaggacaagcggcugcugcucgucggcgcgccccgcgccgaggcccugccccugcagcgggccaaccgcaccggcgggcucuacagcugcgacaucacggcgcggggccccugcacccgcaucgaguucgacaacgacgccgacccgaccuccgagagcaaggaggaccaguggaugggggugaccgugcagucccagggccccgggggcaaggucgugacgugcgcccaccgguacgagaagcgccagcacgugaacaccaagcaggagagccgggacaucuucggccgcugcuacguccugucccagaaccugcggaucgaggacgacauggacgggggcgacuggagcuucugcgacgggcgccuccggggccacgagaaguucggcuccugccagcaggggguggccgccaccuucaccaaggacuuccacuacaucguguucggcgcgcccgggacguacaacuggaagggcaucguccgcguggagcagaagaacaacaccuucuucgacaugaacaucuucgaggacgggcccuacgaggugggcggcgagaccgagcacgacgagagccuggucccggugcccgccaacuccuaccugggguucagccucgacuccggcaaggggaucgugagcaaggacgagaucaccuucgucuccggcgcgccccgggccaaccacagcggggccguggugcugcugaagcgcgacaugaaguccgcccaccuccugcccgagcacaucuucgacggcgagggccuggccagcagcuucggguacgacgucgccgugguggaccucaacaaggacggcuggcaggacaucgucaucggggccccgcaguacuucgaccgggacggcgaggucgggggcgccguguacgucuacaugaaccagcagggccgcuggaacaacgugaagcccauccggcugaacgggacgaaggacuccauguucggcaucgcggucaagaacaucggggacaucaaccaggacggcuaccccgacaucgccgugggcgcccccuacgacgaccuggggaagguguucaucuaccacggcagcgccaacgggaucaacaccaagccgacccagguccucaagggcaucucccccuacuucggguacagcaucgccggcaacauggaccuggaccgcaacuccuaccccgacguggcggugggcagccuguccgacagcgucaccaucuuccgcucccggcccgugaucaacauccagaagacgaucaccgugaccccgaaccgcaucgaccuccggcagaagaccgccugcggggcccccagcggcaucugccugcaggucaaguccugcuucgaguacacggccaaccccgcgggguacaaccccagcaucuccaucgugggcacccuggaggccgagaaggagcgccgcaagagcgggcucuccagccgggugcaguuccggaaccagggcuccgagccgaaguacacccaggagcugacccugaagcgccagaagcagaaggucugcauggaggagacgcucuggcugcaggacaacauccgggacaagcugcgccccauccccaucaccgccagcguggagauccaggagcccuccagccggcgccgggugaacagccucccggagguccugcccauccugaacuccgacgagcccaagaccgcccacaucgacgugcacuuccucaaggagggcugcggggacgacaacgugugcaacagcaaccugaagcuggaguacaaguucugcacccgcgagggcaaccaggacaaguucuccuaccucccgauccagaaggggguccccgagcuggugcugaaggaccagaaggacaucgcccuggagaucacggugaccaacagccccuccaacccccggaacccgaccaaggacggcgacgacgcgcacgaggccaagcucaucgccaccuuccccgacacgcugaccuacagcgccuaccgcgagcugcgggccuuccccgagaagcagcucuccugcgucgcgaaccagaacgggagccaggccgacugcgagcugggcaaccccuucaagcgcaacuccaacgugaccuucuaccuggugcucagcaccacggaggucaccuucgacaccccggaccuggacaucaaccugaagcucgagaccaccuccaaccaggacaaccuggcccccaucacggccaaggccaagguggugaucgagcugcuccugagcgucuccggcguggcgaagcccagccagguguacuucgggggcaccgucgugggggagcaggccaugaaguccgaggacgaggugggcagccugaucgaguacgaguuccgggucaucaaccucgggaagccccugaccaaccugggcaccgccacgcucaacauccaguggccgaaggagaucuccaacggcaaguggcugcuguaccucgugaagguggagagcaaggggcuggagaaggugaccugcgagccccagaaggagaucaacagccugaaccucaccgagucccacaacagccgcaagaagcgcgagaucaccgagaagcagaucgacgacaaccggaaguucucccuguucgccgagcgcaaguaccagacgcugaacugcagcgugaacgugaacugcgucaacauccggugcccccuccgcggccuggacuccaaggcgagccugauccuccggucccgccuguggaacagcaccuuccuggaggaguacuccaagcucaacuaccuggacauccugaugcgggccuucaucgacgugaccgccgccgccgagaacauccgccuccccaacgcggggacccaggugcgggucacgguguucccgagcaagaccguggcccaguacuccggcguccccugguggaucauccugguggccauccuggccggcauccucaugcuggcccugcucguguucauccuguggaagugcggguucuucaagcgcaacaagaaggaccacuacgacgcgaccuaccacaaggccgagauccacgcccagcccagcgacaaggagcggcugaccuccgacgccuga

SEQ ID NO: 31728 - RNA, 3426 nt, Artificial Sequence
  derived and/or modified sequence opt1 from ITGA7__Homo_sapiens__NP_001138468
auggccggcgcccgcagccgggaccccuggggcgcguccgggaucugcuaccuguucgggagccuccugguggagcuccuguucucccgcgccgucgccuucaaccuggacgugaugggcgcccugcggaaggagggggagccgggcagccucuucggcuucuccguggcccugcaccgccagcugcagccccggccccagagcuggcuccuggucggggcgccccaggcccuggcccucccgggccagcaggccaaccgcaccgggggccuguucgcgugcccccugucccucgaggagaccgacugcuaccggguggacaucgaccagggggccgacaugcagaaggagagcaaggagaaccaguggcugggcguguccguccgcagccagggccccgggggcaagaucgugacgugcgcccaccgguacgaggcccgccagcggguggaccagauccuggagacccgcgacaugaucgggcggugcuucguccucucccaggaccuggccauccgcgacgagcuggacggcggcgaguggaaguucugcgaggggcggccccagggccacgagcaguucggguucugccagcagggcaccgcggccgccuucagcccggacucccacuaccuccuguucggggcccccggcaccuacaacuggaagggcacggcccgcguggagcugugcgcgcaggggagcgccgaccucgcccaccuggacgacggccccuacgaggccgggggcgagaaggagcaggacccccggcugaucccggugcccgccaacuccuacuucggguucagcaucgacuccggcaagggccucguccgcgcggaggagcugagcuucguggccggggcgccccgggccaaccacaagggcgccguggucauccugcgcaaggacuccgccagccggcucgugcccgaggugaugcugagcggggagcgccugaccuccggcuucggguacagccucgccgucgccgaccugaacuccgacggcuggccggaccugaucgugggcgcccccuacuucuucgagcgccaggaggagcucgggggcgcgguguacgucuaccugaaccagggcgggcacugggccggcaucagcccccugcggcucugcgggucccccgacagcauguucggcaucucccuggccgugcugggggaccucaaccaggacggcuucccggacaucgccgugggggcccccuucgacggcgacggcaaggucuucaucuaccacgggagcucccugggcguggucgcgaagcccagccaggugcuggagggggaggccgugggcaucaaguccuucggguacagccucuccggcagccuggacauggacggcaaccaguaccccgaccugcucgucgggucccuggccgacaccgccgugcuguuccgcgcccggccgauccugcacgugagccacgaggucuccaucgcgccccgcagcaucgaccucgagcagcccaacugcgccggcgggcacuccgugugcguggaccugcgggucugcuucagcuacaucgccgugcccagcuccuacagcccgaccguggcccuggacuacguccucgacgccgacacggaccgccggcugcgcggccaggugccccgggugaccuuccugucccgcaaccucgaggagcccaagcaccaggcgagcgggaccgucuggcugaagcaccagcacgaccgggugugcggcgacgccauguuccagcugcaggagaacgugaaggacaagcuccgcgccaucgucgugacccuguccuacagccugcagacgccgcggcuccgccggcaggcccccggccaggggcugccgcccguggcgcccauccugaacgcccaccagcccuccacccagcgcgccgagauccacuuccucaagcagggcugcggggaggacaagaucugccagagcaaccugcagcugguccgggcccgcuucugcacccggguguccgacaccgaguuccagccccuccccauggacguggacggcacgaccgcccuguucgcgcugagcgggcagccggucaucggccucgagcugauggugaccaaccugcccuccgaccccgcccagccccaggccgacggcgacgacgcccacgaggcccagcuccuggugaugcugccggacagccuccacuacuccgggguccgcgcgcuggaccccgccgagaagccccugugccucagcaacgagaacgccucccacguggagugcgagcugggcaaccccaugaagcgcggggcccaggugaccuucuaccugauccucagcacguccggcaucagcaucgagaccaccgagcuggaggucgagcugcuccuggccaccaucagcgagcaggagcugcacccgguguccgcgcgggcccgcguguucaucgagcucccccugagcaucgccggcauggccaucccccagcagcuguucuucuccggggucgugcggggcgagcgcgcgaugcagagcgagcgggacgugggguccaaggucaaguacgaggugacggugagcaaccagggccagucccuccgcacccuggggagcgccuuccugaacaucauguggccccacgagaucgccaacggcaaguggcuccuguacccgaugcaggucgagcuggagggcgggcagggccccgggcagaagggccucugcagcccccggcccaacauccugcaccuggacguggacagccgcgaccggcgccggcgcgagcucgagccgcccgagcagcaggagcccggggagcggcaggagccguccaugagcugguggcccguguccagcgccgagaagaagaagaacaucacccuggacugcgcccgcggcaccgcgaacugcgucguguucuccugcccccuguacagcuucgaccgggccgccgugcuccacgucuggggccgccuguggaacuccacguuccuggaggaguacagcgccgugaagucccucgaggugaucguccgggccaacaucaccgugaaguccagcaucaagaaccugaugcugcgcgacgcguccaccgugauccccgucaugguguaccucgacccgauggccgucguggccgagggggugcccuggugggucauccugcuggccgugcucgccggccugcuggugcucgcgcugcugguccuccugcuguggaagaugggguucuucaagcgggccaagcaccccgaggccaccgugccccaguaccacgccgugaagaucccgcgcgaggaccggcagcaguucaaggaggagaagacgggcaccauccuccgcaacaacugggggagcccccgccgggagggccccgacgcccaccccauccuggcggccgacggccacccggagcuggggcccgacggccaccccgggcccggcaccgccuga

SEQ ID NO: 31729 - RNA, 3147 nt, Artificial Sequence
  derived and/or modified sequence opt1 from ITGA8__Homo_sapiens__NP_001278423
augagccccggcgccucccgcgggccgcggggcagccaggccccgcugaucgcgccccucugcugcgccgccgccgcccuggggaugcugcucuggucccccgcgugccaggccuucaaccuggacguggagaagcugaccgucuacagcggccccaagggguccuacuucggcuacgccguggacuuccacauccccgacgcccgcaccgcgagcgugcucgucggcgcccccaaggccaacacgucccagcccgacaucguggagggcggcgccguguacuacugcccguggcccgccgaggggagcgcgcagugccggcagauccccuucgacaccaccaacaaccgcaagauccgggucaacggcaccaaggagcccaucgaguucaaguccaaccagugguucggggccacggugaaggcccacaagggcaagguggucgccugcgccccgcuguaccacuggcgcacccugaagcccacccccgagaaggaccccguggggaccugcuacguggcgauccagaacuucagcgccuacgccgaguucuccccgugccggaacagcaacgccgaccccgaggggcagggcuacugccaggccggguucucccucgacuucuacaagaacggcgaccugaucgucggcgggcccggcagcuucuacuggcagggccaggugaucacggcguccguggccgacaucaucgccaacuacagcuucaaggacauccugcgcaagcucgccggggagaagcagaccgaggucgcccccgcguccuacgacgacagcuaccuggagcugguggccgggaucccgcggggcgcccagaacuucggcuacguguccaucaucaacagcaccgacaugaccuucauccagaacuucacgggggagcagauggccagcuacuucggcuacaccgucgugguguccgacgucaacagcgacgggcucgacgacgugcuggugggcgcgccccuguucauggagcgcgaguucgaguccaacccccgggaggucgggcagaucuaccucuaccuccaggugagcucccugcuguuccgcgacccccagauccugaccggcaccgagacguucggccgguucgggagcgccauggcccaccugggcgaccucaaccaggacggguacaacgacaucgccaucggcgucccguucgccgggaaggaccagcgcggcaaggugcugaucuacaacggcaacaaggacgggcugaacaccaagcccucccaggugcuccagggcgucugggcgagccacgccgugcccuccggguucggcuucacccugcggggcgacagcgacaucgacaagaacgacuaccccgaccugaucgugggggccuucggcaccgggaaggucgccguguaccgcgcccggccgguggucacgguggacgcgcagcuccugcugcaccccaugaucaucaaccucgagaacaagaccugccaggugcccgacuccaugaccagcgccgccugcuucucccugcgcgucugcgccagcgugaccggccaguccaucgccaacacgaucgugcugauggcggagguccagcucgacagccugaagcagaagggggccaucaagcggacccuguuccucgacaaccaccaggcccaccgcguguucccgcuggugaucaagcggcagaagucccaccagugccaggacuucaucgucuaccugcgcgacgagaccgaguuccgcgacaagcucagccccaucaacaucucccugaacuacagccuggacgagagcaccuucaaggagggccucgaggugaagcccauccugaacuacuaccgggagaacaucguguccgagcaggcccacauccuggucgacugcggcgaggacaaccucugcgugcccgaccugaagcugagcgcgcgcccggacaagcaccaggugaucaucggggacgagaaccaccugaugcucaucaucaacgcccggaacgagggcgagggggccuacgaggccgagcuguucgucaugauccccgaggaggccgacuacgugggcaucgagcgcaacaacaagggguuccggccccuguccugcgaguacaagauggagaacgugacgcgcauggucgugugcgaccucggcaaccccauggugagcggcaccaacuacucccuggggcugcgguucgcggucccgcgccucgagaagaccaacaugagcaucaacuucgaccugcagauccgguccagcaacaaggacaaccccgacuccaacuucgugagccugcagaucaacaucaccgccguggcccaggucgagauccgcggcgugucccacccgccccagaucgugcuccccauccacaacugggagcccgaggaggagccccacaaggaggaggaggucgggccccugguggagcacaucuacgagcugcacaacaucggcccgagcacgaucuccgacaccauccucgaggugggguggcccuucagcgcccgggacgaguuccugcuguacaucuuccacauccagacccucggcccccugcagugccagcccaacccgaacaucaacccccaggacaucaagcccgccgcgucccccgaggacaccccggagcugagcgccuuccuccgcaacuccacgaucccccaccugguccggaagcgcgacgugcacguggucgaguuccaccggcagagccccgccaagauccugaacugcaccaacaucgagugccuccagaucagcugcgccgugggccgccuggagggcggggaguccgccgugcugaagguccggagccgccucugggcgcacaccuuccugcagcggaagaacgacccguacgcccuggccucccucgugagcuucgaggugaagaagaugcccuacaccgaccagcccgccaagcugcccgagggguccaucgucaucaagaccagcgugaucugggcgacgccgaacguguccuucagcaucccccugugggucaucauccucgccauccugcugggccuccuggugcuggccauccucacccuggcccuguggaagugcggguucuucgaccgcgcccgcccgccccaggaggacaugaccgaccgggagcagcucaccaacgacaagacgcccgaggcguga

SEQ ID NO: 31730 - RNA, 3108 nt, Artificial Sequence
  derived and/or modified sequence opt1 from ITGA9__Homo_sapiens__NP_002198
augggcgggcccgccgccccgcgcggcgcggggcggcugcgcgcccuccugcuggcccucguggucgccggcauccccgccggggcguacaaccuggacccccagcggcccgugcacuuccagggcccggccgacagcuucuucggcuacgccgugcuggagcacuuccacgacaacacccgcuggguccucgugggggcccccaaggcggacuccaaguacagccccuccgucaagagccccggcgccguguucaagugccgggugcacaccaacccggaccgccggugcacggagcuggacauggcccgcgggaagaaccggggcaccuccugcgggaagaccugccgcgaggaccgggacgacgaguggaugggcgugagccuggcccgccagcccaaggccgacggccggguccucgcgugcgcccaccgcuggaagaacaucuacuacgaggccgaccacauccugccccacggguucugcuacaucauccccuccaaccugcaggccaagggccggacccucaucccgugcuacgaggaguacaagaagaaguacggggaggagcacggcagcugccaggccggcaucgcgggguucuucacggaggagcugguggugaugggcgcccccggguccuucuacugggccggcaccaucaagguccugaaccucaccgacaacaccuaccugaagcugaacgacgaggugaucaugaaccgccgguacacguaccucggguacgccgugaccgccggccacuucagccaccccuccaccaucgacgucgugggcggggcgccccaggacaagggcaucgggaagguguacaucuuccgcgccgaccggcgcagcggcacccugaucaagaucuuccaggccuccgggaagaagaugggcagcuacuucggcuccagccugugcgccgucgaccucaacggggacggccuguccgaccugcucgugggggccccgauguucagcgagauccgggacgagggccaggugacggucuacaucaaccgcgggaacggcgcgcuggaggagcagcuggcccucaccggcgacggggccuacaacgcccacuucggcgaguccaucgcgagccuggacgaccuggacaacgacggguuccccgacguggccaucggcgcccccaaggaggacgacuucgccggcgccguguacaucuaccacggggacgcgggcgggaucgucccccaguacagcaugaagcucuccggccagaagaucaacccggugcugcgcauguucgggcagagcaucuccggcggcaucgacauggacgggaacggcuaccccgacgucaccgugggggccuucaugagcgacuccgugguccugcuccgggcccgccccgugaucaccguggacgucagcaucuuccugcccggcuccaucaacaucacggccccgcagugccacgacgggcagcagcccgugaacugccugaacgugacgaccugcuucagcuuccacggcaagcacguccccggcgagaucgggcucaacuacgugcugauggccgacguggcgaagaaggagaagggccagaugccccgggucuacuucgugcugcucggggagaccaugggccaggugaccgagaagcugcagcugaccuacauggaggagaccugccgccacuacgucgcccacgugaagcggcgcgugcaggacgucaucuccccgaucguguucgaggccgccuacagccucuccgagcacgugaccggggaggaggagcgggagcugccgccccugacgcccguccuccgcuggaagaagggccagaagaucgcccagaagaaccagaccguguucgagcggaacugccgcagcgaggacugcgcggccgaccugcagcugcagggcaagcuccugcuguccagcauggacgagaagacccuguaccucgcccugggggccgugaagaacaucucccugaacaucagcaucuccaaccucggcgacgacgcguacgacgccaacgucagcuucaacgugucccgggagcuguucuucaucaacauguggcagaaggaggagauggggaucagcugcgagcugcucgagagcgacuuccugaagugcuccgugggcuuccccuucaugcgcagcaaguccaaguacgaguucagcgucaucuucgacaccucccaccugagcggggaggaggaggugcucuccuucaucgugacggcccagagcggcaacaccgagcgguccgagagccugcacgacaacacccugguccucauggugccccugaugcacgagguggacaccuccaucacgggcaucaugagccccaccuccuucgucuacggggagagcguggacgccgccaacuucauccagcuggacgaccucgagugccacuuccagccgaucaacaucacccuccagguguacaacaccggccccuccacgcugcccgggagcuccgucagcaucagcuuccccaaccgccuguccagcggcggcgcggagauguuccacgugcaggagaugguggucgggcaggagaagggcaacugcuccuuccagaagaacccgacccccugcaucaucccccaggagcaggagaacaucuuccacaccaucuucgccuucuucaccaagagcgggcggaaggugcuggacugcgagaagcccggcaucuccugccugaccgcccacugcaacuucagcgcccucgccaaggaggagucccgcacgaucgacaucuacaugcugcugaacaccgagauccucaagaaggacagcuccagcgugauccaguucaugucccgggcgaaggucaagguggacccggcccugcgcguggucgagaucgcccacgggaaccccgaggaggugaccguggucuucgaggcccugcacaaccucgagccccggggcuacguggugggcuggaucaucgccaucagccugcuggucgggauccucaucuuccugcugcucgcggugcugcuguggaagaugggcuucuuccgccgccgguacaaggagaucaucgaggccgagaagaaccgcaaggagaacgaggacuccugggacuggguccagaagaaccaguga

SEQ ID NO: 31731 - RNA, 3486 nt, Artificial Sequence
  derived and/or modified sequence opt1 from ITGAD__Homo_sapiens__NP_005344
augaccuucggcaccgugcugcuccugagcguccuggccuccuaccacggguucaaccucgacguggaggagcccacgaucuuccaggaggacgccggcggguucggccagagcgugguccaguucgggggcucccgccugguggugggcgcgccgcuggaggucguggccgccaaccagaccgggcggcucuacgacugcgccgccgcgaccggcaugugccagcccaucccccugcacauccgccccgaggccgugaacaugagccuggggcucacccuggccgccuccacgaacggcagccggcugcucgcgugcgggccgacccugcaccgcgucugcggcgagaacuccuacagcaagggcuccugccugcuccuggggagccggugggagaucauccagaccgugcccgacgccacccccgagugcccccaccaggagauggacaucguguuccugaucgacggcuccgggagcaucgaccagaacgacuucaaccagaugaagggcuucguccaggccgugaugggccaguucgaggggacggacacccucuucgcccugaugcaguacuccaaccugcucaagauccacuucaccuucacccaguuccgcacgagcccgucccagcagagccugguggaccccaucguccagcugaagggccucaccuucaccgccaccgggauccugacgguggugacccagcuguuccaccacaagaacggcgcgcggaaguccgccaagaagauccucaucgucaucaccgacgggcagaaguacaaggacccccuggaguacagcgacgugaucccccaggccgagaaggccggcaucauccgcuacgccaucggcguggggcacgcguuccagggcccgaccgcccggcaggagcugaacacgaucuccagcgccccgccccaggaccacgucuucaagguggacaacuucgccgcccucgggagcauccagaagcagcugcaggagaagaucuacgcgguggagggcacccagucccgcgccagcuccagcuuccagcacgagaugucccaggagggguucagcaccgcccugaccauggacggccucuuccugggcgccgucggguccuucagcugguccggcggggccuuccuguacccgcccaacaugagccccacguucaucaacaugucccaggagaacguggacaugcgggacagcuaccucggcuacuccaccgagcuggcgcuguggaaggggguccagaaccucgugcugggcgcgccccgcuaccagcacaccggcaaggccgugaucuucacccaggucagccggcaguggcgcaagaaggccgaggugacggggacccagaucggcuccuacuucggggccagccugugcuccguggacgucgacagcgacggcuccaccgaccucauccugaucggcgcgccccacuacuacgagcagacccgcgggggccaggugagcgugugcccccugccccgggggcggguccaguggcagugcgacgccgugcuccgcggcgagcaggggcaccccuggggccgguucggcgccgcccugacggugcugggggacgucaacgaggacaagcucaucgacguggccaucggcgcccccggggagcaggagaaccgcggcgccguguaccuguuccacggggccagcgaguccggcaucagcccgucccacagccagcggaucgccuccagccagcugagcccccgccugcaguacuucggccaggcgcucagcgggggccaggaccugacccaggacgggcugauggaccucgccgucggcgcccgcggccaggugcugcugcuccggucccugcccgugcugaaggucgggguggccaugcgcuucagccccguggaggucgccaaggcgguguaccggugcugggaggagaagccguccgcccucgaggccggcgacgccaccgugugccugaccauccagaaguccucccuggaccagcucggggacauccagagcuccguccgcuucgaccuggcgcuggaccccggccggcucacgagccgcgccaucuucaacgagaccaagaaccccacccugacccggcgcaagacccuggggcucggcauccacugcgagacgcugaagcugcuccugccggacugcguggaggacguggucucccccaucauccugcaccucaacuucagccuggugcgggagcccauccccagcccgcagaaccugcgccccgugcucgccgucgggucccaggaccuguucaccgccagccugcccuucgagaagaacugcggccaggacggccucugcgagggggaccugggcgugacccuguccuucagcgggcuccagacccugacggugggcuccagccuggagcucaacgucaucgugaccguguggaacgccggcgaggacuccuacgggaccgucgugagccuguacuaccccgcgggccugucccaccggcgcgugagcggggcccagaagcagccgcaccaguccgcccuccggcuggccugcgagaccguccccacggaggacgagggccugcgcagcucccggugcagcgugaaccaccccaucuuccacgagggguccaacggcaccuucaucgugaccuucgacgucagcuacaaggccacccucggcgaccgcaugcugaugcgggcguccgccagcuccgagaacaacaaggccagcagcuccaaggccacguuccagcuggagcuccccgugaaguacgccguguacaccaugaucagccgccaggaggaguccaccaaguacuucaacuucgcgaccagcgacgagaagaagaugaaggaggccgagcaccgguaccgcgucaacaaccugucccagcgcgaccuggccaucagcaucaacuucugggugccggugcuccugaacggggucgccgugugggacguggucauggaggcgcccucccagagccugcccugcguguccgagcggaagcccccgcagcacagcgacuuccucacgcagaucucccgcagccccaugcuggacugcuccaucgccgacugccugcaguuccggugcgacguccccagcuucuccgugcaggaggagcucgacuucacccugaagggcaaccugagcuucgggugggugcgcgagacccuccagaagaagguccuggugguguccgucgccgagaucaccuucgacacgagcguguacucccagcugcccggccaggaggccuucaugcgggcccagauggagauggugcucgaggaggacgaggucuacaacgcgaucccgaucaucauggggagcagcgugggcgcccugcugcuccuggcccugaucaccgccacccucuacaagcugggcuucuucaagcgccacuacaaggagaugcuggaggacaagcccgaggacaccgccacguucuccggggacgacuucagcugcguggcgcccaacgucccccucuccuga

SEQ ID NO: 31732 - RNA, 3540 nt, Artificial Sequence
  derived and/or modified sequence opt1 from ITGAE__Homo_sapiens__NP_002199
auguggcuguuccacacccuccugugcaucgccagccuggcccuccuggcggccuucaacguggacgucgcccgccccuggcugaccccgaagggcggggcccccuucgugcucuccagccugcugcaccaggaccccuccacgaaccagaccuggcuccuggugaccagcccccggaccaagcgcacgccgggcccccugcaccggugcucccucguccaggacgagauccugugccaccccguggagcacgugcccaucccgaaggggcgccaccggggcgucaccguggugcgcagccaccacgggguccugaucugcauccaggugcucgugcggcgcccccacucccugagcuccgagcugaccgggaccugcagccuccugggccccgaccugcggccccaggcccaggcgaacuucuucgaccucgagaaccugcuggacccggacgcccgcgucgacacgggcgacugcuacuccaacaaggagggcgggggcgaggacgacgugaacaccgcccggcagcgccgggcccucgagaaggaggaggaggaggacaaggaggaggaggaggacgaggaggaggaggaggcggggaccgagaucgccaucauccuggacggcagcggcuccaucgacccgcccgacuuccagcgcgccaaggacuucaucagcaacaugaugcggaacuucuacgagaagugcuucgagugcaacuucgcccuggugcaguacgggggcgucauccagaccgaguucgaccuccgcgacucccaggacgugauggccagccuggcgcgggugcagaacaucacgcaggucggguccgugaccaagaccgccagcgccaugcagcacgugcuggacuccaucuucaccagcagccacggcucccgccggaaggccagcaaggucaugguggugcucacggacggcgggaucuucgaggacccccugaaccugaccaccgucaucaacucccccaagaugcagggcguggagcgcuucgccaucggggucggcgaggaguucaagagcgcgcggaccgcccgcgagcucaaccugaucgccuccgaccccgacgagacgcacgccuucaaggugaccaacuacauggcccuggacgggcuccugagcaagcugcgcuacaacaucaucuccauggagggcaccgugggcgacgcgcuccacuaccagcuggcccagaucggguucagcgcccagauccuggacgagcggcagguccuccugggcgccgugggggccuucgacugguccggcggggcgcugcucuacgacacccgcagccggcgcggccgguuccugaaccagacggccgccgccgcggccgacgccgaggccgcccaguacuccuaccugggcuacgcgguggccguccuccacaagaccugcagccuguccuacaucgccggggcgccccgcuacaagcaccacggcgccguguucgagcugcagaaggaggggcgggaggccagcuuccugcccgugcucgagggcgagcagaugggguccuacuucggcagcgagcugugcccggucgacaucgacauggacggcuccaccgacuuccugcucguggccgcccccuucuaccacgugcacggggaggagggccgcgucuacguguaccggcugagcgagcaggacggguccuucagccuggcccgcauccucagcggccaccccggcuucaccaacgcccgguucggguucgcgauggccgccaugggcgaccugucccaggacaagcugacggacguggccaucggggcgccccucgagggcuucggggccgacgacggcgccagcuucggcuccgucuacaucuacaacgggcacugggacggccugagcgccuccccgagccagcgcauccgggccuccaccguggcgcccgggcugcaguacuucggcaugagcauggccgggggcuucgacaucuccggcgacgggcucgccgacaucaccgugggcacccuggggcaggccgucguguuccgcagccggcccgugguccgccugaagguguccauggccuucacgcccagcgcgcucccgaucggcuucaacgggguggucaacgugcggcugugcuucgagaucuccagcgugaccaccgccuccgagagcggccugcgcgaggcccuccugaacuucacccuggacgucgacgugggcaagcagcggcgccgccuccagugcuccgacgugcggagcugccuggggugccugcgcgaguggagcuccggcagccagcucugcgaggaccugcugcucaugcccacggagggggagcugugcgaggaggacugcuucuccaacgccagcgucaagguguccuaccagcugcagacccccgagggccagaccgaccacccgcagcccauccucgaccgguacaccgagcccuucgccaucuuccagcugcccuacgagaaggcgugcaagaacaagcuguucugcguggccgagcuccagcuggccaccacggucagccagcaggagcuggugguggggcucaccaaggagcugacccugaacaucaaccucaccaacuccggcgaggacagcuacaugacguccauggcccugaacuacccgcgcaaccugcagcucaagcggaugcagaagccgcccagccccaacauccagugcgacgacccccagcccgucgcguccgugcugaucaugaacugccgcaucggccaccccgugcugaagcggagcuccgcccacgucagcgugguguggcagcucgaggagaacgccuuccccaaccgcaccgccgacaucaccgucaccgugacgaacuccaacgagcggcgcagccuggccaacgagacccacacccugcaguuccggcacggguucguggcgguccucuccaagccgagcaucauguacgugaacaccggccaggggcugucccaccacaaggaguuccuguuccacgugcacggcgagaaccucuucggcgccgaguaccagcugcagaucugcguccccacgaagcugcgcgggcuccaggugguggccgucaagaagcugacccggacccaggccagcaccgugugcacguggagccaggagcgcgccugcgcguacuccagcguccagcacguggaggaguggcacuccgugagcugcgucaucgccuccgacaaggagaacgugaccguggccgccgagaucagcugggaccacuccgaggagcugcucaaggacgucaccgagcugcagauccugggcgagaucagcuucaacaagucccucuacgaggggcugaacgccgagaaccaccggaccaagaucacggugguguuccugaaggacgagaaguaccacagccuccccaucaucaucaagggcuccgucgggggccugcuggugcucaucgugauccuggucauccuguucaagugcggcuucuucaagcgcaaguaccagcagcucaaccuggagagcauccggaaggcgcagcugaaguccgagaaccuccuggaggaggagaacuga

SEQ ID NO: 31733 - RNA, 3261 nt, Artificial Sequence
  derived and/or modified sequence opt1 from ITGAL__Homo_sapiens__NP_001107852
augaaggacagcugcaucaccgugauggccauggcccugcucuccggcuucuucuucuucgcgcccgccagcuccuacaaccuggacguccgcggggcccggagcuucuccccgccccgcgccggccggcacuucggguaccgcgugcuccaggugggcaacggggucaucgugggcgcccccggcgaggggaacagcaccggcucccucuaccagugccagagcgggacgggccacugccugcccgugacccugcggggguccaacuacaccagcaaguaccucggcaugacccuggcgacggacccgaccgacggcuccauccuguucgccgccguccaguucagcaccuccuacaagaccgaguucgacuucagcgacuacgugaagcgcaaggaccccgacgcccuccugaagcacgugaagcacaugcugcuccugacgaacaccuucggggcgaucaacuacgucgccaccgagguguuccgggaggagcugggcgcccgccccgacgccaccaaggugcucaucaucaucacggacggggaggccaccgacuccggcaacaucgacgcggccaaggacaucauccgguacaucaucggcaucgggaagcacuuccagaccaaggagagccaggagacccugcacaaguucgccuccaagcccgccagcgaguucgucaagauccuggacacguucgagaagcucaaggaccuguucaccgagcugcagaagaagaucuacgugaucgagggcaccuccaagcaggaccucaccagcuucaacauggagcugagcuccagcgggaucuccgccgaccugagccgcggccacgcgguggucggggccgugggcgccaaggacugggccggcggguuccucgaccugaaggccgaccugcaggacgacacguucaucggcaacgagccgcucacccccgaggugcgggcgggguaccugggcuacaccgucaccuggcugcccucccgccagaagacgagccuccuggccuccggggcgccccgguaccagcacaugggccgcgugcugcuguuccaggagccgcagggcgggggccacuggagccaggugcagaccauccacgggacccagaucggcuccuacuucgggggcgagcugugcggcgucgacguggaccaggacggggagaccgagcugcuccugaucggcgcgccccuguucuacggggagcagcggggcggccgcguguucaucuaccagcggcgccagcucggguucgaggaggucagcgagcugcagggcgaccccggguacccccugggccgguucggggaggccaucacggcccucaccgacaucaacggcgacggccugguggacgucgccgugggggccccgcuggaggagcagggcgccguguacaucuucaacgggcgccacggcgggcucagcccccagcccucccagcggaucgagggcacccagguccuguccggcauccagugguucgggcgcagcauccacggcgugaaggaccuggagggggacggccucgccgacguggccgucggggccgagucccagaugaucgugcugagcucccgccccguggucgacauggugacccugaugagcuucuccccggccgagauccccgugcacgaggucgagugcagcuacagcacguccaacaagaugaaggagggcgugaacaucaccaucugcuuccagaucaagagccugaucccccaguuccagggccggcucguggccaaccugaccuacacccugcagcucgacgggcaccgcacgcggcgccggggccuguuccccgggggccgccacgagcugcggcgcaacaucgcggucaccaccuccaugagcugcaccgacuucuccuuccacuucccggugugcgugcaggaccucaucagccccaucaacgucucccugaacuucagccugugggaggaggaggggacgccccgggaccagcgcgccggcaaggacaucccgcccauccuccggcccucccugcacagcgagaccugggagauccccuucgagaagaacugcggcgaggacaagaagugcgaggccaaccugcgcguguccuucagcccggcccggucccgcgcccuccggcugaccgcguucgccagccuguccguggagcucagccuguccaaccuggaggaggacgccuacuggguccagcucgaccugcacuucccgcccgggcugagcuuccgcaagguggagaugcucaagccccacagccagauccccguguccugcgaggagcugcccgaggagagccggcugcucucccgcgcccugagcugcaacgucuccagccccaucuucaaggccggccacuccguggcgcugcagaugauguucaacacccucgugaacagcuccuggggcgacagcgucgagcugcacgccaacgugaccugcaacaacgaggacuccgaccugcucgaggacaacagcgccacgaccaucauccccauccuguacccgaucaacauccugauccaggaccaggaggacuccacccucuacgugagcuucacccccaaggggcccaagauccaccaggucaagcacauguaccaggugcggauccagcccuccauccacgaccacaacaucccgacgcuggaggccguggucggcgugccccagccgcccagcgaggggcccaucacccaccagugguccgugcagauggagccgcccguccccugccacuacgaggaccuggagcgccuccccgacgcggccgagcccugccugcccggcgcccuguuccgcugccccgugguguuccggcaggagauccucguccaggugaucgggacccuggagcuggugggcgagaucgaggccagcuccauguucagccucugcagcucccugagcaucuccuucaacagcuccaagcacuuccaccuguacgggagcaacgccucccucgcgcaggucgugaugaagguggacgucguguacgagaagcagaugcuguaccuguacgugcucagcggcaucggcgggcugcugcuccugcugcucaucuucaucguccuguacaaggugggcuucuucaagcgcaaccugaaggagaagauggaggccgggcggggcgugccgaacgggauccccgccgaggacuccgagcagcucgccagcggccaggaggccggcgaccccgggugccugaagccgcugcacgagaaggacuccgagagcggcgggggcaaggacuga

SEQ ID NO: 31734 - RNA, 3459 nt, Artificial Sequence
  derived and/or modified sequence opt1 from ITGAM__Homo_sapiens__NP_000623
auggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaagagcaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaagagcacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaagagcacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcaccugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccugcugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccaguga

SEQ ID NO: 31735 - RNA, 3009 nt, Artificial Sequence
  derived and/or modified sequence opt1 from ITGAV__Homo_sapiens__NP_001138471
augcugcucggcacccugcugcucauccuguacauccugaugcucugccgcauguuccugcuggugggggcccccaaggccaacaccacgcagcccggcaucgucgagggcggccaggugcucaagugcgacuggagcuccacccggcgcugccagcccaucgaguucgacgcgaccgggaaccgggacuacgccaaggacgacccccuggaguucaagagccaccagugguucggggccuccgugcgcagcaagcaggacaagauccuggccugcgcgccccucuaccacuggcggaccgagaugaagcaggagcgcgagccggucggcacgugcuuccugcaggacgggaccaagaccguggaguacgcccccugccggucccaggacaucgacgccgacggccagggguucugccagggcggguucagcaucgacuucaccaaggccgaccgcgugcugcucggcggccccggguccuucuacuggcagggccagcugaucagcgaccaggucgccgagaucguguccaaguacgaccccaacguguacagcaucaaguacaacaaccagcuggcgacgcggaccgcccaggccaucuucgacgacuccuaccucggguacagcgucgccgugggcgacuucaacggcgacgggaucgacgacuucguguccggcgucccgcgcgccgcgcggacccuggggaugguguacaucuacgacggcaagaacaugagcucccuguacaacuucaccggggagcagauggccgccuacuucggcuucagcguggccgccacggacaucaacggcgacgacuacgcggacgucuucaucggggcgccccucuucauggaccgcggcuccgacgggaagcugcaggaggugggccaggugagcgucucccugcagcgggccagcggggacuuccagaccaccaagcucaacggcuucgagguguucgcccgcuucggcagcgccaucgcgccccugggggaccuggaccaggacggcuucaacgacaucgccaucgccgcccccuacgggggcgaggacaagaaggggaucguguacaucuucaacggccgguccaccggccucaacgccgucccgagccagauccuggaggggcagugggccgcccgcuccaugccgcccagcuucggcuacuccaugaagggggccacggacaucgacaagaacggcuaccccgaccugaucgugggcgccuucgggguggaccgggcgauccucuaccgcgcccggcccgucaucaccgugaacgccggccuggaggucuaccccagcauccugaaccaggacaacaagaccugcucccuccccgggaccgcccugaaggugagcugcuucaacgugcgcuucugccugaaggccgacggcaaggggguccucccccggaagcugaacuuccagguggagcugcuccuggacaagcugaagcagaagggcgcgauccgccgcgcccucuuccuguacucccggagcccgucccacagcaagaacaugacgaucucccgcggcgggcugaugcagugcgaggagcucaucgccuaccugcgggacgagagcgaguuccgcgacaagcugacccccaucaccaucuucauggaguaccggcucgacuaccgcaccgccgccgacacgaccggccugcagcccauccugaaccaguucacccccgcgaacaucucccggcaggcccacauccugcucgacugcggggaggacaacgugugcaagccgaagcuggaggucagcguggacuccgaccagaagaagaucuacaucggcgacgacaacccccugacccucaucgugaaggcccagaaccagggggagggcgccuacgaggccgagcugaucgucagcaucccccugcaggcggacuucaucggcguggugcgcaacaacgaggcccucgcccggcuguccugcgccuucaagacggagaaccagacccgccaggucgugugcgaccuggggaaccccaugaaggcgggcacccagcuccuggccgggcugcgguucagcgugcaccagcagagcgagauggacaccuccgucaaguucgaccuccagauccagagcuccaaccuguucgacaaggugagcccgguggucucccacaagguggaccuggccgugcucgccgccgucgagauccgcggcgugagcucccccgaccacaucuuccugcccaucccgaacugggagcacaaggagaaccccgagacggaggaggacguggggcccgucgugcagcacaucuacgagcugcggaacaacggccccagcuccuucagcaaggcgaugcuccaccuccaguggccguacaaguacaacaacaacacccugcuguacauccugcacuacgacaucgacggccccaugaacugcaccuccgacauggagaucaacccccugcgcaucaagaucagcucccuccagaccacggagaagaacgacaccguggccgggcagggcgagcgggaccaccugaucaccaagcgcgaccuggcccucagcgagggggacauccacacccugggcugcggggucgcccagugccugaagaucgugugccaggugggccggcucgaccgcggcaaguccgccauccuguacgucaagagccugcucuggaccgagacguucaugaacaaggagaaccagaaccacuccuacagccucaagagcuccgcgagcuucaacgugaucgaguuccccuacaagaaccugccgaucgaggacaucaccaacuccacccuggugaccacgaacgucaccugggggauccagcccgcccccaugcccgugccggugugggucaucauccuggccgugcuggccggccuccugcugcucgccgugcuggucuucgugauguaccggaugggguucuucaagcgcgugcgcccgccccaggaggagcaggagcgggagcagcugcagccccacgagaacggcgagggcaacagcgagaccuga

SEQ ID NO: 31736 - RNA, 3492 nt, Artificial Sequence
  derived and/or modified sequence opt1 from ITGAX__Homo_sapiens__NP_000878
augacccgcacccgggccgcccugcuccuguucacggcgcuggccaccagccucggcuucaaccuggacaccgaggagcugaccgccuuccgcguggacuccgccggguucggcgacagcgucgugcaguacgccaacuccuggguggucgugggggcgccccagaagaucacggccgccaaccagaccggcgggcucuaccagugcggcuacagcaccggcgccugcgagccgaucgggcuccaggugccgcccgaggcggucaacaugucccugggccugagccuggccuccaccacgagccccucccagcugcucgccugcgggcccaccgugcaccacgagugcggccggaacauguaccugaccgggcugugcuuccuccugggccccacccagcugacgcagcgccuccccgugagccggcaggagugcccccgccaggagcaggacaucgucuuccugaucgacggcuccgggagcaucuccagccggaacuucgccaccaugaugaacuucgugcgcgccgugaucucccaguuccagcggccgagcacccaguucucccugaugcaguucagcaacaaguuccagacccacuucacguucgaggaguuccgccgguccagcaacccccucagccugcuggcguccguccaccagcuccagggcuucaccuacaccgccaccgccauccagaacguggugcaccgccuguuccacgccagcuacggggcccggcgcgacgcggccaagauccugaucgucaucacggacggcaagaaggagggcgacucccucgacuacaaggacgugauccccauggccgacgccgccgggaucauccgguacgcgaucggcguggggcuggccuuccagaaccgcaacagcuggaaggagcugaacgacaucgccuccaagcccagccaggagcacaucuucaaggucgaggacuucgacgcccucaaggacauccagaaccagcugaaggagaagaucuucgccaucgagggcaccgagaccaccuccagcuccagcuucgagcuggagauggcgcaggagggguucuccgccguguucacgccggacggccccgugcucggcgccgucgggagcuucaccugguccggcggggccuuccuguacccgcccaacaugagccccaccuucaucaacaugucccaggagaacguggacaugcgggacagcuaccugggcuacuccaccgagcucgcgcuguggaagggggugcagagccugguccucggcgccccgcgcuaccagcacacgggcaaggccgugaucuucacccaggucucccggcaguggcgcaugaaggccgaggugaccgggacccagaucggcagcuacuucggggccagccugugcuccguggacgucgacagcgacggcuccacggaccuggugcucaucggggcgccccacuacuacgagcagacccggggcggccaggugagcgucugcccccugccccgcggguggcgccggugguggugcgacgccgugcuguacggcgagcaggggcaccccuggggccgcuucggcgccgcccucaccgugcugggggacgucaacggcgacaagcugaccgacguggugaucggggcccccggcgaggaggagaaccgcggggcggucuaccucuuccacggcgugcugggccccuccaucagcccgucccacagccagcggaucgccgggucccagcugagcucccggcugcaguacuucggccaggcccucagcgggggccaggaccugacgcaggacgggcugguggaccucgccgucggcgcccgcggccaggugcugcugcuccggacccgccccgugcugugggucgggguguccaugcaguucauccccgcggagaucccccggagcgccuucgagugccgcgagcaggucguguccgagcagacccuggugcagagcaacaucugccucuacaucgacaagcgguccaagaaccugcugggcagccgcgaccuccagagcuccgugacccuggaccuggcccucgacccggggcggcugagcccccgcgccaccuuccaggagacgaagaaccggucccugagccgcguccgggugcucggccugaaggcgcacugcgagaacuucaaccugcuccugcccuccugcguggaggacagcgucaccccgaucacccugcgccucaacuucacccugguggggaagccccugcucgccuuccggaaccugcgccccaugcuggccgccgacgcccagcgcuacuucacggcgucccuccccuucgagaagaacugcggcgccgaccacaucugccaggacaaccugggcaucagcuucuccuucccggggcucaagagccugcuggugggcuccaaccuggagcucaacgccgaggucaugguguggaacgacggggaggacagcuacggcaccaccaucaccuucucccaccccgccgggcugagcuaccgguacguggccgagggccagaagcagggccagcugcgcucccuccaccugacgugcgacagcgcgcccgucgggucccagggcaccuggagcaccuccugccggaucaaccaccugaucuuccgcgggggcgcccagaucaccuuccucgccacguucgacgugagccccaaggccgugcugggcgaccggcugcuccugaccgccaacgucagcuccgagaacaacaccccgcgcaccagcaagacgaccuuccagcuggagcuccccgugaaguacgcgguguacaccgucguguccagccacgagcaguucaccaaguaccugaacuucuccgagagcgaggagaaggagucccacguggccaugcaccgguaccaggucaacaaccuggggcagcgcgaccuccccgugagcaucaacuucugggugcccgucgagcugaaccaggaggccguguggauggacguggaggucucccacccgcagaaccccagccugcggugcuccagcgagaagaucgccccgcccgcguccgacuuccucgcccacauccagaagaaccccgugcuggacugcagcaucgccggcugccugcgcuuccggugcgacgugcccuccuucagcguccaggaggagcucgacuucacgcugaaggggaaccuguccuucggcugggugcgccagauccuccagaagaaggucagcgugguguccgucgccgagaucaccuucgacaccagcguguacagccagcugcccgggcaggaggccuucaugcgggcgcagaccacgaccgugcuggagaaguacaagguccacaaccccaccccgcucaucgugggcuccagcaucggcgggcugcugcuccuggcccugaucaccgccgugcucuacaaggucggcuucuucaagcgccaguacaaggagaugauggaggaggccaacgggcagaucgcccccgagaacggcacgcagacccccuccccgcccagcgagaaguga

SEQ ID NO: 31737 - RNA, 603 nt, Artificial Sequence
  derived and/or modified sequence opt1 from ITGB1BP1__Homo_sapiens__NP_004754
auguuccgcaagggcaagaagcggcacagcuccagcuccagccaguccagcgagaucuccaccaagagcaaguccguggacagcucccucgggggccugagccgcuccagcaccgucgccucccuggacacggacagcaccaaguccagcgggcaguccaacaacaacagcgacacgugcgccgaguuccggaucaaguacgugggcgcgaucgagaagcugaagcucagcgaggggaagggccuggagggcccccuggaccucaucaacuacaucgacguggcccagcaggacgggaagcugcccuucgucccgcccgaggaggaguucaucaugggcguguccaaguacgggaucaaggugagcaccuccgaccaguacgacguccugcaccgccacgcccucuaccugaucauccggauggugugcuacgacgacggccugggggccggcaagagccuccuggcccugaagaccaccgacgcguccaacgaggaguacagccucuggguguaccagugcaacucccuggagcaggcccaggccaucugcaagguccugagcaccgccuucgacuccgugcucaccagcgagaagcccuga

SEQ ID NO: 31738 - RNA, 2406 nt, Artificial Sequence
  derived and/or modified sequence opt1 from ITGB1__Homo_sapiens__NP_391988
augaaccugcagcccaucuucuggaucggccucaucagcuccgugugcugcgucuucgcccagaccgacgagaaccgcugccugaaggccaacgccaagagcugcggggagugcauccaggcgggcccgaacugcggguggugcaccaacuccacguuccugcaggagggcaugcccaccagcgcccggugcgacgaccucgaggcccugaagaagaaggggugcccgcccgacgacaucgagaacccccgcggcuccaaggacaucaagaagaacaagaacgugaccaaccggagcaagggcaccgccgagaagcugaagcccgaggacaucacgcagauccagccccagcagcucgugcugcgccugcgguccggggagccccagaccuucacccucaaguucaagcgcgcggaggacuacccgaucgaccuguacuaccugauggaccucagcuacuccaugaaggacgaccuggagaacgucaagagccugggcaccgaccucaugaacgagaugcggcgcaucacguccgacuuccggaucggguucggcagcuucguggagaagaccgugaugcccuacaucuccaccacccccgccaagcugcgcaaccccugcacgagcgagcagaacugcaccuccccguucagcuacaagaacguccugucccucaccaacaagggggagguguucaacgagcuggugggcaagcagcggaucagcggcaaccuggacucccccgagggcggguucgacgccaucaugcaggucgccgugugcgggagccucaucggcuggcgcaacgugacccggcugcuggucuucagcacggacgcgggcuuccacuucgccggggacggcaagcucgggggcaucgugcugcccaacgacgggcagugccaccuggagaacaacauguacaccaugucccacuacuacgacuaccccagcaucgcccaccucgugcagaagcuguccgagaacaacauccagaccaucuucgccgucaccgaggaguuccagccgguguacaaggagcugaagaaccucauccccaagagcgccgugggcacgcuguccgcgaacagcuccaacgucauccagcugaucaucgacgccuacaacagccucuccagcgaggugauccuggagaacggcaagcuguccgagggggugaccaucagcuacaaguccuacugcaagaacggcgucaacgggaccggcgagaacgggcgcaagugcagcaacaucuccaucggcgacgaggugcaguucgagaucagcaucaccuccaacaagugccccaagaaggacagcgacuccuucaagauccggccccucggcuucacggaggagguggaggucauccugcaguacaucugcgagugcgagugccagagcgaggggaucccggagagccccaagugccacgagggcaacgggaccuucgagugcggcgccugccgcugcaacgaggggcgggugggccgccacugcgagugcuccaccgacgaggucaacagcgaggacauggacgccuacugccggaaggagaacuccagcgagaucugcuccaacaacggcgagugcgugugcgggcagugcgugugccgcaagcgggacaacaccaacgagaucuacagcggcaaguucugcgagugcgacaacuucaacugcgaccgcuccaacgggcugaucugcggcggcaacggggucugcaagugccgcgugugcgagugcaaccccaacuacacgggcagcgccugcgacugcucccucgacaccagcacgugcgaggcguccaacgggcagaucugcaacggccgggggaucugcgagugcggcgugugcaagugcaccgaccccaaguuccagggccagaccugcgagaugugccagaccugccugggggucugcgccgagcacaaggagugcgugcagugccgcgccuucaacaagggcgagaagaaggacacgugcacccaggagugcagcuacuucaacaucaccaagguggagucccgggacaagcugccgcagcccguccagcccgaccccgugagccacugcaaggagaaggacguggacgacugcugguucuacuucaccuacuccgucaacgggaacaacgaggugauggugcacgucguggagaacccggagugccccaccggccccgacaucaucccgaucguggccggggucguggccggcaucgugcucaucggccuggcgcugcuccugaucuggaagcugcucaugaucauccacgaccgccgggaguucgccaaguucgagaaggagaagaugaacgccaagugggacacccaggagaaccccaucuacaagagccccaucaacaacuucaagaaccccaacuacgggcgcaaggccggccuguga

SEQ ID NO: 31739 - RNA, 2310 nt, Artificial Sequence
  derived and/or modified sequence opt1 from ITGB2__Homo_sapiens__NP_000202
augcugggccuccggcccccgcugcuggcccucguggggcugcugagccucggcugcguccugucccaggagugcaccaaguucaaggugagcuccugccgcgagugcaucgagagcgggcccggcugcaccuggugccagaagcugaacuucacggggcccggcgaccccgacuccauccgcugcgacacccggccgcagcuccugaugcgcggcugcgccgcggacgacaucauggaccccaccagccuggccgagacccaggaggaccacaacgggggccagaagcagcucagcccccagaaggugacgcuguaccugcggcccgggcaggccgccgccuucaacgucaccuuccgccgggcgaagggcuacccgaucgaccucuacuaccugauggaccuguccuacuccaugcucgacgaccugcgcaacgugaagaagcucgggggcgaccugcugcgggcccugaacgagaucaccgagagcggccgcaucggguucggcuccuucguggacaagaccguccuccccuucgugaacacgcaccccgacaagcugcggaaccccugcccgaacaaggagaaggagugccagccgcccuucgccuuccgccacgugcugaagcucaccaacaacagcaaccaguuccagaccgaggucgggaagcagcugaucuccggcaaccuggacgcccccgagggcgggcucgacgcgaugaugcaggucgccgccugccccgaggagaucggcuggcggaacgugacccgccugcugguguucgccacggacgacggguuccacuucgccggcgacgggaagcucggcgcgauccugacccccaacgacggccggugccaccuggaggacaaccucuacaagcgcagcaacgaguucgacuaccccuccguggggcagcuggcccacaagcuggccgagaacaacauccagcccaucuucgccgugaccagccggauggucaagaccuacgagaagcucacggagaucaucccgaaguccgccgugggcgagcugagcgaggacuccagcaacgugguccaccugaucaagaacgcguacaacaagcucagcucccgcguguuccuggaccacaacgcccugcccgacacccucaaggugaccuacgacagcuucugcuccaacggggucacccaccggaaccagccccgcggcgacugcgacggggugcagaucaacgugcccaucacguuccaggucaaggugaccgccaccgagugcauccaggagcagagcuucgucauccgggcccugggcuucaccgacaucgugacggugcagguccugccgcagugcgagugccgcugccgcgaccagucccgggaccgcagccucugccacggcaagggguuccuggagugcggcaucugccggugcgacaccggguacaucggcaagaacugcgagugccagacccaggggcgcuccagccaggagcuggagggcuccugccggaaggacaacaacagcaucaucugcuccggccugggggacugcgugugcggccagugccucugccacaccagcgacgugcccgggaagcugaucuacggccaguacugcgagugcgacacgaucaacugcgagcgcuacaacggccaggucugcgggggccccgggcggggccugugcuucugcgggaagugccgcugccaccccggcuucgagggcuccgccugccagugcgagcggaccaccgaggggugccucaacccgcgccggguggagugcagcggccgcgggcggugccgcugcaacgugugcgagugccacuccggcuaccagcugccccugugccaggagugccccgggugcccgagccccugcggcaaguacaucuccugcgcggagugccucaaguucgagaagggccccuucgggaagaacugcagcgccgccugccccggccugcagcuguccaacaacccggucaaggggcggaccugcaaggagcgcgacagcgagggcugcuggguggccuacacgcucgagcagcaggacgggauggaccgguaccugaucuacguggacgagagccgcgagugcgucgccggccccaacaucgcggccaucgugggcgggaccguggccggcaucguccugaucgggauccuccugcuggugaucuggaaggcccucauccaccuguccgaccugcgggaguaccgccgcuucgagaaggagaagcucaagagccaguggaacaacgacaacccccuguucaaguccgcgaccaccacggugaugaaccccaaguucgccgagagcuga

SEQ ID NO: 31740 - RNA, 2367 nt, Artificial Sequence
  derived and/or modified sequence opt1 from ITGB3__Homo_sapiens__NP_000203
augcgcgcccggccccgcccgcggccccugugggccaccgugcucgcgcugggcgcccuggccggggucggcgucgggggccccaacaucugcaccacgcgcggggugagcuccugccagcagugccucgccgugagccccaugugcgccuggugcuccgacgaggcgcugccgcugggcagcccccggugcgaccucaaggagaaccugcugaaggacaacugcgcccccgaguccaucgaguuccccgugagcgaggcccgcgugcucgaggaccggccgcuguccgacaagggcagcggggacuccagccaggucacccaggugagcccccagcgcaucgcccugcggcuccgccccgacgacuccaagaacuucuccauccaggugcggcaggucgaggacuaccccguggacaucuacuaccugauggaccugagcuacuccaugaaggacgaccucuggagcauccagaaccugggcaccaagcuggcgacccagaugcgcaagcucacguccaaccugcggaucggguucggcgccuucguggacaagccggucagccccuacauguacaucuccccgcccgaggcccuggagaaccccugcuacgacaugaagacgaccugccuccccauguucggguacaagcacgugcugacccugaccgaccaggugacccgcuucaacgaggaggucaagaagcagagcgugagccggaaccgcgacgcccccgagggcggcuucgacgccaucaugcaggcgaccgugugcgacgagaagaucggguggcggaacgacgccucccaccuccuggucuucaccacggacgccaagacccacaucgcccuggacggccgccucgccgggaucgugcagcccaacgacggccagugccacgugggcagcgacaaccacuacuccgcgagcaccaccauggacuacccgucccuggggcugaugacggagaagcucagccagaagaacaucaaccugaucuucgccgucaccgagaacguggugaaccuguaccagaacuacuccgagcucauccccggcaccaccgucggggugcugagcauggacuccagcaacguccugcagcucaucguggacgccuacggcaagauccgguccaagguggagcuggagguccgcgaccugcccgaggagcucagccuguccuucaacgccacgugccugaacaacgaggugauccccgggcucaagagcugcaugggccugaagaucggcgacaccguguccuucagcaucgaggccaagguccgggggugcccgcaggagaaggagaaguccuucaccaucaagcccgugggcuucaaggacagccugaucgugcaggucaccuucgacugcgacugcgcgugccaggcccaggccgagcccaacucccaccgcugcaacaacgggaacggcacguucgagugcggggugugccgcugcggccccggcuggcucgggagccagugcgagugcagcgaggaggacuaccggccgucccagcaggacgagugcagcccccgcgagggccagcccgugugcucccagcgcggggagugccugugcggccagugcgucugccacagcuccgacuucgggaagaucaccggcaaguacugcgagugcgacgacuucagcugcgugcgguacaagggcgagaugugcuccgggcacggccagugcagcugcggggacugccugugcgacuccgacuggaccggcuacuacugcaacugcaccacgcggaccgacacgugcaugagcuccaacggccuccugugcagcgggcgcggcaagugcgagugcggguccugcgugugcauccagccgggcagcuacggggacacgugcgagaagugcccgaccugccccgacgccugcaccuucaagaaggagugcgucgagugcaagaaguucgaccggggcgcccugcacgacgagaacacgugcaaccgcuacugccgggacgagaucgaguccgugaaggagcugaaggacaccggcaaggacgcggugaacugcaccuacaagaacgaggacgacugcgucgugcgcuuccaguacuacgaggacagcuccggcaagagcauccucuacguggucgaggagcccgagugccccaaggggcccgacauccugguggugcugcucagcgucaugggggccauccugcugaucggccucgccgcccugcugaucuggaagcuccugaucaccauccacgaccggaaggaguucgcgaaguucgaggaggagcgcgcccgggccaagugggacaccgccaacaacccccuguacaaggaggccaccuccaccuucaccaacaucaccuaccgcgggaccuga

SEQ ID NO: 31741 - RNA, 5469 nt, Artificial Sequence
  derived and/or modified sequence opt1 from ITGB4__Homo_sapiens__NP_000204
auggccggcccccgcccgagccccugggcccggcugcuccuggcggcccugaucuccgugagccucuccgggacccuggccaaccgcugcaagaaggcccccgucaagagcugcaccgagugcgugcggguggacaaggacugcgccuacugcacggacgagauguuccgcgaccggcgcugcaacacccaggcggagcugcucgccgccggcugccagcgggaguccaucgucgugauggagagcuccuuccagaucaccgaggagacccagaucgacacgacccugcgccggagccagauguccccccaggggcugcgcgugcggcuccgcccgggcgaggagcggcacuucgagcuggaggucuucgagccccuggagagccccguggaccucuacauccugauggacuucuccaacagcauguccgacgaccuggacaaccucaagaagauggggcagaaccuggcccgcgugcugagccagcucaccuccgacuacaccaucggcuucggcaaguucgucgacaaggugagcgugccccagacggacaugcggccggagaagcugaaggagcccuggcccaacuccgaccccccguucagcuucaagaacgucaucucccugaccgaggacguggacgaguuccgcaacaagcuccagggggagcggaucagcggcaaccuggacgcgcccgaggggggcuucgacgccauccugcagaccgccgugugcacccgcgacaucggguggcggcccgacagcacgcaccuccuggucuucuccaccgagagcgccuuccacuacgaggccgacggcgcgaacgugcuggccggcaucaugucccgcaacgacgagcggugccaccucgacaccaccgggacguacacccaguaccgcacccaggacuaccccagcgugccgacccugguccgccugcucgccaagcacaacaucauccccaucuucgccgugacgaacuacuccuacagcuacuacgagaagcugcacaccuacuuccccguguccagccugggcguccuccaggaggacuccagcaacaucguggagcugcuggaggaggccuucaaccggauccgcuccaaccucgacauccgggcgcuggacagcccccgcgggcugcggaccgaggugaccuccaagauguuccagaagacgcgcaccggcagcuuccacauccggcgcggcgaggucgggaucuaccaggugcagcuccgggcccuggagcacgucgacggcacccacgugugccagcugccggaggaccagaaggggaacauccaccucaagcccuccuucagcgacggccugaagauggacgccgggaucaucugcgacgugugcaccugcgagcugcagaaggagguccgcuccgcccggugcagcuucaacggcgacuucgugugcggccagugcgugugcuccgagggguggagcggccagacgugcaacugcagcaccgggucccucagcgacauccagcccugccugcgcgagggcgaggacaagcccugcuccgggcggggcgagugccagugcggccacugcgucugcuacggggagggccgcuacgaggggcaguucugcgaguacgacaacuuccagugcccgcggaccagcggcuuccugugcaacgaccgcgggcggugcuccaugggccagugcgugugcgagcccggcuggaccgggcccagcugcgacugcccccucuccaacgccacgugcaucgacagcaacggcgggaucugcaacggccgcggccacugcgagugcgggcggugccacugccaccagcagucccuguacaccgacaccaucugcgagaucaacuacagcgcgauccacccgggccugugcgaggaccugcgcuccugcgugcagugccaggccugggggaccggcgagaagaaggggcgcacgugcgaggagugcaacuucaaggucaagaugguggacgagcucaagcgggccgaggagguggucgugcgcugcagcuuccgggacgaggacgacgacugcaccuacuccuacaccauggagggcgacggcgcccccgggcccaacagcaccgugcugguccacaagaagaaggacugcccgcccggcuccuucugguggcugaucccccuccugcugcuccugcugccccuccuggcccugcuccugcugcucugcuggaaguacugcgcgugcugcaaggccugccuggcccugcucccgugcugcaaccgcgggcacauggugggcuucaaggaggaccacuacaugcugcgggagaaccugauggccagcgaccaccucgacacccccaugcugcgcuccgggaaccugaagggccgggacgugguccgcuggaaggugacgaacaacaugcagcggcccggcuucgcgacccacgccgccagcaucaaccccaccgagcucgugccguacgggcugagccugcgccucgcccggcugugcaccgagaaccugcucaagcccgacacgcgcgagugcgcccagcugcggcaggaggucgaggagaaccugaacgagguguaccgccagaucuccggcgugcacaagcuccagcagaccaaguuccggcagcagcccaacgcggggaagaagcaggaccacaccaucgucgacaccgugcugauggccccccgcagcgccaagccggcccugcucaagcugacggagaagcagguggagcagcgggccuuccacgaccugaaggucgcgcccggcuacuacacccucaccgccgaccaggacgcccgcgggaugguggaguuccaggagggcguggagcuggucgacgugcgggugccccuguucauccgccccgaggacgacgacgagaagcagcuccuggucgaggccaucgacgugccggccggcaccgcgacgcuggggcggcgccucgugaacaucaccaucaucaaggagcaggcccgcgacgucguguccuucgagcagcccgaguucagcgugucccggggcgaccaggucgcccgcauccccgugauccggcgcgugcuggacgggggcaagagccaggucuccuaccggacccaggacgggaccgcccagggcaaccgcgacuacauccccguggagggcgagcugcucuuccagccgggggaggcguggaaggagcugcaggugaagcugcucgagcugcaggaggucgacagccugcuccggggccgccaggugcggcgcuuccacgugcagcuguccaaccccaaguucggggcccaccugggccagccccacagcacgaccaucaucauccgggaccccgacgagcucgaccgcuccuucaccagccagaugcuguccagccagccgcccccccacggcgaccugggggccccgcagaaccccaacgccaaggccgcgggcucccggaagauccacuucaacuggcucccccccagcgggaagccgaugggcuaccgcgucaaguacuggauccagggggacuccgagagcgaggcccaccugcuggacuccaaggugcccagcguggagcucaccaaccuguaccccuacugcgacuacgagaugaaggucugcgccuacggcgcccagggcgaggggcccuacagcucccuggugagcugccggacgcaccaggaggucccguccgagcccggccgccucgccuucaacguggugagcuccaccgucacccagcugagcugggcggagcccgccgagaccaacggggagaucacggccuacgaggugugcuacggccuggugaacgacgacaaccggcccaucgggccgaugaagaagguccucguggacaaccccaagaaccgcaugcugcugaucgagaaccuccgggagucccagcccuaccgcuacaccgugaaggcccgcaacggcgccggcugggggcccgagcgggaggcgaucaucaaccuggccacccagccgaagcgccccaugagcauccccaucauccccgacaucccgaucgucgacgcccaguccggcgaggacuacgacagcuuccugauguacuccgacgacgugcuccggagccccuccgggagccagcgccccuccgugagcgacgacaccggcugcggguggaaguucgagccccugcugggcgaggagcucgaccugcggcgcgucacguggcggcugccgcccgagcucaucccccgccuguccgccagcuccggccggagcagcgacgcggaggccccccacgggccgcccgacgacggcggggccggcggcaaggggggcucccugccccgcagcgccaccccggggccccccggcgagcaccucgugaacgggcggauggacuucgccuuccccggcuccaccaacagccugcaccgcaugaccacgaccuccgcggccgccuacggcacccaccugagcccgcacgugccccaccggguccucuccaccagcuccacgcugacccgcgacuacaacagccugacccgguccgagcacagccacuccaccacccucccccgcgacuacagcacgcugaccuccgugagcucccacgacagccggcugaccgccggggugcccgacaccccgacgcgccucgucuucuccgcccugggccccaccagccugcgggugagcuggcaggagccccgcugcgagcggccccugcagggguacuccguggaguaccagcuccugaacggcggggagcugcaccgccucaacaucccgaaccccgcgcagaccagcgucgugguggaggaccugcugcccaaccacuccuacgucuuccgcgugcgggcccagagccaggagggcuggggccgcgagcgggagggggugaucaccaucgagucccagguccacccccagagcccgcucugcccccugcccggcuccgccuucacgcugagcacccccuccgccccggggccccucguguucaccgcccugagccccgacucccugcagcucagcugggagcgcccccggcgcccgaacggcgacaucgugggguaccuggucaccugcgagauggcgcagggcggcgggcccgccacggccuuccggguggacggcgacucccccgagagccgccugaccgugcccgggcucuccgagaacgucccguacaaguucaaggugcaggcccggaccaccgagggcuucgggcccgagcgcgagggcaucaucacgaucgagagccaggacggcgggcccuucccgcagcugggcucccgggccgggcuguuccagcacccccuccagagcgaguacuccagcaucaccaccacccacacgagcgcgaccgagcccuuccugguggacggccugacccucggcgcccagcaccuggaggccgggggcucccugacccgccacgucacgcaggaguucgugagccggacccucaccaccuccgggacgcugagcacccacauggaccagcaguucuuccagaccuga

SEQ ID NO: 31742 - RNA, 2400 nt, Artificial Sequence
  derived and/or modified sequence opt1 from ITGB5__Homo_sapiens__NP_002204
augccccgcgccccggcgccccuguacgccugccuccugggccugugcgcccuccugccccggcuggccgggcucaacaucugcaccagcggcuccgccaccagcugcgaggagugccugcugauccaccccaagugcgccuggugcuccaaggaggacuucgggagcccgcgcuccaucacgagccggugcgaccuccgcgcgaaccuggugaagaacggcugcgggggcgagaucgagucccccgccagcuccuuccacguccugcggagccucccccuguccagcaagggcuccgggagcgccggcugggacgugauccagaugacgccccaggagaucgccgugaaccugcgcccgggggacaagaccaccuuccagcuccagguccgccagguggaggacuaccccguggaccuguacuaccugauggaccucucccugagcaugaaggacgaccuggacaacauccggucccucggcaccaagcuggcggaggagaugcggaagcugaccagcaacuuccgccucggguucggcuccuucgucgacaaggacaucagccccuucagcuacaccgcgccccgguaccagaccaacccgugcaucggcuacaagcuguuccccaacugcgugcccuccuucggguuccgccaccuccugccccugacggaccggguggacagcuucaacgaggagguccgcaagcagcgggugucccgcaaccgggacgccccggagggcggguucgacgccgugcugcaggccgccgucugcaaggagaagaucggcuggcgcaaggacgcccuccaccuccugguguucaccaccgacgacgugccccacaucgcccuggacggcaagcucgggggccugguccagccccacgacgggcagugccaccugaacgaggccaacgaguacaccgccagcaaccagauggacuaccccucccuggcgcugcucggcgagaagcuggccgagaacaacaucaaccugaucuucgccgugacgaagaaccacuacaugcucuacaagaacuucaccgcccugaucccggggaccaccguggagauccuggacggcgacagcaagaacaucauccagcucaucaucaacgccuacaacuccauccggagcaaggucgagcuguccgugugggaccagcccgaggaccugaaccucuucuucacggcgaccugccaggacggcgugagcuaccccgggcagcgcaagugcgagggccugaagaucggggacaccgccuccuucgaggucagccuggaggcccgguccugccccagccgccacaccgagcacguguucgcccugcgcccggugggcuuccgggacucccucgaggucggggugacguacaacugcacgugcggcugcagcgucggccuggagcccaacuccgcccgcugcaacgggagcggcaccuacgugugcgggcugugcgagugcucccccggcuaccucgggacccggugcgagugccaggacggcgagaaccagagcguguaccagaaccugugccgcgaggcggagggcaagccccugugcagcgggcggggcgacugcuccugcaaccagugcagcugcuucgaguccgaguucgggaagaucuacggcccguucugcgagugcgacaacuucagcugcgcccgcaacaagggcguccucugcuccgggcacggcgagugccacugcggggagugcaagugccacgccggcuacaucggggacaacugcaacugcagcaccgacaucuccacgugccggggccgcgacggccagaucugcagcgagcgggggcacugccugugcggccagugccagugcaccgagcccggggccuucggcgagaugugcgagaagugcccgaccugccccgacgcgugcuccaccaagcgcgacugcguggagugccugcuccugcacagcgggaagcccgacaaccagaccugccacucccugugccgggacgaggugaucaccugggucgacaccaucgugaaggacgaccaggaggccgugcucugcuucuacaagacggccaaggacugcgucaugauguucaccuacguggagcugcccagcggcaaguccaaccugaccgugcuccgcgagcccgagugcggcaacaccccgaacgccaugacgauccugcuggccgucguggggagcauccuccuggugggccuggcgcuccuggccaucuggaagcugcucgucaccauccacgaccggcgcgaguucgccaaguuccaguccgagcggagccgcgcccgguacgagauggccuccaacccccuguaccgcaagcccaucagcacccacaccguggacuucaccuucaacaaguucaacaagagcuacaacgggacgguggacuga

SEQ ID NO: 31743 - RNA, 2367 nt, Artificial Sequence
  derived and/or modified sequence opt1 from ITGB6__Homo_sapiens__NP_000879
augggcaucgagcugcucugccuguucuuccuguuccucgggcgcaacgaccacgugcagggcgggugcgcccugggcggggccgagaccugcgaggacugccugcucaucggcccccagugcgcguggugcgcccaggagaacuucacccacccgagcggcgucggggagcggugcgacacgcccgccaaccugcuggccaagggcugccagcucaacuucaucgagaaccccgugucccagguggagauccugaagaacaagccccugagcgucgggcgccagaagaacuccagcgacaucgugcagaucgccccgcagucccucauccugaagcugcggcccggcggggcgcagacccuccaggugcacguccgccagaccgaggacuaccccguggaccuguacuaccugauggaccucagcgccuccauggacgacgaccugaacaccaucaaggagcugggcagccggcucuccaaggagaugagcaagcugacguccaacuuccgccugggcuucgggagcuucguggagaagcccgucuccccguucgugaagaccacccccgaggagaucgccaaccccugcagcuccauccccuacuucugccucccgaccuucggcuucaagcacauccugccccugacgaacgacgccgagcgguucaacgagaucgugaagaaccagaagaucagcgcgaacaucgacacccccgagggcggguucgacgccaucaugcaggccgccgucugcaaggagaagaucggcuggcgcaacgacucccuccaccuccugguguucgugagcgacgccgacucccacuucgggauggacagcaagcuggcgggcaucgucauccccaacgacgggcugugccaccuggacagcaagaacgaguacuccaugagcaccgugcucgaguacccgaccaucggccagcugaucgacaagcuggugcagaacaacguccuccugaucuucgccgugacgcaggagcagguccaccuguacgagaacuacgccaagcucauccccggggccaccgugggccugcugcagaaggacuccggcaacauccuccagcugaucaucagcgccuacgaggagcugcgguccgagguggagcucgaggugcugggggacaccgagggccugaaccucagcuucaccgcgaucugcaacaacgggacgcuguuccagcaccagaagaagugcucccacaugaaggucggcgacaccgccagcuucuccgugaccgucaacaucccccacugcgagcgccggagccgccacaucaucaucaagcccguggggcugggcgacgcccuggagcuccugguguccccggagugcaacugcgacugccagaaggaggucgaggugaacagcuccaagugccaccacggcaacgggagcuuccagugcggcgugugcgccugccaccccgggcacaugggcccccggugcgagugcggggaggacaugcuguccaccgacagcugcaaggaggcccccgaccacccguccugcagcggccgcggcgacugcuacugcgggcagugcaucugccaccucucccccuacggcaacaucuacgggcccuacugccagugcgacaacuucagcugcguccggcacaagggccugcugugcggcgggaacggcgacugcgacugcggggagugcgugugccgcagcggcuggacgggggaguacugcaacugcaccaccuccaccgacagcugcguguccgaggacggcguccucugcagcggccgcggggacugcgugugcggcaagugcgugugcacgaaccccggggcguccggcccgaccugcgagcggugcccgaccugcggggaccccugcaacagcaagcgguccugcaucgagugccaccugagcgccgccggccaggcccgcgaggagugcgucgacaagugcaagcuggccggcgcgaccaucuccgaggaggaggacuucagcaaggacggguccgugagcugcucccuccagggcgagaacgagugccugaucacguuccugaucaccaccgacaacgaggggaagaccaucauccacagcaucaacgagaaggacugccccaagccgcccaacauccccaugaucaugcucggcgugucccuggccauccugcucaucggggucgugcugcugugcaucuggaagcuccuggugagcuuccacgaccggaaggaggucgccaaguucgaggccgagcgcuccaaggcgaaguggcagacgggcaccaacccccuguaccgcggcagcaccagcaccuucaagaacgugacguacaagcaccgggagaagcagaagguggaccucuccaccgacugcuga

SEQ ID NO: 31744 - RNA, 2397 nt, Artificial Sequence
  derived and/or modified sequence opt1 from ITGB7__Homo_sapiens__NP_000880
augguggcccugcccaugguccucgugcugcugcucgugcugagccgcggcgaguccgagcuggacgccaagaucccgagcaccggggacgcgaccgaguggcggaacccccaccucuccaugcugggcagcugccagcccgcccccuccugccagaagugcauccugagccacccguccugcgccuggugcaagcagcucaacuucacggccagcggggaggccgaggcgcgccggugcgcccgccgggaggagcugcuggcccgcggcugcccccucgaggagcuggaggagccccgggggcagcaggagguccugcaggaccagccccucucccagggcgcccgcggcgagggggcgacccagcuggccccgcagcgggugcgcgugacccugcggcccggcgagccccagcagcuccagguccgcuuccugcgggccgagggguaccccguggaccuguacuaccucauggaccugagcuacuccaugaaggacgaccuggagcgcgugcggcagcucggccacgcccugcugguccgccuccaggaggugacccacagcgugcggaucggguucggcuccuucgucgacaagacggugcugccguucgugagcaccguccccuccaagcugcgccaccccugccccacccggcucgagcgcugccagagcccguucuccuuccaccacgugcugagccugaccggcgacgcccaggcguucgagcgggagguggggcgccaguccgucagcggcaaccucgacagccccgagggcggguucgacgccauccugcaggccgcccugugccaggagcagaucggcuggcgcaacgugucccggcuccugguguucacgagcgacgacaccuuccacaccgccggggacggcaagcucgggggcaucuucaugcccuccgacgggcacugccaccuggacagcaacggccuguacucccgcagcaccgaguucgacuaccccuccgucggccagguggcgcaggcccugagcgccgccaacauccagccgaucuucgccgugacguccgcggcccuccccgucuaccaggagcugagcaagcugauccccaaguccgccgugggggagcucagcgaggacuccagcaacgucgugcagcugaucauggacgccuacaacucccugagcuccaccgugacccucgagcacagcucccugcccccgggcguccacaucagcuacgagagccagugcgaggggcccgagaagcgggagggcaaggccgaggaccgcgggcagugcaaccacgugcggaucaaccagaccgugacguucugggucucccugcaggcgacccacugccugcccgagccccaccuccugcgccugcgggcccucggcuucagcgaggagcugaucguggagcugcacacccucugcgacugcaacugcuccgacacccagccgcaggcgccccacugcagcgacggccaggggcaccuccagugcggcgugugcuccugcgcccccgggcgccugggccggcugugcgagugcagcgucgccgagcuguccagcccggaccuggaguccgggugccgcgcccccaacggcacgggcccccucugcagcgggaagggccacugccagugcgggcggugcuccugcagcggccaguccagcggccaccugugcgagugcgacgacgccuccugcgagcgccacgaggggauccugugcggcggguucggccggugccagugcggggugugccacugccacgccaaccgcaccggccgggccugcgagugcagcggcgacauggacuccugcaucagccccgagggcgggcucugcagcgggcacggccgcugcaagugcaaccggugccagugccuggacggguacuacggcgcgcugugcgaccagugcccgggcugcaagacccccugcgagcgccaccgggacugcgccgagugcggggccuuccgcaccggcccccucgccacgaacugcuccaccgccugcgcgcacaccaacgugacccuggcccuggcccccauccucgacgacggguggugcaaggagcgcacgcuggacaaccagcuguucuucuuccucgucgaggacgacgcccggggcaccguggugcugcgcguccggccgcaggagaagggggccgaccacacccaggcgaucgugcugggcugcgugggcgggaucgucgccgugggccucgggcuggugcuggccuaccgccucagcgucgagaucuacgaccggcgcgaguacucccgguucgagaaggagcagcagcagcugaacuggaagcaggacagcaacccccuguacaaguccgccaucaccacgaccaucaacccccgcuuccaggaggcggacagccccacccucuga

SEQ ID NO: 31745 - RNA, 2310 nt, Artificial Sequence
  derived and/or modified sequence opt1 from ITGB8__Homo_sapiens__NP_002205
augugcggcagcgcccuggccuucuucaccgcggccuucgugugccuccagaacgaccgccgggggcccgccuccuuccugugggccgccugggucuucagccuggugcucggccuggggcagggcgaggacaaccgcugcgcguccagcaacgccgccuccugcgcccggugccuggcgcucgggccggagugcggcuggugcgugcaggaggacuucaucagcggcgggucccgcagcgagcggugcgacaucgucuccaaccugaucagcaagggcugcuccguggacagcaucgaguaccccuccgugcacgucaucauccccaccgagaacgagaucaacacccaggugacgcccggggaggugagcauccagcugcgcccgggcgccgaggccaacuucaugcucaagguccacccccugaagaaguaccccguggaccuguacuaccucguggacgucuccgccagcaugcacaacaacaucgagaagcugaacuccguggggaacgaccugagccggaagauggccuucuucucccgcgacuuccggcucggcuucggcagcuacguggacaagaccgucagccccuacaucuccauccacccggagcgcauccacaaccagugcagcgacuacaaccuggacugcaugccgccccacggguacauccacgugcugucccucaccgagaacaucacggaguucgagaaggcggugcaccggcagaagaucagcggcaacaucgacacccccgagggcggguucgacgccaugcugcaggccgccgucugcgagucccacaucggcuggcgcaaggaggccaagcggcugcuccuggugaugaccgaccagaccagccaccuggcgcucgacuccaagcuggccgggaucgugguccccaacgacggcaacugccaccugaagaacaacguguacgucaagagcacgaccauggagcaccccucccucgggcagcugagcgagaagcugaucgacaacaacaucaacgugaucuucgccgugcagggcaagcaguuccacugguacaaggaccuccugccccugcuccccgggaccaucgccggcgagaucgaguccaaggccgcgaaccugaacaaccuggucguggaggccuaccagaagcucaucagcgaggugaagguccagguggagaaccaggugcagggcaucuacuucaacaucaccgccaucugcccggacgggucccgcaagcccggcauggaggggugccggaacgucacgagcaacgacgaggugcuguucaacgugaccgucaccaugaagaagugcgacgugaccggcgggaagaacuacgccaucaucaagcccaucggcuucaacgagacggccaagauccacauccaccgcaacugcuccugccagugcgaggacaaccggggccccaaggggaagugcguggacgagaccuuccuggacagcaagugcuuccagugcgacgagaacaagugccacuucgacgaggaccaguucuccagcgaguccugcaagagccacaaggaccagccggucugcagcggccgcggggugugcgugugcggcaagugcuccugccacaagaucaagcucgggaaggucuacggcaaguacugcgagaaggacgacuucagcugccccuaccaccacggcaaccugugcgcggggcacggcgagugcgaggccgggcggugccagugcuucuccggcugggagggcgaccgcugccagugccccagcgccgccgcgcagcacugcgugaacuccaagggccaggugugcagcgggcgggggaccugcgucugcggccgcugcgagugcaccgacccccgcuccaucgggcgguucugcgagcacugcccgacgugcuacaccgccugcaaggagaacuggaacugcaugcagugccugcacccccacaaccucagccaggccauccuggaccagugcaagaccuccugcgcccugauggagcagcagcacuacguggaccagaccagcgagugcuucuccagccccuccuaccuccgcaucuucuucaucaucuucaucgugacguuccugaucggccugcucaagguccugaucauccgccaggugauccugcaguggaacagcaacaagaucaaguccagcuccgacuaccgggugagcgccagcaagaaggacaagcugauccuccaguccgucugcacccgggcggugaccuaccgccgggagaagcccgaggagaucaagauggacaucagcaagcugaacgcccacgagaccuuccgcugcaacuucuga

SEQ ID NO: 31746 - RNA, 1062 nt, Artificial Sequence
  derived and/or modified sequence opt1 from ITGBL1__Homo_sapiens__NP_001258683
augugcaagaacagccaggacaucaucugcuccaacgccgggaccugccacugcgggcgcugcaagugcgacaacagcgacggcuccgggcugguguacggcaaguucugcgagugcgacgaccgggagugcaucgacgacgagaccgaggagaucugcgggggccacggcaagugcuacugcgggaacugcuacugcaaggccggcuggcacggggacaagugcgaguuccagugcgacaucacccccugggagagcaagcgccggugcaccuccccggacggcaagaucugcagcaaccgcgggaccugcgucugcggcgagugcacgugccacgacguggaccccaccggcgacuggggcgacauccacggcgacacgugcgagugcgacgagcgggacugccgcgcgguguacgaccgguacuccgacgacuucugcagcgggcacggccagugcaacugcggccgcugcgacugcaaggccgggugguacggcaagaagugcgagcacccccaguccugcacccucagcgccgaggaguccauccggaagugccaggggagcuccgaccugcccugcagcggccgcgggaagugcgagugcggcaagugcacgugcuacccgcccggcgaccggcgcgucuacgggaagaccugcgagugcgacgaccggcgcugcgaggaccuggacggcguggugugcgggggccacgggaccugcuccugcggccggugcgucugcgagcgcggcugguucgggaagcucugccagcacccccggaagugcaacaugaccgaggagcagagcaagaaccugugcgaguccgccgacggcauccugugcagcgggaagggcuccugccacugcgggaagugcaucugcagcgccgaggagugguacaucagcggcgaguucugcgacugcgacgaccgcgacugcgacaagcacgacggccucaucugcaccgggaacggcaucugcuccugcgggaacugcgagugcugggacggcuggaacggcaacgcgugcgagaucuggcuggggagcgaguaccccuga

SEQ ID NO: 31747 - RNA, 2736 nt, Artificial Sequence
  derived and/or modified sequence opt1 from ITIH1__Homo_sapiens__NP_002206
auggacggcgccauggggccccgcggccugcuccugugcauguaccuggugagccuccugauccugcaggccaugccggcgcucggguccgccaccggccggagcaaguccagcgagaagcgccaggccgucgacaccgccguggacgggguguucauccggucccugaaggucaacugcaaggugacgagccgcuucgcccacuacguggucaccucccagguggugaacaccgcgaacgaggcccgggaggucgccuucgaccuggagauccccaagaccgccuucaucagcgacuucgcggugacggccgacggcaacgccuucaucggcgacaucaaggacaaggugaccgccuggaagcaguaccgcaaggccgcgaucuccggggagaacgccggccucguccgggccagcgggcgcaccauggagcaguucaccauccaccugacggugaacccccaguccaaggugaccuuccagcugaccuacgaggagguccucaagcggaaccacaugcaguacgagaucgugaucaaggugaagcccaagcagcugguccaccacuucgagaucgacguggacaucuucgagccgcagggcaucagcaagcuggacgcccaggccuccuuccuccccaaggagcuggcggcccagaccaucaagaaguccuucagcgggaagaagggccacgugcuguuccgccccacggucagccagcagcaguccugccccacgugcagcaccucccuccugaacggccacuucaaggugaccuacgacgugagccgggacaagaucugcgaccugcucgucgccaacaaccacuucgcccacuucuucgccccgcagaaccugaccaacaugaacaagaacguggucuucgugaucgacaucagcggguccaugcgcggccagaaggugaagcagaccaaggaggcgcugcucaagauccugggggacaugcagcccggcgacuacuucgaccugguccucuucggcacccgggugcagagcuggaaggggucccuggugcaggccagcgaggccaaccugcaggccgcccaggacuucguccgcggcuucucccucgacgaggcgaccaaccugaacgggggccugcuccgggggaucgagauccugaaccaggugcaggagagccugcccgagcucuccaaccacgccagcauccugaucaugcugacggacggcgaccccaccgagggcgugaccgaccgcucccagauccucaagaacguccggaacgccauccgcgggcgguucccgcuguacaaccugggcuucgggcacaacguggacuucaacuuccucgaggugaugagcauggagaacaacggccgcgcccagcggaucuacgaggaccacgacgcgacccagcagcugcagggguucuacucccaggucgccaagccccugcucguggacguggaccugcaguacccccaggacgccguccuggcccucacgcagaaccaccacaagcaguacuacgagggcagcgagaucgugguggccggccgcaucgcggacaacaagcaguccagcuucaaggccgacguccaggcccacggggagggccaggaguucuccaucacgugccugguggacgaggaggagaugaagaagcugcugcgcgagcgggggcacaugcucgagaaccacguggagcgccugugggccuaccugaccauccaggagcuccuggccaagcggaugaaggucgaccgcgaggagcgggcgaaccugagcucccaggcccuccagaugagccuggacuacggcuucgugacgccccugaccuccaugagcauccgcgggauggccgaccaggacggccucaagccgaccaucgacaagcccagcgaggacuccccgccccuggagaugcugggcccccggcgcaccuucgugcucagcgcccugcagcccucccccacccacagcuccagcaacacccagcggcugcccgaccgcgucaccgggguggacaccgacccgcacuucaucauccacgugccccagaaggaggacacccucugcuucaacaucaacgaggagcccggcgucauccugucccuggugcaggaccccaacacgggguucagcgugaacggccagcucaucggcaacaaggcccgguccccggggcagcacgacggcaccuacuucgggcgccugggcaucgcgaaccccgccaccgacuuccagcuggaggucacgccccagaacaucacccucaacccgggguucggcggccccguguucagcuggcgggaccaggccgugcugcgccaggacggggucguggugaccaucaacaagaagcggaaccuggucguguccguggacgacggcgggaccuucgaggucgugcuccaccgcguguggaagggcagcuccguccaccaggacuuccugggguucuacgugcuggacagccaccggauguccgcccgcacccacggccuccugggccaguucuuccaccccaucggguucgaggugagcgacauccaccccggcuccgacccgaccaagcccgacgcgacgauggucgugcggaaccgccgccugaccgugacccgggggcuccagaaggacuacagcaaggaccccuggcacggcgccgaggucagcugcugguucauccacaacaacggggccggccugaucgacggcgccuacaccgacuacaucgugcccgacaucuucuga

SEQ ID NO: 31748 - RNA, 2841 nt, Artificial Sequence
  derived and/or modified sequence opt1 from ITIH2__Homo_sapiens__NP_002207
augaagcgccugaccugcuucuucaucugcuucuuccucagcgagguguccggcuucgagauccccaucaacgggcugagcgaguucgucgacuacgaggaccugguggagcucgccccgggcaaguuccagcugguggccgagaaccggcgcuaccagcggucccugcccggggagagcgaggagaugauggaggaggucgaccaggugacccucuacuccuacaaggugcagagcacgaucaccucccgcauggcgaccaccaugauccagagcaaggucgugaacaacagcccccagccccagaacguggucuucgacgugcagaucccgaagggcgccuucaucuccaacuucuccaugacgguggacgggaagaccuuccggagcuccaucaaggagaagaccgucggccgcgcccuguacgcccaggcccgggcgaagggcaagaccgccgggcuggugcgcagcuccgcccucgacauggagaacuuccggacggaggugaacguccugcccggcgccaaggugcaguucgagcugcacuaccaggaggugaaguggcgcaagcucgggagcuacgagcaccggaucuaccugcagcccggccgccuggcgaagcaccucgaggucgacgugugggugaucgagccccaggggcugcgguuccugcacgucccggacaccuucgagggccacuucgacggcgugcccgugaucuccaaggggcagcagaaggcccacgucagcuucaagcccaccguggcccagcagcgcaucugccccaacugccgggagaccgccgucgacggcgagcucguggugcuguacgacgucaagcgcgaggagaaggccggggagcuggagguguucaacggcuacuucgugcacuucuucgcgccggacaaccucgaccccauccccaagaacauccuguucgucaucgacguguccggcagcauguggggcgugaagaugaagcagacggucgaggccaugaagaccauccuggacgaccuccgggccgaggaccacuucagcgugaucgacuucaaccagaacauccgcaccuggcggaacgaccugaucuccgccaccaagacccagguggccgacgcgaagcgcuacaucgagaagauccagcccagcggcgggacgaacaucaacgaggcccugcuccgggccaucuucauccugaacgaggccaacaaccuggggcuccuggacccgaacuccgucagccugaucauccucguguccgacggggaccccaccgugggcgagcugaagcugagcaagauccagaagaacgucaaggagaacauccaggacaacaucucccucuucagccugggcaugggguucgacguggacuacgacuuccugaagcgccucuccaacgagaaccacggcaucgcccagcgcaucuacgggaaccaggacaccagcucccagcugaagaaguucuacaaccaggugagcacgccccugcuccggaacguccaguucaacuacccccacaccuccgugaccgacgugacccagaacaacuuccacaacuacuucggcgggagcgagaucgucguggcgggcaaguucgacccggccaagcuggaccagaucgaguccgugaucacggccaccagcgccaacacccagcugguccucgagacccuggcccagauggacgaccugcaggacuuccucuccaaggacaagcacgcggaccccgacuucacgcgcaagcugugggccuaccugaccaucaaccagcugcucgccgagcggagccuggcccccaccgcggccgccaagcgccggaucacccgcuccauccugcagaugagccucgaccaccacaucgugacgccccugaccagccuggugaucgagaacgaggccggcgacgagcggaugcucgccgacgcgccgccccaggaccccuccugcugcagcggggcccuguacuacggcuccaaggucgugcccgacagcaccccguccugggccaaccccagccccaccccggugaucuccaugcuggcccaggggagccagguccucgaguccacgcccccgccccacgugaugcgcguggagaacgacccccacuucaucaucuaccugcccaagagccagaagaacaucugcuucaacaucgacuccgagcccggcaagauccugaaccucgucagcgaccccgaguccgggaucguggugaacggccagcuggucggcgccaagaagccgaacaacgggaagcugagcaccuacuucggcaagcucggguucuacuuccaguccgaggacaucaagaucgagaucagcaccgagaccaucacccugucccacggcagcagcacguucucccugagcugguccgacaccgcccaggugaccaaccagcgggugcagaucagcgucaagaaggagaagguggugaccaucacgcucgacaaggagauguccuucagcguccugcugcaccgcguguggaagaagcaccccgugaacgucgacuuccucggcaucuacaucccgcccaccaacaaguucucccccaaggcgcacgggcugaucggccaguucaugcaggagcccaagauccacaucuucaacgagcggcccgggaaggaccccgagaagccggaggccagcauggaggugaagggccagaagcugaucaucacccgcgggcuccagaaggacuaccggaccgaccugguguucggcacggacgugaccugcugguucguccacaacuccggcaagggguucaucgacggccacuacaaggacuacuucgugccccagcuguacagcuuccucaagcgccccuga

SEQ ID NO: 31749 - RNA, 2673 nt, Artificial Sequence
  derived and/or modified sequence opt1 from ITIH3__Homo_sapiens__NP_002208
auggccuucgccugguggcccugccugauccucgcgcugcugagcucccucgccgccagcggcuucccgcgcucccccuuccggcugcuggggaagcgcagccuccccgagggcguggccaacgggaucgaggucuacuccaccaagaucaacagcaaggugaccucccgguucgcccacaacguggucacgaugcgcgcggugaaccgggccgacaccgccaaggaggugagcuucgacgucgagcugcccaagaccgccuucaucaccaacuucacgcugaccaucgacggcgugaccuacccggggaacgugaaggagaaggaggucgcgaagaagcaguacgagaaggccgugucccagggcaagaccgccggccucgugaaggccagcgggcgcaagcuggagaaguucacggucuccgugaacguggccgcgggcagcaaggucaccuucgagcugaccuacgaggagcuccugaagcggcacaaggggaaguacgagauguaccugaaggugcagcccaagcagcucgugaagcacuucgagaucgaggucgacaucuucgagccccagggcaucuccaugcuggacgccgaggccagcuucaucaccaacgaccugcucggguccgcccugaccaagagcuucuccggcaagaagggccacgugagcuucaagcccucccuggaccagcagcgcagcugcccgacgugcaccgacagccuccugaacggggacuucaccaucacguacgacgugaaccgggagucccccggcaacguccagaucgugaacggguacuucgugcacuucuucgcgccccagggccugcccgucgugccgaagaacgucgccuucgugaucgacaucagcggcuccauggccgggcgcaagcucgagcagaccaaggaggcccugcugcggauccucgaggacaugcaggaggaggacuaccugaacuucauccuguucagcggcgacguguccaccuggaaggagcaccucguccaggccacccccgagaaccugcaggaggcccgcacguucgucaagagcauggaggacaaggggaugaccaacaucaacgacggccugcuccgggggaucuccaugcugaacaaggcgcgcgaggagcaccggauccccgagcgcagcaccuccaucgugaucaugcugaccgacggcgacgccaacgugggcgagagccggcccgagaagauccaggagaacgugcgcaacgccaucgggggcaaguucccgcucuacaaccugggguucggcaacaaccugaacuacaacuuccucgagaacauggcccuggagaaccacggguucgcccggcgcaucuacgaggacuccgacgcggaccugcagcuccagggcuucuacgaggagguggccaacccccugcugacgggcgucgagauggaguaccccgagaacgccauccucgaccugacccagaacaccuaccagcacuucuacgacgggagcgagaucgugguggccggccggcuggucgacgaggacaugaacuccuucaaggcggacgugaaggggcacggcgccaccaacgaccucacguucaccgaggagguggacaugaaggagauggagaaggcccugcaggagcgcgacuacaucuucgggaacuacaucgagcgccugugggccuaccugaccaucgagcagcuccuggagaagcggaagaacgcccacggcgaggagaaggagaaccugaccgcgcgcgcccucgaccugagccugaaguaccacuucgucacgccccucaccuccaugguggugaccaagccggaggacaacgaggacgagcgggccaucgccgacaagcccggcgaggacgccgaggcgacccccgucagccccgccauguccuaccugacgagcuaccagccgccccagaaccccuacuacuacguggacggggacccccacuucaucauccagaucccggagaaggacgacgcccugugcuucaacaucgacgaggcccccggcaccgugcuccgccugauccaggacgccgucaccgggcugaccgugaacggccagaucaccggcgacaagcgggggucccccgacagcaagacgcgcaagaccuacuucggcaagcucgggaucgcgaacgcccagauggacuuccagguggaggucaccaccgagaagaucacgcuguggaaccgggccgugccgagcaccuucuccuggcuggacaccgugaccgucacgcaggacggccucagcaugaugaucaaccgcaagaacauggugguguccuucggggacggcgucaccuucguggugguccugcaccagguguggaagaagcaccccgugcaccgggacuuccugggcuucuacgucguggacagccaccgcauguccgcccagacccacgggcuccugggccaguucuuccagcccuucgacuucaaggugagcgacauccggcccggguccgacccgaccaagcccgacgcgacgcuggucgugaagaaccaccagcucaucgugacccgcggcagccagaaggacuaccggaaggacgccuccaucgggaccaaggucgugugcugguucgugcacaacaacggcgagggccugaucgacgggguccacaccgacuacaucgugcccaaccuguucuga

SEQ ID NO: 31750 - RNA, 2703 nt, Artificial Sequence
  derived and/or modified sequence opt1 from ITIH4__Homo_sapiens__NP_001159921
augaagcccccgcgccccgugcggaccugcagcaagguccuggugcuccugucccugcucgccauccaccagaccacgaccgccgagaagaacggcaucgacaucuacagccugaccguggacucccgcgucagcucccgguucgcgcacaccguggugacgagccgcgucgugaaccgggccaacaccgugcaggaggccaccuuccagauggagcugcccaagaaggccuucaucaccaacuucuccaugaucaucgacgggaugacguaccccggcaucaucaaggagaaggccgaggcgcaggcccaguacagcgccgccgucgcgaaggggaaguccgccggccucgugaaggccaccgggcgcaacauggagcaguuccaggugagcgucuccguggccccgaacgccaagaucaccuucgagcugguguacgaggagcugcucaagcggcgccugggcgucuacgagcugcuccugaaggugcggccccagcagcuggugaagcaccuccagauggacauccacaucuucgagccccagggcaucagcuuccuggagaccgaguccacguucaugaccaaccagcuggucgacgcgcucaccaccuggcagaacaagacgaaggcccacauccgcuucaagcccacccugagccagcagcagaaguccccggagcagcaggagaccgugcuggacgggaaccucaucauccgguacgacguggaccgcgccaucagcggcggguccauccagaucgagaacggcuacuucguccacuacuucgcccccgaggggcugaccacgaugcccaagaacgugguguucgucaucgacaagagcggcuccaugagcggccggaagauccagcagacccgcgaggcccugaucaagauccucgacgaccugagcccccgggaccaguucaaccugaucguguucuccaccgaggcgacccaguggcgccccagccucguccccgccuccgccgagaacgugaacaaggcccggagcuucgccgcggggauccaggcccugggcgggacgaacaucaacgacgccaugcugauggccgugcagcuccuggacuccagcaaccaggaggagcgccugcccgagggcuccgucagccucaucauccugcugaccgacggcgaccccaccgugggggagaccaacccgcgguccauccagaacaacgugcgcgaggccgucagcggccgguacucccucuucugccugggguucggcuucgacgugagcuacgcguuccuggagaagcucgcccuggacaacgggggccuggcccgccgcauccacgaggacuccgacagcgcccuccagcugcaggacuucuaccaggagguggcgaacccccugcucacggccgucaccuucgaguaccccuccaacgccguggaggaggugacccagaacaacuuccggcugcuguucaagggcagcgagauggucguggccgggaagcuccaggaccgcggccccgacgugcugaccgccacggucuccgggaagcugccgacccagaacaucaccuuccagaccgagagcuccguggcggagcaggaggccgaguuccagagccccaaguacaucuuccacaacuucauggagcggcugugggccuaccucacgauccagcagcugcuggagcagaccgugagcgccuccgacgccgaccagcaggcgcuccgcaaccaggcccugaaccugagccucgccuacuccuucgucacgccccugaccagcaugguggugaccaagcccgacgaccaggagcagucccaggucgccgagaagccgauggagggcgagagccggaaccgcaacgugcacuccgccggggcggccggcagccggaugaacuuccgccccggcgugcuguccagccggcagcucgggcugcccgggcccccggacguccccgaccacgccgccuaccaccccuuccgccggcuggcgauccucccggccuccgccccgcccgccaccagcaaccccgaccccgccgugucccgcgugaugaacaugaagaucgaggagaccaccaugaccacgcagacccccgcgcccauccaggcccccagcgccauccugccgcugcccggccaguccgucgagcggcucugcguggacccccgccaccggcagggccccgugaaccugcugagcgacccggagcagggggucgaggugaccggccaguacgagcgcgagaaggccggcuucuccuggaucgaggugaccuucaagaacccccucgucugggugcacgccagccccgagcacguggucgugacgcggaaccgccggagcuccgcguacaaguggaaggagacccuguucagcgugaugcccgggcugaagaugaccauggacaagaccggccuccugcugcucuccgacccggacaaggucacgaucgggcugcuguucugggacggccgcggcgaggggcuccgccugcugcuccgggacaccgaccgcuucagcucccacgugggcgggacccugggccaguucuaccaggaggugcugugggggagccccgccgccuccgacgacggccggcgcacccuccggguccagggcaacgaccacagcgccacgcgcgagcggcgccuggacuaccaggaggggccgcccggcguggagaucuccugcuggagcguggagcuguga

SEQ ID NO: 31751 - RNA, 2109 nt, Artificial Sequence
  derived and/or modified sequence opt1 from ITIH5__Homo_sapiens__NP_001001851
augcugcuccugcugggccucugccuggggcugagccucugcgugggcucccaggaggaggcccagagcugggggcacuccagcgagcaggacggccugcgcgucccccgccaggugcggcugcuccagcggcugaagaccaagccgcugaugaccgaguucuccgucaagagcacgaucaucucccgcuacgccuucaccaccgugagcugccggaugcucaaccgcgcguccgaggaccaggacaucgaguuccagaugcagauccccgccgccgccuucaucaccaacuucacgaugcugaucggggacaagguguaccagggcgagaucaccgagcgggagaagaaguccggcgaccgcgugaaggagaagcggaacaagaccaccgaggagaacggggagaagggcacggagaucuuccgcgccagcgcggucauccccagcaaggacaaggccgccuucuuccuguccuacgaggagcuccugcagcggcgccuggggaaguacgagcacagcaucuccgugcggccccagcagcucagcggccgccuguccguggacgucaacauccuggagagcgccgggaucgcgucccucgaggugcugccgcugcacaacagccggcagcgcggcagcggccgcggggaggacgacuccgggcccccgcccagcaccgugaucaaccagaacgagaccuucgccaacaucaucuucaagccgaccgucgugcagcaggcccggaucgcccagaacgggauccucggcgacuucaucauccgguacgacgugaaccgcgagcaguccaucggcgacauccagguccugaacggguacuucgugcacuacuucgcccccaaggaccugccgccccuccccaagaacguggucuucgugcuggacagcuccgcgagcauggugggcacgaagcugcggcagaccaaggacgcccucuucaccauccugcacgaccugcgcccccaggaccgcuucuccaucaucggguucagcaaccggaucaaggucuggaaggaccaccucaucuccgugacccccgacagcauccgcgacggcaagguguacauccaccacaugucccccaccgggggcaccgacaucaacggcgcccugcagcgggccauccgccugcucaacaaguacgucgcccacagcgggaucggcgaccgguccgugagccugaucgucuuccugaccgacgggaagccgaccgugggcgagacgcacacccucaagauccugaacaacacccgcgaggcggcccggggccaggugugcaucuucaccaucggcaucggcaacgacgucgacuuccgccugcucgagaagcugucccuggagaacugcgggcucacgcggcgcgugcacgaggaggaggacgccggcagccagcugaucggguucuacgacgagauccggacgccccugcucuccgacauccgcaucgacuacccgcccagcuccgugguccaggccaccaagacccuguuccccaacuacuucaacggcagcgagaucaucaucgccgggaagcugguggaccggaagcuggaccaccuccacguggaggucacggcgagcaacuccaagaaguucaucauccugaagaccgacgugcccgugcgcccccagaaggccggcaaggacgucaccggcagcccccggcccgggggcgacggggagggcgacaccaaccacaucgagcgccugugguccuaccucacgaccaaggagcugcugagcuccuggcuccagagcgacgacgagcccgagaaggagcggcugcgccagcgggcccaggcccuggccguguccuaccgcuuccucacccccuucaccagcaugaagcugcgcggccccgugccgcggauggacgggcuggaggaggcgcacggcauguccgccgccauggggcccgagcccgucgugcagagcgugcgcggcgccgggacgcagccgggcccccuccugaagaagcccuaccagccccggaucaagaucuccaagaccagcguccgcggcuuccggcgcgaggagcagaucuucuccaacgugaugaaguucccguucgcgagcauccuggagcucuga

SEQ ID NO: 31752 - RNA, 1863 nt, Artificial Sequence
  derived and/or modified sequence opt1 from ITK__Homo_sapiens__NP_005537
augaacaacuucauccugcucgaggagcagcugaucaagaagucccagcagaagcgccggaccagccccagcaacuucaaggugcgcuucuucguccugaccaaggccucccucgccuacuucgaggaccggcacggcaagaagcgcacgcugaaggggagcaucgagcugucccggaucaagugcguggagaucgucaagagcgacaucuccaucccgugccacuacaaguaccccuuccagguggugcacgacaacuaccuccuguacguguucgcgcccgaccgcgagagccggcagcgcuggguccuggcccucaaggaggagacccggaacaacaacucccuggugcccaaguaccacccgaacuucuggauggacggcaaguggcgcugcugcagccagcuggagaagcucgccaccgggugcgcccaguacgaccccaccaagaacgccuccaagaagccccugcccccgacgcccgaggacaaccggcgcccccugugggagcccgaggagaccguggucaucgcgcucuacgacuaccagaccaacgacccgcaggagcuggcccugcggcgcaacgaggaguacugccuccuggacagcuccgagauccacugguggcgggugcaggaccgcaacggccacgagggguacgugcccagcuccuaccuggucgagaagucccccaacaaccucgagaccuacgagugguacaacaagagcaucagccgggacaaggccgagaagcugcugcucgacacgggcaaggagggcgccuucauggugcgcgacucccggaccgcggggaccuacaccgugagcgucuucacgaaggccguggugagcgagaacaaccccugcaucaagcacuaccacaucaaggagaccaacgacaacccgaagcgcuacuacgucgccgagaaguacguguucgacuccaucccccugcugaucaacuaccaccagcacaacggcgggggccucgugacccggcugcgcuaccccgucugcuucgggcgccagaaggcccccgugaccgccggccugcgguacggcaagugggugaucgacccgagcgagcucacguucguccaggagaucggguccggccaguucgggcuggugcaccugggcuacuggcucaacaaggacaaggucgcgaucaagaccauccgcgagggcgccaugagcgaggaggacuucaucgaggaggccgaggugaugaugaagcugucccaccccaagcuggugcagcucuacggggucugccuggagcaggcccccaucugccugguguucgaguucauggagcacggcugccucagcgacuaccugcggacccagcgcgggcuguucgccgcggagacccuccugggcaugugccuggacgugugcgaggggauggccuaccucgaggaggccugcgucauccaccgggaccuggccgcccgcaacugccuggugggcgagaaccaggugaucaaggucuccgacuucggcaugacgcgguucgugcucgacgaccaguacaccagcuccaccgggaccaaguuccccgugaagugggcgagcccggaggucuucuccuucagccgcuacuccagcaaguccgacguguggagcuucggcgugcugaugugggaggucuucuccgaggggaagauccccuacgagaaccggagcaacuccgaggugguggaggacaucagcacgggcuuccgccuguacaagccccggcuggccagcacccacgucuaccagaucaugaaccacugcuggaaggagcgccccgaggaccggccggccuucucccgccuccugcggcagcuggccgagaucgccgagagcgggcucuga

SEQ ID NO: 31753 - RNA, 942 nt, Artificial Sequence
  derived and/or modified sequence opt1 from ITLN1__Homo_sapiens__NP_060095
augaaccagcugagcuuccuccuguuccugaucgccaccacccgcggcugguccacggacgaggccaacaccuacuucaaggaguggaccugcagcuccagccccucccucccgcggagcugcaaggagaucaaggacgagugccccuccgcguucgacgggcuguacuuccugcgcaccgagaacggcgugaucuaccagacguucugcgacaugaccagcgggggcgggggcuggacccucgucgccuccgugcacgagaacgacaugcggggcaagugcaccgugggggaccgcuggagcucccagcagggcagcaaggccgucuaccccgagggggacggcaacugggccaacuacaacacguucggguccgccgaggcggccaccagcgacgacuacaagaaccccggcuacuacgacauccaggccaaggaccugggcaucuggcacgugccgaacaagucccccaugcagcacuggcggaacagcucccugcuccgcuaccggaccgacaccggguuccugcagacgcugggccacaaccucuucgggaucuaccagaaguaccccgugaaguacggcgagggcaagugcuggaccgacaacgggcccgucaucccggugguguacgacuucggcgacgcccagaagaccgcgagcuacuacucccccuacgggcagcgcgaguucaccgccggcuucguccaguuccggguguucaacaacgagcgcgccgccaacgcccugugcgcggggaugcgggugacgggcugcaacaccgagcaccacugcaucggcgggggcggguacuuccccgaggccagcccccagcagugcggcgacuucagcggguucgacugguccggcuacggcacccacgucggguacagcuccagccgcgagaucaccgaggccgccgugcuccuguucuaccgguga

SEQ ID NO: 31754 - RNA, 978 nt, Artificial Sequence
  derived and/or modified sequence opt1 from ITLN2__Homo_sapiens__XP_011507512
augcugagcaugcuccgcaccaugacccggcugugcuuccugcuguucuucuccguggccacgagcggcugcuccgccgcggccgccagcucccuggagaugcugagccgcgaguucgagaccugcgccuucuccuucagcucccucccccggagcugcaaggagaucaaggagcgcugccacuccgccggggacggccuguacuuccugcggaccaagaacggggucguguaccagaccuucugcgacaugacgagcggcgggggcggcuggacccucguggcguccguccacgagaacgacaugcgcgggaagugcaccgugggcgaccgguggagcucccagcaggggaacaaggccgacuacccggagggcgacgggaacugggccaacuacaacaccuucggcagcgccgaggcggccacguccgacgacuacaagaaccccggcuacuacgacauccaggccaaggaccuggggaucuggcacgugcccaacaagagccccaugcagcacuggcgcaacuccgcccugcuccgguaccgcaccaacaccggcuuccugcagcggcuggggcacaaccucuucggcaucuaccagaaguacccggucaaguaccgcagcggcaagugcuggaacgacaacgggcccgccauccccgugguguacgacuucggcgacgcgaagaagaccgccagcuacuacucccccuacgggcagcgggaguucgucgccggcuucgugcaguuccgcguguucaacaacgagcgggccgccaacgcgcugugcgccgggaucaaggucacgggcugcaacaccgagcaccacugcaucggcgggggcggguucuucccgcagggcaagccccgccagugcggggacuucagcgccuucgacugggacggcuacggcacccacgugaaguccagcugcucccgggagaucaccgaggccgccgugcuccucuucuaccgcuga

SEQ ID NO: 31755 - RNA, 660 nt, Artificial Sequence
  derived and/or modified sequence opt1 from ITM2A__Homo_sapiens__NP_001165052
auggugaagaucgccuucaacacccccaccgccguccagaaggaggaggcgcgccaggacguggaggcccugcucagccggacggugcgcacccagauccugaccggcaaguccaccaucuaccgcggggagaugugcuucuucgacagcgaggacccggccaacucccugcggggcggggagcccaacuuccuccccgucacggaggaggccgacauccgggaggacgacaacaucgccaucaucgacgugcccgugccgagcuucuccgacagcgaccccgcggccaucauccacgacuucgagaagggcaugaccgccuaccuggaccugcuccuggggaacugcuaccugaugccccucaacaccuccaucgucaugcccccgaagaaccugguggagcuguucggcaagcucgccagcggccgcuaccugccccagaccuacgugguccgggaggaccugguggcgguggaggagauccgcgacgucuccaaccucgggaucuucaucuaccagcugugcaacaaccgcaagagcuuccggcugcggcgccgggaccuccugcugggcuucaacaagcgcgccaucgacaagugcuggaagauccggcacuuccccaacgaguucaucguggagacgaagaucugccaggaguga

SEQ ID NO: 31756 - RNA, 801 nt, Artificial Sequence
  derived and/or modified sequence opt1 from ITM2B__Homo_sapiens__NP_068839
auggugaaggucaccuucaacagcgcccuggcccagaaggaggcgaagaaggacgagcccaaguccggcgaggaggcccucaucaucccgcccgacgccguggccguggacugcaaggaccccgacgacgucgugcccguggggcagcgccgggccuggugcuggugcaugugcuucggccuggcguucaugcuggccggggucauccucggcggggccuaccuguacaaguacuucgcccugcagccggacgacguguacuacugcggcaucaaguacaucaaggacgacgugauccucaacgagcccagcgcggacgcccccgccgcccuguaccagaccaucgaggagaacaucaagaucuucgaggaggaggaggucgaguucaucuccgugcccgugccggaguucgccgacagcgaccccgcgaacaucguccacgacuucaacaagaagcugacggccuaccucgaccugaaccuggacaagugcuacgugaucccccucaacaccuccaucgugaugcccccgcgcaaccugcuggagcuccugaucaacaucaaggccggcaccuaccugccccagagcuaccucauccacgagcacauggucaucaccgaccggaucgagaacaucgaccaccugggguucuucaucuaccgccugugccacgacaaggagacguacaagcuccagcggcgcgagaccaucaagggcauccagaagcgggaggccuccaacugcuucgccauccgccacuucgagaacaaguucgcgguggagacccugaucugcagcuga

SEQ ID NO: 31757 - RNA, 663 nt, Artificial Sequence
  derived and/or modified sequence opt1 from ITM2C__Homo_sapiens__NP_001012532
auggugaagaucagcuuccagcccgccgucgccggcaucaagggggacaaggcggacaaggccuccgccagcgccccggcccccgcguccgccaccgagauccugcucacccccgcccgccuggcccgggacaacuucuuccgcugcggcgugcuguacgaggacagccucuccagccaggugcggacgcagauggagcuggaggaggacgucaagaucuaccuggacgagaacuacgagcgcaucaacgugcccgugccgcaguucgggggcggggaccccgcggacaucauccacgacuuccagcggggccucaccgccuaccacgacaucucccuggacaagugcuacgucaucgagcugaacaccaccaucgugcucccgccccgcaacuucugggagcugcugaugaacgugaagcggggcacguaccucccccagaccuacaucauccaggaggagauggucgugaccgagcacgugagcgacaaggaggcccugggguccuucaucuaccaccugugcaacggcaaggacaccuaccgccuccggcgccgggccacgcgccggcgcaucaacaagcgcggggccaagaacugcaacgcgauccggcacuucgagaacaccuucgucguggagacccugaucugcggcguggucuga

SEQ ID NO: 31758 - RNA, 462 nt, Artificial Sequence
  derived and/or modified sequence opt1 from ITPA__Homo_sapiens__NP_001254552
auggccgccagccuggugggcaagaagaucgucuucgugaccgggaacgcgaagaagcucgaggaggugcagggccccguccugguggaggacacgugccugugcuucaacgcccucgggggccugccggggcccuacaucaagugguuccuggagaagcucaagcccgagggccugcaccagcugcucgccggcuucgaggacaaguccgccuacgcccugugcaccuucgcgcugagcaccggggaccccucccagccggugcgccucuuccggggccgcaccagcgggcggaucgucgcgccccgcggcugccaggacuucgggugggaccccugcuuccagcccgacggcuacgagcagaccuacgccgagaugccgaaggccgagaagaacgccgugucccaccgguuccgcgcccugcuggagcuccaggaguacuucggcagccuggccgccuga

SEQ ID NO: 31759 - RNA, 1245 nt, Artificial Sequence
  derived and/or modified sequence opt1 from ITPK1__Homo_sapiens__NP_001136065
augcagaccuuccugaagggcaagcgcgugggguacuggcucagcgagaagaagaucaagaagcugaacuuccaggccuucgccgagcugugccggaagcgcggcauggaggucgugcagcucaaccugucccggcccaucgaggagcaggggccgcuggacgugaucauccacaagcucaccgacgucauccuggaggcggaccagaacgacagccagucccuggagcucgugcaccgcuuccaggaguacaucgacgcccaccccgagacgaucgugcuggacccccugcccgccauccggacccuccuggaccgcagcaaguccuacgagcugauccggaagaucgaggccuacauggaggacgaccgcaucugcagcccgcccuucauggagcucaccucccugugcggcgacgacaccaugcggcugcucgagaagaacgggcugacguuccccuucaucugcaagacccgcgucgcccacggcaccaacagccacgagauggcgaucguguucaaccaggagggccugaacgccauccagcccccgugcgugguccagaacuucaucaaccacaacgccgugcucuacaagguguucgucgugggggaguccuacaccgugguccagcggcccagccugaagaacuucuccgccggcacgagcgaccgcgaguccaucuucuucaacagccacaacguguccaagcccgagagcuccagcgugcugaccgagcucgacaagaucgagggggucuucgagcggcccuccgacgaggugauccgcgagcugagccgggcgcugcgccaggcccucggcgugagccuguucgggaucgacaucaucaucaacaaccagaccggccagcacgccgucaucgacaucaacgccuucccgggcuacgaggggguguccgaguucuucaccgaccugcucaaccacaucgccacggugcugcagggccagagcaccgcgauggccgccaccggggacgucgcccugcuccggcacuccaagcugcuggccgagcccgcgggcggccucgugggggagcggaccugcagcgccucccccggcugcugcgggagcaugaugggccaggacgcccccuggaaggccgaggccgacgccgggggcacggcgaagcugccgcaccagcgccugggcugcaacgccggggucucccccagcuuccagcagcacugcguggccucccucgccaccaaggcgagcucccaguga

SEQ ID NO: 31760 - RNA, 1386 nt, Artificial Sequence
  derived and/or modified sequence opt1 from ITPKA__Homo_sapiens__NP_002211
augacccugcccggcgggccgaccggcauggcccgccccgggggcgcccggcccugcagccccgggcucgagcgcgcgccgcggcgcuccgugggcgagcugcggcuccuguucgaggcccgcugcgccgccgucgccgcggccgccgccgcgggcgagccccgggcccgcggggccaagcggcgcggcggccaggugcccaacgggcugccccgggccccgcccgcccccgugaucccccagcugaccgucaccgcggaggagccggacgugccgcccaccagccccgggccgcccgagcgcgagcgggacugccuccccgccgccggcuccagccaccuccagcagccccgccggcuguccaccagcuccgugagcuccacgggcagcuccagccugcuggaggacuccgaggacgaccugcucagcgacuccgagagccgcucccgggggaacguccagcuggaggccggcgaggacguggggcagaagaaccacuggcagaagauccgcaccauggugaaccugcccgucaucagccccuucaagaagcgguacgccugggugcagcucgcgggccacaccggcuccuucaaggccgccgggaccagcggccugauccugaagcgcugcagcgagcccgagcgguacugccucgcccgccugauggccgacgcgcugcgcgggugcgugcccgccuuccacggcgucguggagcgggacggggaguccuaccuccagcugcaggaccugcucgacggcuucgacggcccgugcgugcuggacugcaagauggggguccgcacguaccuggaggaggagcucaccaaggcccgggagcgccccaagcugcggaaggacauguacaagaagaugcuggccguggaccccgaggcccccaccgaggaggagcacgcgcagcgcgccgugaccaagccgcgguacaugcaguggcgcgagggcaucagcuccagcacgacccucggguuccggaucgagggcaucaagaaggccgacggguccugcagcaccgacuucaagaccacgcgcucccgggagcagguccugcgcguguucgaggaguucgugcagggcgacgaggagguccugcggcgcuaccucaaccggcugcagcagauccgcgacacccuggaggugagcgaguucuuccggcgccacgaggugaucggcuccagccuccuguucguccacgaccacugccaccgggccgggguguggcugaucgacuucggcaagaccacgccccuccccgacgggcagauccuggaccaccgccgcccgugggaggagggcaaccgggaggacggguaccugcucggccuggacaaccugaucggcauccucgcgucccuggccgagcgcuga

SEQ ID NO: 31761 - RNA, 2052 nt, Artificial Sequence
  derived and/or modified sequence opt1 from ITPKC__Homo_sapiens__XP_006723467
augcgccggugccccugccgcggcagccugaacgaggccgaggccggggcgcucccggccgccgcccggaugggccuggaggcgccccgcgggggccggcgccggcagcccgggcagcagcgccccggcccgggcgccggggcccccgccggccggcccgagggcggcgggcccugggcccgcaccgagggcuccagccugcacuccgagccggagcgggcgggccucgggcccgcccccggcaccgagagcccccaggccgaguucuggacggacgggcagaccgagccggccgccgcgggccugggcguggagaccgagcgccccaagcagaagaccgagcccgaccgguccagccugcgcacgcaccucgagugguccuggagcgagcuggagacgaccugccuguggaccgagaccgggaccgacggccucuggaccgacccccaccgguccgaccugcaguuccagccggaggaggccagccccuggacccagcccgggguccacggccccuggacggagcuggagacccacgggucccagacccagccggagcgcgucaagagcugggccgacaaccucuggacccaccagaacuccagcucccugcagacgcaccccgagggcgccugccccagcaaggagcccuccgccgacggcagcuggaaggagcuguacaccgacgggucccggacccagcaggacaucgagggcccguggaccgagcccuacacggacgggagccagaagaagcaggacaccgaggcggcccgcaagcagcccggcaccgggggcuuccagauccagcaggacaccgacggcagcuggacgcagcccuccaccgacgggagccagaccgccccgggcaccgacugccuccugggggagcccgaggacggcccccuggaggagccggagcccggggagcuccugacgcaccuguacucccaccucaagugcagcccccugugccccgugccgcggcugaucaucacccccgagacccccgagcccgaggcccagccggugggcccgcccucccgcguggagggcgggagcggcggguucuccagcgccuccagcuucgacgaguccgaggacgacguggucgcgggcggcgggggcgccagcgaccccgaggaccgguccgggagcaagcccuggaagaagcucaagaccgugcugaaguacucccccuucguggucagcuuccgcaagcacuaccccugggugcagcuguccggccacgccgggaacuuccaggccggcgaggacggccgcauccucaagcgguucugccagugcgagcagcgcagccuggagcagcugaugaaggacccccuccggccguucgugcccgccuacuacgggaugguccugcaggacggccagacguucaaccagauggaggaccugcucgcggacuucgaggggcccuccaucauggacugcaagaugggcagccgcaccuaccuggaggaggagcuggugaaggcccgggagcgcccccggccgcgcaaggacauguacgagaagaugguggccgucgaccccggggcccccacccccgaggagcacgcgcagggcgccgugaccaagccgcgguacaugcaguggcgcgagacgaugagcuccaccagcacccucggcuuccggaucgaggggaucaagaaggccgacgggaccugcaacaccaacuucaagaagacgcaggcccuggagcaggucaccaaggugcuggaggacuucguggacggggaccacgugauccuccagaaguacgucgccugccuggaggagcugcgcgaggcgcucgagaucucccccuucuucaagacccacgagguggugggcagcucccugcuguucguccacgaccacaccgggcucgccaagguguggaugaucgacuucggcaagacggucgcccugcccgaccaccagacccugagccaccggcucccgugggccgagggcaaccgcgaggacggguaccuguggggccuggacaacaugaucugccugcuccaggggcuggcccaguccuga

SEQ ID NO: 31762 - RNA, 8133 nt, Artificial Sequence
  derived and/or modified sequence opt1 from ITPR1__Homo_sapiens__NP_001093422
augagcgacaagaugagcagcuuccugcacaucggcgacaucugcucccuguacgccgaggggagcaccaacggcuucaucuccacccuggggcugguggacgaccggugcguggugcagcccgagaccggcgaccugaacaacccgcccaagaaguuccgggacugccuguucaagcugugccccaugaaccgcuacagcgcccagaagcaguucuggaaggcggccaagcccggggccaacuccaccaccgacgccgugcuccugaacaagcugcaccacgccgcggaccucgagaagaagcagaacgagaccgagaaccggaagcugcugggcaccgucauccaguacggcaacgugauccagcuccugcaccucaaguccaacaaguaccucaccgugaacaagcgccugccggcccugcucgagaagaacgccaugcgggucacccuggacgaggccgggaacgagggcuccugguucuacauccagcccuucuacaagcugcgcagcaucggggacuccguggugaucggcgacaaggucgugcucaaccccgugaacgcggggcagccccugcacgccagcucccaccagcuggucgacaacccgggcugcaacgaggugaacagcgugaacugcaacaccuccuggaagaucguccucuucaugaaguggagcgacaacaaggacgacauccugaagggcggggacguggugcggcuguuccacgccgagcaggagaaguuccucacgugcgacgagcaccgcaagaagcagcacgucuuccugcggaccaccggccgccaguccgccaccagcgccacguccagcaaggcgcugugggagguggaggugguccagcacgaccccugccgcgggggcgccggcuacuggaacagccucuuccgcuucaagcaccuggccaccgggcacuaccuggccgccgagguggaccccgacuucgaggaggagugccucgaguuccagcccuccguggacccggaccaggacgcgagccggucccgccugcggaacgcccaggagaagauggucuacagccugguguccguccccgagggcaacgacaucagcuccaucuucgagcucgaccccaccacccugcgcgggggcgacagccuggugccccggaacuccuacgugcgccuccggcaccugugcacgaacaccuggguccacagcaccaacaucccgaucgacaaggaggaggagaagcccgugaugcugaagaucgggaccucccccgugaaggaggacaaggaggccuucgccaucguccccgugagcccggccgaggugcgcgaccucgacuucgcgaacgacgccuccaagguccugggcagcaucgccggcaagcuggagaaggggacgaucacccagaacgagcggcgcuccgugaccaagcuccuggaggaccugguguacuucgucaccggcgggacgaacagcggccaggacgugcucgagguggucuucuccaagcccaaccgcgagcggcagaagcugaugcgcgagcagaacauccugaagcagaucuucaagcugcuccaggcccccuucaccgacugcggggacggccccaugcugcggcuggaggagcucggcgaccagcgccacgccccguuccggcacaucugccgccugugcuaccgggugcugcgccacagccagcaggacuaccggaagaaccaggaguacaucgcgaagcaguucggguucaugcagaagcagaucggcuacgacgugcucgccgaggacaccaucaccgcccugcugcacaacaaccgcaagcuccuggagaagcacaucacggccgcggagaucgacaccuucgucucccuggugcggaagaaccgcgagccccgguuccucgacuaccugagcgaccugugcgugagcaugaacaaguccauccccgucacccaggagcucaucugcaaggccgugcugaaccccaccaacgccgacauccugaucgagacgaagcucgugcugagccgcuucgaguucgagggggucuccagcaccggcgagaacgcccuggaggccggggaggacgaggaggagguguggcuguucuggcgggacuccaacaaggagauccgcagcaaguccgugcgggagcuggcgcaggacgccaaggagggccagaaggaggaccgcgacguccugagcuacuaccgguaccagcucaaccuguucgcccgcaugugccuggaccgccaguaccucgccaucaacgagaucuccggccagcuggacguggaccugauccuccggugcaugagcgacgagaaccugccguacgaccugcgcgccuccuucugccggcucaugcugcacaugcacguggaccgcgacccccaggagcaggucacccccgugaaguacgcgcggcuguggagcgagaucccguccgagaucgccaucgacgacuacgacagcuccggggccagcaaggacgagaucaaggagcgcuucgcccagaccauggaguucguggaggaguaccuccgggacgucgugugccagcgcuuccccuucuccgacaaggagaagaacaagcugacguucgagguggucaaccuggcccggaaccucaucuacuucggcuucuacaacuucagcgaccugcugcgccucaccaagauccugcuggcgauccucgacugcgugcacgugaccaccaucuuccccaucagcaagauggccaagggggaggagaacaagggcuccaacgucaugcggagcauccacggcgugggggagcugaugacccaggugguccugcgcggcgggggcuuccuccccaugacgccgauggccgccgcgcccgaggggaacgugaagcaggccgagcccgagaaggaggacaucauggugauggacaccaagcugaagaucaucgagauccugcaguucauccucaacguccggcuggacuaccgcaucuccugccugcucugcaucuucaagcgggaguucgacgagagcaacucccagaccagcgagaccuccagcggcaacuccagccaggagggccccuccaacgugccgggggcccuggacuucgagcacaucgaggagcaggccgagggcaucuucgggggcagcgaggagaacacgccccuggaccucgacgaccacgggggccgcaccuuccugcgggugcugcuccaccugaccaugcacgacuacccgccccucgucuccggcgcccuccagcugcuguuccgccacuucagccagcggcaggaggugcuccaggcguucaagcagguccagcugcuggucaccucccaggacguggacaacuacaagcagaucaagcaggaccucgaccagcugcgcagcaucgucgagaaguccgagcuguggguguacaaggggcagggcccggacgagacgauggacggggccagcggcgagaacgagcacaagaagaccgaggaggggaacaacaagccccagaagcacgaguccaccagcagcuacaacuaccggguggucaaggagauccucauccgccuguccaagcugugcgugcaggagagcgccuccgugcgcaagagccggaagcagcagcagcgccuccugcggaacaugggcgcccacgccgucgugcuggagcuccugcagauccccuacgagaaggcggaggacaccaagaugcaggagaucaugcgccuggcccacgaguuccuccagaacuucugcgccggcaaccagcagaaccaggcccugcugcacaagcacaucaaccucuuccugaaccccgggauccuggaggccgugacgaugcagcacaucuucaugaacaacuuccagcucugcuccgagaucaacgagcgggucgugcagcacuucgugcacugcaucgagacccacggccgcaacguccaguacaucaaguuccugcagaccaucgugaaggcggaggggaaguucaucaagaagugccaggacauggugauggccgagcuggucaacagcggcgaggacgugcucguguucuacaacgaccgggccuccuuccagacccugauccagaugaugcgcagcgagcgggaccgcauggacgagaacuccccgcugauguaccacauccaccucgucgagcugcuggccgugugcacggaggggaagaacguguacaccgagaucaagugcaacagccugcucccccuggacgacaucguccggguggugacccacgaggacugcauccccgaggucaagaucgcguacaucaacuuccugaaccacugcuacguggacaccgagguggagaugaaggagaucuacacguccaaccacauguggaagcuguucgagaacuuccuggucgacaucugccgcgccugcaacaacaccagcgaccggaagcacgccgacuccauccuggagaaguacgugaccgagaucgugaugagcaucgucaccacguucuucuccagccccuucuccgaccagagcaccacccuccagacccgccagccgguguucgugcagcugcugcagggcgucuuccggguguaccacugcaacuggcucaugcccucccagaaggccagcguggagagcugcauccgcguccuguccgacguggccaagagccgggcgaucgccauccccguggaccuggacucccaggucaacaaccucuuccucaagagccacuccaucgugcagaagacggccaugaacuggcgccugagcgcccggaacgccgcgcgccgcgacuccgugcucgccgccagccgggacuaccgcaacaucaucgagcggcugcaggacaucgucuccgcccuggaggaccgccuccggccccuggugcaggccgagcugagcgugcucgucgacgugcugcaccgcccggagcuccuguuccccgagaacaccgacgcgcggcgcaagugcgaguccggcggguucaucugcaagcugaucaagcacaccaagcagcugcucgaggagaacgaggagaagcugugcaucaaggugcugcagacccuccgggagaugaugacgaaggaccgcggcuacggggagaagggcgaggcccugcggcagguccuggugaaccgcuacuacggcaacgugcggcccagcgggcgccgggagucccucaccagcuucggcaacgggccgcuguccgccggcgggcccggcaagcccggcgggggcgggggcgggagcggcuccagcuccaugagccgcggcgagaugagccuggccgagguccagugccaccucgacaaggagggggccuccaaccuggugaucgaccugaucaugaacgcgagcuccgaccgggucuuccacgagagcauccuccuggccaucgcccugcucgagggcgggaacaccaccauccagcacuccuucuucugccgccugacggaggacaagaaguccgagaaguucuucaagguguucuacgaccggaugaagguggcccagcaggagaucaaggcgaccgucaccgugaacaccuccgaccugggcaacaagaagaaggacgacgagguggaccgcgacgcccccagccggaagaaggccaaggagccgaccacgcagaucaccgaggagguccgcgaccagcuccuggaggccuccgccgcgacccgcaaggccuucaccacguuccggcgcgaggccgaccccgacgaccacuaccagcccggggagggcacccaggccaccgccgacaaggcgaaggacgaccuggagaugagcgccgugaucaccaucaugcagcccauccuccgguuccugcagcugcucugcgagaaccacaaccgcgaccugcagaacuuccugcggugccagaacaacaagacgaacuacaaccucgugugcgagacccugcaguuccuggacugcaucugcggcuccaccaccgggggccucgggcugcugggccucuacaucaacgagaagaacgucgcccugaucaaccagacgcuggagagccucaccgaguacugccagggcccgugccacgagaaccagaacugcaucgccacccacgaguccaacgggaucgacaucaucaccgcccugauccugaacgacaucaacccccucggcaagaagcgcauggaccuggugcuggagcucaagaacaacgcgagcaagcugcugcucgccaucauggagucccggcacgacagcgagaacgccgagcgcauccuguacaacaugcggcccaaggagcugguggaggucaucaagaaggccuacaugcagggggagguggaguucgaggacggcgagaacggggaggacggcgcggccagcccccgcaacgugggccacaacaucuacauccucgcccaccagcuggcccggcacaacaaggagcugcagagcaugcucaagcccgggggccaggucgacggggacgaggcccuggaguucuacgcgaagcacacggcccagaucgagaucgugcgccuggaccggaccauggagcagaucguguuccccguccccuccaucugcgaguuccucaccaaggagagcaagcugcgcaucuacuacaccacggagcgggacgagcagggcagcaagaucaacgacuucuuccugcgcuccgaggaccucuucaacgagaugaacuggcagaagaagcugcgggcccagcccgugcuguacuggugcgcccgcaacaugagcuucugguccagcaucuccuucaaccucgccgugcugaugaaccugcucgucgcguucuucuacccguucaagggggugcggggcggcacccuggagccccacuggagcgggcugcucuggaccgccaugcugaucucccuggccaucgugaucgcccuccccaagccccacggcauccgcgcccugaucgcgagcaccauccugcgccucaucuucuccgucgggcugcagccgacgcuguuccugcucggcgccuucaacgugugcaacaagaucaucuuccugaugagcuucguggggaacugcggcaccuucacccggggcuaccgcgccaugguccuggacguggaguuccucuaccaccuccuguaccucgugaucugcgccauggggcuguucguccacgaguucuucuacucccugcuccuguucgaccugguguaccgggaggagacccuccugaacgugaucaagagcgucacgcgcaacggccgguccaucauccugaccgcggugcucgcccugauccugguguaccucuucagcaucgucggguaccuguucuucaaggacgacuucauccuggagguggaccgccuccccaacgagaccgccgugcccgagaccggcgagucccuggccagcgaguuccuguucuccgacgucugccggguggagagcggggagaacugcuccagccccgccccgcgcgaggagcucgugcccgcggaggagacggagcaggacaaggagcacacgugcgagacccugcugaugugcaucgucaccgugcucagccacggccugcgguccggcgggggcgugggggacguccugcgcaagcccagcaaggaggagccccucuucgccgcccgggugaucuacgaccugcuguucuucuucauggugaucaucaucguccucaaccugaucuucggcgugaucaucgacacguucgccgaccugcgcuccgagaagcagaagaaggaggagauccucaagacgaccugcuucaucugcggccuggagcgggacaaguucgacaacaagaccgugaccuucgaggagcacaucaaggaggagcacaacauguggcacuaccugugcuucaucguccucgugaaggucaaggacagcacggaguacaccgggccggaguccuacguggccgagaugaucaaggagcgcaaccuggacugguucccccggaugcgcgcgaugagccugguguccagcgacuccgagggcgagcagaacgagcuccggaaccugcaggagaagcuggagagcaccaugaagcucgucaccaaccuguccgggcagcugagcgagcucaaggaccagaugacggagcagcgcaagcagaagcagcggaucggccugcuggggcacccgccccacaugaacgugaacccccagcagcccgccuga

SEQ ID NO: 31763 - RNA, 8106 nt, Artificial Sequence
  derived and/or modified sequence opt1 from ITPR2__Homo_sapiens__NP_002214
augaccgagaagaugagcagcuuccucuacaucggcgacaucgugagccucuacgcggaggggagcgugaacggcuucaucagcacccuggggcugguggacgaccgcugcgugguccaccccgaggcgggcgaccucgcgaacccgcccaagaaguuccgcgacugccuguucaaggugugccccaugaaccgcuacagcgcccagaagcaguacuggaaggccaagcaggccaagcaggggaaccacacggaggccgcgcugcucaagaagcugcagcacgccgccgagcuggagcagaagcagaacgagagcgagaacaagaagcuccugggcgagaucgugaaguacuccaacgucauccagcugcuccacaucaagagcaacaaguaccugaccgugaacaagcggcugcccgcccuccuggagaagaacgcgaugcgcgugucccuggacgccgccggcaacgaggggagcugguucuacauccaccccuucuggaagcuccgguccgagggcgacaacaucgucgugggggacaaggugguccugaugcccgugaacgccggccagccccugcacgccagcaacaucgagcuccuggacaaccccgggugcaaggaggugaacgcggucaacugcaacaccuccuggaagaucacccuguucaugaaguacagcuccuaccgcgaggacgugcucaagggcggcgacgugguccggcuguuccacgccgagcaggagaaguuccugacgugcgacgaguacgagaagaagcagcacaucuuccuccgcaccacccugcggcagagcgccaccuccgccacgagcuccaaggcccugugggagaucgagguggugcaccacgaccccugccgcgggggcgcggggcaguggaacagccucuuccgguucaagcaccuggccaccggcaacuaccuggccgccgagcucaaccccgacuaccgcgacgcccagaacgagggcaagaacguccgggacggggugccgcccaccagcaagaagaagcgccaggcgggcgagaagaucauguacacccugguguccgucccgcacgggaacgacaucgccagccuguucgagcucgacgccacgacccugcagcgggccgacugccuggugccccgcaacuccuacguccggcuccgccaccugugcaccaacaccugggugacgagcaccuccauccccaucgacaccgacgaggagcggcccgugaugcugaagaucgggaccugccagacgaaggaggacaaggaggccuucgcgaucgucagcgugccgcucuccgaggugcgcgaccuggacuucgccaacgacgccaacaagguccuggccaccaccgugaagaagcucgagaacgggaccaucacgcagaacgagcggcgcuucgugaccaagcugcuggaggaccucaucuucuucgucgcggacgugcccaacaacggccaggaggugcuggacgucgugaucaccaagcccaaccgcgagcggcagaagcugaugcgcgagcagaacauccuggcccagguguucggcauccucaaggcccccuucaaggagaaggccggggagggcagcaugcugcggcuggaggaccucggggaccagcgcuacgccccguacaaguacaugcugcggcugugcuaccgcguccuccggcacucccagcaggacuaccgcaagaaccaggaguacaucgcgaagaacuucugcgugaugcagagccagaucggcuacgacauccuggccgaggacaccaucacggcccugcuccacaacaaccggaagcugcuggagaagcacaucaccgccaaggagaucgagaccuucgugucccuccugcgccggaaccgcgagccccgguuccuggacuaccucagcgaccugugcgucuccaacaccacggccauccccgugacccaggagcugaucugcaaguucaugcucagccccgggaacgcggacauccugauccagaccaagguggucuccaugcaggccgacaacccgauggagagcuccauccugagcgacgacaucgacgacgaggagguguggcucuacuggaucgacuccaacaaggagccccacggcaaggccauccgccaccuggcccaggaggccaaggagggcaccaaggcggaccuggaggugcucacguacuaccgguaccagcugaaccuguucgcccgcaugugccucgaccggcaguaccuggccaucaaccagaucagcacccagcugagcgucgaccucauccugcgcugcguguccgacgagagccugcccuucgaccuccgggccuccuucugccgccugaugcugcacaugcacguggaccgcgacccccaggagagcgucgugccggugcgguacgcgcgccucuggaccgagauccccaccaagaucaccauccacgaguacgacuccaucacggacagcucccggaacgacaugaagcgcaaguucgcccugaccauggaguucgucgaggaguaccugaaggagguggugaaccagcccuucccguucggggacaaggagaagaacaagcucaccuucgaggucgugcaccuggcccggaaccugaucuacuucggcuucuacagcuucuccgagcuccugcgccugacccggacgcuccuggccauccuggacaucgugcaggcccccaugagcuccuacuucgagcgccucagcaaguuccaggacgggggcaacaacgucaugcggaccauccacggggugggcgagaugaugacccagauggugcugucccgcggcagcaucuuccccauguccguccccgacgugccgcccagcauccaccccuccaagcaggggagccccaccgagcacgaggacgugacggucauggacaccaagcugaagaucaucgagauccuccaguucauccugagcgugcggcuggacuaccgcaucuccuacaugcucagcaucuacaagaaggaguucggcgaggacaacgacaacgcggagaccuccgccagcggguccccggacacccugcugcccagcgccaucgugcccgacaucgacgagaucgccgcccaggcggagacgauguucgccggccggaaggagaagaaccccguccagcucgacgacgagggcgggcgcaccuuccugcgggugcugauccaccucaucaugcacgacuacccgccccugcuguccggcgcccuccagcugcuguucaagcacuucagccagcgcgccgaggugcuccaggccuucaagcagguccagcugcugguguccaaccaggacguggacaacuacaagcagaucaaggcggaccucgaccagcugcggcugaccgucgagaaguccgagcucuggguggagaaguccagcaacuacgagaacggggagaucggcgagucccaggucaagggcggggaggagcccaucgaggagagcaacauccugucccccgugcaggacggcaccaagaagccgcagaucgacagcaacaaguccaacaacuaccgcaucgugaaggagauccugauccggcucagcaagcugugcguccagaacaagaagugccgcaaccagcaccagcggcugcucaagaacaugggggcccacuccguggugcuggaccugcuccagauccccuacgagaagaacgacgagaagaugaacgaggucaugaaccuggcccacacguuccugcagaacuucugccgcggcaacccccagaaccaggugcuccugcacaagcaccugaaccucuuccugacccccgggcugcucgaggccgagaccaugcgccacaucuucaugaacaacuaccaccugugcaacgagaucagcgagcgggugguccagcacuucgugcacugcaucgagacccacggccgccacguggaguaccugcgguuccuccagacgaucgucaaggcggacgggaaguacgugaagaagugccaggacauggugaugaccgagcugaucaacggcggcgaggacguccugaucuucuacaacgaccgcgccagcuucccgauccugcuccacaugaugugcuccgagcgggaccgcggggacgagagcggcccccuggccuaccacaucacccugguggagcuccuggccgccugcaccgaggggaagaacguguacacggagaucaagugcaacucccugcucccccuggacgacaucguccggguggugacccacgacgacugcauccccgaggucaagaucgcguacgugaacuucgugaaccacugcuacgucgacaccgagguggagaugaaggagaucuacaccagcaaccacaucuggaagcuguucgagaacuuccucguggacauggcccgcgucugcaacacgaccaccgaccggaagcacgccgacaucuuccuggagaagugcgugaccgaguccaucaugaacaucgugagcggcuucuucaacuccccguucagcgacaacuccacgagccugcagacccaccagcccgucuucauccagcuccugcaguccgccuuccgcaucuacaacugcaccuggcccaacccggcccagaaggcgagcguggaguccugcauccggacccuggccgagguggccaagaaccgcgggaucgccauccccgucgaccucgacagccaggugaacacgcuguucaugaagucccacagcaacauggugcagcgggccgcgaugggcuggcgccuguccgcccggagcggcccccgcuucaaggaggcccucgggggccccgccugggacuaccggaacaucaucgagaagcugcaggacgucguggccucccuggagcaccaguucagcccgaugaugcaggcggaguucagcgugcucgucgacgugcuguacucccccgagcuccuguuccccgaggggagcgacgcccgcauccggugcggcgccuucauguccaagcugaucaaccacaccaagaagcugauggagaaggaggagaagcucugcaucaagauccugcagacccugcgcgagaugcucgagaagaaggacagcuucguggaggaggggaacacccugcgcaagauccugcucaaccgguacuucaagggcgacuacuccaucggcgucaacgggcaccugagcggcgccuacuccaagaccgcccaggucggcgggagcuucuccgggcaggacagcgacaagauggggaucuccaugagcgacauccagugccugcucgacaaggagggcgccuccgagcuggugaucgacgucaucgugaacacgaagaacgaccgcaucuucagcgaggggaucuuccugggcaucgcccuccuggagggcggcaacacccagacccaguacuccuucuaccagcagcugcacgagcagaagaaguccgagaaguucuucaaggugcucuacgaccggaugaaggccgcccagaaggagauccgcuccaccgucacggugaacaccaucgaccugggcaacaagaagcgggacgacgacaacgagcugaugaccagcgggccccgcaugcgggugcgcgacuccacccuccaccugaaggagggcaugaaggggcagcugacggaggcgagcagcgccaccuccaaggccuacugcgucuaccggcgcgagauggacccggagaucgacaucaugugcaccggccccgaggccgggaacaccgaggagaaguccgccgaggaggugacgaugucccccgcgaucgccaucaugcagcccauccuccgguuccugcagcugcucugcgagaaccacaaccgcgagcugcagaacuuccugcggaaccagaacaacaagaccaacuacaaccucgucugcgagacccugcaguuccuggacugcaucugcggcagcaccacgggcgggcucggccugcuggggcucuacaucaacgagaagaacguggcccuggugaaccagaaccuggagucccucaccgaguacugccagggcccgugccacgagaaccagaccugcaucgccacccacgagagcaacgggaucgacaucaucaucgcccugauccugaacgacaucaacccccucggcaaguaccgcauggaccugguccugcagcucaagaacaacgcguccaagcugcugcucgccaucauggagagccggcacgacuccgagaacgccgagcgcauccuguucaacaugcggccccgcgagcugguggacgugaugaagaacgccuacaaccagggccucgagugcgaccacggggacgacgagggcggggacgacggcgucagccccaaggacgugggccacaacaucuacauccuggcgcaccagcuggcccggcacaacaagcuccugcagcagaugcugaagccgggguccgaccccgacgagggcgacgaggcccucaaguacuacgccaaccacacggcccagaucgagaucgugcgccacgaccggaccauggagcagaucgucuuccccgugcccaacaucugcgaguaccugacccgcgagagcaagugccgcguguucaacaccacggagcgggacgagcagggguccaaggucaacgacuucuuccagcagaccgaggaccuguacaacgagaugaaguggcagaagaagauccgcaacaacccggcccucuucugguucagccggcacaucucccuguggggcagcaucuccuucaaccuggccguguucaucaaccucgccguggcccuguucuaccccuucggggacgacggcgacgagggcacccugagcccccucuucuccguccugcuguggaucgccguggcgaucugcaccagcaugcuguucuucuucagcaagcccguggggauccgcccguuccuggucuccaucaugcugcggagcaucuacacgaucggccucgggcccacccugauccugcucggcgccgccaaccugugcaacaagaucguguuccugguguccuucgucgggaaccgcggcaccuucacccggggcuaccgcgccgugauccuggacauggccuuccucuaccacguggcguacguccuggugugcaugcugggccucuucgugcacgaguucuucuacagcuuccugcuguucgaccucgucuaccgggaggagacgcugcugaacgugaucaaguccgugacccgcaacggccggagcaucauccucaccgccguccuggcccugauccucguguaccuguucuccaucaucggguuccuguuccucaaggacgacuucaccauggagguggaccgccugaagaaccggacgcccgucaccggcagccaccaggugcccaccaugacccugaccacgaugauggaggccugcgcgaaggagaacugcuccccgaccauccccgccagcaacaccgccgacgaggaguacgaggacgggaucgagcggaccugcgacacgcuccugaugugcaucgugaccguccugaaccagggccuccggaacggcgggggcgugggggacgugcugcgccggcccuccaaggacgagccgcuguucgccgcccgcgucguguacgaccuccuguucuacuucaucgugaucaucaucguccugaaccucaucuucggcgugaucaucgacaccuucgcggaccugcggagcgagaagcagaagaaggaggagauccugaagaccacgugcuucaucugcgggcucgagcgcgacaaguucgacaacaagaccguguccuucgaggagcacaucaagagcgagcacaacauguggcacuaccuguacuucaucguccuggugaaggugaaggaccccaccgaguacaccggccccgaguccuacgucgcccagaugaucguggagaagaaccucgacugguucccccgcaugcgggccaugagccugguguccaacgagggcgacagcgagcagaacgagauccgcucccugcaggagaagcucgagagcacgaugagccuggucaagcagcuguccgggcagcucgccgagcugaaggagcagaugaccgagcagcggaagaacaagcagcgccugggcuuccucgggagcaacaccccgcacgugaaccaccacaugccgccccacuga

SEQ ID NO: 31764 - RNA, 8016 nt, Artificial Sequence
  derived and/or modified sequence opt1 from ITPR3__Homo_sapiens__NP_002215
augagcgagaugagcagcuuccugcacaucggcgacaucgugagccucuacgccgaggggagcgugaacggcuucaucuccacccuggggcugguggacgaccgcugcgugguggagcccgccgccggcgaccucgacaacccgcccaagaaguuccgggacugccuguucaaggugugccccaugaaccgcuacagcgcccagaagcaguacuggaaggccaagcagaccaagcaggacaaggagaagaucgccgacgugguccugcuccagaagcugcagcacgccgcgcagauggagcagaagcagaacgacacggagaacaagaaggugcacggggacguggucaaguacggcuccgugauccagcugcuccacaugaaguccaacaaguaccugaccgugaacaagcggcugcccgcccuccuggagaagaacgccaugcgcgucacccuggacgccaccggcaacgagggguccuggcuguucauccagcccuucuggaagcugcggagcaacggcgacaacgugguggucggggacaaggugauccugaaccccgugaacgcgggccagccccuccacgccuccaacuacgagcugagcgacaacgccgggugcaaggaggucaacuccgugaacugcaacacgagcuggaagaucaaccuguucaugcaguuccgcgaccaccucgaggaggugcugaagggcggcgacgucgugcggcuguuccacgccgagcaggagaaguuccugacgugcgacgaguacaaggggaagcuccagguguuccugcgcaccacccuccggcaguccgccacgagcgcgaccuccagcaacgcccugugggaggucgaggugguccaccacgaccccugccgcggcggggccggccacuggaacggccuguaccgguucaagcaccucgccaccgggaacuaccuggccgcggaggagaacccguccuacaagggcgacgccagcgaccccaaggccgccgggaugggcgcccaggggcgcaccggccggcgcaacgcgggcgagaagaucaaguacugccugguggccgugccccacgggaacgacaucgccagccucuucgagcuggaccccacgacccugcagaagaccgacuccuucgucccgcggaacagcuacgugcgccuccggcaccugugcaccaacacguggauccaguccaccaacgugcccaucgacaucgaggaggagcgccccauccggcugaugcucggcacgugccccaccaaggaggacaaggaggccuucgccaucgucagcgugccgguguccgagauccgcgaccuggacuucgcgaacgacgccagcuccaugcuggccagcgccgucgagaagcucaacgagggguucaucucccagaacgaccggcgcuucgugauccagcugcuggaggaccucguguucuucgucagcgacgugcccaacaacggccagaacgugcuggacaucauggucacgaagcccaaccgcgagcggcagaagcugaugcgcgagcagaacauccucaagcaggucuucgggauccugaaggcgcccuuccgggagaagggcggcgaggggccgcuggugcgccuggaggagcucuccgaccagaagaacgcccccuaccagcacauguuccggcugugcuaccgcguccugcggcacagccaggaggacuaccgcaagaaccaggagcacaucgccaagcaguucggcaugaugcagucccagaucggguacgacauccucgccgaggacaccaucaccgcccugcugcacaacaaccggaagcuccuggagaagcacaucaccaagacggagguggagaccuucgugagccugguccgcaagaaccgggagccccgcuuccucgacuaccuguccgaccugugcgugagcaaccacaucgcgauccccgugacccaggagcucaucugcaagugcguccuggacccgaagaacuccgacauccugauccggaccgagcuccgccccgugaaggagauggcccagagccacgaguaccuguccaucgaguacagcgaggaggagguguggcugacguggaccgacaagaacaacgagcaccacgagaaguccguccggcagcucgcccaggaggcccgcgccggcaacgcgcacgacgagaacgugcuguccuacuaccgguaccagcugaagcuguucgcccgcaugugccuggaccggcaguaccuggccaucgacgagaucagccagcagcucgggguggaccugaucuuccugugcauggccgacgagaugcuccccuucgaccugcgcgccuccuucugccaccugaugcuccacguccacguggaccgcgacccccaggagcuggugaccccggucaaguucgcgcggcuguggaccgagauccccacggccaucaccaucaaggacuacgacagcaaccucaacgccucccgcgacgacaagaagaacaaguucgccaacaccauggaguucguggaggacuaccugaacaacguggucagcgaggcggugcccuucgccaacgaggagaagaacaagcugaccuucgagguggucucccucgcccacaaccugaucuacuucggcuucuacagcuucuccgagcugcuccggcugacgcgcacccugcucggcaucaucgacugcgugcaggggccgcccgccaugcugcaggccuacgaggaccccggcgggaagaacgugcggcgcagcauccagggcgucggccacaugauguccaccauggugcugagccggaagcaguccguguucagcgcgcccucccucagcgccggggccuccgccgccgagccgcuggaccgcagcaaguucgaggagaacgaggacaucgucgugauggagaccaagcugaagauccucgagauccugcaguucauccugaacgugcggcucgacuaccgcaucagcuaccugcuguccgucuucaagaaggaguucguggagguguuccccaugcaggacagcggcgcggacgggaccgcccccgccuucgacuccacgaccgccaacaugaaccucgaccggaucggcgagcaggccgaggcgauguucggggucggcaagaccagcuccaugcuggagguggacgacgagggcgggcgcauguuccugcggguccucauccaccugaccaugcacgacuacgcgccccucgugagcggcgcccuccagcugcuguucaagcacuucucccagcgccaggaggccaugcacacguucaagcagguccagcuccugaucagcgcgcaggacgucgagaacuacaaggugaucaaguccgagcuggaccggcuccgcaccaugguggagaaguccgagcugugggucgacaagaagggguccggcaagggggaggagguggaggccggcgccgccaaggacaagaaggagcggccgaccgacgaggagggcuuccugcacccgcccggggagaaguccuccgagaacuaccagaucgugaagggcauccucgagcgccugaacaagaugugcggggucggcgagcagaugcggaagaagcagcagcgccugcucaagaacauggacgcccacaaggugaugcuggaccugcuccagauccccuacgacaagggggacgcgaagaugauggagauccugcgguacacccaccaguuccugcagaaguucugcgccggcaacccgggcaaccaggcccuccugcacaagcaccuccaccuguuccugacgcccgggcugcucgaggccgagaccaugcagcacaucuuccugaacaacuaccagcugugcagcgagaucuccgagcccgugcuccagcacuucguccaccuccuggccacccacggccgccacgugcaguaccucgacuuccugcacaccgugaucaaggcggaggggaaguacgucaagaagugccaggacaugaucaugacggagcugaccaacgccggcgacgacgugguggucuucuacaacgacaaggccagccucgcccaccuccuggacaugaugaaggccgcgcgcgacgggguggaggaccacagcccccugauguaccacaucagccucguggaccugcuggccgccugcgccgagggcaagaacgucuacaccgagaucaagugcaccucccuccugccgcuggaggacguggugagcgucgugacgcacgaggacugcaucaccgaggugaagauggccuacgucaacuucgugaaccacugcuacguggacaccgaggucgagaugaaggagaucuacaccagcaaccacaucuggacccuguucgagaacuucacccuggacauggcgcgggugugcuccaagcgcgagaagcggguggccgaccccacccuggagaaguacguccucagcguggugcuggacaccaucaacgccuucuucuccagccccuucuccgagaacagcacgucccugcagacccaccagaccaucgucgugcagcuccugcagagcaccacgcgccugcucgagugccccuggcugcagcagcagcacaagggcuccguggaggccugcauccggacccuggcgauggucgccaaggggcgcgccauccuccugccgauggaccuggacgcccacaucagcuccaugcucagcuccggcgccagcugcgcggccgccgcccagcggaacgccuccagcuacaaggcgaccacccgcgccuucccccgggugacgcccaccgccaaccagugggacuacaagaacaucaucgagaagcugcaggacaucaucaccgcccuggaggagcgccucaagccccuggugcaggccgagcuguccguccucguggacgugcugcacuggccggagcuccuguuccuggaggggagcgaggcguaccagcggugcgaguccggcggcuuccugagcaagcucauccagcacaccaaggaccugauggagagcgaggagaagcugugcaucaagguccuccgcacgcugcagcagaugcugcucaagaagaccaaguacggggaccggggcaaccagcugcgcaagaugcugcuccagaacuaccugcagaaccggaaguccaccagccgcggggaccugcccgaccccaucggcaccgggcucgacccggacugguccgccaucgccgccacccagugccggcuggacaaggagggcgcgacgaagcuggugugcgaccucaucaccagcaccaagaacgagaagaucuuccaggaguccaucggccuggccauccaccuccuggacgggggcaacaccgagauccagaaguccuuccacaaccugaugauguccgacaagaaguccgagcgcuucuucaaggugcugcacgaccggaugaagcgcgcccagcaggagacgaaguccaccgucgccgugaacaugaacgaccucgggagccagccccacgaggaccgcgagcccguggaccccaccaccaagggccgggucgccuccuucagcaucccgggguccagcucccgcuacagccugggccccucccugcggcgcggccacgaggugagcgagcggguccaguccagcgagauggggacgagcgugcucaucaugcagcccauccugcgcuuccugcagcuccugugcgagaaccacaaccgggaccugcagaacuuccuccgcugccagaacaacaagaccaacuacaaccuggugugcgagacccugcaguuccucgacaucaugugcggcuccaccaccgggggccuggggcugcucggccuguacaucaacgaggacaacgucggccuggugauccagacccucgagacccugaccgaguacugccaggggcccugccacgagaaccagacgugcaucgugacccacgagagcaacggcaucgacaucaucaccgcgcugauccucaacgacaucuccccgcugugcaaguaccggauggaccugguccuccagcugaaggacaacgccagcaagcugcuccuggcccugauggagucccgccacgacagcgagaacgccgagcggauccucaucucccugcgcccccaggagcugguggacgugaucaagaaggccuaccuccaggaggaggagcgggagaacagcgaggucagcccccgcgagguggggcacaacaucuacauccuggcgcugcagcucagccggcacaacaagcagcugcagcaccuccugaagcccgugaagcgcauccaggaggaggaggccgagggcaucuccagcaugcugucccugaacaacaagcagcucagccagaugcugaaguccagcgccccggcccaggaggaggaggaggacccccuggccuacuacgagaaccacaccucccagaucgagaucguccggcaggaccgcagcauggagcagaucguguuccccgugcccggcaucugccaguuccucacggaggagaccaagcaccggcuguucaccaccacggagcaggacgagcagggguccaaggucagcgacuucuucgaccagagcuccuuccugcacaacgagauggaguggcagcgcaagcugcggagcaugccgcucaucuacugguucucccgccgcaugacccuguggggcagcaucuccuucaaccuggcgguguucaucaacaucaucaucgccuucuucuaccccuacauggagggggccagcaccggcgugcucgacagcccccugaucagccuccucuucuggauccugaucugcuucuccaucgccgcgcuguucaccaagcgguacagcauccgcccccucaucgucgcccugauccugcgguccaucuacuaccucgggaucggcccgacgcugaacauccugggcgcccucaaccugaccaacaagaucguguucguggucagcuucguggggaaccgcggcaccuucauccggggguacaaggccauggugauggacauggaguuccuguaccacgucggcuacauccucaccuccgugcuggggcuguucgcccacgagcuguucuacagcauccugcuguucgaccucaucuaccgcgaggagacgcuguucaacgugaucaaguccgucacccggaacggccgcagcauccugcucaccgcgcugcuggcccucauccugguguaccuguucuccaucgugggcuuccucuuccugaaggacgacuucauccuggaggucgaccggcuccccaacaaccacagcaccgccagcccccuggggaugccccacggcgccgccgcguucguggacacgugcagcggggacaagauggacugcgugagcggccuguccgucccggaggugcucgaggaggaccgcgagcuggacagcaccgagcgggccugcgacacccugcucaugugcaucgugaccgucaugaaccacgggcugcgcaacggcggcggggugggcgacauccugcggaagcccuccaaggacgagagccucuuccccgcccgcguggucuacgaccugcuguucuucuucaucgugaucaucaucgugcucaaccugaucuucggggucaucaucgacaccuucgccgaccugcgguccgagaagcagaagaaggaggagauccucaagacgaccugcuucaucugcggccuggagcgcgacaaguucgacaacaagaccgugagcuucgaggagcacaucaagcuggagcacaacauguggaacuaccucuacuucaucgugcugguccgggugaagaacaagaccgacuacacggggcccgaguccuacguggcccagaugaucaagaacaagaaccuggacugguucccgcgcaugcgggcgaugagccucgucuccaacgagggcgagggcgagcagaacgagauccgcauccugcaggacaagcugaacagcaccaugaagcucgugucccaccugaccgcccagcugaacgagcucaaggagcagaugaccgagcagcgcaagcggcgccagcggcugggguucguggacguccagaacugcaucagccgcuga

SEQ ID NO: 31765 - RNA, 3663 nt, Artificial Sequence
  derived and/or modified sequence opt1 from ITSN1__Homo_sapiens__NP_001001132
auggcccaguuccccaccccguucggcgggagccuggacaucugggccaucaccguggaggagcgcgcgaagcacgaccagcaguuccacucccucaagcccaucagcggcuucaucacgggggaccaggcccggaacuucuucuuccaguccggccugccccagcccguccuggcccagaucugggcccucgccgacaugaacaacgacgggcgcauggaccagguggaguucagcaucgcgaugaagcugaucaagcugaagcuccagggcuaccagcugccguccgcccugccgcccgugaugaagcagcagcccgucgccaucagcuccgcccccgcguucggcaugggcgggaucgccagcaugccgccccucaccgccguggcccccgugcccaugggguccauccccgucgugggcaugagccccacccugguguccagcguccccaccgccgcggugccgccccuggccaacggggccccgcccgugauccagccccuccccgccuucgcccaccccgcggccacgcugcccaaguccagcuccuucagccgguccggcccgggcagccagcugaacaccaagcuccagaaggcccaguccuucgacgucgccagcgugccgcccguggccgagugggcggucccccagagcucccgccugaaguaccggcagcuguucaacagccacgacaagaccauguccgggcaccucaccggcccccaggcccgcacgauccugaugcagagcucccugccccaggcccagcucgccagcaucuggaaccuguccgacaucgaccaggacgggaagcugaccgccgaggaguucauccucgcgaugcaccugaucgacguggccaugagcggccagccccugccgcccgugcucccgcccgaguacaucccgcccuccuuccggcgcguccggagcggcuccgggaucagcgugaucuccagcaccuccguggaccagcgccugcccgaggagcccguccuggaggacgagcagcagcagcucgagaagaagcugcccgugaccuucgaggacaagaagcgggagaacuucgagcgcggcaaccuggagcucgagaagcggcgccaggcccugcuggagcagcagcggaaggagcaggagcgccucgcccagcuggagcgggcggagcaggagcgcaaggagcgggagcgccaggagcaggagcggaagcgccagcuggagcucgagaagcagcuggagaagcagcgcgagcuggagcggcagcgcgaggaggagcggcgcaaggagaucgagcggcgcgaggccgccaagcgggagcucgagcgccagcggcagcuggagugggagcgcaaccggcgccaggagcugcucaaccagcggaacaaggagcaggaggacaucgugguccugaaggccaagaagaagacgcuggaguucgagcucgaggcccugaacgacaagaagcaccagcuggaggggaagcugcaggacauccgcugccggcucaccacccagcgccaggagaucgagagcaccaacaagucccgggagcugcgcaucgcggagaucacgcaccuccagcagcagcugcaggagagccagcagaugcugggccggcugauccccgagaagcagauccucaacgaccagcugaagcagguccagcagaacucccugcaccgcgacagccucgugacccugaagcgcgcccuggaggccaaggagcucgcccggcagcaccuccgcgaccagcuggacgagguggagaaggagacccggagcaagcugcaggagaucgacaucuucaacaaccagcugaaggagcugcgcgagauccacaacaagcagcagcuccagaagcagaaguccauggaggccgagcggcugaagcagaaggagcaggagcgcaagaucaucgagcuggagaagcagaaggaggaggcgcagcggcgcgcccaggagcgggacaagcaguggcucgagcacgugcagcaggaggacgagcaccagcgcccccggaagcugcacgaggaggagaagcugaagcgcgaggagagcgucaagaagaaggacggggaggagaagggcaagcaggaggcccaggacaagcucggccggcuguuccaccagcaccaggagcccgccaagccggccgugcaggcgcccugguccaccgccgagaaggggccccugacgaucagcgcccaggagaacgugaaggucguguacuaccgcgcccucuaccccuucgagucccggagccacgacgagaucaccauccagccgggcgacaucgugauggucaagggggaguggguggacgagucccagaccggcgagcccggguggcugggcggcgagcugaaggggaagaccggcugguuccccgcgaacuacgccgagaagauccccgagaacgaggugccggcccccgucaagcccgugacggacagcaccuccgcccccgccccgaagcucgcgcugcgcgagacccccgcgccccuggccgugaccagcuccgagccgagcacgacccccaacaacugggccgacuucuccagcaccuggcccaccuccacgaacgagaagcccgagaccgacaacugggacgccugggccgcccagccgagccucaccguccccuccgccgggcagcugcggcagcgcagcgccuucacccccgccacggcgaccggcagcucccccagcccggugcuggggcagggcgagaagguggagggccuccaggcccaggcccuguaccccuggcgggccaagaaggacaaccaccugaacuucaacaagaacgacgucaucaccgugcucgagcagcaggacauguggugguucggggaggugcagggccagaaggggugguuccccaaguccuacgucaagcugaucagcggccccauccgcaaguccaccagcauggacuccggcagcuccgagagcccggcgucccugaagcggguggccagccccgccgccaagcccguggucuccggggaggaguucaucgccauguacaccuacgagagcuccgagcagggcgaccucacguuccagcagggggacgugauccuggugaccaagaaggacggcgacugguggaccgggaccgucggcgacaaggcgggcguguuccccagcaacuacgugcgccugaaggacuccgaggggagcggcacggccgggaagaccggcucccucgggaagaagccggagaucgcccaggucaucgccagcuacaccgccaccggccccgagcagcugacgcuggcgcccggccagcucauccugauccgcaagaagaaccccgggggcuggugggagggggagcugcaggcccggggcaagaagcgccagaucgggugguucccggccaacuacgugaagcuccugagccccggcaccuccaagaucacccccaccgagcccccgaaguccacggcccuggccgcggugugccaggucaucggcauguacgacuacaccgcccagaacgacgacgagcucgccuucaacaaggggcagaucaucaacgugcugaacaaggaggaccccgacugguggaagggcgaggugaacgggcaggucggccuguuccccagcaacuacgugaagcucaccaccgacauggaccccagccagcaguga

SEQ ID NO: 31766 - RNA, 5094 nt, Artificial Sequence
  derived and/or modified sequence opt1 from ITSN2__Homo_sapiens__NP_006268
augauggcgcaguuccccaccgccaugaacggcgggcccaacaugugggcgaucaccagcgaggagcgcacgaagcacgaccggcaguucgacaaccucaagcccuccggcggguacaucaccggcgaccaggcccgcaacuucuuccuccagagcgggcugcccgcccccgugcuggccgagaucugggcccucuccgaccugaacaaggacggcaagauggaccagcaggaguucagcaucgcgaugaagcugaucaagcucaagcugcagggccagcagcugcccgucgugcugccgcccaucaugaagcagccgcccauguucagcccccucaucuccgcccgguucgggaugggcuccaugcccaaccugagcaucccccagccccugccgcccgccgcccccaucaccucccugagcuccgcgaccagcgggacgaaccugccgccccucaugaugcccacgccccucgugccguccgucagcaccuccagccugcccaacggcaccgccucccucauccagccccugcccaucccguacagcuccagcacccugccccacgggagcuccuacagccucaugaugggcggcuucgggggcgccuccauccagaaggcccagagccugaucgaccugggguccagcuccagcaccuccagcaccgccucccucagcggcaacucccccaagaccggcacgagcgagugggcggugccccagccgacccgccugaaguaccggcagaaguucaacacccuggacaaguccaugagcggguaccucuccggcuuccaggcccgcaacgcccugcugcagagcaaccucucccagacccagcuggccacgaucuggacccuggccgacguggacggggacggccagcucaaggcggaggaguucauccuggccaugcaccugaccgacauggccaaggccgggcagccccucccccugacccugccgcccgagcucgucccgcccagcuuccggggcggcaagcagaucgacagcaucaacgggacgcugcccuccuaccagaagaugcaggaggaggagccccagaagaagcugcccgugaccuucgaggacaagcgcaaggccaacuacgagcggggcaacauggagcucgagaagcgccggcaggcgcugauggagcagcagcagcgcgaggccgagcggaaggcccagaaggagaaggaggagugggagcgcaagcagcgggagcugcaggagcaggaguggaagaagcagcucgagcuggagaagcgccuggagaagcagcgggagcucgagcgccagcgggaggaggagcgccggaaggacaucgagcgccgcgaggccgccaagcaggagcuggagcggcagcgccggcuggagugggagcgcauccggcgccaggagcugcucaaccagaagaaccgggagcaggaggagaucgugcgccugaacagcaagaagaagaaccugcaccucgagcuggaggcgcugaacgggaagcaccagcagaucuccggccggcuccaggacguccgccugaagaagcagacccagaagaccgagcuggaggugcucgacaagcagugcgaccuggagaucauggagaucaagcagcugcagcaggagcuccaggaguaccagaacaagcugaucuaccuggugcccgagaagcagcuccugaacgagcggaucaagaacaugcaguucagcaacacgccggacuccggggucagccugcuccacaagaagucccuggagaaggaggagcugugccagcgccucaaggagcagcuggacgcccuggagaaggagaccgccagcaagcucuccgagauggacagcuucaacaaccagcugaagugcggcaacauggacgacuccgugcugcagugccuccugagccugcucuccugccugaacaaccuguuccuccugcugaaggagcuccgggagaccuacaacacccagcagcuggcccuggagcagcucuacaagaucaagcgcgacaagcugaaggagaucgagcggaagcgccuggagcucaugcagaagaagaagcuggaggacgaggcggcccggaaggccaagcagggcaaggagaaccuguggaaggagaaccuccgcaaggaggaggaggagaagcagaagcggcugcaggaggagaagacgcaggagaagauccaggaggaggagcgcaaggccgaggagaagcagcgcaaggacaaggacacccugaaggccgaggagaagaagcgggagaccgcgagcgugcucgucaacuaccgcgcccuguaccccuucgaggcccggaaccacgacgagauguccuucaacagcggggacaucauccagguggacgagaagaccgugggcgagcccggguggcuguacggcuccuuccaggggaacuucggcugguuccccugcaacuacgucgagaagaugccgagcagcgagaacgagaaggccgugucccccaagaaggcccuccugccgcccacggugagccuguccgcgaccagcaccuccagcgagccgcucuccagcaaccagcccgccuccgucaccgacuaccagaacgugagcuucuccaaccugacggugaacaccagcuggcagaagaaguccgccuucacccgcaccgucagccccggcuccgugagccccauccacgggcagggccaggucguggagaaccugaaggcccaggcccucugcuccuggaccgcgaagaaggacaaccaccugaacuucagcaagcacgacaucaucacggugcuggagcagcaggagaacuggugguucggggagguccacggcggccgggggugguucccgaaguccuacgugaagaucauccccggcagcgaggugaagcgcgaggagcccgaggcccucuacgccgccgucaacaagaagcccaccagcgcggccuacuccgugggggaggaguacaucgcccuguacccguacagcuccguggagcccggcgaccugaccuucaccgagggggaggagauccucgucacgcagaaggacggcgagugguggaccggcagcaucggggaccgguccggcaucuuccccagcaacuacgugaagccgaaggaccaggaguccuucgggagcgccuccaagagcggcgccuccaacaagaagcccgagaucgcccaggugaccagcgccuacgucgccuccgggagcgagcagcugucccuggcccccggccagcucauccugauccugaagaagaacaccagcggcugguggcagggggagcuccaggcccgcggcaagaagcggcagaaggggugguuccccgcgucccacgugaagcugcugggcccgagcuccgagcgcgccacgcccgccuuccaccccgugugccaggucaucgccauguacgacuacgccgcgaacaacgaggacgagcucagcuucagcaaggggcagcugaucaacgugaugaacaaggacgaccccgacugguggcagggcgagaucaacggcgugaccgggcuguucccguccaacuacgucaagaugaccaccgacagcgaccccucccagcaguggugcgccgaccuccagacgcuggacaccaugcagcccaucgagcggaagcgccagggcuacauccacgagcugauccagaccgaggagcgguacauggccgaccuccagcuggugguggaggucuuccagaagcgcauggccgagagcggguuccugaccgagggcgagauggcgcucaucuucgugaacuggaaggagcugaucauguccaacacgaagcugcucaaggcccugcgggugcgcaagaagaccgggggcgagaagaugcccguccagaugaucggcgacauccuggccgccgagcucagccacaugcaggccuacauccgguucugcuccugccagcugaacggggcggcccugcuccagcagaagaccgacgaggacaccgacuucaaggaguuccugaagaagcuggccagcgacccgcgcugcaagggcaugccccucuccagcuuccugcugaagcccaugcagcggaucacgcgcuacccccugcucauccgguccauccuggagaacaccccggagagccacgccgaccacuccagccugaagcucgcccuggagcgcgcggaggagcugugcucccaggugaacgagggggugcgcgagaaggagaacagcgaccggcucgaguggauccaggcccacguccagugcgagggccuggccgagcagcugaucuucaacucccucaccaacugccugggcccccgcaagcugcuccacagcgggaagcuguacaagaccaaguccaacaaggagcugcacggcuuccucuucaacgacuuccugcugcucacguacauggugaagcaguucgccgugagcagcggguccgagaagcuguucagcuccaagagcaacgcccaguucaagauguacaagacccccaucuuccugaacgagguccucgugaagcugcccaccgacccguccagcgacgagcccguguuccacaucucccacaucgaccgggucuacacccugcgcacggacaacaucaacgagcggaccgcgugggugcagaagaucaaggccgccagcgagcaguacaucgacaccgagaagaagaagcgcgagaaggccuaccaggcccggucccagaagaccagcggcaucgggcgccucauggugcacgucaucgaggcgacggagcugaaggccugcaagcccaacggcaaguccaaccccuacugcgagaucagcaugggcucccagagcuacaccacccggaccauccaggacacgcugaacccgaaguggaacuucaacugccaguucuucaucaaggaccucuaccaggacgugcugugccugacccucuucgaccgcgaccaguucucccccgacgacuuccuggggcggaccgagauccccguggccaagauccgcaccgagcaggagagcaagggccccaugacccggcgccugcuccugcacgaggucccgacgggggaggugugggugcgguucgaccugcagcuguucgagcagaagacccugcuguga

SEQ ID NO: 31767 - RNA, 1191 nt, Artificial Sequence
  derived and/or modified sequence opt1 from IVD__Homo_sapiens__NP_001152980
auggccgagauggccaccgcgacccgccugcucggcuggcggguggccagcuggcgccugcggcccccgcuggccggguucgucucccagcgcgcccacagccuccugcccguggacgacgccaucaacggccuguccgaggagcagcggcaggaguucuggaagcagcucgggaaccugggcgugcuggggaucacggcgcccguccaguacggcggcagcgggcucggcuaccuggagcacgugcuggugauggaggagaucucccgcgccagcggggccgucggccucuccuacggggcccacagcaaccugugcaucaaccagcuggugcggaacggcaacgaggcgcagaaggagaaguaccuccccaagcugaucuccggcgaguacaucggggcccuggccaugagcgagccgaacgccggcuccgacguggucagcaugaagcucaaggccgagaagaaggggaaccacuacauccugaacggcaacaaguucuggaucaccaacggccccgacgcggacgugcugaucguguacgccaagaccgaccucgccgccguccccgccucccgcgggaucaccgcguucaucguggagaagggcaugcccggguucagcacguccaagaagcuggacaagcugggcaugcgggggagcaacacgugcgagcucaucuucgaggacugcaagaucccggccgccaacauccugggccacgagaacaagggcguguacguccugauguccgggcucgaccuggagcgccuggugcucgccggcgggccccugggccugaugcaggccgugcucgaccacaccauccccuaccugcacguccgggaggcguucgggcagaagaucggccacuuccagcugaugcagggcaagauggccgacauguacacccgccucauggccugccggcaguacguguacaacguggccaaggccugcgacgaggggcacugcaccgcgaaggacugcgccggcgucauccuguacagcgccgagugcgccacccagguggcgcuggacgggauccagugcuucggcgggaacggcuacaucaacgacuuccccaugggccgcuuccuccgggacgccaagcuguacgagaucggggccggcaccuccgaggugcgccggcuggucaucgggcgcgccuucaacgccgacuuccacuga

SEQ ID NO: 31768 - RNA, 1758 nt, Artificial Sequence
  derived and/or modified sequence opt1 from IVL__Homo_sapiens__XP_006711363
augagccagcagcacacccugcccgugacccucucccccgcccugagccaggagcugcucaagacggugcccccgcccgugaacacccaccaggagcagaugaagcagcccacgccccugcccccgcccugccagaaggugcccgucgagcugcccguggaggugcccuccaagcaggaggagaagcacaugaccgccgucaagggccucccggagcaggagugcgagcagcagcagaaggagccccaggagcaggagcugcagcagcagcacugggagcagcacgaggaguaccagaaggcggagaaccccgagcagcagcugaagcaggagaagacccagcgcgaccagcagcucaacaagcagcuggaggaggagaagaagcugcucgaccagcagcuggaccaggagcuggugaagcgggacgagcagcucgggaugaagaaggagcagcugcuggagcuccccgagcagcaggagggccaccugaagcaccuggagcagcaggaggggcagcucaagcacccggagcagcaggagggccagcuggagcugcccgagcagcaggaggggcagcucgagcugcccgagcagcaggagggccagcuggagcuccccgagcagcaggagggccagcuggagcugccggagcagcaggaggggcagcucgagcugcccgagcagcaggagggccagcuggagcucccccagcagcaggaggggcagcuggagcugagcgagcagcaggagggccagcucgagcuguccgagcagcaggaggggcagcugaagcaccucgagcaccaggagggccagcuggaggugcccgaggagcagaugggccagcugaaguaccucgagcagcaggaggggcagcugaagcaccuggaccagcaggagaagcagccggagcuccccgagcagcagaugggccagcugaagcaccuggagcagcaggaggggcagcccaagcaccucgagcagcaggagggccagcuggagcagcuggaggagcaggagggccagcugaagcaccucgagcagcaggaggggcagcuggagcaccuggagcaccaggagggccagcucgggcugcccgagcagcagguccugcagcucaagcagcuggagaagcagcagggccagccgaagcaccuggaggaggaggaggggcagcucaagcaccuggugcagcaggagggccagcugaagcaccucgugcagcaggagggccagcuggagcagcaggagcgccaggucgagcaccuggagcagcaggucgggcagcucaagcaccuggaggagcaggagggccagcugaagcaccucgagcagcagcaggggcagcuggaggugcccgagcagcaggucggccagcccaagaaccuggagcaggaggagaagcagcucgagcugccggagcagcaggagggccaggugaagcaccuggagaagcaggaggcccagcucgagcugcccgagcagcaggucgggcagcccaagcaccuggagcagcaggagaagcaccucgagcaccccgagcagcaggacggccagcugaagcaccuggagcagcaggaggggcagcucaaggaccuggagcagcagaagggccagcuggagcagccgguguucgcccccgcccccggccaggugcaggacauccagcccgcccucccgaccaagggggaggugcugcugcccgucgagcaccagcagcagaagcaggaggugcaguggccgcccaagcacaaguga

SEQ ID NO: 31769 - RNA, 1929 nt, Artificial Sequence
  derived and/or modified sequence opt1 from IVNS1ABP__Homo_sapiens__NP_006460
augauccccaacggcuaccugauguucgaggacgagaacuucaucgagagcuccguggccaagcucaacgcccugcgcaagagcgggcaguucugcgacguccggcuccaggugugcggccacgagaugcucgcgcaccgcgccgugcuggccugcugcuccccguaccuguucgagaucuucaacagcgacuccgacccccacgggaucagccacgucaaguucgacgaccucaaccccgaggccguggaggugcugcugaacuacgccuacaccgcgcagcucaaggccgacaaggagcuggucaaggacguguacuccgccgccaagaagcugaagauggaccgggugaagcaggucugcggcgacuaccuccugagccgcauggacgugaccuccugcaucagcuaccggaacuucgcguccugcaugggggacagccgccugcucaacaagguggacgccuacauccaggagcaccuccugcagaucuccgaggaggaggaguuccugaagcugccccggcugaagcucgaggucaugcuggaggacaacgugugccugccgagcaacggcaagcucuacacgaaggugaucaacuggguccagcgcuccaucugggagaacggcgacagccuggaggagcugauggaggaggugcagacccucuacuacuccgccgaccacaagcugcuggacgggaaccuccuggacggccaggccgagguguucgggagcgacgacgaccacauccaguucguccagaagaagccgccccgggagaacggccacaagcagaucuccagcagcuccaccgggugccugagcucccccaacgccaccgugcagagccccaagcacgaguggaagaucguggcguccgagaagacgagcaacaacaccuaccucugccuggccguccuggacggcaucuucugcgugaucuuccuccacggccgcaacagcccccaguccucccccaccagcacccccaagcuguccaagagccuguccuucgagaugcagcaggacgagcucaucgagaagccgaugagccccaugcaguacgcccgguccgggcugggcacggccgagaugaacgggaagcugaucgccgcgggcggcuacaaccgcgaggagugccuccggaccguggagugcuacaacccccacaccgaccacuggagcuuccuggcccccaugcgcaccccgcgggcccgcuuccagauggccguccugauggggcagcucuacguggucggcggguccaacggccacagcgacgaccuguccugcggggagauguacgacagcaacaucgacgacuggauccccgugcccgagcugcggacgaaccgcugcaacgccggcgugugcgcgcucaacggcaagcuguacaucgucgggggcagcgaccccuacgggcagaagggccugaagaacugcgacguguucgacccggugaccaagcuguggaccuccugcgcgccccucaacauccggcgccaccagagcgccgucugcgagcucgggggcuaccuguacaucaucggcggggccgaguccuggaacugccugaacaccguggagcgguacaaccccgagaacaacacguggacccugaucgcccccaugaacguggcccgccgcggcgccggggucgccgugcugaacggcaagcuguucgugugcgggggcuucgacggcagccacgccaucuccugcgucgagauguacgacccgacccggaacgaguggaagaugauggggaacaugaccagcccccgcuccaacgcgggcaucgccacgguggggaacaccaucuacgccgugggcggcuucgacgggaacgaguuccugaacaccgucgagguguacaaccuggagagcaacgaguggucccccuacaccaagaucuuccaguucuga

SEQ ID NO: 31770 - RNA, 882 nt, Artificial Sequence
  derived and/or modified sequence opt1 from IYD__Homo_sapiens__NP_001158166
auguacuuccugacccccauccucguggccauccugugcauccuggucguguggaucuucaagaacgccgaccgcagcauggagaagaagaagggcgagccccggacccgcgcggaggcccggcccuggguggacgaggaccucaaggacuccagcgaccugcaccaggccgaggaggacgccgacgaguggcaggaguccgaggagaacgucgagcacauccccuucagccacaaccacuaccccgagaaggagauggugaagcgcucccaggaguucuacgagcugcucaacaagcggcgcagcgugcgguucaucuccaacgagcaggucccgauggaggugaucgacaacgugauccgcacggccgggaccgcgcccagcggcgcccacaccgagcccuggaccuucgucguggugaaggaccccgacgucaagcacaagauccggaagaucaucgaggaggaggaggagaucaacuacaugaagcgcauggggcaccggugggugacggaccugaagaagcugcgcaccaacuggaucaaggaguaccucgacaccgccccgauccugauccugaucuucaagcagguccacggcuucgccgcgaacgggaagaagaaggugcacuacuacaacgagaucuccgugagcaucgccugcggcauccuccuggccgcccuccaggugaacaacggcaucaccaugcggcaccagacggcccgccaccggcaccugaucgaggggcccggccgcuccagcgaggcgugcuccaagcugagcucccaggggugccccgagugccggagcggcgacugccacuaccacuccagccagcuguggcccuccaccgagggggccccgggcccgccccgcaccuga

SEQ ID NO: 31771 - RNA, 1131 nt, Artificial Sequence
  derived and/or modified sequence opt1 from IZUMO1__Homo_sapiens__XP_005258850
augagcgugcugcuccuguccgucuggggcgagagcacccugcccaacgggcuccgcgagcugugcgccccggccgcgaugggcccccacuucacccugcucugcgccgcccuggccgggugccugcuccccgccgagggcugcgugaucugcgaccccuccgugguccuggcgcucaagagccuggagaaggacuaccugccggggcaccuggacgccaagcaccacaaggccaugauggagcggguggagaacgccgugaaggacuuccaggagcucucccugaacgaggacgcguacaugggcgucguggacgaggccacgcugcagaagggcagcuggucccuccugaaggaccugaagcgcaucaccgacagcgacgugaagggggaccucuucgucaaggagcuguucuggaugcugcaccuccagaaggagaccuucgccaccuacguggcccgguuccagaaggaggccuacugccccaacaagugcggcgugaugcugcagacgcugaucuggugcaagaacugcaagaaggagguccacgcgugccgcaaguccuacgacugcggggagcggaacguggaggugccccagauggaggacaugauccucgacugcgagcugaacuggcaccaggccagcgagggccugaccgacuacuccuucuaccgcgucugggggaacaacaccgagacccucgugagcaagggcaaggaggccacgcugaccaagcccauggugggcccggaggacgccggguccuaccggugcgagcugggcagcgucaacuccagccccgccaccaucaucaacuuccacgugaccgugcuccccaagaugaucaaggaggagaagcccuccccgaacaucgucacgcccggggaggcgaccaccgagagcuccaucagccugcagccccugcagcccgagaagaugcucgccagccgccugcugggccuccugaucugcggcucccuggcccucaucaccgggcugacguucgccaucuuccggcgccggaaggugaucgacuucaucaagagcucccuguucggccucgggagcggcgccgcggagcagacccaggugccgaaggagaaggccaccgacucccgccagcaguga

SEQ ID NO: 31772 - RNA, 2493 nt, Artificial Sequence
  derived and/or modified sequence opt1 from JADE1__Homo_sapiens__NP_001274366
augaagcgcggccggcugcccagcuccagcgaggacuccgacgacaacgggagccucuccaccaccuggagccagaacucccgcagccagcaccggcgcuccagcugcucccggcacgaggaccgcaagccgagcgagguguuccggacggaccugaucaccgccaugaagcugcacgacuccuaccagcucaaccccgacgaguacuacguccuggccgaccccuggcgccaggagugggagaagggcguccaggugcccgugagcccggggaccaucccccagcccguggcgcggcccaagaaguacaucguguccagcggcuccgagccgcccgagcugggguacgucgacauccgcacccucgccgacagcgugugccgguacgaccugaacgacauggacgccgccuggcuggagcucacgaacgaggaguucaaggagaugggcaugcccgagcuggacgaguacaccauggagcgcgugcuggaggaguucgagcagcggugcuacgacaacaugaaccacgccaucgagaccgaggagggccucgggaucgaguacgacgaggacgucgugugcgacgugugccagucccccgacggcgaggacgggaacgagauggucuucugcgacaagugcaacaucugcgugcaccaggcgugcuacggcauccugaaggugccggaggggagcuggcugugccggaccugcgcccucggcguccagcccaagugccugcugugccccaagaagggcggggccaugaagcccacgcgcagcggcaccaagugggugcacguguccugcgcccucuggaucccggaggucagcaucgggucccccgagaagauggagcccaucaccaaggugagccacauccccuccagccgcugggcgcuggugugcucccugugcaacgagaaguucggcgccagcauccagugcuccgucaagaacugccggaccgccuuccacgugacgugcgccuucgaccgcggccucgagaugaagaccauccuggccgagaacgacgaggugaaguucaagagcuacugcccgaagcacuccagccaccggaagcccgaggagucccuggggaagggcgcggcccaggagaacggggcccccgagugcagcccccgcaacccgcucgagcccuucgccucccuggagcagaaccgggaggaggcccaccgcgucagcgugcgcaagcagaagcugcagcagcucgaggacgaguucuacaccuucgucaaccugcuggacguggcgcgggcccuccgccugcccgaggagguggucgacuuccuguaccaguacuggaagcucaagcggaaggugaacuucaacaagccccugaucaccccgaagaaggacgaggaggacaaccuggccaagcgcgagcaggacgugcuguuccggcgccugcagcuguucacgcaccuccggcaggaccuggagcgcguccggaaccugaccuacauggugacccgccgggagaagaucaagcgcuccgugugcaagguccaggagcagaucuucaaccucuacaccaagcugcuggagcaggagcgggugagcggcgugcccuccagcugcagcuccagcucccucgagaacaugcugcuguucaacagccccuccgucgggccggacgcccccaagaucgaggaccucaaguggcacagcgccuucuuccgcaagcagaugggcacgucccuggugcacagccugaagaagccccacaagcgggacccccugcagaacuccccgggcagcgaggggaagacccuccugaagcagcccgaccugugcggccgccgggaggggauggugguccccgaguccuuccucggccuggagaagaccuucgcggaggcccgccugaucagcgcccagcagaagaacgggguggugaugcccgaccacggcaagcggcgcgacaaccgcuuccacugcgaccucaucaagggcgaccugaaggacaaguccuucaagcagagccacaagccgcugcgguccaccgacgucagccagcgccaccucgacaacacgcgggccgccaccucccccggggugggccagagcgcgcccgggacccgcaaggagaucgugcccaagugcaacggcagccugaucaaggucaacuacaaccagaccgccgugaaggugccgacgacccccgccucccccgucaagaacuggggcggguuccggauccccaagaagggcgagcgccagcagcagggggaggcccacgacggcgcgugccaccagcacagcgacuacccguaccuggggcucggccgggugcccgccaaggagcgcgccaaguccaagcucaagagcgacaacgagaacgacggcuacgugcccgacgucgagauguccgacagcgaguccgaggccagcgagaagaagugcauccacaccuccagcaccaucucccggcgcacggacaucauccggcgcagcauccuggccuccuga

SEQ ID NO: 31773 - RNA, 2553 nt, Artificial Sequence
  derived and/or modified sequence opt1 from JADE2__Homo_sapiens__NP_001276914
auggugcccaccgccgccaucgcggucggcggguacuuccugggcgggauggaggagaagcgccggaaguacagcaucuccagcgacaacuccgacaccacggacagccacgccaccuccaccagcgccucccgcugcagcaagcucccguccagcaccaaguccggcuggccccggcagaacgagaagaagcccagcgagguguuccgcacggaccugaucaccgccaugaagauccccgacuccuaccagcugagcccggacgacuacuacauccucgccgaccccuggcggcaggagugggagaagggggugcagguccccgcgggcgccgaggccauccccgagccgguggugcgcauccugcccccccuggagggccccccggcccaggcgucccccagcuccaccaugcucggggagggcagccagcccgacuggcccgggggcucccgguacgaccuggacgagaucgacgccuacuggcuggagcucaucaacagcgagcugaaggagauggagcgcccggagcuggacgagcucacccuggagcggguccuggaggagcucgagacgcugugccaccagaacauggcccgcgccaucgagacccaggaggggcugggcaucgaguacgacgaggacguggugugcgacgucugccggagccccgagggcgaggacgggaacgagaugguguucugcgacaagugcaacgugugcguccaccaggccugcuacggcauccucaaggugcccaccggguccuggcugugccgcaccugcgcgcugggcgugcagcccaagugccuccugugcccgaagcggggcggggcccugaagcccacgcgcagcggcaccaaguggguccacguguccugcgcccucuggauccccgaggugagcaucgggugccccgagaagauggagccgaucaccaagaucucccacauccccgccagccggugggcccuguccugcagccugugcaaggagugcaccggcacgugcauccagugcuccaugcccagcugcgucaccgcguuccacgugaccugcgccuucgaccacgggcucgagaugcgcaccauccuggccgacaacgacgaggugaaguucaaguccuucugccaggagcacagcgacggcggcccccggaacgagccgacguccgagcccaccgagcccagccaggccggggaggaccuggagaaggucacccuccgcaagcagcggcugcagcagcuggaggaggacuucuacgagcucguggagccggccgagguggcggagcgccuggaccuggccgaggcccucgucgacuucaucuaccaguacuggaagcugaagcggaaggccaacgccaaccagccccugcucacccccaagacggacgagguggacaaccuggcgcagcaggagcaggacguccuguaccgccgccucaagcuguucacccaccugcggcaggaccucgagcgcgugcggaaccugugcuacauggugacccgccgggagcgcaccaagcacgccaucugcaagcugcaggagcagaucuuccaccuccagaugaagcugaucgagcaggaccugugccgggagcgcuccggccggcgcgccaaggggaagaagagcgacuccaagcggaagggcugcgaggggagcaagggcuccacggagaagaaggagaaggucaaggccggccccgacagcgugcuggggcagcucgcgggccugagcaccuccuucccgaucgacgggaccuucuucaacagcuggcuggcccaguccgugcagaucaccgccgagaacauggccaugagcgaguggccccucaacaacggccaccgcgaggaccccgcccccgggcugcuguccgaggagcuccugcaggacgaggagacgcugcucagcuucaugcgggacccgucccugcgccccggcgaccccgcgcggaaggcccgcggccggacccgccugcccgccaagaagaagccgcccccccccccgccccaggacgggcccggcagccggaccacccccgacaaggccccgaagaagacgugggggcaggacgccggcuccggcaaggggggccaggggccccccacccgcaagcccccgcgccggaccagcucccaccuccccagcucccccgcggccggcgacugcccgauccuggccacccccgagagcccccccccgcuggcccccgagacccccgacgaggccgcguccgucgccgccgacagcgacgugcaggugcccgggccggccgcgucccccaagccccucggccgccugcggcccccgcgcgagagcaaggucacgcggcgccugcccggcgcccggcccgacgccgggaugggccccccgagcgccguggccgagcgccccaaggugucccuccacuucgacaccgagaccgacggguacuucagcgacggcgagauguccgacagcgacgucgaggcggaggacgggggcgugcagcggggcccccgcgaggccggggccgaggaggugguccggaugggcgugcuggccuccuga

SEQ ID NO: 31774 - RNA, 3657 nt, Artificial Sequence
  derived and/or modified sequence opt1 from JAG1__Homo_sapiens__NP_000205
augcgcagcccccggacccgcggccgguccgggcgcccgcugagccuccugcuggcccuccugugcgcccugcgggcgaaggugugcggcgccuccgggcaguucgagcucgagauccugagcaugcagaacgucaacggcgagcugcagaacgggaacugcugcggcggcgcccgcaaccccggggaccggaagugcacccgcgacgagugcgacacguacuucaaggugugccucaaggaguaccagucccgggugaccgccggcgggcccugcagcuucggcuccgggagcacccccgucaucggcggcaacaccuucaaccugaaggccucccgcgggaacgaccggaaccgcaucgugcugccguucagcuucgcguggccccgguccuacacgcuccugguggaggccugggacagcuccaacgacaccguccagcccgacagcaucaucgagaaggccucccacagcggcaugaucaaccccucccgccaguggcagacccugaagcagaacaccgggguggcccacuucgaguaccagauccgggugacgugcgacgacuacuacuacggcuucggcugcaacaaguucugccgcccgcgggacgacuucuucgggcacuacgcgugcgaccagaacggcaacaagaccugcauggagggguggaugggccccgagugcaaccgcgccaucugccggcaggggugcagccccaagcacggcuccugcaagcuccccggcgacugccgcugccaguacggguggcagggccuguacugcgacaagugcaucccgcaccccgggugcguccacggcaucugcaacgagcccuggcagugccugugcgagaccaacuggggcgggcagcucugcgacaaggaccugaacuacugcggcacccaccagcccugccugaacgggggcacgugcagcaacaccgggccggacaaguaccagugcagcugccccgagggcuacuccgggcccaacugcgagaucgccgagcacgccugccucagcgaccccugccacaaccggggcuccugcaaggagaccagccugggcuucgagugcgagugcuccccgggguggaccggccccacgugcagcaccaacaucgacgacugcucccccaacaacugcagccacgggggcacgugccaggaccuggugaacggcuucaagugcgugugcccgccccaguggaccgggaagaccugccagcucgacgccaacgagugcgaggcgaagcccugcgucaacgccaaguccugcaagaaccugaucgccagcuacuacugcgacugccugcccggcuggauggggcagaacugcgacaucaacaucaacgacugccucggccagugccagaacgacgccuccugccgcgaccuggugaacggguaccgcugcaucugcccgcccggcuacgccggcgaccacugcgagcgggacaucgacgagugcgcgagcaaccccugccugaacgggggccacugccagaacgagaucaaccgcuuccagugccucugccccaccggguucuccggcaaccugugccagcuggacaucgacuacugcgagccgaaccccugccagaacggggcccagugcuacaaccgggccagcgacuacuucugcaagugccccgaggacuacgagggcaagaacugcucccaccucaaggaccacugccgcaccacccccugcgaggugaucgacagcugcacggucgccauggccuccaacgacaccccggagggcgugcgguacaucagcuccaacgugugcgggccccacggcaagugcaagagccagagcgggggcaaguucacgugcgacugcaacaagggguucaccggcaccuacugccacgagaacaucaacgacugcgaguccaaccccugccgcaacggcgggaccugcaucgacggcgucaacagcuacaagugcaucugcuccgacgggugggagggcgcguacugcgagaccaacaucaacgacugcagccagaaccccugccacaacgggggcacgugccgggaccuggugaacgacuucuacugcgacugcaagaacggcuggaaggggaagaccugccacucccgcgacagccagugcgacgaggcgaccugcaacaacggcgggaccugcuacgacgagggcgacgccuucaagugcaugugcccgggcgggugggagggcaccacgugcaacaucgcccggaacuccagcugccugcccaaccccugccacaacgggggcacgugcguggucaacggggaguccuucacgugcgugugcaaggagggcugggagggccccaucugcgcccagaacaccaacgacugcagcccgcaccccugcuacaacuccgggaccugcguggacggcgacaacugguaccgcugcgagugcgcccccggguucgccggccccgacugccggaucaacaucaacgagugccagagcuccccgugcgccuucggggcgaccugcgucgacgagaucaacggcuaccgcugcgugugcccgcccggccacagcggggccaagugccaggaggucuccggccggcccugcaucaccauggggagcgugauccccgacggcgccaagugggacgacgacugcaacacgugccagugccucaacgggcgcaucgccugcuccaagguguggugcggcccccggcccugccugcugcacaagggccacagcgagugccccagcgggcaguccugcaucccgauccucgacgaccagugcuucguccaccccugcaccggcgugggggagugccgcagcuccagccugcagcccgugaagaccaagugcaccuccgacagcuacuaccaggacaacugcgccaacaucaccuucaccuucaacaaggagaugauguccccgggccugaccaccgagcacaucugcagcgagcuccggaaccugaacauccugaagaacgucuccgccgaguacagcaucuacaucgcgugcgagcccucccccagcgccaacaacgagauccacguggccaucuccgccgaggacauccgcgacgacggcaaccccaucaaggagaucaccgacaagaucaucgaccucgugagcaagcgggacgggaacuccagccugaucgccgcggucgccgaggugcgcgugcagcgccggccgcugaagaaccgcaccgacuuccucgucccccugcuguccagcgugcugacgguggccuggaucugcugccucgucaccgccuucuacuggugccugcggaagcgccggaagcccggcucccacacccacagcgccagcgaggacaacaccacgaacaacgugcgcgagcagcugaaccagaucaagaaccccaucgagaagcacggggcgaacaccgugccgaucaaggacuacgagaacaagaacuccaagaugagcaagauccggacccacaacuccgaggucgaggaggacgacauggacaagcaccagcagaaggcccgcuucgccaagcagcccgccuacacccucguggaccgggaggagaagccgcccaacggcacgcccaccaagcaccccaacuggaccaacaagcaggacaaccgcgaccuggagagcgcgcagucccugaaccggauggaguacaucguguga

SEQ ID NO: 31775 - RNA, 3717 nt, Artificial Sequence
  derived and/or modified sequence opt1 from JAG2__Homo_sapiens__NP_002217
augcgcgcccagggccgggggcgccugccccggcgccuccugcugcuccuggcccugugggugcaggcggcccggccgaugggcuacuucgagcuccagcugagcgcccugcgcaacgucaacggggagcuccuguccggcgccugcugcgacggggacggccggaccacccgcgccggcgggugcggccacgacgagugcgacacguacgugcgggugugccugaaggaguaccaggcgaaggucacccccaccgggcccugcagcuacggccacggggccacccccgugcucggcggcaacuccuucuaccugccgcccgccggggccgcgggcgaccgcgcccgggcccgcgcccgggccgggggcgaccaggaccccggccugguggucauccccuuccaguucgcguggccgcgcagcuucacgcucaucguggaggccugggacugggacaacgacaccacccccaacgaggagcugcugaucgagcgggugucccacgccgggaugaucaaccccgaggaccgcuggaagucccuccacuucuccggccacgucgcccaccuggagcugcagauccgggugcgcugcgacgagaacuacuacagcgcgaccugcaacaaguucugccggccccgcaacgacuucuucgggcacuacacgugcgaccaguacggcaacaaggcgugcauggacggguggaugggcaaggagugcaaggaggccgugugcaagcagggcugcaaccuccugcacgggggcugcaccgucccgggggagugccggugcuccuacggcuggcaggggcgcuucugcgacgagugcgugcccuaccccggcugcgugcacggcagcugcgucgagcccuggcagugcaacugcgagaccaacuggggcgggcugcucugcgacaaggaccugaacuacugcgggucccaccacccgugcaccaacggcgggacgugcaucaacgccgagcccgaccaguaccgcugcacgugccccgacggcuacagcggccggaacugcgagaaggccgagcacgccugcaccuccaaccccugcgcgaacgggggcagcugccacgaggugccguccggguucgagugccacugccccagcggcugguccggcccgaccugcgcccuggacaucgacgagugcgccagcaaccccugcgccgccgggggcacgugcguggaccaggucgacggguucgagugcaucugcccggagcagugggugggcgcgaccugccagcucgacgccaacgagugcgaggggaagcccugccugaacgccuucagcugcaagaaccugaucggcggcuacuacugcgacugcauccccggguggaagggcaucaacugccacaucaacgugaacgacugccgcgggcagugccagcacggcgggaccugcaaggaccucgucaacggcuaccagugcgugugcccccggggcuucgggggccgccacugcgagcuggagcgggacgagugcgccagcagccccugccacuccgggggccugugcgaggaccucgccgacggguuccacugccacugcccccagggcuucagcggcccccugugcgagguggacgucgaccugugcgagccgucccccugccgcaacggggcccggugcuacaaccucgagggcgacuacuacugcgccugccccgacgacuucgggggcaagaacugcagcgugccccgcgagccgugccccgggggcgccugccgggucaucgacggcugcggguccgacgccggccccgggaugcccggcaccgcggccagcggcgugugcgggccgcacggccgcugcgugucccagcccgggggcaacuucagcugcaucugcgacuccggguucaccggcaccuacugccacgagaacaucgacgacugccugggccagcccugccggaacggcgggaccugcaucgacgaggucgacgccuuccgcugcuucugccccagcgggugggagggcgagcugugcgacaccaacccgaacgacugccuccccgaccccugccacucccgggggcgcugcuacgaccuggugaacgacuucuacugcgccugcgacgacggcuggaagggcaagacgugccacagccgggaguuccagugcgacgccuacacgugcuccaacggcgggaccugcuacgacagcggggacaccuuccgcugcgcgugcccgcccggcuggaagggguccacgugcgccguggccaagaacagcuccugccugcccaaccccugcgucaacggcgggaccugcgugggcagcggcgccuccuucagcugcaucugccgggacgggugggagggccggaccugcacccacaacaccaacgacugcaacccccucccgugcuacaacggcgggaucugcguggacggcgucaacugguuccgcugcgagugcgcccccggguucgcgggccccgacugccgcaucaacaucgacgagugccagagcucccccugcgccuacggggcgaccugcguggacgagaucaacggcuaccgcugcagcugcccgcccggccgggccgggccccgcugccaggaggugaucggcuucgggcgguccugcuggagccgcggcaccccguucccccacggguccagcugggucgaggacugcaacuccugccggugccuggacggccgccgggacugcagcaagguguggugcggcuggaagcccugccugcucgccgggcagcccgaggcccuguccgcccagugcccgcugggccagcgcugccucgagaaggcccccgggcagugccugcggccgcccugcgaggccuggggcgagugcggggcggaggagccgcccagcacccccugccugccccgcuccggccaccuggacaacaacugcgcccggcucacgcugcacuucaaccgcgaccacgugccccagggcaccaccgucggggccaucugcagcggcauccggucccugcccgccacccgcgccguggcgcgggaccgccuccuggugcugcucugcgaccgggccagcuccggggccagcgccgucgagguggccguguccuucagccccgcgcgcgaccugcccgacagcucccugauccagggcgccgcccacgccaucgucgcggccaucacccagcgggggaacagcucccuccugcuggccgugacggaggugaaggucgagaccguggugaccggcggcagcuccaccgggcuccuggucccggugcugugcggcgccuucagcgugcucuggcuggccugcgucgugcugugcgugugguggacgcgcaagcggcgcaaggagcgcgagcggucccgccucccccgggaggagagcgcgaacaaccagugggcgccccugaaccccauccgcaacccgaucgagcggcccgggggccacaaggacguccuguaccagugcaagaacuucaccccgccgccccgccgggccgacgaggcccuccccggccccgccgggcacgccgccgugcgcgaggacgaggaggacgaggaccugggccgcggggaggaggacucccuggaggccgagaaguuccucagccacaaguucaccaaggaccccggccggucccccgggcggcccgcccacugggccagcggccccaagguggacaaccgcgcgguccgguccaucaacgaggcccgcuacgccggcaaggaguga

SEQ ID NO: 31776 - RNA, 552 nt, Artificial Sequence
  derived and/or modified sequence opt1 from JAGN1__Homo_sapiens__NP_115881
auggccagccgcgccggcccccgggcggccgggaccgacggcuccgacuuccagcaccgcgagcggguggccaugcacuaccagaugagcgugacccugaaguacgagaucaagaagcucaucuacgugcaccuggugaucuggcugcuccuggucgccaagauguccguggggcaccuccgccugcugagccacgaccagguggccaugccguaccagugggaguaccccuaccugcucuccauccugcccagccugcucggccugcuguccuucccccggaacaacaucagcuaccucguccuguccaugaucagcauggggcuguucuccaucgcgccgcucaucuacggcagcauggagauguuccccgccgcccagcagcuguaccgccacggcaaggccuaccgguuccuguucggguucuccgcggugagcaucauguaccucgugcugguccuggccguccaggugcacgccuggcagcucuacuacuccaagaagcugcuggacagcugguucacguccacccaggagaagaagcacaaguga

SEQ ID NO: 31777 - RNA, 3399 nt, Artificial Sequence
  derived and/or modified sequence opt1 from JAK2__Homo_sapiens__NP_004963
augggcauggccugccugaccaugaccgagauggaggggacgagcaccuccagcaucuaccagaacggcgacaucuccgggaacgccaacagcaugaagcagaucgaccccgugcuccaggucuaccuguaccacucccugggcaagagcgaggcggacuaccucaccuucccguccggggaguacguggccgaggagaucugcaucgccgccagcaaggccugcggcaucacccccguguaccacaacauguucgcgcugauguccgagacggagcgcaucugguacccgcccaaccacgucuuccacaucgacgagagcacccggcacaacgugcuguaccgcauccgguucuacuucccccgcugguacugcuccggcagcaaccgggccuaccgccacgggaucucccggggcgccgaggcgccccuccuggacgacuucgugaugagcuaccuguucgcccaguggcgccacgacuucguccacggguggaucaaggugcccgugacccacgagacccaggaggagugccucggcauggccguccuggacaugaugcggaucgccaaggagaacgaccagacgccccuggccaucuacaacuccaucagcuacaagaccuuccucccgaagugcauccgcgccaagauccaggacuaccacauccugacccggaagcgcauccgguaccgcuuccggcgcuucauccagcaguucucccagugcaaggcgaccgcccggaaccugaagcucaaguaccugaucaaccuggagacgcuccagagcgccuucuacaccgagaaguucgaggugaaggagcccggguccggccccagcggcgaggagaucuucgccaccaucaucaucaccgggaacggcgggauccaguggagccgcggcaagcacaaggaguccgagacgcugaccgagcaggaccugcagcucuacugcgacuuccccaacaucaucgacgugagcaucaagcaggccaaccaggagggcuccaacgagagccgggucgugaccauccacaagcaggacgggaagaaccuggagaucgagcuguccagccuccgcgaggcgcuguccuucgugagccugaucgacggcuacuaccggcucaccgccgacgcccaccacuaccugugcaaggaggucgccccgcccgccgugcuggagaacauccaguccaacugccacgggcccaucagcauggacuucgcgaucuccaagcucaagaaggccggcaaccagacggggcuguacgugcugcgcugcagccccaaggacuucaacaaguacuuccucaccuucgccgucgagcgcgagaacgugaucgaguacaagcacugccugaucaccaagaacgagaacgaggaguacaaccuguccggcaccaagaagaacuucagcucccucaaggaccugcugaacugcuaccagauggagacggugcggagcgacaacaucaucuuccaguucaccaagugcugcccgcccaagcccaaggacaaguccaaccuccuggucuuccgcaccaacggcgugagcgacgugcccaccuccccgacgcugcagcggcccacccacaugaaccagauggucuuccacaagauccgcaacgaggaccucaucuucaacgagagccuggggcagggcaccuucaccaagaucuucaagggggugcggcgcgaggucggcgacuacgggcagcugcacgagacggaggugcuccugaaggugcuggacaaggcccaccggaacuacagcgaguccuucuucgaggccgcgagcaugauguccaagcucagccacaagcaccugguccugaacuacggcgugugcgugugcggcgacgagaacauccugguccaggaguucgugaaguucgggucccucgacaccuaccugaagaagaacaagaacugcaucaacauccuguggaagcucgagguggccaagcagcuggccugggccaugcacuuccuggaggagaacacccucauccacggcaacgucugcgcgaagaacauccugcugauccgcgaggaggaccggaagaccgggaacccgcccuucaucaagcucagcgaccccggcaucuccaucacggugcugcccaaggacauccugcaggagcgcauccccugggugcccccggagugcaucgagaaccccaagaaccucaaccuggccaccgacaaguggagcuucgggaccacccugugggagaucugcuccggcggcgacaagccccucagcgcccuggacucccagcggaagcugcaguucuacgaggaccgccaccagcucccggcccccaagugggccgagcuggcgaaccugaucaacaacugcauggacuacgagcccgacuuccggcccagcuuccgcgccaucauccgggaccucaacucccuguucaccccggacuacgagcugcucacggagaacgacaugcugcccaacaugcgcaucggggcccugggcuucagcggggccuucgaggaccgggaccccacccaguucgaggagcgccaccucaaguuccugcagcagcugggcaagggcaacuucggguccgucgagaugugccgguacgacccccuccaggacaacaccggcgaggugguggccgucaagaagcugcagcacagcaccgaggagcaccuccgcgacuucgagcgcgagaucgagauccugaagucccugcagcacgacaacaucgugaaguacaagggggugugcuacagcgcgggccggcgcaaccugaagcucaucauggaguaccugccguacgggagccugcgggacuaccuccagaagcacaaggagcgcaucgaccacaucaagcugcugcaguacacgucccagaucugcaagggcauggaguaccucggcaccaagcgguacauccaccgcgaccuggccacccggaacauccuggucgagaacgagaaccgcgugaagaucggggacuucggccucaccaaggugcugccccaggacaaggaguacuacaaggucaaggagcccggggagagccccaucuucugguacgccccggagucccugacggagagcaaguucuccguggccagcgacgugugguccuucggcgucgugcucuacgagcuguucaccuacaucgagaaguccaagagcccgcccgccgaguucaugcggaugaucgggaacgacaagcagggccagaugaucguguuccaccugaucgagcuccugaagaacaacggccgccugccccggcccgacgggugccccgacgagaucuacaugaucaugaccgagugcuggaacaacaacgucaaccagcgccccagcuuccgggaccucgcgcugcgcguggaccagauccgggacaacauggccggcuga

SEQ ID NO: 31778 - RNA, 3504 nt, Artificial Sequence
  derived and/or modified sequence opt1 from JAK3__Homo_sapiens__XP_005259953
augaccguggcccaggagaccaagggccccacgcaggagggggccgagugggacuucccgcuggcggccagccgccucugcccgcccuucgagucccccggcagccugcccgcccggcaggucgcccugauggccccgcccuccgaggagacgccccucaucccccagcgcagcugcucccugcugagcaccgaggcgggggcccuccacgugcugcugcccgcccggggccccgggcccccgcagcgccucuccuucagcuucggcgaccaccuggccgaggaccugugcgugcaggcggccaaggccuccggcauccuccccgucuaccacagccuguucgcccuggccaccgaggaccucuccugcugguucccgcccagccacaucuucuccguggaggacgcgagcacccaggugcugcuguaccggauccgcuucuacuuccccaacugguucgggcucgagaagugccaccgguucggccugcgcaaggaccuggccuccgccauccucgaccugcccguccuggagcaccucuucgcccagcaccggagcgaccugguguccgggcgccugcccgugggccucagccugaaggagcagggggagugccugucccucgccguccuggaccuggcgcggauggcccgcgagcaggcccagcggcccggcgagcuccugaagaccgugagcuacaaggccugccugccgcccagccuccgcgaccugauccagggccuguccuucgugacccggcgccggauccgccggaccguccgccgggcccuccgccgcguggcggccugccaggccgaccggcacagccugauggccaaguacaucauggaccuggagcgccucgaccccgccggggcggccgagacguuccacgugggccugcccggggcccugggcggccacgacgggcucggccugcugcgggucgccggggacggcgggaucgcguggacccagggcgagcaggaggugcuccagccguucugcgacuuccccgagaucguggacaucuccaucaagcaggcgccccgcgucggccccgccggggagcaccggcuggugaccgugacccgcacggacaaccagauccuggaggccgaguucccgggccugcccgaggcccucagcuucgucgcccugguggacggguacuuccggcugaccaccgacucccagcacuucuucugcaaggagguggcgcccccgcgccuccuggaggaggucgccgagcagugccacggccccaucacccuggacuucgccaucaacaagcucaagaccgggggcagccggcccggcuccuacgugcugcgccggagcccccaggacuucgacuccuuccugcucacggucugcgugcagaacccgcuggggcccgacuacaagggcugccugauccgccggagccccaccgggaccuuccuccuggugggccugucccgcccccacagcucccuccgggagcugcuggccacgugcugggacgggggccuccacgucgacggcguggccgugacccugaccagcugcugcaucccgcgccccaaggagaaguccaaccugaucgucgugcagcgggggcacagcccgcccaccuccagccucgugcagccccagucccaguaccagcugagccagaugacguuccacaagauccccgccgacagccuggaguggcacgagaaccucggccacggguccuucaccaagaucuaccgcggcugccggcacgaggucguggacggcgaggcccgcaagaccgaggugcugcugaaggucauggacgccaagcacaagaacugcauggagagcuuccucgaggccgcgucccugaugagccagguguccuaccgccaccuggugcuccugcacggggucugcauggccggcgacagcaccauggugcaggaguucgugcaccugggggccaucgacauguaccuccggaagcgcggccaccugguccccgccuccuggaagcuccagguggugaagcagcuggcguacgcccugaacuaccuggaggacaaggggcucccccacggcaacgucagcgcccggaaggugcugcuggcccgcgagggcgccgacggguccccgcccuucaucaagcucagcgaccccggcgugucccccgcgguccugagccuggagaugcucacggaccggaucccguggguggcccccgagugccugcgcgaggcccagacccugucccucgaggccgacaaguggggguucggcgccaccgugugggaggucuucagcggggugaccaugcccaucuccgcgcuggaccccgccaagaagcugcaguucuacgaggaccggcagcagcucccggcccccaaguggacggagcuggcccugcucauccagcagugcauggccuacgagcccgugcagcgcccgagcuuccgggcggucauccgcgaccugaacucccugaucagcagcgacuacgagcuccuguccgaccccacccccggcgcccuggcgccccgggacggccucuggaacggggcccagcuguacgccugccaggacccgaccaucuucgaggagcgccaccugaaguacaucagccagcucggcaaggggaacuucggcuccguggagcugugccgguacgacccccugggggacaacaccggcgcccucguggccgucaagcagcugcagcacagcggccccgaccagcagcgcgacuuccagcgggagauccagauccugaaggcccuccacuccgacuucaucgugaaguaccgcggggugagcuacggccccgggcggcagucccugcgccuggucauggaguaccucccgagcggcugccugcgggacuuccugcagcgccaccgggcccgccucgacgcgucccgccugcugcucuacagcucccagaucugcaaggggauggaguaccugggcagccggcgcugcgugcaccgggaccuggccgcccgcaacauccucguggaguccgaggcccacgucaagaucgccgacuucggccuggcgaagcugcucccccuggacaaggacuacuacguggugcgggagcccgggcagagccccaucuucugguacgccccggagucccugagcgacaacaucuucucccgccagagcgacgucugguccuucggcguggugcucuacgagcuguucacguacugcgacaagagcugcagccccuccgccgaguuccugcggaugauggggugcgagcgcgacguccccgcccucugccggcugcuggagcuccuggaggagggccagcgccugcccgccccgcccgcgugccccgccgaggugcacgagcugaugaagcucugcugggcccccagcccgcaggaccggcccuccuucagcgcccugggcccccagcuggacaugcucugguccgggagccgcggcugcgagacccacgccuucaccgcgcaccccgaggggaagcaccacucccugagcuucuccuga

SEQ ID NO: 31779 - RNA, 2496 nt, Artificial Sequence
  derived and/or modified sequence opt1 from JAKMIP1__Homo_sapiens__NP_001092903
augagcaagaagggccgcuccaagggggagaagcccgagauggagaccgacgccgugcagauggccaacgaggagcugcgggcgaagcucaccagcauccagaucgaguuccagcaggagaaguccaaggucggcaagcugcgcgagcggcugcaggaggccaagcucgagcgcgagcaggagcagcggcgccacacggccuacaucagcgagcugaaggccaagcugcacgaggagaagaccaaggagcuccaggcccugcgggaggggcugauccgccagcacgagcaggaggcggcccggaccgccaagaucaaggagggcgagcuccagcgccugcaggccacccugaacgugcuccgggacggggcggccgacaaggugaagacggcccugcugaccgaggcccgcgaggaggcccggcgcgcguucgacggcgagcggcuccgccugcagcaggagauccuggagcucaaggccgcccggaagcaggccgaggaggcccuguccaacugcaugcaggcggacaagaccaaggccgccgaccugcgcgccgccuaccaggcgcaccaggacgagguccaccggaucaagcgcgagugcgagcgggacauccgccgccucauggacgagaucaagggcaaggaccgggugauccuggcccuggagaaggagcucggggugcaggccggccagacccagaagcugcugcuccagaaggaggcccuggacgagcagcugguccaggugaaggaggccgagcgccaccacagcuccccgaagcgggagcucccgcccgggaucggcgacaugguggagcugauggggguccaggaccagcacauggacgagcgcgacgugcggcgcuuccagcugaagaucgcggagcucaacagcgugauccggaagcuggaggaccgcaacacgcugcucgccgacgagcggaacgagcugcugaagcgcucccgggagaccgagguccagcucaagccccugguggagaagaacaagcgcaugaacaagaagaacgaggaccugcuccagagcauccagcggauggaggagaagaucaagaaccugacccgcgagaacguggagaugaaggagaagcuguccgcccaggccagccucaagcggcacaccucccugaacgaccugagccucacgcgcgacgagcaggagaucgaguuccugcggcugcagguccuggagcagcagcacgugaucgacgaccucucccuggagcgcgagcggcugcuccgcagcaagcgccaccggggcaagucccugaagccgcccaagaagcacguggucgagaccuucuucggcuucgacgaggagagcguggacuccgagacccugagcgagaccagcuacaacacggaccgcaccgaccggacccccgcgacccccgaggaggaccucgacgacgccacggcccgcgaggaggccgaccugcgguucugccagcugacccgcgaguaccaggcccuccagcgggcguacgcccugcugcaggagcaggucgggggcacccucgacgccgagcgcgaggcccggacccgcgagcagcugcaggccgaccugcuccggugccaggcgaagaucgaggaccuggagaagcugcucguggagaaggggcaggacuccaaguggguggaggagaagcagcugcugauccgcacgaaccaggaccuccuggagaagaucuaccggcuggagauggaggagaaccagcucaagaacgagaugcaggacgccaaggaccagaacgagcugcuggaguuccgcgugcucgagcuggaggagcgggagcgccggagccccgccuucaaccugcagaucaccaccuuccccgagaaccacuccagcgcccuccagcuguucugccaccaggagggcgucaaggacgugaacgucuccgagcugaugaagaagcucgacauccugggcgacaacgggaaccugcgcaacgaggagcaggucgccaucauccaggcgggcaccgugcucgcccugugcgagaaguggcugaagcagaucgaggggacggaggccgcccucacccagaagaugcuggaccuggagaaggagaaggaccucuucagccggcagaagggcuaccuggaggaggagcuggacuaccgcaagcaggcgcucgaccaggccuaccugaagauccaggaccuggaggccacccucuacaccgcccugcagcaggagcccgggcggcgcgccggcgaggcgcuguccgagggccagcgcgaggaccuccaggccgccguggagaaggugcggcgccagauccugcggcagagccgcgaguucgacucccagauccugcgggagcgcauggagcuccugcagcaggcccagcagcggauccgcgagcuggaggacaagcucgaguuccagaagcggcaccugaaggagcuggaggagaaguuccucuuccuguuccuguucuucagccucgccuucauccuguggcccuga

SEQ ID NO: 31780 - RNA, 2400 nt, Artificial Sequence
  derived and/or modified sequence opt1 from JAKMIP2__Homo_sapiens__NP_001257863
augagcaagaagggccgcaacaagggggagaagcccgaggcccugaucguggcccuccaggcggccaacgaggaccugcggaccaagcugaccgacauccagaucgagcuccaccaggagaaguccaaggucagcaagcuggagcgcgagaagacgcaggaggccaagcggauccgcgagcuggagcagcggaagcacaccgugcucgugaccgagcugaaggccaagcugcacgaggagaagaugaaggagcuccaggccguccgcgagaaccugaucaagcagcacgagcaggagaugucccggaccgugaaggugcgcgacggcgagauccagcggcucaagagcgcgcucugcgcccugcgcgacggguccagcgacaagguccggacggcccugaccaucgaggcccgcgaggaggcgcggaagcuguucgacaccgagcgccugaagcugcuccaggagaucgccgaccugaagaccgccaagaagcaggucgacgaggcccuguccaacaugauccaggccgacaagaucaaggcgggcgaccuccggagcgagcaccagucccaccaggaggccaucagcaagaucaagugggaguccgagcgcgacauccggcgccugauggacgagaucaaggccaaggaccggaucaucuucagccuggagaaggagcucgagacgcagaccggguacgugcagaagcugcagcugcagaaggaggcccucgacgagcagcuguuccuggugaaggaggccgagugcaacauguccagcccgaagcgcgagauccccggccgggcgggcgacggguccgagcacugcagcucccccgaccuccgccgcaaccagaagcggaucgccgagcugaacgccaccauccgcaagcuggaggaccggaacacccuccugggcgacgagcgcaacgagcugcucaagcgggugcgcgagacggagaagcagugcaagccccugcuggagcggaacaagugccucgccaagcgcaacgacgagcugauggugagccugcagcggauggaggagaagcucaaggccgucaccaaggagaacuccgagaugcgcgagaagaucaccagccacccgccccugaagaagcucaagagccugaacgaccuggaccaggcgaacgaggagcaggagaccgaguuccugaagcuccaggugaucgagcagcagaacaucaucgacgagcugacgcgggaccgcgagaagcugauccggcgccggaagcaccgccgguccagcaagcccaucaagcgccccgugcuggacccguucaucggguacgacgaggacuccauggacagcgagaccuccagcauggccuccuuccggaccgaccgcacccccgccacgcccgacgacgaccucgacgagagccuggccgccgaggaguccgagcugcgcuuccggcagcucaccaaggaguaccaggcgcugcagcgcgccuacgcccugcuccaggagcagaccggcgggaucaucgacgccgagcgggaggcgaaggcccaggagcagcugcaggccgagguccugcgcuacaaggccaagaucgaggaccucgaggccacccuggcgcagaagggccagaucgagaagcaggaggccgagaaccaccggcugcagcaggagcuccaggacgcccgcgaccagaacgagcugcuggaguuccggaaccucgagcuggaggagcgcgagcggcgcagcccgcccuucaaccugcagauccaccccuucuccgacggcgugagcgcccuccagaucuacugcaugaaggagggggugaaggacgucaacauccccgaccugaucaagcagcuggacauccucggcgacaacgggaaccugcggaacgaggagcaggucgccaucauccaggcguccacggugcugagccucgccgagaaguggauccagcagaucgagggcgccgaggccgcccugcaccagaagaugauggagcuggaguccgacauggagcaguucugcaagaucaagggcuaccucgaggaggagcuggacuaccgcaagcaggcgcuggaccaggccuacaugcggauccaggagcucgaggccacccuguacaacgcccugcagcaggagaccgugaucaaguucggggagcuccugagcgagaagcagcaggaggagcugcgcaccgcgguggagaagcuccggcgccagaugcugcggaagucccgcgaguacgacugccagauccugcaggagcggauggagcuccugcagcaggcccaccagcgcauccgggaccuggaggacaagacggacauccagaagcgccagaucaaggaccucgaggagaaguuccuguuccuguuccucuucuucagccuggccuucauccuguggcccuga

SEQ ID NO: 31781 - RNA, 2535 nt, Artificial Sequence
  derived and/or modified sequence opt1 from JAKMIP3__Homo_sapiens__XP_011537986
augagcaagcgcggcauguccagccgggccaagggggacaaggccgaggcgcuggccgcccuccaggccgccaacgaggaccugcgcgcgaagcugaccgacauccagaucgagcuccagcaggagaaguccaaggugagcaaggucgagcgggagaagaaccaggagcugcgccaggugcgggagcacgagcagcacaagaccgccgugcugcucacggagcugaagaccaagcugcacgaggagaagaugaaggagcuccaggccguccgcgagacccugcugcggcagcacgaggccgagcuccugcgcgugaucaagaucaaggacaacgagaaccagcggcugcaggcgcuccuguccgcccugcgcgacggcgggcccgagaaggugaagaccguccuccugagcgaggccaaggaggaggccaagaagggcuucgagguggagaaggugaagaugcagcaggagaucuccgagcugaagggggccaagcggcaggucgaggaggcgcucacgcuggugauccaggccgacaagaucaaggccgccgagauccgcagcguguaccaccuccaccaggaggagaucacccggaucaagaaggagugcgagcgcgagauccggcgccucauggaggagaucaaguucaaggaccgggccgucuucgugcuggagcgcgagcugggcgugcaggcgggccacgcccagcggcuccagcugcagaaggaggcccuggacgagcagcucucccagguccgcgaggccgaccggcacccggggagcccccgccgcgagcugccccacgccgcgggcgccggggacgccuccgaccacagcggcucccccgagcagcagcuggacgagaaggacgcccggcgcuuccagcucaagaucgccgagcugagcgcgaucauccggaagcuggaggaccgcaacgcccuccuguccgaggagcggaacgagcugcucaagcgcgugcgggaggccgagagccaguacaagccgcugcuggacaagaacaagcgccucucccggaagaacgaggaccugagccacgcccugcgccggauggagaacaagcucaaguucgugacccaggagaacaucgagaugcgccagcgggcggggaucauccgccggcccuccagccugaacgaccuggaccagagccaggacgagcgcgaggucgacuuccucaagcugcagaucguggagcagcagaaccugaucgacgagcuguccaagacccucgagacggccggcuacgucaagagcgugcuggagcgggacaagcugcuccgcuuccggaagcagcgcaagaagauggccaagcugcccaagcccgugguggucgagaccuucuucggcuacgacgaggaggccucccuggagagcgacggguccagcguguccuaccagaccgaccgcaccgaccagacgccgugcacccccgacgacgaccucgaggagggcauggccaaggaggagaccgagcugcgguuccgccagcugaccauggaguaccaggcgcuccagcgggccuacgcccugcugcaggagcaggucgggggcacgcucgacgccgagcgcgaggugaagacccgggagcagcugcaggccgaggugcagcgcgcgcaggcccggaucgaggaccuggagaaggcccucgccgagcagggccaggacaugaaguggaucgaggagaagcaggcccuguaccgccggaaccaggagcuggucgagaagaucaagcagauggagaccgaggaggcgcgccuccggcacgaggugcaggacgcccgcgaccagaacgagcugcuggaguuccggauccucgagcuggaggagcgcgagcgcaagagccccgccaucuccuuccaccacacccccuucguggacggcaagagcccgcugcaggucuacugcgaggccgagggggugacggacaucguggucgcggagcucaugaagaagcuggacauccugggggacaacgccaaccucaccaacgaggagcaggucguggugauccaggcccggaccgugcugacccuggccgagaaguggcuccagcagaucgaggagacggaggccgcgcugcagcggaagaugguggaccuggaguccgagaaggagcuguucagcaagcagaagggcuaccuggacgaggagcuggacuaccgcaagcaggcccucgaccaggccaacaagcacauccuggagcuggaggccaugcucuacgacgcccugcagcaggaggcgggggccaaggucgccgagcugcucuccgaggaggagcgggagaagcugaagguggccguggagcaguggaagcgccaggucaugagcgagcugcgggagcgcgacgcccagauccuccgcgagcggauggagcugcugcagcucgcgcagcagcgcaucaaggagcuggaggagcggaucgaggcccagaagcgccagaucaaggagcuggaggagaaguuccucuuccuguuccuguucuucucccucgccuucauccuguggagcuga

SEQ ID NO: 31782 - RNA, 789 nt, Artificial Sequence
  derived and/or modified sequence opt1 from JAM2__Homo_sapiens__NP_001257336
auggcccgccggagccgccaccggcugcuccugcugcuccugcgcuaccugguggucgcccucggcuaccacaaggcguacggguucuccgcccccaaggaccagcaggucgugaccgccguggaguaccagggcgacuucaagaaccgggccgagaugaucgacuucaacauccgcaucaagaacgugacccggagcgacgccgggaaguaccgcugcgagguguccgcgccgagcgagcagggccagaaccuggaggaggacacggucacccuggaggugcucguggcccccgccguccccuccugcgaggugcccagcuccgcccugagcgggaccguggucgagcugcggugccaggacaaggagggcaacccggcgcccgaguacaccugguucaaggacggcauccgccuccuggagaacccccggcuggggucccagagcacgaacuccagcuacaccaugaacaccaagaccggcacgcuccaguucaacaccguguccaagcuggacaccggggaguacagcugcgaggcccgcaacuccgugggcuaccggcgcugccccgggaagcggaugcaggucgacgaccugaacaucagcggcaucaucgccgccgugguggucguggcccucgugaucuccgucugcggccugggggugugcuacgcgcagcgcaagggcuacuucagcaaggagaccuccuuccagaaguccaacagcagcagcaaggccacgaccauguccgagaacgacuucaagcacaccaagagcuucaucaucuga

SEQ ID NO: 31783 - RNA, 780 nt, Artificial Sequence
  derived and/or modified sequence opt1 from JAM3__Homo_sapiens__NP_001192258
auggcccugcgccggcccccgcgccuccggcugugcgcccgccugcccgacuucuuccuccugcugcuguuccggggcugccugaucggggcggugaaccucaagagcuccaaccgcacccccgucgugcaggaguucgagagcguggagcucuccugcaucaucaccgacagccagacguccgacccccggaucgaguggaagaagauccaggacgagcagaccaccuacgucuucuucgacaacaagauccaggugaagccggugacccccgucugccgcgugcccaaggccgugcccgucggcaagauggccacgcugcacugccaggagagcgaggggcacccgcggccccacuacuccugguaccgcaacgacgugccccugcccaccgacagccgggccaacccgcgcuuccggaacuccagcuuccaccucaacuccgagaccggcacccugguguucacggccguccacaaggacgacagcgggcaguacuacugcaucgcguccaacgacgccggcagcgcccgcugcgaggagcaggagauggagguguacgaccugaacaucggcgggaucaucggcggggugcucgucgugcuggccgugcuggcgcucaucacccugggcaucugcugcgccuaccggcgcggguacuucaucaacaacaagcaggacggcgaguccuacaagaaccccggcaagcccgacggggucaacuacauccggaccgacgaggagggcgacuuccgccacaagagcuccuucgugaucuga

SEQ ID NO: 31784 - RNA, 3225 nt, Artificial Sequence
  derived and/or modified sequence opt1 from JARID2__Homo_sapiens__NP_001253969
augguguacuucggcagcucccaggacgaggaggaggucgaggaggaggacgacgagaccgaggacgugaagaccgccacgaacaacgccagcuccagcugccaguccacgccccgcaaggggaagacccacaagcacgugcacaacggccacgucuucaacgggagcucccggagcacccgcgagaaggagccggugcagaagcacaaguccaaggaggcgacccccgccaaggagaagcacagcgaccaccgggccgacucccgccgggagcaggccagcgccaaccaccccgcggccgcccccuccaccggcagcuccgccaaggggcuggcggccacccaccaccacccgccccuccaccgcagcgcccaggaccugcggaagcaggucuccaaggugaacggcgugacccgcaugagcucccugggcgccggggugacgagcgccaagaagaugcgggagguccgccccagccccuccaagaccgugaaguacaccgcgaccgugacgaagggcgccgucaccuacaccaaggccaagcgggagcucgugaaggacaccaagccgaaccaccacaagcccagcuccgccgugaaccacacgaucagcgggaagaccgaguccagcaacgccaagacccgcaagcagguccugucccugggcggggcgagcaaguccaccggccccgccgugaacggccucaaggugagcgggcggcugaaccccaaguccugcacgaaggaggucggcgggcgccagcugcgggagggccuccagcugcgcgagggccugcggaacagcaagcgccggcucgaggaggcccaccaggccgagaagccgcaguccccgcccaagaagaugaagggggccgcgggccccgccgaggggcccggcaagaaggcccccgccgagcgcgggcugcugaacggccacgugaagaaggaggugcccgagcggagccucgagcgcaaccgccccaagcgggccaccgcgggcaaguccaccccggggcgccaggcccacggcaaggccgacagcgccuccugcgagaaccggagcaccucccagcccgagagcguccacaagccccaggacagcgggaaggcggagaagggcgggggcaaggccggcugggccgccauggacgagauccccgugcugcgcccguccgccaaggaguuccacgacccccugaucuacaucgagagcgugcgggcgcaggucgagaaguucgggaugugccgcgugaucccgccgcccgacuggcggcccgagugcaagcucaacgacgagaugcgcuucgucacgcagauccagcacauccacaagcugggccggcgcugggggcccaacgugcagcggcuggccugcaucaagaagcaccucaagucccagggcaucaccauggacgagcugccccugaucgggggcugcgagcucgaccuggccugcuucuuccgccugaucaacgagaugggcgggaugcagcaggucaccgaccucaagaaguggaacaagcuggccgacaugcugcggaucccccgcaccgcccaggaccggcucgcgaagcugcaggaggccuacugccaguaccugcucagcuacgacucccugagccccgaggagcaccgccggcuggagaaggaggugcucauggagaaggagauccuggagaagcgcaagggcccccuggaggggcacacggagaacgaccaccacaaguuccacccgcucccccgguucgagcccaagaacggccugauccacggcguggcgccccgcaacggguuccgcuccaagcugaaggaggugggccaggcccagcucaagaccgggcggcgccggcuguucgcccaggagaaggaggucgugaaggaggaggaggaggacaagggcgugcugaacgacuuccacaagugcaucuacaaggggcgcagcgucucccucaccaccuucuaccggacggcccgcaacaucaugagcaugugcuucuccaaggagccggcccccgccgagaucgagcaggaguacuggcggcugguggaggagaaggacugccacguggccguccacugcggcaagguggacaccaacacccacggcagcggguuccccgugggcaaguccgagcccuucagccgccacggguggaaccugaccguccucccgaacaacacgggcuccauccugcggcaccugggggcggugcccggcgugaccauccccuggcugaacaucggcauggucuucagcaccuccugcuggagccgcgaccagaaccaccuccccuacaucgacuaccugcacaccggggccgacugcaucugguacugcaucccggccgaggaggagaacaagcuggaggacguggugcacacccuccugcaggccaacggcacgcccgggcugcagaugcucgagagcaacgucaugaucucccccgaggugcugugcaaggagggcaucaaggugcaccggaccguccagcagagcgggcaguucguggugugcuuccccggcuccuucgucagcaaggugugcugcggcuacuccgugagcgagaccguccacuucgccaccacgcaguggaccuccaugggguucgagaccgcgaaggagaugaagcgccggcacaucgccaagccguucagcauggagaagcugcucuaccagaucgcccaggccgaggccaagaaggagaacggccccacccuguccacgaucagcgcgcugcucgacgagcugcgcgacaccgagcugcggcagcgccggcagcuguucgaggccgggcuccacuccagcgcccgcuacggcucccacgacgggagcuccaccguggccgacggcaagaagaagccccggaaguggcugcagcucgagaccagcgagcgccggugccagaucugccagcaccugugcuaccuguccauggugguccaggagaacgagaacgugguguucugccucgagugcgcccugcgccacgucgagaagcagaaguccugccgcggccugaagcucauguaccgguacgacgaggagcagaucaucagccuggugaaccagaucugcgggaaggugagcggcaagaacgggagcaucgagaacugccuguccaagcccacgccgaagcgcggcccccggaagcgcgcgaccgucgacgugcccccgagccggcucuccgccagcuccagcuccaagagcgccuccagcuccagcuga

SEQ ID NO: 31785 - RNA, 732 nt, Artificial Sequence
  derived and/or modified sequence opt1 from JAZF1__Homo_sapiens__NP_778231
augaccggcaucgccgccgcgagcuucuucuccaacacgugccgcuucgggggcugcgggcugcacuuccccacccucgccgaccugaucgagcacaucgaggacaaccacaucgacaccgacccgcgggugcuggagaagcaggagcuccagcagcccaccuacgucgcccugagcuacaucaaccgcuucaugaccgacgccgcccggcgcgagcaggagucccugaagaagaagauccagcccaagcucagccugacgcuguccagcuccgugagccggggcaacguguccacgcccccgcgccacagcuccgggagccucaccccgcccgucaccccgcccaucacccccuccagcuccuuccggagcuccacccccaccggcagcgaguacgacgaggaggagguggacuacgaggaguccgacagcgacgagagcuggaccacggaguccgcgaucagcuccgaggccauccugagcuccaugugcaugaacggcggggaggagaagcccuucgccugccccgugcccggcugcaagaagcgcuacaagaacgucaacgggaucaaguaccacgccaagaacggccaccggacccagauccgcgugcggaagcccuucaagugccgcugcggcaagagcuacaagaccgcgcaggggcugcggcaccacaccaucaacuuccacccgcccguguccgccgagaucauccgcaagaugcagcaguga

SEQ ID NO: 31786 - RNA, 492 nt, Artificial Sequence
  derived and/or modified sequence opt1 from JDP2__Homo_sapiens__XP_005267389
augaugcccggccagaucccggaccccagcgugaccaccgggucccugcccggccucgggccccugacgggccugccgagcuccgcccucaccgucgaggagcugaaguacgccgacauccgcaaccugggggcgaugaucgcgccccuccacuuccuggaggugaagcugggcaagcggccccagcccgucaagagcgagcucgacgaggaggaggagcgccggaagcgccggcgcgagaagaacaagguggccgccgcccggugccgcaacaagaagaaggagcggaccgaguuccugcagcgcgaguccgagcggcuggagcucaugaacgccgagcugaagacccagaucgaggagcugaagcaggagcgccagcagcucauccugaugcugaaccggcaccgcccgacgugcaucgugcggaccgacagcgugaagacccccgaguccgagggcaacccccuccuggagcagcuggagaagaaguga

SEQ ID NO: 31787 - RNA, 7077 nt, Artificial Sequence
  derived and/or modified sequence opt1 from JMJD1C__Homo_sapiens__NP_001269877
augcagggccccuacagccugaacggguaccgcgugcgcgucuaccgccaggacuccgccacccagugguucaccggcaucaucacccaccacgaccuguucacccgcaccaugaucgugaugaacgaccaggugcuggagccccagaacgucgaccccuccauggugcagaugaccuuccuggacgacgugguccacucccugcugaagggggagaacaucggcaucaccagccgccggcgcucccgggccaaccagaacgugaacgccgugcacagccacuacacccgcgcccaggccaacagcccccgccccgccaugaacagccaggccgcggucccgaagcagaacacccaccagcagcagcagcagcgcuccauccggcccaacaagcgcaaggggagcgacuccagcauccccgacgaggagaagaugaaggaggagaaguacgacuacaucucccggggcgagaaccccaagggcaagaacaagcaccugaugaacaagcgccggaagcccgaggaggacgagaagaagcugaacaugaagcgccugcggaccgacaacgugagcgacuucuccgagagcuccgacagcgagaacuccaacaagcgcaucaucgacaacagcagcgagcagaagcccgagaacgagcugaagaacaagaacacguccaagaucaacggggaggagggcaagccccacaacaacgagaaggccggggaggagacccugaagaacagccagcccccgugggaccagauccaggaggacaagaagcacgaggaggccgagaagcggaaguccguggacacccagcugcaggaggacaugaucauccacagcuccgagcagagcaccgucuccgaccacaacagcaacgaccugcucccccaggagugcaacauggacaagacgcacaccauggagcugcugcccaaggagaaguucgugucccggccgcccacccccaagugcgugaucgacaucaccaacgacaccaaccucgagaaggucgcccaggagaacagcuccaccuucggccugcagacccugcagaagauggaccccaacgugagcgacuccaagcacagcaucgcgaacgccaaguuccucgagaccgccaagaaggacuccgaccagagcuggguguccgacgucgugaagguggaccugacgcagagcuccgucaccaacgccagcagcgggaacgaccaccugaacauggagaaggagaaguacguguccuacaucagcccccucuccgccgugagcgucauggaggacaagcugcacaagcggagcccgccgcccgagaccaucaaguccaagcugaacaccuccguggacacgcacaagaucaagagcucccccagccccgaggucgugaagcccaagaucacccacucccccgacagcgugaaguccaaggcgaccuacgucaacagccaggccaccggcgagcgccgccucgccaacaagaucgagcacgagcugucccggugcagcuuccaccccaucccgacgcgcuccagcacccuggagaccaccaagagcccccucaucaucgacaagaacgagcacuucacgguguaccgggaccccgcccugaucggcuccgagaccggggccaaccacaucagcccguuccugucccagcaccccuucccccuccacagcuccagccaccggaccugccugaaccccggcacccaccacccggcgcugacgcccgcgccccaccuccuggccggguccagcucccagacgccccugccgaccaucaacacccacccccucaccagcggcccccaccacgccgugcaccacccccaccuccugccgacgguccuccccggcgugcccaccgccucccugcucgggggccacccccggcucgagagcgcgcacgccuccagccugucccaccuggcccucgcccaccagcagcagcagcagcugcugcagcaccagagcccgcaccuccuggggcaggcccaccccuccgcgagcuacaaccagcugggccuguaccccaucaucuggcaguaccccaacgggacccacgccuacuccggccucggccugccgagcagcaagugggugcaccccgagaacgccgucaacgccgaggcgucccugcgccggaacagccccucccccuggcuccaccagccgacccccgugacgagcgccgacgggaucggccugcugucccacauccccgugcgcccgagcuccgccgagccccaccggccccucaagaucaccgcccacagcagcccgccccugaccaagacccuggucgaccaccacaaggaggagcucgagcgcaaggccuucauggagccccugcggagcguggcguccacgagcgccaagaacgaccuggaccucaaccgcucccagaccgggaaggacugccaccuccaccggcacuucguggaccccguccugaaccagcuccagcggccgccccaggagaccggcgagcggcugaacaaguacaaggaggagcaccgccggauccugcaggagagcaucgacguggcccccuucaccacgaagaucaaggggcucgagggcgagcgcgagaacuacucccggguggccagcuccagcuccagccccaagagccacaucaucaagcaggacauggacgucgagcgcuccgugagcgaccuguacaagaugaagcacuccgugccccagagccugccccaguccaacuacuucaccacccucagcaacuccgucgugaacgagccgccccgcagcuaccccuccaaggaggugagcaacaucuacggcgacaagcaguccaacgcccuggcggccgccgccgccaacccccagacccugacgagcuucaucaccucccucagcaagcccccgccccucaucaagcaccagcccgaguccgaggggcuggucggcaagauccccgagcaccucccccaccagaucgcgagccacuccgugaccaccuuccggaacgacugccgcagccccacgcaccugaccguguccagcaccaacacccugcggagcaugccggcccuccaccgcgcccccgucuuccacccgcccauccaccacucccuggagcggaaggaggggagcuacuccagccuguccccgcccacgcucacccccgugaugccggugaacgccggcgggaagguccaggagagccagaagccgcccacccugauccccgagccgaaggacucccaggcgaacuucaagagcuccagcgagcagucccugaccgagauguggcgccccaacaacaaccucagcaaggagaagacggaguggcacguggagaaguccagcggcaagcugcaggccgccauggccuccgugaucguccggcccagcuccagcaccaagaccgacuccaugcccgccaugcagcuggcgagcaaggaccgcgugagcgagcgguccagcgccggcgcccacaagaccgacugccucaagcuggccgaggccggggagacgggccgcaucauccugccgaacgugaacuccgacagcguccacaccaaguccgagaagaacuuccaggcggugagccagggguccgugcccagcuccgucaugagcgccgugaacaccaugugcaacaccaagacggacgugaucaccuccgccgccgacaccaccagcgucuccagcuggggcggcuccgaggugaucagcucccucagcaacaccauccuggccuccacgagcagcgagugcguguccagcaaguccgucagccagcccguggcgcagaagcaggagugcaagguguccaccaccgcccccgucacccuggccagcuccaagacggggagcguggugcagccguccagcggcuucuccgggaccaccgacuucauccaccucaagaagcacaaggccgcgcuggccgccgcccaguacaagagcuccaacgccagcgagaccgagcccaacgcgaucaagaaccagacgcuguccgccagccucccccuggacuccaccgucaucugcagcaccaucaacaaggccaacagcgugggcaacgggcaggccucccagaccagccagcccaacuaccacacgaagcugaagaaggccuggcucacccggcacuccgaggaggacaagaacaccaacaagauggagaacagcggcaacuccgucagcgagaucaucaagccgugcuccgugaaccugaucgcgagcaccuccagcgacauccagaacuccguggacagcaagaucaucgucgacaaguacgugaaggacgacaaggugaaccgccggaaggccaagcgcacguacgaguccggcagcgaguccggggacagcgacgaguccgagagcaaguccgagcagcggaccaagcgccagcccaagcccaccuacaagaagaagcagaacgaccugcagaagcggaagggcgagaucgaggaggaccucaagcccaacgggguccugagccgcagcgccaaggagcgguccaagcugaagcuccagagcaacuccaacaccggcaucccgcgcagcgugcugaaggacuggcggaaggugaagaagcugaagcagacgggggaguccuuccuccaggacgacagcugcugcgagaucggccccaaccugcagaagugccgcgagugccgccugauccgguccaagaagggcgaggagcccgcccacagccccgucuucugccgcuucuacuacuuccggcgccucuccuucagcaagaacgggguggugcggaucgacggcuucuccagcccggaccaguacgacgacgaggccaugucccuguggacccacgagaacuucgaggacgacgagcuggacaucgagaccagcaaguacauccucgacaucaucggggacaaguucugccagcuggucaccuccgagaagacggcgcugagcugggugaagaaggacgccaagaucgccuggaagcgcgccgugcggggcguccgcgagaugugcgacgccugcgaggcgacccucuucaacauccacugggugugccagaagugcggguucguggucugccuggacugcuacaaggccaaggagcggaaguccagccgcgacaaggagcuguacgccuggaugaagugcgugaagggccagccccacgaccacaagcaccucaugcccacccagaucauccccggcuccgugcugaccgaccugcucgacgccaugcacacgcugcgggagaaguacgggaucaagagccacugccacugcaccaacaagcagaaccugcaggucggcaacuucccgaccaugaacggggugagccaggugcuccagaacguccugaaccacuccaacaagaucagccugugcaugcccgagucccagcagcagaacacgccgcccaaguccgagaagaacggcggguccagccccgaguccgacgugggcacggacaacaagcucacgccgcccgagagccagagcccccugcacuggcuggcggaccucgccgagcagaaggcccgcgaggagaagaaggagaacaaggagcugacccuggagaaccagaucaaggaggagcgggagcaggacaacuccgagucccccaacggccgcaccagcccccucgugucccagaacaacgagcaggggagcacgcugcgggaccugcucaccaccaccgccggcaagcugcgcgucggguccaccgacgccggcaucgcguucgcccccguguacagcaugggcgccccguccagcaaguccgggcggacgaugcccaacauccuggacgacaucaucgccagcguggucgagaacaagaucccgcccagcaagaccuccaagaucaacgugaagccggagcucaaggaggagcccgaggagagcaucaucuccgccguggacgagaacaacaagcuguacagcgacaucccccacuccuggaucugcgagaagcacauccuguggcugaaggacuacaagaacagcuccaacuggaagcuguucaaggagugcuggaagcagggccagcccgcggucgugagcggggugcacaagaagaugaacaucucccuguggaaggccgagagcaucucccuggacuucggcgaccaccaggccgaccuccugaacugcaaggacagcaucaucuccaacgccaacgucaaggaguucugggacggguucgaggaggugagcaagcgccagaagaacaaguccggcgagaccgugguccugaagcucaaggacuggccgagcggcgaggacuucaagaccaugaugcccgcccgguacgaggaccugcugaagucccucccccugcccgaguacugcaacccggaggggaaguucaaccuggcgagccaccuccccggcuucuucgugcgccccgaccuggggccccgccugugcuccgccuacggcguggucgccgccaaggaccacgacaucgggacgaccaaccuccacaucgaggugagcgacguggucaacauccugguguacgugggcaucgcgaagggcaacgggauccugagcaaggccggcauccucaagaaguucgaggaggaggaccuggacgacauccugcggaagcgccucaaggacuccagcgagaucccgggggcccuguggcacaucuacgccggcaaggacgucgacaagauccgggaguuccugcagaagaucuccaaggagcaggggcucgaggugcugcccgagcacgaccccauccgcgaccagagcugguacgugaacaagaagcugcggcagcgccuccuggaggaguacggcguccggaccugcacccugauccaguuccucggcgacgccaucgugcugccggcgggggcccugcaccagguccagaacuuccacuccugcauccaggugacggaggacuucgugagccccgagcaccucgucgaguccuuccaccugacccaggagcugcgccuccugaaggaggagaucaacuacgacgacaagcuccaggugaagaacauccucuaccacgccgugaaggagaugguccgggcccugaagauccacgaggacgagguggaggacauggaggagaacuga

SEQ ID NO: 31788 - RNA, 1245 nt, Artificial Sequence
  derived and/or modified sequence opt1 from JMJD6__Homo_sapiens__NP_001074930
augaaccacaagagcaagaagcgcauccgggaggccaagcgcuccgcccggcccgagcugaaggacagccucgacuggacccgccacaacuacuacgaguccuucagccuguccccggcggccguggccgacaacgucgagcgggccgacgcccugcagcucagcguggaggaguucguggagcgcuacgagcggcccuacaagcccgucgugcugcugaacgcgcaggagggcugguccgcccaggagaaguggacccucgagcgccugaagcggaaguaccgcaaccagaaguucaagugcggggaggacaacgacggcuacagcgugaagaugaagaugaaguacuacaucgaguacauggaguccacccgggacgacagcccccuguacaucuucgacuccagcuacggggagcacccgaagcgccggaagcuccuggaggacuacaagguccccaaguucuucaccgacgaccuguuccaguacgccggcgagaagcgccggccgcccuaccgcugguucgugauggggccgccccgguccggcaccggcauccacaucgacccccucgggaccagcgccuggaacgcgcuggugcagggccacaagcgcuggugccuguuccccacguccacgccccgggagcucaucaaggucacccgcgacgagggcgggaaccagcaggacgaggccaucaccugguucaacgugaucuacccccggacccagcugcccaccuggcccccggaguucaagccccuggagauccuccagaagcccggggagaccguguucguccccggcggcugguggcacguggugcugaaccuggacaccacgaucgccaucacccagaacuucgccagcuccaccaacuucccggucguguggcacaagaccgugcgcgggcgccccaagcucagccggaagugguaccgcauccugaagcaggagcaccccgagcuggccguccucgcggacuccguggaccugcaggagagcacgggcaucgccagcgacuccagcuccgacagcuccagcuccagcuccagcuccagcuccgacagcgacuccgagugcgagagcggguccgagggcgacggcaccgugcaccggcgcaagaagcggcggaccugcagcauggucgggaacggcgacaccacgucccaggacgacugcgugagcaaggagcgcagcuccagccgcauccgggacacgugcgggggccgcgcccaccccuga

SEQ ID NO: 31789 - RNA, 2967 nt, Artificial Sequence
  derived and/or modified sequence opt1 from JMY__Homo_sapiens__NP_689618
augagcuucgcccuggaggagacccucgaguccgacuggguggccguccgcccccacguguucgacgagcgggagaagcacaaguucguguucaucgucgcguggaacgagaucgagggcaaguucgccaucaccugccacaaccgcacggcccagcggcagcgcagcgggucccgggagcaggccggcgcccgcgggggcgcggaggccgggggcgccgccagcgacggcucccgggggccgggcagccccgcggggcgcggccggcccgaggccaccgccuccgccacccuggugcgcagccccgggccgcggcgcuccagcgccugggcggagggcggcuccccccggagcacccgcucccugcucggggacccccggcugcgcagccccggcuccaagggggccgagagccggcugcgcuccccggugcgggccaagcccauccccggccagaagacgagcgaggccgacgacgccgcgggcgccgccgccgccgcggcccgccccgccccgcgggaggcccaggucuccagcgugcgcaucgugagcgccuccgggaccgucagcgaggagaucgaggugcucgagauggugaaggaggacgaggcgccccuggcccuguccgacgccgagcagccccccccggccaccgagcucgagagccccgcggaggagugcuccugggccggccuguucagcuuccaggaccugcgcgccguccaccagcagcucugcuccgugaacagccagcuggagcccugccugcccguguucccggaggagcccuccgggauguggaccguccucuucggcggggcccccgagaugacggagcaggagaucgacacccugugcuaccagcugcagguguaccucggccacggccuggacaccugcggguggaagauccugagccaggugcucuucaccgagacggacgaccccgaggaguacuacgagucccugagcgagcugcggcagaagggcuacgaggagguccuccagcgcgcccggaagcgcauccaggagcugcuggacaagcacaagaacaccgaguccaugguggagcuccuggaccuguaccagauggaggacgaggcguacagcucccucgccgaggccaccaccgagcuguaccaguaccugcuccagccguuccgggacaugcgcgagcuggccaugcugcggcgccagcagaucaagaucagcauggagaacgacuaccucgggccccggcgcaucgagucccugcagaaggaggacgccgacuggcagcggaaggcgcacauggccgugcugagcauccaggaccucacggucaaguacuucgagaucaccgccaaggcccagaaggccguguacgaccgcaugcgggcggaccagaagaaguucggcaaggccuccugggccgccgcggccgagcgcauggagaagcugcaguacgccgugagcaaggagacccugcagaugaugcgggccaaggagaucugccucgagcagcgcaagcacgcccugaaggaggagaugcagagccugcgggggggcaccgaggcgaucgcccgccucgaccagcuggaggccgacuacuacgaccugcagcuccagcuguacgagguccaguucgagauccugaagugcgaggagcugcuccugacggcccagcuggaguccaucaagcggcucaucagcgagaagcgcgacgagguggucuacuacgacaccuacgaguccauggaggccaugcuggagaaggaggagauggcggccagcgccuaccugcagcgcgaggagcuccagaagcugcagcagaaggcccggcagcuggaggcccgccggggccgcguguccgcgaagaagagcuaccuccggaacaagaaggagaucugcaucgccaagcacaacgagaagauccagcagcgcacccggaucgaggacgaguaccgcacccaccacacggugcagcugaagcgggagaagcugcacgacgaggaggagcgcaaguccgccugggucagccaggagcggcagcgcacccucgaccggcugcgcaccuucaagcagcgguaccccgggcaggugauccugaaguccacccgccuccggcuggcccacgcgcgccggaagggcgccgccagccccgugcugcaggaggaccacugcgacucccucccgagcguccugcagguggaggagaagacggaggaggugggggagggccgcgucaagcgggggcccucccagaccaccgagccccagagccuggugcagcucgaggacaccucccugacgcagcuggaggccaccagccucccgcuguccggcgugaccagcgagcugccccccaccaucagccucccccugcugaacaacaaccucgagccgugcuccgucacgaucaacccccugcccagcccccugccgcccaccccccccccgcccccccccccgcccccccccccgcccccccccccgcuccccguggccaaggacuccggccccgagacccuggagaaggaccugccgcgcaaggaggggaacgagaagcgcauccccaagagcgcguccgcccccagcgcccaccucuucgacuccagccagcugguguccgcccggaagaagcugcgcaagaccgccgagggccuccagcggcgccgggucagcucccccauggacgaggugcuggcgagccugaagcgcggguccuuccaccucaagaagguggagcagcggacccugccgcccuuccccgacgaggacgacagcaacaacauccuggcccagauccgcaagggcgucaagcucaagaaggugcagaaggacgugcugcgggaguccuucacgcugcuccccgacaccgacccgcugacccgcagcauccacgaggcccugcggcgcaucaaggaggccucccccgagagcgaggacgaggaggaggcccuccccugcaccgacugggagaacuga

SEQ ID NO: 31790 - RNA, 390 nt, Artificial Sequence
  derived and/or modified sequence opt1 from JPH2__Homo_sapiens__NP_787109
augagcggcgggcgcuucgacuucgacgacggcggggccuacugcggcgggugggagggcggcaaggcccacgggcacggccugugcaccgggcccaagggccagggggaguacuccggcagcuggaacuucggcuucgagguggcgggggucuacaccuggccguccggcaacacguucgagggguacuggagccagggcaagcggcacggccucgggaucgagaccaagggccgcuggcuguacaagggggaguggacccacggcuucaaggggcgguacggcauccgccaguccagcuccagcggcgccaaguacgaggggaccuggaacaacggccugcaggacggguacggcacggagaccuacgccgacgggggcaugugcuga

SEQ ID NO: 31791 - RNA, 561 nt, Artificial Sequence
  derived and/or modified sequence opt1 from JPH3__Homo_sapiens__NP_001258533
augagcuccggcgggcgcuucaacuucgacgacggcgggagcuacugcggcgggugggaggacggcaaggcccacggccacggggugugcaccggccccaaggggcagggcgaguacaccggguccuggagccacggcuucgagguccugggcguguacacguggccguccgggaacaccuaccagggcaccugggcccaggggaagcggcacggcaucggccucgagagcaaggggaaguggguguacaagggcgaguggacccacggguucaagggccgcuacgggguccgggagugcgcgggcaacggcgccaaguacgaggggacgugguccaacggccugcaggacggguacggcaccgagaccuacagcgacggggacgccaccgccuucggcgccgagcccggccccgaggcgcgcgagcugcccgccgccgccgcggccgccgccgccgcggccgccgccgccgugcggugguuccucugccgcgagccguggcccgcgcugcagcugcccgccugccucgacucccccaucagcacgccgcagugcaccuga

SEQ ID NO: 31792 - RNA, 1887 nt, Artificial Sequence
  derived and/or modified sequence opt1 from JPH4__Homo_sapiens__NP_115828
augagccccggcgggaaguucgacuucgacgacggcgggugcuacgugggcgggugggaggccggccgcgcccacggcuacggggucugcaccggcccgggggcgcagggcgaguacuccgggugcugggcccacggcuucgagagccugggcguguucaccgggcccggcgggcacuccuaccagggccacuggcagcagggcaagcgggaggggcucggcguggagcgcaagagccgguggacguaccgcggggaguggcugggcgggcugaagggccgguccggcgucugggagagcguguccgggcuccgcuacgccggccuguggaaggacggguuccaggacggcuacgggaccgagaccuacagcgacggcggcaccuaccaggggcaguggcaggccggcaagcggcacggguacggcgugcgccaguccguccccuaccaccaggccgcgcugcuccggagcccccgccggacgucccuggacagcgggcacuccgacccgcccaccccgcccccgccccugccccuccccggcgacgagggcgggagcccggccuccggcagccgcgggggcuucgugcuggccggccccggggacgccgacggcgcguccagccggaagcgcacccccgccgccgggggcuucuuccggcgcucccugcuccugagcgggcugcgggccggcggccgccggagcucccucgggagcaagcgcggcucccugcggagcgagguguccagcgaggucggguccaccgggcccccgggcagcgaggccuccggcccgcccgcggccgccccgcccgcccugaucgagggcagcgccacggagguguacgcgggggaguggcgcgccgaccgccgguccggcuucggggugagccagcgcuccaacggccuccgguacgagggggaguggcugggcaaccgccggcacggcuacgggcgcaccacccggcccgacggcagccgcgaggaggggaaguacaagcggaaccgccugguccacggcgggcgggugcgcucccuccugccccuggcccuccggcgcggcaaggugaaggagaaggucgaccgggccguggagggcgcccgccgggcggugagcgccgcccgccagcggcaggagaucgccgccgcgcgcgccgccgacgcccugcugaaggcggucgccgccuccagcguggccgagaaggccguggaggcggcccgcauggccaagcucaucgcccaggaccugcagcccaugcuggaggcccccgggcggcgcccccggcaggacuccgagggcagcgacaccgagccccucgacgaggacagccccggggucuacgagaacggccugacgcccuccgagggcagccccgagcugcccuccagcccggcguccagccgccagcccuggcggccgcccgccugccgcagcccccucccgcccgggggcgaccaggggcccuucuccucccccaaggccuggcccgaggaguggggcggggccggcgcccaggcggaggagcuggccggcuacgaggccgaggacgaggccgggaugcagggccccgggccccgggacggcagcccgcugcucgggggcugcuccgacagcuccggcagccugcgcgaggaggagggggaggacgaggagccccugccgccccuccgggcgcccgccggcaccgagcccgagcccaucgccaugcuggugcugcgcggguccagcucccggggccccgacgccgggugccucaccgaggagcugggcgagccggccgcgaccgagcgccccgcccagcccggcgccgccaacccccugguggucggggccguggcgcuccuggaccugagccucgccuuccuguucagccagcugcugacguga

SEQ ID NO: 31793 - RNA, 1671 nt, Artificial Sequence
  derived and/or modified sequence opt1 from JRK__Homo_sapiens__NP_001070995
auggccagcaagcccgccgcgggcaagucccgcggggagaagcggaagcgcgugguccugacccucaaggagaagaucgacaucugcacccggcuggagaagggcgagagccgcaaggcccugaugcaggaguacaacguggggauguccacgcucuacgacauccgggcccacaaggcccagcugcugcgcuucuucgccagcuccgacagcaacaaggcgcucgagcagcggcgcacccugcacaccccgaagcuggagcaccucgaccgggugcuguacgagugguuccugggcaagcgcuccgaggggguccccgugagcggccccaugcucaucgagaaggccaaggacuucuacgagcagaugcagcugaccgagcccugcguguucuccggcggguggcuguggcgguucaaggcccgccacggcaucaagaagcucgacgccagcuccgagaagcagagcgcggaccaccaggccgccgagcaguucugcgccuucuuccggucccuggccgcggagcacgggcugagcgccgagcaggucuacaacgccgacgagacgggccucuucuggcgcugccugccgaaccccacccccgagggcggggccgugcccggcccgaagcaggggaaggaccggcugaccgugcucaugugcgccaacgcgaccggcucccaccgccugaagccccuggccaucgggaagugcagcggcccccgggccuucaagggcauccagcaccuccccgucgccuacaaggcccaggggaacgcguggguggacaaggagaucuucuccgacugguuccaccacaucuucgugccgagcguccgcgagcacuuccggacgaucggccugcccgaggacuccaaggccgugcugcuccuggacagcagccgcgcccacccccaggaggccgagcugguguccagcaacgucuucaccaucuuccuccccgccuccguggcgagccuggugcagccgauggagcaggggauccggcgcgacuucaugcgcaacuucaucaacccgcccgucccccugcagggcccccacgcccgguacaacaugaacgacgccaucuucuccguggccugcgcguggaacgccgugcccagccacgucuuccgccgggccuggcgcaagcucuggcccuccguggccuucgccgaggggagcuccagcgaggaggagcuggaggcggagugcuuccccgugaagccgcacaacaaguccuucgcccacauccuggagcucgucaaggagggcagcuccugccccggccagcugcggcagcgccaggccgccagcuggggcguggccgggcgggaggcggagggcgggcgcccgcccgccgccaccucccccgccgaggucguguggagcuccgagaagacccccaaggccgaccaggacgggcggggcgaccccggcgagggggaggagguggcgugggagcaggccgccgucgccuucgacgcggugcugcgcuucgccgagcggcagccgugcuucagcgcccaggaggugggccagcuccgcgcccugcgggccgucuuccgcucccagcagcaggagacgguggggcuggaggacguggucgugaccagccccgaggagcucgcgauccccaagugcugccuggaggccagcaccgagaccuga

SEQ ID NO: 31794 - RNA, 996 nt, Artificial Sequence
  derived and/or modified sequence opt1 from JSRP1__Homo_sapiens__NP_653217
augagcaugaccacccgcgccugggaggagcuggacggcgggcucggcuccugccaggcccuggaggaccacagcgcgcuggccgagacgcaggaggaccgggccuccgccaccccccgccucgccgacagcggguccgugccgcacgacagccaggucgcggagggccccuccguggacacccggcccaagaagauggagaaggagcccgccgcccgcgggaccccgggcacgggcaaggagcggcugaaggccggggcgagcccccgcuccgugcccgcccggaagaaggcccagaccgcccccccgcugcagcccccccccccgccccccgcccucagcgaggagcugcccuggggcgaccugucccucaacaagugccugguccuggcgagccucguggcccugcugggguccgccuuccagcucugccgcgacgccgugccgggcgaggccgcgcugcaggcccggguccccgagcccugggugcccccgagcuccgccccccgcgagcccagcuccccccugccgaaguucgaggcccaggccccccccagcgcgcccccggccccccgggccgaggccgaggugcgccccaagaucccggggucccgggaggccgcggagaacgacgaggaggagcccggcgaggccaccggcgaggccguccgcgaggaccgggugacccucgccgaccgcgggcccaaggagcggccccgccgggagggcaagccgcgcaaggagaagccccggaaggaggagcgccccaagaaggagcgcccccggaaggaggagcgcccgcgggcggcccgcgagccccgggaggcccugccccagcgcugggagagccgggaggggggccaccgccccugggcccgggacagccgcgacgccgagccgcggaagaagcaggcguggguguccccccgccggcccgacgaggagcagcgccccggcagccggcagaagcugcgcgccgggaagggccgggacuga

SEQ ID NO: 31795 - RNA, 441 nt, Artificial Sequence
  derived and/or modified sequence opt1 from JTB__Homo_sapiens__NP_006685
augcuggccggcgccgggcgccccggccucccgcaggggcggcaccugugcuggcugcucugcgcguucacccugaagcugugccaggccgaggcccccgugcaggaggagaagcucagcgccuccaccagcaaccugcccugcuggcuggucgaggaguucgugguggccgaggagugcucccccugcagcaacuuccgcgcgaagaccaccccggagugcggccccaccggguacgucgagaagaucacgugcuccagcuccaagcggaacgaguucaagagcugccgcuccgcccucauggagcagcggcuguucuggaaguucgagggcgccguggugugcgucgcccugaucuucgcgugccucgugaucauccgccagcggcagcuggaccgcaaggcccuggagaaggugcggaagcagaucgagagcaucuga

SEQ ID NO: 31796 - RNA, 1044 nt, Artificial Sequence
  derived and/or modified sequence opt1 from JUNB__Homo_sapiens__NP_002220
augugcaccaagauggagcagcccuucuaccacgacgacagcuacaccgccacgggcuacgggcgcgccccgggcgggcugucccuccacgacuacaagcugcugaagcccagccucgcggugaaccuggccgaccccuaccggucccugaaggcccccggcgcccgcgggccgggccccgagggcgggggcgggggcagcuacuucuccgggcagggcagcgacaccggcgccucccucaagcuggcgagcuccgagcuggagcggcucaucguccccaacagcaacggggugaucaccaccacgcccaccccgcccggccaguacuucuacccccgcgggggcggcuccgggggcggggccggcggggccggcggcggggugaccgaggagcaggagggcuucgccgacggguucgucaaggcgcuggacgaccugcacaagaugaaccacgugacgcccccgaacgugagccucggcgccaccgggggcccgcccgccggccccgggggcgucuacgccgggcccgagcccccgcccguguacaccaaccuguccagcuacucccccgccagcgcguccagcggcggggccggcgccgccgugggcaccggguccagcuaccccaccacgaccaucagcuaccugccccacgcgcccccguucgccggcgggcaccccgcccagcucggccugggccgcggggccuccaccuucaaggaggagccccagaccguccccgaggcccggagccgggacgccacgccgcccgugucccccaucaacauggaggaccaggagcgcaucaagguggagcggaagcgccugcggaaccgccucgcggccaccaagugccggaagcgcaagcuggagcggaucgcccgccuggaggacaaggucaagacccucaaggccgagaacgccggccugagcuccaccgcggggcugcuccgggagcaggucgcccagcugaagcagaaggugaugacgcacgugagcaacggcugccagcugcuccugggggugaagggccacgccuucuga

SEQ ID NO: 31797 - RNA, 1044 nt, Artificial Sequence
  derived and/or modified sequence opt1 from JUND__Homo_sapiens__NP_005345
auggagacccccuucuacggcgacgaggcccugagcgggcucggcgggggcgccuccgggagcggcggcuccuucgcgagcccggggcgccuguuccccggcgccccgcccaccgccgccgccggguccaugaugaagaaggacgcgcugacgcucagccuguccgagcaggucgccgccgcccugaagcccgcggccgccccgccgcccacgccccuccgggccgacggcgcccccagcgcggccccgcccgacgggcugcuggccucccccgaccucggccugcugaagcucgccagccccgagcuggagcgccugaucauccaguccaacggccucgucaccaccacccccaccagcucccaguuccuguaccccaagguggccgcgagcgaggagcaggaguucgccgagggguucgugaaggcccuggaggaccuccacaagcagaaccagcugggcgccggggccgcggccgccgccgccgcggccgccgccggcggccccuccgggaccgcgaccggcagcgccccgcccggggagcuggcccccgccgccgcggcccccgaggcccccguguacgccaaccucuccagcuacgccggcggggcgggcggcgccgggggcgccgccacgguggccuucgcggccgagcccgugcccuucccgcccccgcccccgcccggggcccuggggccgccccggcuggccgcgcucaaggacgagccccagaccguccccgacgugcccuccuucggcgagagcccgccccugagccccaucgacauggacacccaggagcgcaucaaggccgagcggaagcgccugcggaaccgcaucgccgccuccaagugccggaagcgcaagcucgagcggaucagccgccuggaggagaaggugaagacccugaagucccagaacacggagcucgccagcaccgcgucccugcugcgggagcaggucgcccagcucaagcagaaggugcugagccacgugaacuccggcugccagcugcucccccagcaccagguccccgccuacuga

SEQ ID NO: 31798 - RNA, 2238 nt, Artificial Sequence
  derived and/or modified sequence opt1 from JUP__Homo_sapiens__XP_006721941
auggaggugaugaaccugauggagcagcccaucaaggucaccgaguggcagcagaccuacacguacgacagcggcauccacuccggggccaacacgugcgugcccagcguguccagcaagggcaucauggaggaggacgaggccugcgggcgccaguacacccucaagaagaccaccaccuacacccagggcgucccgcccucccagggggaccuggaguaccagaugagcaccacggcgcgggccaagcgcgugcgggaggccaugugccccggcguguccggcgaggacagcucccugcuccuggccacccaggucgaggggcaggccaccaaccugcagcgccucgcggagcccagccagcugcugaaguccgccaucgugcaccucaucaacuaccaggacgacgccgagcuggccacccgggcgcugcccgagcucacgaagcugcugaacgacgaggaccccguggucgugaccaaggccgccaugaucgugaaccagcucagcaagaaggaggccucccgccgggcccugaugggcagcccccagcuggucgcggccguggugcgcaccaugcagaacaccuccgaccucgacacggcccggugcaccaccagcauccugcacaaccugucccaccaccgcgaggggcuccuggccaucuucaagagcggcgggaucccggcccugguccggaugcucuccagccccguggagagcgugcuguucuacgcgaucaccacgcugcacaaccuccugcuguaccaggagggcgccaagauggccguccgccucgccgacggccugcagaagauggugccccugcucaacaagaacaaccccaaguuccuggccaucaccaccgacugccugcagcuccuggcguacgggaaccaggaguccaagcugaucauccucgccaacggcgggccgcaggcccuggugcagaucaugcggaacuacagcuacgagaagcugcucuggaccacgucccgcguccugaaggugcugagcgugugccccuccaacaagcccgccaucgucgaggccggcggcaugcaggcgcucgggaagcaccugaccagcaacagcccccggcuggugcagaacugccucuggacccugcgcaaccuguccgacgucgccaccaagcaggagggccuggaguccgugcucaagauccuggugaaccagcugagcgucgacgacgugaacgugcucacgugcgccaccgggacccuguccaaccugaccugcaacaacagcaagaacaagacgcucgucacccagaacuccggcguggaggcccugauccacgcgauccugcgggccggggacaaggacgacaucaccgagccggccgugugcgcccuccgccaccugaccagccggcaccccgaggccgagauggcgcagaacuccguccgccugaacuacggcauccccgccaucgugaagcuccugaaccagcccaaccaguggccgcuggugaaggccacgaucggccucauccggaaccuggcccugugccccgccaaccacgcgccccuccaggaggccgccgucaucccccgccuggugcagcugcucgugaaggcccaccaggacgcccagcgccacgucgcggccgggacccagcagccguacaccgacggcgugcggauggaggagaucguggaggggugcaccggcgcccugcacauccuggcccgcgaccccaugaaccggauggagaucuuccgccucaacaccaucccccuguucguccagcugcucuacagcuccguggagaacauccagcggguggcggccgggguccugugcgagcuggcccaggacaaggaggccgccgacgcgaucgacgccgagggcgccagcgcgccccucauggagcugcugcacucccgcaacgagggcacggccaccuacgccgccgccguccucuuccggaucagcgaggacaagaacccggacuaccgcaagcgggugagcguggagcugaccaacucccuguucaagcacgaccccgccgccugggaggcggcccagagcaugauccccaucaacgagccguacggggacgacauggacgccaccuaccgccccauguacuccagcgacgugccccucgacccccuggagaugcacauggacauggacggcgacuacccgaucgacacguacuccgacgggcugcggccgcccuaccccaccgccgaccacaugcucgcguga

SEQ ID NO: 31799 - RNA, 2043 nt, Artificial Sequence
  derived and/or modified sequence opt1 from KAL1__Homo_sapiens__NP_000207
auggugcccggcgucccgggggccgugcugacccucugccuguggcuggccgcgagcuccggcugccucgccgccgggcccggcgccgccgcggcccgccggcuggacgagagccuguccgccgggagcgugcagcgcgcccggugcgcgucccgcugccucagccugcagaucacccggaucuccgccuucuuccagcacuuccagaacaacggcagccuggucuggugccagaaccacaagcagugcuccaagugccucgagcccugcaaggagagcggcgaccugcgcaagcaccagugccaguccuucugcgagccccuguucccgaagaaguccuacgagugccucacgagcugcgaguuccugaaguacauccugcucgugaagcagggggacugccccgcccccgagaaggccagcggcuucgccgcggccugcguggaguccugcgaggucgacaacgagugcagcggggugaagaagugcugcuccaacggcugcgggcacacgugccaggugcccaagacccuguacaagggcgucccgcugaagccccggaaggagcuccgcuucaccgagcugcagagcggccagcuggaggugaagugguccagcaaguucaacaucagcaucgagcccgugaucuacgucgugcagcggcgcuggaacuacgggauccaccccuccgaggacgacgccacccacuggcagaccguggcccagaccaccgacgagcggguccagcucacggacauccgcccgagccggugguaccaguuccgcguggccgcggugaacguccacggcacccggggguucaccgcccccuccaagcacuuccgcagcuccaaggaccccagcgcgcccccggcccccgccaaccugcggcuggccaacuccaccgugaacagcgacggcuccgugacggucaccaucgugugggaccuccccgaggagcccgacaucccggugcaccacuacaaggucuucuggagcuggaugguguccagcaagucccugguccccaccaagaagaagcgccggaagaccacggacggcuuccagaacagcgugauccuggagaagcuccagcccgacugcgacuacguggucgagcugcaggccaucaccuacugggggcagacccgccugaaguccgccaaggugagccuccacuucaccuccacgcacgccaccaacaacaaggagcagcuggugaagacccggaagggcgggauccagacccagcugcccuuccagcgccgccggccgacgcgcccccucgaggucggcgcccccuucuaccaggacgggcagcuccaggugaagguguacuggaagaagaccgaggaccccaccgucaaccgguaccacgugcgcugguucccggaggcgugcgcccacaaccggaccacgggcagcgaggccuccagcggcaugacccacgagaacuacaucauccugcaggaccugagcuucuccugcaaguacaaggugaccguccagcccauccgccccaagagccacuccaaggccgaggcgguguucuucaccacgccgcccugcagcgcccugaaggggaagucccacaagcccgugggcugccugggggaggccggccacguccucagcaaggugcuggccaagcccgagaaccuguccgccagcuucaucgugcaggacgucaacaucaccgggcacuucuccuggaagauggcgaaggccaaccucuaccagccgaugaccggcuuccaggugaccugggccgaggugacgaccgagagccggcagaacucccugcccaacagcaucaucucccagagccagauccugcccuccgaccacuacguccucaccgugcccaaccugcgcccgagcacccuguaccggcucgaggugcagguccugacccccggcggggagggccccgccacgaucaagaccuuccgcacccccgagcugccgcccuccagcgcccaccggagccaccugaagcaccgccacccccaccacuacaagcccuccccggagcgguacuga

SEQ ID NO: 31800 - RNA, 8961 nt, Artificial Sequence
  derived and/or modified sequence opt1 from KALRN__Homo_sapiens__NP_001019831
augaccgaccgcuucugggaccagugguaccugugguaccuccggcugcugcgccuccuggaccggggcagcuuccgcaacgacgggcugaaggccuccgacgugcuccccauccugaaggagaagguggccuucgugagcggcgggcgggacaagcgcggcgggcccauccugaccuuccccgcccgguccaaccacgaccgcauccggcaggaggaccuccgcaagcuggugaccuaccuggccagcgugcccuccgaggacgugugcaagcggggcuucaccgugaucaucgacaugcgcggcagcaagugggaccucaucaagccccugcugaagacccuccaggaggccuuccccgccgagauccacguggcccugaucaucaagcccgacaacuucuggcagaagcagaagaccaacuucggguccagcaaguucaucuucgagaccuccauggugagcguggagggccugaccaagcucgucgaccccucccagcugaccgaggaguucgacgggagccuggacuacaaccacgaggaguggaucgagcuccggcugucccuggaggaguucuucaacagcgcggugcaccuccugucccgccuggaggaccuccaggagaugcuggcccggaaggaguuccccguggacgucgagggcagccgccggcugaucgacgagcacacccagcucaagaagaaggugcugaaggcccccguggaggagcuggaccgcgaggggcagcggcuccugcagugcauccgcugcuccgacggcuucagcggccggaacugcauccccggguccgccgacuuccagagccugguccccaagaucaccagccuccuggacaagcugcacuccacccgccagcaccuccaccagauguggcacgugcgcaagcugaagcuggaccagugcuuccagcuccggcuguucgagcaggacgcggagaagauguucgacuggaucagccacaacaaggagcuguuccuccagucccacaccgagaucggcgugagcuaccaguacgcccuggaccugcagacccagcacaaccacuucgccaugaacuccaugaacgccuacgucaacaucaaccgcaucaugagcguggccucccggcucagcgaggcggggcacuacgccucccagcagaucaagcagaucagcacccagcuggaccaggaguggaaguccuucgccgccgcccuggacgagcgcagcaccauccuggcgauguccgccguguuccaccagaaggccgagcaguuccucagcggcgucgacgccuggugcaagaugugcuccgagggcgggcugcccagcgagaugcaggaccuggagcucgccauccaccaccaccagacccuguacgagcaggucacccaggcguacaccgaggugucccaggacggcaaggcccugcucgacguccugcagcggccccugagccccgggaacuccgagagccucaccgccaccgccaacuacagcaaggccgugcaccagguccuggacguggugcacgagguccugcaccaccagcgccggcucgaguccaucuggcagcaccgcaaggugcggcugcaccagcgccugcagcucugcguguuccagcaggacguccagcagguccuggacuggaucgagaaccacggcgaggcguuccugagcaagcacaccggggugggcaagucccuccaccgggcccgcgcccugcagaagcggcacgacgacuucgaggaggucgcccagaacacguacaccaacgcggacaagcugcucgaggccgccgagcagcuggcccagaccggcgagugcgaccccgaggagaucuacaaggccgcgcgccaccuggaggugcggauccaggacuucgugcgccgggucgagcagcgcaagcuccugcuggacaugagcguguccuuccacacccacacgaaggagcucuggaccuggauggaggaccugcagaaggagaugcuggaggacgugugcgccgacagcgucgacgccgugcaggagcucaucaagcaguuccagcagcagcagaccgccacccuggacgccacgcugaacgugaucaaggagggggaggaccucauccagcagcugcgguccgcgcccccgagccugggcgagcccuccgaggcccgcgacagcgccgucuccaacaacaagacgccccacagcuccagcaucucccacaucgagagcgugcuccagcagcuggacgacgcccaggugcagauggaggagcuguuccacgagcgcaagaucaagcucgacaucuuccugcagcugcggaucuucgagcaguacaccaucgaggucaccgccgagcucgacgcguggaacgaggaccugcugcgccagaugaacgacuucaacacggaggaccucacccuggccgagcagcggcugcagcgccacaccgagcggaagcucgccaugaacaacaugaccuucgaggugauccagcaggggcaggaccugcaccaguacaucacggaggugcaggccuccggcaucgagcugaucugcgagaaggacaucgaccucgcggcccagguccaggagcugcuggaguuccuccacgagaagcagcacgagcuggagcugaacgccgagcagacccacaagcgccucgagcagugccugcagcugcggcaccuccaggccgaggugaagcagguccugggguggauccgcaacggcgagagcaugcugaacgccagccucgucaacgcguccagccuguccgaggccgagcagcugcagcgggagcacgagcaguuccagcucgccaucgagagccuguuccacgccaccucccugcagaagacccaccagagcgcccuccaggugcagcagaaggcggaggugcugcugcaggccggccacuacgacgccgacgccauccgcgagugcgccgagaaggucgcgcuccacuggcagcagcugaugcugaagauggaggaccggcucaagcuggugaacgccuccguggccuucuacaagaccagcgagcaggucugcuccgugcuggagagccucgagcaggaguaccgccgggacgaggacuggugcgggggccgcgacaagcuggggcccgccgcggagaucgaccacgugaucccgcugaucuccaagcaccucgagcagaaggaggccuuccugaaggccugcacgcuggcccggcgcaacgccgaggucuuccucaaguacauccaccggaacaacgugagcaugcccuccguggcgagccacacccgcggccccgagcagcaggucaaggccauccuguccgagcugcuccagcgggagaaccgcgugcugcacuucuggacccugaagaagcggcgccucgaccagugccagcaguacguggucuucgagcgcagcgccaagcaggcccuggacuggauccaggagaccggggaguucuaccuguccacgcacaccagcaccggcgagaccacggaggagacccaggagcuccugaaggaguacggcgaguuccgggugcccgccaagcagaccaaggagaaggugaagcugcugauccagcucgcggacuccuucgucgagaaggggcacauccacgccaccgagauccgcaagugggugacgaccguggacaagcacuaccgggacuucagccugcgcaugggcaaguaccgguacagccuggagaaggcccucggggucaacaccgaggacaacaaggaccuggagcuggacaucaucccggccucccucagcgaccgcgaggugaagcugcgggacgccaaccacgaggugaacgaggagaagcgcaaguccgcgcggaagaaggaguucaucauggccgagcugcuccagaccgagaaggccuacguccgcgaccugcacgagugccuggagacguaccucugggagaugaccagcggcguggaggagaucccgcccggcauccugaacaaggagcacaucaucuucgggaacauccaggagaucuacgacuuccacaacaacaucuuccugaaggagcucgagaaguacgagcagcugcccgaggacgucggccacugcuucgugaccugggccgacaaguuccagauguacgugaccuacugcaagaacaagccggacuccaaccagcugauccucgagcacgccgggacguucuucgacgagauccagcagcggcacggccuggcgaacagcaucuccagcuaccugaucaagcccguccagcgcaucaccaaguaccagcuccugcugaaggagcuccugaccugcugcgaggaggggaagggcgagcugaaggacggccucgaggugaugcuguccgugcccaagaaggccaacgacgccaugcacgucagcaugcuggagggguucgacgagaaccucgacgugcagggcgagcugauccugcaggacgccuuccaggugugggacccgaagucccucauccggaaggggcgcgagcggcaccuguuccuguucgagaucagccucgucuucuccaaggagaucaaggacagcuccggccacaccaaguacguguacaagaacaagcugcugacgagcgagcucggggugaccgagcacgucgagggcgaccccugcaaguucgcgcugugguccggccgcacccccagcuccgacaacaagaccgugcugaaggccagcaacaucgagacgaagcaggaguggaucaagaacauccgggaggugauccaggagcgcaucauccaccucaagggggcccugaaggagccccugcagcucccgaagacccccgccaagcagcggaacaacagcaagcgcgacggcgucgaggacaucgacucccagggggacggcagcucccagcccgacaccaucagcaucgccucccgcaccagccagaacacgguggacuccgacaagcugagcgggggcugcgagcugaccgugguccuccaggacuucuccgcgggccacagcuccgagcugaccauccagguggggcagaccguggagcugcucgagcggcccagcgagcgcccgggcuggugccugguccggacgaccgagcgcagcccgccccucgaggggcucgugcccagcuccgcccugugcaucagccacucccggagcuccguggagauggacugcuucuucccgcuggucaaggacgccuacagccacagcuccagcgagaacggcgggaaguccgagagcguggccaaccuccaggcccagcccucccugaacagcauccacuccagccccggccccaagcgcuccaccaacacccugaagaaguggcucaccagcccggugcggcgccugaacuccggcaaggcggacgggaacaucaagaagcagaagaagguccgggacggccgcaagagcuucgaccuggggucccccaagcccggcgacgagacgacgccccagggcgacagcgccgacgagaaguccaagaagggguggggcgaggacgagccggacgaggagagccacacgccccugccgccgcccaugaagaucuucgacaacgaccccacccaggacgagauguccagcucccugcuggccgcccggcaggccagcacggaggugcccaccgcggccgaccucgugaacgccaucgagaagcuggucaagaacaagcugagccucgagggguccagcuaccgcggcucccugaaggaccccgccgggugccugaacgagggcauggcgccgcccacgccgcccaagaaccccgaggaggagcagaaggccaaggcccuccggggccgcauguucgugcugaacgagcuggugcagaccgagaaggacuacgucaaggaccucgggaucgugguggagggcuucaugaagcggaucgaggagaaggggguccccgaggacaugcgcggcaaggacaagaucguguucgggaacauccaccagaucuacgacuggcacaaggacuucuuccuggccgagcuggagaagugcauccaggagcaggaccggcucgcccagcuguucaucaagcacgagcgcaagcugcacaucuacgugugguacugccagaacaagccccggagcgaguacaucgucgcggaguacgacgccuacuucgaggaggugaagcaggagaucaaccagcgccucacgcuguccgacuuccugaucaagcccauccagcggaucaccaaguaccagcuccugcugaaggacuuccuccgcuacagcgagaaggccggccuggagugcuccgacaucgagaaggccguggagcugaugugccucguccccaagcgcugcaacgacaugaugaaccugggccggcugcagggguucgagggcacccucaccgcccaggggaagcugcugcagcaggacacguucuacgugaucgagcucgacgcgggcaugcagagccgcaccaaggagcggcgcguguuccuguucgagcagaucgucaucuucuccgagcugcuccggaaggggagccugacccccggcuacauguucaagcgcuccaucaagaugaacuaccuggugcuggaggagaacguggacaacgaccccugcaaguucgcccucaugaaccgggagaccagcgagcgcgucgugcugcaggccgccaacgccgacauccagcaggcgugggugcaggacaucaaccagguccuggagacgcagcgggacuuccucaacgcccugcaguccccgaucgaguaccagcgcaaggagcggagcaccgccgugaugcgcucccagcccgcccggcugccccaggcgagcccccgcccguacuccagcguccccgccggcuccgagaagccgcccaaggggagcagcuacaacccgccccugccgccccucaagaucuccaccagcaacggcuccccgggguucgaguaccaccagcccggcgacaaguucgaggccagcaagcagaacgaccugggcgggugcaacggcaccuccagcauggccgugaucaaggacuacuacgcccucaaggagaacgagaucugcgugucccagggggaggucguccaggugcuggcggucaaccagcagaacaugugccugguguaccagcccgccagcgaccacucccccgccgccgagggcugggugccggggagcauccucgcgccccugacgaaggcgaccgccgccgaguccagcgacggcuccaucaagaaguccugcagcuggcacacccugcggaugcgcaagcgggccgaggucgagaacaccggcaagaacgaggccacggggccccgcaagccgaaggacauccucggcaacaaggugagcgugaaggagaccaacuccagcgaggagagcgagugcgacgaccuggaccccaacaccuccauggagauccugaaccccaacuucauccaggaggucgcgcccgaguuccucgugccgcugguggacgugaccugccugcucggggacacggugauccugcagugcaaggugugcggccggcccaagcccaccaucaccuggaaggggcccgaccagaacauccuggacaccgacaacagcuccgccacguacaccgucagcuccugcgacagcggcgagaucacccucaagaucugcaaccugaugccgcaggacuccggcaucuacacgugcaucgccacgaacgaccacgggaccaccagcaccuccgccaccgugaaggugcagggcguccccgccgcgcccaaccgccccaucgcccaggagcgcagcugcacguccgugauccugcgguggcucccgcccagcuccaccgggaacugcaccaucagcggcuacaccguggaguaccgcgaggaggggucccagaucuggcagcagagcgucgccuccacgcuggacaccuaccuggugaucgaggaccucagccccggcugccccuaccaguuccggguguccgccagcaacccguggggcaucagccugcccuccgagcccagcgaguucguccgccugcccgaguacgacgcggccgccgacggggccaccaucuccuggaaggagaacuucgacagcgccuacaccgagcucaacgagaucggccgggggcgcuucuccaucgugaagaagugcauccacaaggcgacgcggaaggacguggccgucaaguucgugagcaagaagaugaagaagaaggagcaggccgcccacgaggccgcgcugcugcagcaccuccagcacccgcaguacaucacccugcacgacaccuacgagucccccaccagcuacauccugauccucgagcugauggacgacggccgccugcucgacuaccugaugaaccacgacgagcugauggaggagaagguggccuucuacauccgggacaucauggaggcccuccaguaccugcacaacugccgcgucgcccaccuggacaucaagcccgagaaccuccugaucgaccugcggauccccgugccgcgcgugaagcucaucgaccuggaggacgccguccagaucuccgggcacuuccacauccaccaccuccugggcaaccccgaguucgcggcccccgaggugauccagggcauccccgugagccuggggacggacaucugguccaucggcguccugaccuacgugaugcucagcgggguguccccguuccuggacgagagcaaggaggagaccugcaucaacgucugccggguggacuucuccuucccccacgaguacuucugcggcgugagcaacgccgcccgcgacuucaucaacgucauccugcaggaggacuuccggcgccggcccaccgcggccacgugccuccagcacccguggcugcagccccacaacggcuccuacagcaagaucccccuggacaccucccgccucgccugcuucaucgagcggcgcaagcaccagaacgacgugcggcccaucccgaacgugaaguccuacaucgucaaccgcgugaaccaggggaccuga

SEQ ID NO: 31801 - RNA, 4059 nt, Artificial Sequence
  derived and/or modified sequence opt1 from KANK1__Homo_sapiens__NP_001243806
auggcccacaccaccaaggugaacggcagcgccuccgggaaggcgggcgacauccugagcggggaccaggacaaggagcagaaggaccccuacuucgucgagacgccguacggcuaccagcucgaccuggacuuccugaaguacguggacgacauccagaaggggaacaccaucaagcgccucaacauccagaagcggcgcaagcccuccgugcccugccccgagccgcggaccaccagcggccagcagggcaucuggacguccaccgagagccuguccagcuccaacagcgacgacaacaagcagugccccaacuuccugaucgcccgcucccaggucaccagcacccccaucuccaagcccccgcccccccucgagacgagccugcccuuccugaccaucccggagaaccggcagcuccccccccccuccccgcagcugcccaagcacaaccugcacgugaccaagacccucauggagacgcgccggcgccuggagcaggagcgggccaccaugcagaugacccccggggaguuccgccggccccgccuggccagcuucggcgggaugggcaccacguccagccucccguccuucguggggagcggcaaccacaaccccgccaagcaccagcugcagaacggcuaccaggggaacggcgacuacgggagcuacgcgcccgccgcccccaccaccuccagcaugggcuccagcauccggcacuccccgcugagcuccggcaucagcacccccgucacgaacgugucccccaugcaccuccagcacauccgcgagcagauggccaucgcgcugaagcggcugaaggagcucgaggagcaggugcgcaccauccccguccugcaggugaagaucagcgugcugcaggaggagaagcggcagcucgucucccagcugaagaaccagcgcgccgccagccagaucaacgugugcggggugcggaagcgcuccuacagcgccggcaacgccucccagcuggagcagcucagccgggcgcgccgcuccgggggcgagcuguacaucgacuacgaggaggaggagauggagaccgucgagcagagcacccagcggaucaaggaguuccgccagcugacggccgacaugcaggcccucgagcagaagauccaggacuccagcugcgaggccagcuccgagcugcgggagaacggggagugccgcagcguggccgugggcgcggaggagaacaugaacgacaucgucguguaccaccggggcucccgcagcugcaaggacgccgccguggggacccuggucgagaugcggaacugcggcguguccgugaccgaggccaugcucggggucaugaccgaggccgacaaggagaucgagcugcagcagcagacgaucgagagccugaaggagaagaucuaccgccucgaggugcagcugcgggagaccacccacgaccgcgagaugaccaagcugaagcaggagcuccaggcggccggcucccggaagaaggucgacaaggccacgauggcccagccgcugguguucagcaagguggucgaggccguggugcagacccgcgaccagauggucgggucccacauggaccugguggacaccugcgugggcaccagcgucgagacgaacuccgugggcaucagcugccagcccgagugcaagaacaagguggucgggcccgagcucccgaugaacugguggaucgugaaggagcggguggagaugcacgaccgcugcgcgggccgguccgucgagaugugcgacaagagcguguccguggaggucagcgugugcgagaccggguccaacaccgaggagagcgugaacgaccugacccugcucaagaccaaccugaaccugaaggagguccgcagcaucggcugcggggacugcuccguggacgugacggucugcagccccaaggagugcgccucccggggcgugaacaccgaggccgugagccaggucgaggccgcggugauggccgugccccgcaccgccgaccaggacaccuccacggaccucgagcagguccaccaguucaccaacaccgagaccgccacgcugaucgagagcugcaccaacaccugccuguccacccuggacaagcagacgagcacccagaccguggagacccggacgguggccgucggcgaggggcgcgugaaggacaucaacuccagcaccaagacccgcuccaucggcguggggacccuccugagcggccacuccggcuucgaccggcccagcgcggucaagacgaaggaguccggggugggccagaucaacaucaacgacaacuaccugguggggcucaagaugcgcaccaucgccugcggcccgccccagcugaccgucgggcugaccgccagccggcgcuccgugggcgugggcgacgaccccgucggggagagccucgagaacccccagccgcaggccccccugggcaugaugacggggcuggaccacuacaucgagcggauccagaagcuccuggccgagcagcagacccugcucgcggagaacuacuccgagcuggccgaggccuucggcgagccccacagccagauggggagccugaacucccagcucaucagcacccuguccagcaucaacuccgugaugaagagcgccuccaccgaggagcugcgcaaccccgacuuccagaagacgagccucggcaagaucaccggcaacuaccugggguacaccugcaagugcggcgggcugcaguccggcagcccgcucuccagccagaccucccagcccgagcaggagguggggacgagcgagggcaagcccaucuccagccuggacgccuuccccacccaggagggcacccuguccccggucaaccucaccgacgaccagaucgcggccgggcuguacgccugcacgaacaacgagagcacccugaaguccaucaugaagaagaaggacggcaacaaggacagcaacggggccaagaagaaccuccaguucgugggcaucaacgggggcuacgagaccaccagcuccgacgacagcuccagcgacgaguccagcuccagcgaguccgacgacgagugcgacgugaucgaguacccccuggaggaggaggaggaggaggaggacgaggacacccggggcauggcggaggggcaccacgccgucaacaucgagggccugaagagcgcccgcguggaggacgagaugcaggugcaggagugcgagcccgagaaggucgagauccgggagcgcuacgagcucuccgagaagaugcugagcgccugcaaccugcucaagaacacgaucaacgaccccaaggcccugaccuccaaggacaugcgguucugccugaacacccuccagcacgagugguuccgcgugagcucccagaagagcgcgaucccggccauggucggggacuacaucgccgccuucgaggccaucucccccgacgugcugcgguacgugaucaaccuggcggacggcaacggcaacaccgcccuccacuacagcgucucccacagcaacuucgagaucgugaagcugcugcucgacgccgacgugugcaacgucgaccaccagaacaaggccggguacacgcccaucaugcuggccgcgcuggccgccguggaggccgagaaggacaugcgcaucguggaggagcucuucggcugcggggacgucaacgcgaaggccagccaggccggccagaccgcccugaugcuggccgugucccacgggcggaucgacauggugaagggccuccuggcgugcggcgccgacgucaacauccaggacgacgaggggagcaccgcccugaugugcgccuccgagcacggccacguggagaucgugaagcuccugcuggcccagcccgggugcaacggccaccucgaggacaacgacgggagcaccgcgcuguccaucgcccuggaggccggccacaaggacaucgccguccuccuguacgcccacgugaacuucgcgaaggcccagagcccgggcacgccccgccuggggcggaagaccucccccggcccgacccaccgcgggagcuucgacuga

SEQ ID NO: 31802 - RNA, 2556 nt, Artificial Sequence
  derived and/or modified sequence opt1 from KANK2__Homo_sapiens__NP_001129663
auggcccaggugcugcacguccccgccccguuccccggcacccccgggcccgcgagcccgcccgccuuccccgccaaggaccccgacccgcccuacuccguggagacccccuacggcuaccgccucgaccuggacuuccugaaguacguggacgacaucgagaaggggcacacgcuccggcgcgucgccgugcagcggcgcccccggcugagcucccugccgcgcggccccgggagcugguggaccuccaccgagagccucugcuccaacgccagcggcgacucccggcacagcgcguacuccuacugcggccgcggguucuacccccaguacggcgcccuggagacccgcgggggcuucaacccccggguggagcggacgcugcucgacgcccgccggcgccuggaggaccaggccgcgaccccgaccgggcugggcagccucacccccuccgccgccggcagcacggccucccuggucggggugggccugcccccgcccacgccccggagcuccgggcucagcacccccgugcccccguccgccggccaccuggcgcacguccgcgagcagauggccggcgcccugcggaagcuccgccagcuggaggagcaggucaagcugauccccgugcuccaggugaagcugagcgugcugcaggaggagaagcggcagcucaccgugcagcucaagagccagaaguuccuggggcaccccaccgccggccgcgggcgguccgagcugugccuggaccugcccgacccgcccgaggaccccgucgcccucgagacccgcagcgugggcaccugggugcgcgagcgggaccuggggaugccggacggcgaggcggcccuggccgccaaggucgccgugcucgagacccagcugaagaaggcgcugcaggagcuccaggccgcccaggcccgccaggccgacccccagccccaggcguggcccccgcccgacucccccgugcgggucgacacggugcgcguggucgagggcccccgggagguggaggucguggccagcaccgccgccggggcgccggcccagcgcgcccagucccuggagcccuacggcaccgggcugcgggcccucgccaugcccggccgccccgagagcccgcccguguuccggucccaggaggucguggagaccaugugccccgugcccgcggccgccacgagcaacguccacauggugaagaagaucuccaucaccgagcgcagcugcgacggggccgccggccugccggaggugcccgcggaguccagcuccagcccgcccggcuccgaggucgccagccugacccagcccgagaaguccaccgggcgggugcccacgcaggagcccacccaccgcgagcccacccggcaggccgccagccaggaguccgaggaggccggcgggaccggcgggccgcccgcgggcgugcgcagcaucaugaagcggaaggaggaggucgccgaccccacggcccaccgccggagccuccaguucgugggcgugaacgggggcuacgaguccagcuccgaggacagcuccaccgccgagaacaucagcgacaacgacuccaccgagaacgaggcgccggagccccgcgagcggguccccagcguggccgaggcgccccagcugcgcccggccgggaccgccgccgccaagacgucccgccaggagugccagcugagccgggagucccagcacauccccaccgccgagggcgccagcggcuccaacaccgaggaggagauccgcauggagcucagccccgaccugaucuccgccugccuggcgcucgagaaguaccuggacaaccccaacgcccugaccgagcgggagcugaagguggccuacacgaccguccuccaggaguggcugcgccuggccugccggagcgacgcccacccggagcucgugcgccggcaccuggugaccuuccgcgcgauguccgcccggcugcucgacuacgucgugaacaucgccgacagcaacgggaacaccgcccugcacuacagcgugucccacgcgaacuuccccgucgugcagcagcugcucgacagcggcgugugcaaggucgacaagcagaaccgcgccggguacucccccaucaugcugaccgcccuggccacgcucaagacccaggacgacaucgagaccgugcugcagcuguuccggcucggcaacaucaacgccaaggcgagccaggccgggcagaccgcccugaugcuggccgugucccacggccgcgucgacguggugaaggcccuccuggcgugcgaggccgacgucaacgugcaggacgacgacggcagcacggcccugaugugcgccugcgagcacgggcacaaggagaucgccggccuccugcuggcggugcccuccugcgacaucagccucaccgaccgggacggguccaccgcccugauggucgcccuggacgccggccagagcgagaucgccuccaugcucuacagccgcaugaacaucaagugcuccuucgcgccgaugagcgacgacgagucccccaccagcuccagcgccgaggaguga

SEQ ID NO: 31803 - RNA, 1104 nt, Artificial Sequence
  derived and/or modified sequence opt1 from KANK4__Homo_sapiens__NP_001307198
auggagaagaccgacgagaucagccccuccaccagccugaaguccaucaugaagaagaaggacuacggcuuccgcgccgggggcaacgggacgaagaagaaccuccaguucgugggcgucaacgggggcuacgagaccaccagcuccgaggagaccagcggcgaggacuccacgccggaggaccugagcgacuccgaggccgagaagaagugcgacgggcccgaccacaagcacgugaaggacgcgcaccugaccugcgaggccggccaggggauccccgaggggaccugccacgccgcccaggagagcggccccggcgaggaggugccgcacuccaaggccgagcgguacaagcccagcgaggaguuccucaacgcgugccgcgcccugucccagcaccuccccgagaccggcacgaccaccgaccagcugcugcggcagagccugaacaccaucucccaggagugguuccgcgucagcucccggaaguccuccagccccgccgugguggccagcuaccuccacgagguccagccgcacagcccccacuuccugaagcugcucgugaaccuggcggaccacaacgggaacacggcccugcacuacagcgugucccacagcaacuucuccaucgucaagcuccugcuggagaccggcgugugcaacguggaccaccagaacaaggccggguacaccgccgucaugaucacgccccucgccagcgcggagaccaacgaggacauggccgugguguggaagcugcugcgcgagggcaacgucaacauccaggccacccagggcgggcagaccgcccucaugcugggcgugucccacgaccgggaggacauggugcaggcccugcucagcugccaggcggacgucaaccugcaggaccacgacggguccagcgcccugaugguggccugccaccacggcaacguggaccucguccgccugcugcucgcccaccccgccugcgacuccagccugaccgacaaggcggggcggacggcccuguccaucgcccucaagagcccgacccacauggagaucgccggccugcugcgcgcccacgcggagcagggccggucccucgggcuguga

SEQ ID NO: 31804 - RNA, 3318 nt, Artificial Sequence
  derived and/or modified sequence opt1 from KANSL1__Homo_sapiens__XP_005275701
auggccgccauggcgcccgcccugaccgacgccgccgccgaggcgcaccacauccgcuucaagcucgccccgcccagcuccacccugagccccggcuccgccgagaacaacgggaacgccaacauccugaucgcggccaacggcacgaagcggaaggccaucgccgccgaggaccccagccucgacuuccgcaacaacccgaccaaggaggaccuggggaagcugcagccccucguggcguccuaccugugcagcgacgucaccuccgugcccagcaaggagucccugaagcuccagggcguguucagcaagcagaccguccugaagucccacccccugcucagccaguccuacgagcugcgggccgagcugcucgggcgccagccggugcuggaguucagccuggagaaccuccggacgaugaacaccuccggccagaccgcccugccccaggcccccgugaacggccuggccaagaagcucaccaagagcuccacgcacagcgaccacgacaacuccaccagccugaacgggggcaagcgcgcgcugaccagcuccgcccuccacgggggcgagauggggggcagcgaguccggcgaccugaaggggggcaugaccaacugcacgcugccccaccggagccucgacgucgagcacaccacccuguacuccaacaacagcaccgccaacaaguccagcgugaacuccauggagcagccggcccugcaggggagcucccgccucagccccggcacggacuccagcuccaaccugggcggggugaagcuggagggcaagaagagcccccucuccagcauccuguucuccgcccuggacagcgacacccggaucaccgcgcuccugcgccggcaggccgacaucgagagccgcgcccggcgccugcagaagcggcuccaggucgugcaggccaagcagguggagcgccacauccagcaccagcuggggggcuuccuggagaagacccucuccaagcugcccaaccuggagagccuccggccgcgcucccagcugaugcugacgcggaaggccgaggcggcccuccgcaaggccgccagcgagaccaccaccuccgaggggcugagcaacuuccugaaguccaacagcaucuccgaggagcuggagcgguucacggcgagcggcaucgccaaccuccgcugcuccgagcaggccuucgacagcgacgucaccgacuccagcuccggcggggagagcgacaucgaggaggaggagcugacccgcgccgaccccgagcagcggcacgugccccugcgccggcgcuccgaguggaagugggccgcggaccgggccgccaucgugagccgcuggaacuggcuccaggcccacgucagcgaccuggaguaccggauccgccagcagaccgacaucuacaagcagauccgggccaacaagggccugaucgugcucggggaggugcccccgcccgagcacacgaccgaccuguuccugccccucuccagcgaggucaagaccgaccacggcaccgacaagcugaucgaguccgugagccagccccuggagaaccacggggcgccgaucaucggccacaucuccgagagccucuccacgaagagcugcggcgcccugcgccccgugaacggggucaucaacacccugcagcccgugcucgccgaccacauccccggcgacuccagcgacgccgaggagcagcugcacaagaagcagcggcugaaccucguguccagcuccagcgacgggaccugcgucgccgcgcgcacccggccggugcuguccugcaagaagcgccggcugguccgccccaacagcaucgugccccucuccaagaaggugcaccggaacagcacgauccgcccgggcugcgacgucaaccccuccugcgcccugugcgggagcggcagcaucaacaccaugccccccgagauccacuacgaggccccgcugcucgagcggcugucccagcuggacagcugcgugcaccccgugcucgccuuccccgacgacguccccaccucccugcacuuccagagcaugcugaagucccaguggcagaacaagccguucgacaagaucaagccccccaagaagcucagccugaagcaccgcgcgcccaugccgggcucccugcccgaccccgcccgcaaggaccggcacaagcucgugagcuccuuccugaccaccgccaagcugagccaccaccagacgcgccccgaccggacccaccgccagcaccucgacgacgugggggccgucccgaugguggagcgggugaccgcccccaaggcggagcgccugcugaacccccccccgcccguccacgaccccaaccacuccaagaugcggcuccgcgaccacagcuccgagcggagcgaggugcugaagcaccacaccgacauguccagcuccagcuaccuggccgccacgcaccaccccccgcacuccccccucgugcgccagcugagcaccagcuccgacagccccgccccggccuccagcuccagccaggucaccgcguccaccagccagcagcccgugcggcgccggcgcggcgaguccagcuucgacaucaacaacaucgugauccccauguccgucgccgccacgacccggguggagaagcugcaguacaaggagauccucacccccagcuggcgcgagguggaccugcagucccugaaggggagcccggacgaggagaacgaggagaucgaggaccucuccgacgccgccuucgcggcccugcacgccaagugcgaggagauggagcgggcccgcuggcuguggaccacgagcguccccccccagcggcgcggcucccggagcuaccgcuccagcgacggccgcaccaccccccagcucgggagcgcgaacccguccaccccccagcccgccagccccgacguguccagcucccacagccuguccgaguacagccacggccaguccccgcggagccccaucucccccgagcugcacagcgccccccucacgccgguggcccgcgacaccccccggcaccuggccuccgaggacacccgcugcagcacccccgagcuggggcucgacgagcaguccguccagcccugggagcggcgcacguucccgcuggcgcacagcccccaggccgagugcgaggaccagcuggacgcccaggagcgggccgcccgcugcacccggcgcaccuccggcagcaagaccgggcgggagacggaggcggcccccaccucccccccgaccgugccccucaagagccgccaccugguggccgccgccaccgcgcagcggcccacgcaccgcuga

SEQ ID NO: 31805 - RNA, 2637 nt, Artificial Sequence
  derived and/or modified sequence opt1 from KANSL3__Homo_sapiens__NP_001108488
auggcccaccgcggcggggagcgggacuuccagaccagcgcccgccggaugggcaccucccuccuguuccagcugagcgugcacgagcgcgagcuggaccucgucuuccuggaccacuccuacgcgaagcccuggagcgcccacccggacgccuccagcgcccggcccacgcgcaugcuguucgugacgccccggcgccagcacgaguccaccaucgagagcgacgugcccaucgacgucgagaccgugaccuccaccccgaugccccucuacgacaaccagaaggcccggagcgugaugaacgagugcgagcgccacgucaucuucgcgcggaccgacgccgacgccccgccgccgcccgaggacugggaggagcacgugaaccgcaccggguggacgauggcccagaacaagcuguucaacaagauccugaaggcgcuccaguccgaccggcuggcccgccuggccaacgagggcgccugcaacgagcccgugcuccggcgcgucgccguggacaagugcgcgcggcgcgugcggcaggcccuggccagcgucuccugggacaccaagcugauccaguggcuccacaccacccugguggagacgcugagccuccccaugcuggccgccuaccuggacgcgcuccagacccugaaggggaagauccccacccugaucgaccgcaugcucguguccagcaacaccaagacgggcgccgccggcgccgaggcccugucccugcuccugaagcggcccugggaccccgcggucggggugcugagccacaacaagcccuccaagcuccccggcagcccccugauccugaucgccagcuccgggcccagcuccagcguguuccccaccucccgccgccaccgguucuggcagagccagcucuccugccugggcaaggucaucccgguggccacccaccuccugaacaacgggagcggcgugggcguccugcagugccuggagcacaugaucggggccgugcgcuccaaggugcucgagauccacagccacuucccccacaagcccaucauccugaucggcuggaacaccggggcccuggucgcgugccacguguccgucauggaguacgugacggccguggucugccucggcuucccccugcugaccguggacggcccgcgcggggacguggacgacccccuccuggacaugaagacccccguccuguucgugaucggccagaacagccuccagugccaccccgaggccauggaggacuuccgggagaagauccgggccgagaacucccugguggucgucgggggcgcggacgacaaccugcgcaucagcaaggccaagaagaaguccgaggggcugacccagagcaugguggaccggugcauccaggacgagaucguggacuuccucacgggcgugcugacccgcgccgagggccacaugggguccgagccgcgggaccaggacgccgagaagaagaagaagccccgcgacguggcccggcgcgaccuggcguucgagguccccgagcggggcagccgcccggccucccccgccgccaagcuccccgccagccccagcggguccgaggaccugagcuccgugagcuccagcccgaccuccagccccaagaccaaggugacgaccgucaccuccgcgcagaaguccucccagaucggcagcucccagcugcucaagcggcacgugcagcgcaccgaggccgugcugacgcacaagcaggcccagguccccaucagcuccgagcccccggaggagggggagaaggaggaccugcgggugcagcucaagcgccaccaccccagcagcccccugcccggcagcaagaccagcaagcggccgaagaucaaggugucccugaucagccagggcgacaccgccgggggccccugcgcccccucccaggggagcgcgcccgaggccgccggcgggaagccgaucaccaugacgcucggccaggccuccgcgggcgccaaggagcugaccgggcugcucaccaccgccaagagcuccagcuccgagggcggggucagcgccucccccgugcccagcguggucuccagcuccaccgcccccagcgcgcugcacacgcugcagucccgccucguggccaccagcccgggcuccagccugcccggcgccaccagcgccuccagccugcuccaggggcuguccuucagccugcaggacaucuccagcaagaccuccggccuccccgccaaccccagcccggggcccgcgccccaggccacguccgugaagcugccgacccccaugcagagccugggcgccaucaccaccgggacguccaccaucguccgcaccauccccguggccaccacgcucagcucccugggcgccacccccggcgggaagccgaccgcgauccaccagcugcucaccaacggcgggcuggccaagcuggccagcucccuccccggccuggcccagaucagcaaccaggcguccgggcugaaggugcccacgaccaucacccucacccugcggggccagcccagccgcaucacgacccuguccccgaugggcagcggggccgcccccagcgaggaguccagcucccagguccuccccagcuccagccagcggcugcccccggcccccuga

SEQ ID NO: 31806 - RNA, 1878 nt, Artificial Sequence
  derived and/or modified sequence opt1 from KARS__Homo_sapiens__NP_001123561
augcugacccaggccgccgugcgccucguccggggcagccugcgcaagaccuccugggcggagugggggcaccgggagcugcgccucggccagcuggcccccuucacggccccgcacaaggacaagagcuucuccgaccagcggagcgagcugaagcgccggcucaaggccgagaagaagguggccgagaaggaggcgaagcagaaggagcuguccgagaagcagcugagccaggccaccgccgccgcgaccaaccacaccacggacaacggggugggccccgaggaggaguccgucgaccccaaccaguacuacaagauccgcagccaggccauccaccagcucaaggugaacggggaggaccccuacccgcacaaguuccacguggacaucucccugaccgacuucauccagaaguacagccaccuccagcccggcgaccaccucaccgacaucacccugaaggucgccggccggauccacgccaagcgcgccuccgggggcaagcugaucuucuacgaccuccgcggggagggcgugaagcuccaggugauggcgaacagccggaacuacaaguccgaggaggaguucauccacaucaacaacaagcugcggcgcggggacaucaucggcguccagggcaaccccgggaagacgaagaagggcgagcucagcaucauccccuacgagaucacccugcugucccccugccuccacaugcugccccaccuccacuucgggcugaaggacaaggagacccgguaccgccagcgguaccuggaccugauccucaacgacuucgugcgccagaaguucaucauccggagcaagaucaucaccuacauccgcuccuuccuggacgagcugggcuuccucgagaucgagacgcccaugaugaacaucauccccggcggggccguggccaagccguucaucaccuaccacaacgagcuggacaugaaccuguacaugcggaucgcccccgagcucuaccacaagaugcuggucgugggcgggaucgaccgcguguacgagaucggccgccaguuccggaacgaggggaucgaccugacccacaaccccgaguucaccacgugcgaguucuacauggccuacgcggacuaccacgaccucauggagaucaccgagaagauggucagcggcauggugaagcacaucaccggcuccuacaaggugaccuaccaccccgacgggccggagggccaggccuacgacgucgacuucacgccgcccuuccgccggaucaacaugguggaggagcuggagaaggcccuggggaugaagcuccccgagaccaaccuguucgagaccgaggagacccgcaagauccuggacgacaucugcguggccaaggccgucgagugcccgccgccccggacgaccgcgcgccuccuggacaagcuggugggcgaguuccucgaggugaccugcaucaaccccaccuucaucugcgaccacccccagaucaugagcccccuggccaaguggcaccggagcaaggaggggcugacggagcgcuucgagcuguucgucaugaagaaggagaucugcaacgccuacaccgagcugaacgaccccaugcggcagcgccagcuguucgaggagcaggccaaggccaaggcggccggcgacgacgaggccauguucaucgacgagaacuucugcaccgcccuggaguacggccugccgcccaccgcgggguggggcauggggaucgaccggguggccauguuccugacggacuccaacaacaucaaggagguccuccuguuccccgccaugaagcccgaggacaagaaggagaacguggccaccaccgacacccuggagagcacgaccgugggcaccuccgucuga

SEQ ID NO: 31807 - RNA, 2514 nt, Artificial Sequence
  derived and/or modified sequence opt1 from KAT2A__Homo_sapiens__NP_066564
auggccgagcccagccaggcccccacccccgcgcccgccgcccagccccgcccgcugcagucccccgcccccgcccccaccccgacgcccgcgcccagccccgccuccgccccgauccccacccccacccccgccccggcgcccgcccccgccgccgcccccgcgggcagcaccgggacgggcgggccgggcgugggguccggcggcgccgggagcggcggggaccccgcccggcccggccucucccagcagcagcgcgccagccagcggaaggcccagguccgcgggcugccccgggcgaagaagcuggagaagcucggcguguucuccgccugcaaggccaacgagaccugcaagugcaacggcuggaagaacccgaagccgcccaccgcgccccgcauggaccugcagcagcccgccgccaaccugagcgagcucugccgguccugcgagcacccccuggccgaccacgugagccaccuggagaacgucuccgaggacgagaucaaccgccuccuggggauggugguggacgucgagaaccuguucaugagcgugcacaaggaggaggacaccgacacgaagcaggucuacuucuaccucuucaagcugcugcggaagugcauccuccagaugacccgccccgugguggagggcucccuggggagcccgcccuucgagaagcccaacaucgagcagggcgugcugaacuucguccaguacaaguucucccaccucgcgccccgggagcgccagaccauguucgagcugagcaagauguuccugcucugccugaacuacuggaagcuggagaccccggcccaguuccggcagcgcucccaggccgaggacguggccacguacaaggugaacuacacccgguggcucugcuacugccacgucccccagagcugcgacagccugccccgcuacgagaccacccacguguucggccggucccugcuccgcagcaucuucacggugacccggcgccagcugcuggagaaguuccgggucgagaaggacaagcucgugcccgagaagcgcacccugauccugacccacuucccgaaguuccucuccaugcuggaggaggagaucuacggggccaacagccccaucugggaguccggcuucacgaugccgcccagcgaggggacccagcuggugccccgccccgccuccgucagcgccgcgguggugcccuccacccccaucuucagcccguccaugggcgggggcagcaacuccagccucucccuggacagcgccggcgccgagcccaugcccggggagaagcggacccugcccgagaaccucacgcuggaggacgccaagcgccugcgggucaugggcgacaucccgauggagcucgugaacgaggucaugcugaccaucaccgaccccgccgcgaugcuggggcccgagaccucccuccugagcgccaacgccgcccgcgacgagacggcccggcuggaggagcgccggggcaucaucgaguuccacgugaucgggaacucccucacccccaaggcgaaccgccgggugcugcuguggcuggucggccuccagaacguguucagccaccagcugccgcgcaugcccaaggaguacaucgcccggcugguguucgaccccaagcacaagacccucgcccugaucaaggacggccgcgucaucgggggcaucugcuuccggauguucccgacccagggguucacggagaucguguucugcgccgugaccagcaacgagcaggucaagggcuacgggacccaccugaugaaccaccucaaggaguaccacaucaagcacaacauccuguacuuccugaccuacgccgacgaguacgcgaucggcuacuucaagaagcagggcuucuccaaggacaucaaggugcccaagagccgcuaccucggguacaucaaggacuacgagggcgccacgcugauggagugcgagcugaacccccggauccccuacaccgagcucucccacaucaucaagaagcagaaggagaucaucaagaagcugaucgagcgcaagcaggcccagauccggaagguguacccggggcugagcugcuucaaggagggcguccgccagauccccguggaguccgugcccggcauccgggagaccggguggaagccccucggcaaggagaaggggaaggagcugaaggacccggaccagcuguacaccacccucaagaaccugcuggcccagaucaagagccaccccuccgcguggcccuucauggagcccgucaagaaguccgaggccccggacuacuacgaggugauccgcuuccccaucgaccucaagacgaugaccgagcgccugcggagccgcuacuacgugacccggaagcuguucgucgccgaccuccagcgcgugaucgccaacugccgggaguacaacccgcccgacagcgaguacugccgcugcgccuccgcgcuggagaaguucuucuacuucaagcugaaggagggcgggcucaucgacaaguga

SEQ ID NO: 31808 - RNA, 2499 nt, Artificial Sequence
  derived and/or modified sequence opt1 from KAT2B__Homo_sapiens__NP_003875
augagcgaggccggcggggccggccccgggggcugcggggcgggcgccggcgccggggccggcccgggggcccugccgccccagcccgcggcccucccgcccgccccgccccagggcucccccugcgccgcggccgccgggggcagcggcgccugcgggcccgccaccgcgguggccgccgccggcaccgccgaggggcccggcggcgggggcuccgcgcgcaucgccgucaagaaggcccagcugcggagcgcgccccgcgccaagaagcuggagaagcucgggguguacuccgccugcaaggccgaggagagcugcaagugcaacggcuggaagaacccgaaccccucccccacgcccccgcgggccgaccugcagcagaucaucgugagccugaccgaguccugccgcagcugcucccacgcccucgccgcgcacgucagccaccuggagaacguguccgaggaggagaugaaccggcugcucgggaucgugcuggacgucgaguaccuguucacgugcgugcacaaggaggaggacgccgacaccaagcaggucuacuucuaccucuucaagcugcugcgcaagagcauccuccagcggggcaagcccgucguggagggcucccuggagaagaagccgcccuucgagaagcccagcaucgagcagggggugaacaacuucguccaguacaaguucucccaccucccggccaaggagcgccagacgaucguggagcuggccaagauguuccugaaccggaucaacuacuggcaccuggaggcgcccagccagcgccggcuccgcucccccaacgacgacaucagcggcuacaaggagaacuacacccgguggcugugcuacugcaacgugccccaguucugcgacagccugccccgcuacgagaccacccagguguucgggcggacccuccugcgcuccguguucaccgugaugcggcgccagcugcucgagcaggcccggcaggagaaggacaagcugccccuggagaagcgcacccucauccugacccacuuccccaaguuccugagcaugcucgaggaggaggucuacucccagaacagcccgaucugggaccaggacuuccuguccgccagcucccggacgagccagcugggcauccagaccgugaucaacccgccgcccguggccgggaccaucuccuacaacagcaccuccagcucccucgagcagcccaacgccggcagcuccagccccgcgugcaaggccuccagcggccuggaggccaaccccggggagaagcgcaagaugacggacucccacguccuggaggaggccaagaagccccgcgugaugggcgacauccccauggagcucaucaacgaggugaugagcaccaucaccgaccccgccgcgaugcuggggcccgagaccaacuuccugagcgcccacuccgcccgggacgaggccgcccgccucgaggagcggcgcggcgucaucgaguuccacguggucgggaacagccugaaccagaagcccaacaagaagauccugauguggcucgugggccugcagaacguguucucccaccagcugccccggaugcccaaggaguacaucacgcgccucgucuucgaccccaagcacaagacccuggcgcugaucaaggacggccgggugaucgggggcaucugcuuccgcauguucccgagccagggguucaccgagaucguguucugcgccgucaccuccaacgagcaggucaagggcuacggcacgcaccugaugaaccaccucaaggaguaccacaucaagcacgacauccugaacuuccugaccuacgccgacgaguacgccaucggguacuucaagaagcagggcuucagcaaggagaucaagauccccaagaccaaguacgugggguacaucaaggacuacgagggcgcgacccucauggggugcgagcugaacccccggauccccuacacggaguucuccgugaucaucaagaagcagaaggagaucaucaagaagcugaucgagcgcaagcaggcccagauccggaagguguacccgggccucagcugcuucaaggacggcgugcgccagauccccaucgaguccauccccgggauccgggagaccggcuggaagcccagcgggaaggagaaguccaaggagccgcgcgaccccgaccagcuguacagcacccugaaguccauccuccagcaggucaagagccaccaguccgccuggcccuucauggagcccgugaagcggaccgaggccccgggcuacuacgaggugauccgcuuccccauggaccugaagacgaugagcgagcggcugaagaaccgcuacuacgucuccaagaagcuguucauggccgaccuccagcggguguucaccaacugcaaggaguacaacccgcccgagagcgaguacuacaagugcgcgaacauccuggagaaguucuucuucagcaagaucaaggaggccgggcucaucgacaaguga

SEQ ID NO: 31809 - RNA, 1485 nt, Artificial Sequence
  derived and/or modified sequence opt1 from KAT5__Homo_sapiens__NP_001193762
auggccgagguggucagccccgugccgggcgccgggcgccgggagcccggcgagguggggcgcgcgcggggcccgcccgucgccgaccccgggguggcccugagcccccagggcgagaucaucgagggcugccgccuccccgugcugcggcgcaaccaggacaacgaggacgaguggccccuggccgagauccucuccgucaaggacaucuccgggcggaagcuguucuacgugcacuacaucgacuucaacaagcgccuggacgagugggugacccacgagcggcucgaccugaagaagauccaguucccgaagaaggaggccaagacccccacgaagaacggccugcccgggagccgccccggcuccccggagcgggaggucaagcgcaagguggagguggucagccccgcgacccccgugcccuccgagaccgccccggccagcguguucccccagaacggggccgcgcggcgcgccgucgccgcccagcccggccggaagcgcaaguccaacugccucggcaccgacgaggacagccaggacuccagcgacgggauccccuccgccccgcggaugacgggcagccugguguccgaccgcagccacgacgacaucgugacccggaugaagaacaucgagugcaucgagcuggggcgccaccggcucaagcccugguacuucucccccuacccccaggagcugaccacccugccgguccucuaccugugcgaguucugccugaaguacggccgcagccucaagugccugcagcgccaccugacgaagugcgaccuccggcacccgcccggcaacgagaucuaccgcaaggggaccaucuccuucuucgagaucgacggccggaagaacaagagcuacagccagaaccugugccugcucgcgaagugcuuccuggaccacaagacccuguacuacgacaccgaccccuuccucuucuacgugaugacggaguacgacugcaagggguuccacaucgugggcuacuucuccaaggagaaggagagcaccgaggacuacaacgucgccugcauccugacccugccgcccuaccagcgccggggguacggcaagcuccugaucgaguucuccuacgagcugagcaagguggagggcaagaccgggacgcccgagaagccccucuccgaccugggccugcucagcuaccgcuccuacuggagccagaccauccuggagauccugauggggcucaaguccgagagcggcgagcggccccagaucaccaucaacgagaucuccgagaucaccagcaucaagaaggaggacgugaucuccacgcugcaguaccugaaccucaucaacuacuacaaggggcaguacauccugacccugagcgaggacaucgucgacggccacgagcgcgccaugcucaagcggcugcugcgcaucgacuccaagugccuccacuucacccccaaggacuggagcaagcggggcaagugguga

SEQ ID NO: 31810 - RNA, 6015 nt, Artificial Sequence
  derived and/or modified sequence opt1 from KAT6A__Homo_sapiens__NP_006757
auggugaagcucgccaacccccucuacaccgaguggauccucgaggccaucaagaaggugaagaagcagaagcagcgccccagcgaggagcggaucugcaacgccgugagcagcagccacggccucgaccgcaagaccgugcucgagcagcuggagcugagcgucaaggacggcaccauccucaaggugagcaacaagggccugaacagcuacaaggaccccgacaaccccgggcggaucgcccugcccaagccccgcaaccacggcaagcucgacaacaagcagaacguggacuggaacaagcugaucaagcgggccgucgaggggcuggccgagagcggcggcagcacccucaagagcaucgagcgcuuccugaaggggcagaaggacgugagcgcccuguucggcggguccgccgccagcggcuuccaccagcagcuccggcuggccaucaagcgcgccaucgggcacggccggcugcucaaggacggcccccuguaccgccugaacaccaaggcgaccaacguggacgggaaggaguccugcgagagccucuccugccugccgcccgucagccugcucccgcacgagaaggacaagcccguggccgagcccauccccaucugcuccuucugccugggcaccaaggagcagaaccgggagaagaagccggaggagcugaucagcugcgccgacugcgggaacuccggccaccccagcugccucaaguucagccccgagcugaccgugcgcgucaaggcccugcgguggcagugcaucgagugcaagaccugcuccagcugccgcgaccagggcaagaacgccgacaacaugcuguucugcgacuccugcgaccggggguuccacauggagugcugcgacccgccccugacccgcaugcccaagggcauguggaucugccagaucugccggccccgcaagaaggggcggaagcugcuccagaagaaggcggcccagaucaagcgccgguacaccaaccccaucggccgccccaagaaccgccugaagaagcagaacaccgugagcaaggggcccuucuccaaggugcggaccggccccggccgcgggcggaagcgcaagaucacccugagcucccagagcgccuccagcuccagcgaggagggcuaccucgagcggaucgacgggcuggacuucugccgcgacuccaacgucagccugaaguucaacaagaagacgaagggccucaucgacgggcugaccaaguucuucacccccuccccggacggccggaaggcccgcggcgaggugguggacuacagcgagcaguaccggauccgcaagcgggggaaccgcaaguccagcaccuccgacuggcccacggacaaccaggacggcugggacgggaagcaggagaacgaggagcggcuguucggcagccaggagaucaugaccgagaaggacauggagcuguuccgcgacauccaggagcaggcccugcagaaggucggggugaccgggccgcccgacccccaggugcggugccccagcgucaucgaguucggcaaguacgagauccacaccugguacuccagccccuacccgcaggaguacucccgccugcccaagcucuaccugugcgaguucugccugaaguacaugaagucccggacgauccuccagcagcacaugaagaagugcgggugguuccacccgcccgcgaacgagaucuaccgcaagaacaacaucuccguguucgagguggacggcaacgucagcaccaucuacugccagaaccugugccugcuggccaagcuguuccuggaccacaagacccuguacuacgacguggagcccuuccucuucuacguccugacccagaacgacgugaaggggugccaccuggugggcuacuucuccaaggagaagcacugccagcagaaguacaacgucagcugcaucaugauccucccccaguaccagcggaagggcuacgggcgcuuccugaucgacuucuccuaccugcucagcaagcgcgagggccaggccgggucccccgagaagccccugagcgaccugggccggcucuccuacauggccuacuggaaguccgugauccuggagugccuguaccaccagaacgacaagcagaucuccaucaagaagcucagcaagcugacggggaucugcccgcaggacaucaccuccacccugcaccaccuccgcaugcuggacuuccggagcgaccaguucgugaucauccgccgggagaagcugauccaggaccacauggccaagcuccagcugaaccugcgccccgucgacguggaccccgagugccuccgguggacccccgugaucgucagcaacuccguggugagcgaggaggaggaggaggaggcggaggagggcgagaacgaggagccgcagugccaggagcgcgagcuggagaucuccgucggcaagagcgugucccacgagaacaaggagcaggacagcuacuccguggagagcgagaagaagcccgaggucauggcccccguguccagcacgcggcuguccaagcagguccucccccacgacagccugccggccaacucccagcccagccgccgggggcgcuggggccggaagaaccgcaagacccaggagcgguucggggacaaggacuccaagcugcuccuggaggagaccagcuccgcgccccaggagcaguacggcgagugcggggagaaguccgaggccacccaggagcaguacacggaguccgaggagcagcuggucgcgagcgaggagcagcccagccaggacggcaagccggaccuccccaagcgccggcuguccgagggcguggagcccuggcgcgggcagcugaagaagucccccgaggcccucaagugccggcugaccgagggcuccgagcgccugccgcggcgcuacagcgagggggaccgcgccgugcuccggggcuucuccgagagcuccgaggaggaggaggagcccgagagcccccgcuccagcuccccgcccauccugaccaagcccacccugaagcggaagaagcccuuccuccaccgccggcgccggguccgcaagcggaagcaccacaacagcuccguggugacggagaccaucagcgagaccaccgagguccuggacgagccguucgaggacuccgacagcgagcgccccaugccccggcuggagcccaccuucgagaucgacgaggaggaggaggaggaggacgagaacgagcuguucccgcgcgaguacuuccggcgccuguccagccaggacgugcugcggugccaguccagcagcaagcgcaaguccaaggacgaggaggaggacgaggagagcgacgacgccgacgacacgcccauccucaagcccgugucccugcugcggaagcgcgacgucaagaacagcccccucgagccggacaccuccacgccccucaagaagaagaagggguggcccaagggcaagagccggaagcccauccacuggaagaagcgcccgggccgcaagcccggguucaagcugucccgggagaucaugcccgugagcacccaggcgugcgugaucgagcccaucgucuccaucccgaaggccggccgcaagcccaagauccaggagagcgaggagacgguggagcccaaggaggacaugccccucccggaggagcggaaggaggaggaggagaugcaggccgaggccgaggaggccgaggagggggaggaggaggacgcggccuccagcgaggugcccgccgccucccccgccgacagcuccaacagccccgagaccgagaccaaggagccggaggucgaggaggaggaggagaagccccgcguguccgaggagcagcggcagagcgaggaggagcagcaggagcuggaggagcccgagccggaggaggaggaggacgcggccgccgagaccgcccagaacgacgaccacgacgccgacgacgaggacgacggccaccuggaguccacgaagaagaaggagcucgaggagcagcccacccgcgaggacgugaaggaggagcccgggguccaggagagcuuccuggacgcgaacaugcagaagucccgggagaagaucaaggacaaggaggagaccgagcuggacuccgaggaggagcagcccagccacgacaccuccguggugagcgagcagauggccggcuccgaggacgaccacgaggaggacagccacacgaaggaggagcucaucgagcugaaggaggaggaggagaucccgcacuccgagcuggaccucgagaccguccaggccgugcagagccugacccaggaggaguccagcgagcacgagggcgccuaccaggacugcgaggagacccuggcggccugccagacgcuccaguccuacacccaggccgacgaggacccccagaugagcaugguggaggacugccacgccuccgagcacaacagccccaucuccagcguccagucccaccccagccaguccgugcgcagcgugagcuccccgaacguccccgcccuggagagcggguacacccagaucucccccgagcagggcagccuguccgcgcccagcaugcagaacauggagaccuccccgaugauggacgugcccagcguguccgaccacagccagcaggucguggacuccggguucagcgaccucggcuccaucgagagcacgaccgagaacuacgagaaccccuccagcuacgacuccaccaugggcgggagcaucugcggcaacuccagcagccaguccagcugcuccuacgggggccugagcuccagcuccagccugacccaguccagcugcguggucacgcagcagauggccuccauggggagcuccugcagcaugaugcagcaguccagcgugcagcccgccgccaacugcuccaucaagagcccgcagagcugcgucguggagcggccgcccuccaaccagcagcagcagcccccgcccccgccgccccagcagccccagccgcccccgccccagccccagccggcgccccagccgcccccgccccagcagcagccccagcagcagccccagccccagccccagcagcccccgccgccgcccccgccccagcagcagccgccccucagccagugcuccaugaacaacagcuucacccccgcgcccaugaucauggagauccccgaguccggcagcaccggcaacaucuccaucuacgagcgcauccccggggacuucggcgccgggagcuacucccagcccagcgccaccuucucccuggccaagcugcagcagcucacgaacaccaucauggacccccacgccaugcccuacagccacucccccgcggugaccagcuacgccaccuccgucagccuguccaacacgggccuggcccagcucgcccccagccacccccuggcggggacgccccaggcccaggccaccaugacgcccccgcccaaccuggccuccacgaccaugaaccucaccagcccccugcugcagugcaacaugagcgccaccaacaucggcaucccccacacccagcggcuccagggccagaugcccgugaaggggcacaucuccauccgcagcaaguccgcgccccugcccagcgccgccgcccaccagcagcagcuguacggccggucccccagcgccguggcgaugcaggccgggccgcgcgcccucgccguccagcggggcaugaacaugggggugaaccugaugcccacgcccgccuacaacgugaacuccaugaacaugaacacccugaacgcgaugaacagcuaccgcaugacccagcccaugaugaacuccagcuaccacuccaacccggccuacaugaaccagaccgcccaguaccccaugcagaugcagaugggcaugaugggcagccaggccuacacgcagcagcccaugcagcccaacccgcacgggaacaugauguacaccggccccucccaccacagcuacaugaacgccgcggggguccccaagcagucccucaacggccccuacaugcggcgcuga

SEQ ID NO: 31811 - RNA, 5673 nt, Artificial Sequence
  derived and/or modified sequence opt1 from KAT6B__Homo_sapiens__NP_001243397
auggugaagcuggccaacccccucuacaccgaguggauccuggaggccauccagaagaucaagaagcagaagcagcggcccagcgaggagcggaucugccacgcgguguccaccagccacggccuggacaagaagaccguguccgagcagcucgagcugagcgugcaggacggguccgugcugaaggugaccaacaagggccucgccagcuacaaggaccccgacaaccccgggcgcuucuccagcgugaagcccggcaccuuccccaaguccgccaaggggagccggggcuccugcaacgaccugcgcaacgucgacuggaacaagcugcuccggcgcgccaucgagggccuggaggagcccaacgggagcucccugaagaacaucgagaaguaccuccggagccaguccgaccugaccagcaccaccaacaaccccgccuuccagcagcgccugcggcucggcgcgaagcgcgccgugaacaacgggcggcugcugaaggacggcccccaguaccgcgugaacuacgggucccucgacggcaagggcgcgccccaguaccccagcgccuuccccuccagccugccgcccgucagccugcucccccacgagaaggaccagccccgggccgaccccauccccaucugcuccuucugccuggggaccaaggagagcaaccgcgagaagaagcccgaggagcugcucuccugcgccgacugcggcagcuccgggcaccccagcugccugaaguucugccccgagcugaccaccaacgugaaggcccuccgguggcagugcaucgagugcaagaccugcuccgccugccgcgugcagggccggaacgccgacaacaugcuguucugcgacagcugcgaccgcggcuuccacauggagugcugcgacccgccccugucccggaugcccaaggggauguggaucugccaggucugccgccccaagaagaagggccggaagcuccugcacgagaaggcggcccagaucaagcgccgcuacgccaagcccaucgggcggcccaagaacaagcugaagcagcgccuccugagcgugaccuccgacgagggcagcaugaacgccuucaccgggcggggcucccccggccgcgggcagaagacgaaggugugcaccacccccagcuccggccacgccgcgagcgggaaggacuccagcucccggcuggccgucaccgaccccacgcgccccggcgccaccaccaagaucaccacgaccagcaccuacaucagcgccuccacccucaaggugaacaagaagacgaaggggcugaucgacggccugaccaaguucuucacccccagccccgacggccggcgcucccgcggggagaucaucgacuucagcaagcacuaccgcccccggaagaaggugucccagaagcagagcugcaccucccacguccucgccacggacaccgagaucaagaucaacaucaagcaggagagcgcggacgugaacgugaucggcaacaaggacgucgugaccgaggaggaccuggacguguucaagcaggcccaggagcuguccugggagaagaucgagugcgagagcggggucgaggacugcggccgcuaccccuccgugaucgaguucgggaaguacgagauccagaccugguacagcucccccuacccccaggaguacgcccggcuccccaagcuguaccugugcgaguucugccucaaguacaugaaguccaagaacauccugcugcgccacuccaagaagugcggcugguuccacccgcccgccaacgagaucuaccggcgcaaggaccucagcgucuucgagguggacggcaacauguccaagaucuacugccagaaccugugccugcuggccaagcuguuccuggaccacaagacgcuguacuacgacguggagccguuccucuucuacguccugaccaagaacgacgagaaggggugccaccuggugggcuacuucagcaaggagaagcucugccagcagaaguacaacgugagcugcaucaugaucaugccccagcaccagcggcagggguucggccgcuuccugaucgacuucuccuaccugcucagccggcgcgagggccaggcggggucccccgagaagccccugagcgaccugggccgccucuccuaccuggccuacuggaaguccgucauccuggaguaccucuaccaccaccacgagcggcacaucuccaucaaggccaucagccgcgccaccgggaugugcccgcacgacaucgcgaccacgcugcagcaccuccacaugaucgacaagcgggacggccgcuucgugaucauccggcgcgagaagcucauccugucccacauggagaagcugaagaccugcagccgggccaacgagcucgaccccgacucccugcgcuggacccccauccugaucagcaacgccgccguguccgaggaggagcgggaggccgagaaggaggcggagcgccucauggagcaggccagcugcugggagaaggaggagcaggagauccuguccacccgggccaacagccgccagucccccgccaagguccagagcaagaacaaguaccugcacuccccggagagccggcccgugaccggggagcgcggccagcuccuggagcugagcaaggaguccagcgaggaggaggaggaggaggaggacgaggaggaggaggaggaggaggaggaggaggaggaggacgaggaggaggaggaggaggaggaggaggaggaggaggaggagaacauccaguccuccccgccccggcucacgaagccgcaguccguggccaucaagcgcaagcggcccuucguccugaagaagaagcgcggccggaagcgccggcgcaucaacagcuccgugaccaccgagaccaucagcgagacgaccgaggugcugaacgagcccuucgacaacuccgacgaggagcgccccaugccgcagcucgagccgaccugcgagaucgaggucgaggaggacgggcggaagcccgugcugcgcaaggcguuccagcaccagccgggcaagaagcggcagaccgaggaggaggaggggaaggacaaccacugcuucaagaacgccgaccccugccgcaacaacaugaacgacgacagcuccaaccugaaggagggcagcaaggacaaccccgagccccucaagugcaagcaggucuggccgaaggggacgaagcggggccuguccaaguggcgccagaacaaggagcggaagaccggcuucaagcugaaccucuacacgccgcccgagacccccauggagccggacgagcaggucacgguggaggagcagaaggagaccagcgaggggaagaccucccccagccccauccgcaucgaggaggaggugaaggagaccggcgaggcccugcugccccaggaggagaaccggcgcgaggagacgugcgccccggucucccccaacaccagccccggggagaagcccgaggacgaccucaucaagccggaggaggaggaggaggaggaggaggaggaggaggaggaggaggaggaggaggagggcgaggaggaggagggcgggggcaacguggagaaggaccccgacggggccaagucccaggagaaggaggagcccgagaucagcaccgagaaggaggacagcgcgcggcuggacgaccacgaggaggaggaggaggaggacgaggagcccucccacaacgaggaccacgacgccgacgacgaggacgacagccacauggaguccgccgagguggagaaggaggagcugccgcgcgagagcuucaaggagguccucgagaaccaggagaccuuccuggaccugaacgugcagcccggccacuccaaccccgaggugcucauggacugcggggucgaccugacggccagcugcaacuccgagcccaaggagcuggcgggcgacccggaggccgugcccgagagcgacgaggagccgccgcccggggagcaggcccagaagcaggaccagaagaacuccaaggagguggacaccgaguucaaggagggcaaccccgccaccauggagaucgacagcgagaccguccaggccgugcagucccucacgcaggagagcuccgagcaggacgacaccuuccaggacugcgcggagacccaggaggccugccggagccugcagaacuacacccgcgccgaccagagcccccagaucgccacgacccuggacgacugccagcagagcgaccacuccagccccguguccagcguccacagccaccccggccaguccgugcggagcgugaacucccccagcguccccgcccucgagaacuccuacgcgcagaucagcccggaccaguccgccaucagcgugcccucccugcagaacauggagaccagccccaugauggacgugcccuccgucagcgaccacucccagcaggucguggacagcggguucuccgaccugggcagcaucgaguccaccacggagaacuacgagaacccgagcuccuacgacagcaccaugggcgggagcaucugcggcaacggguccagccagaacuccugcagcuacuccaaccucaccagcuccagccugacccaguccagcugcgccgucacgcagcagauguccaacaucagcggcuccugcagcaugcugcagcagaccuccaucagcagcccgccgaccugcagcgucaagagcccccaggggugcgugguggagcgcccgcccagcagcucccagcagcucgcccagugcagcauggccgcgaacuucacgccgcccaugcagcuggccgagaucccggagaccuccaacgccaacaucggccuguacgagcggauggggcagagcgacuucggcgccggccacuacccccagcccuccgcgacguucagccucgccaagcugcagcagcugaccaacacccucaucgaccacucccugcccuacagccacuccgccgccgugaccagcuacgccaacuccgcgagccuguccacgccgcucagcaacaccgggcuggugcagcugucccagagcccccacuccguccccggcgggccccaggcccaggccaccaugaccccgccgcccaaccucacgcccccgcccaugaaccugcccccgccccugcuccagcgcaacauggccgccagcaacaucggcaucagccacucccagcggcugcagacccagaucgcgagcaaggggcacaucuccaugcgcaccaagagcgccucccugagccccgccgccgccacccaccagucccagaucuacggccgcagccagacgguggcgaugcagggccccgcccggacccucaccaugcagcgcgggaugaacauguccgugaaccugaugccggcccccgccuacaacgucaacagcgugaacaugaacaugaacacccugaacgccaugaacggcuacuccaugagccagcccaugaugaacuccggguaccacagcaaccacggcuacaugaaccagacgccccaguacccgaugcagaugcagauggggaugaugggcacccagcccuacgcgcagcagcccaugcagacgccgccccacggcaacaugauguacaccgcccccgggcaccacggcuacaugaacacggggauguccaagcagagccucaacggcuccuacaugcggcgcuga

SEQ ID NO: 31812 - RNA, 1746 nt, Artificial Sequence
  derived and/or modified sequence opt1 from KAT7__Homo_sapiens__NP_001186084
augccccgccggaagcgcaacgccggcagcuccagcgacgggaccgaggacuccgacuucagcaccgaccuggagcacacggacuccagcgaguccgacggcaccagccggcgcuccgcccgggugacccgcagcuccgcgcggcucagccaguccagccaggacuccagcccgguccgcaaccugcaguccuucgggaccgaggagcccgccuacagcacgcggcgcgugacccggucccagcagcagcccacccccgugaccccgaagaaguacccccugcgccagacgcggagcagcggcuccgagaccgagcaggucguggacuucagcgaccgcgagaccaagaacaccgccgaccacgacgaguccccgccccggacgcccaccgggaacgcccccagcuccgagagcgacaucgacaucuccagccccaacgugucccacgacgagagcaucgccaaggacaugucccucaaggacagcggcuccgaccugagccaccgccccaagcggcgccgguuccacgaguccuacaacuucaacaugaagugcccgacccccggcugcaacagccuggggcaccucaccggcaagcacgagcgccacuucuccaucagcgggugcccccuguaccacaaccuguccgcggacgagugcaaggcccccacggagcggcagcuccgcuacaaggagaaggucgccgagcugcgcaagaagcggaacagcggccugagcaaggagcagaaggagaaguacauggagcaccgccagaccuacgggaacacccgggagccgcuccuggagaaccugaccuccgaguacgaccucgaccuguuccgccgggcccaggcgcgcgccagcgaggaccuggagaagcuccggcugcagggccagaucacggagggcuccaacaugaucaagaccaucgccuucgggcgcuacgagcuggacaccugguaccacagccccuaccccgaggaguacgcccggcucggccgccuguacaugugcgaguucugccugaaguacaugaagucccagaccauccuccggcgccacauggccaagugcguguggaagcacccgcccggggacgagaucuaccggaagggcagcaucuccguguucgaggucgacggcaagaagaacaagaucuacugccagaaccugugccugcucgcgaagcuguuccuggaccacaagacgcucuacuacgacguggagcccuuccuguucuacgugaugaccgaggccgacaacaccgggugccaccugaucggcuacuucagcaaggagaagaacuccuuccucaacuacaacgucagcugcauccugaccaugccccaguacaugcgccagggguacggcaagaugcugaucgacuucuccuaccuccugagcaagguggaggagaagguggggucccccgagcggccgcugagcgaccucggccugaucuccuaccgcagcuacuggaaggagguccugcuccgguaccugcacaacuuccagggcaaggagaucuccaucaaggagaucagccaggagacggccgugaaccccguggacaucgucagcacccugcaggcccuccagaugcugaaguacuggaaggggaagcaccuggugcucaagcgccaggaccugaucgacgaguggaucgccaaggaggcgaagcgguccaacagcaacaagaccauggaccccuccugccugaaguggacgcccccgaagggcaccuga

SEQ ID NO: 31813 - RNA, 1377 nt, Artificial Sequence
  derived and/or modified sequence opt1 from KAT8__Homo_sapiens__NP_115564
auggccgcccagggcgcggccgccgccguggccgcggggaccagcggcgucgccggggagggcgagcccgggcccggcgagaacgccgccgcggagggcaccgcccccucccccgggcgcgugagcccgcccacgcccgcccggggcgagcccgaggugaccgucgagaucggggagaccuaccugugccgccggcccgacuccaccuggcacagcgccgaggugauccagucccgcgugaacgaccaggagggccgggaggaguucuacguccacuacgugggguucaaccgccggcucgacgaguggguggacaagaaccgccuggcccugacgaagaccgucaaggacgcggugcagaagaacagcgagaaguaccucuccgagcuggccgagcagccggagcggaagaucacccgcaaccagaagcggaagcacgacgagaucaaccacgugcagaagaccuacgccgagauggaccccacgaccgccgcccuggagaaggagcacgaggcgaucaccaaggucaaguacguggacaagauccacaucggcaacuacgagaucgacgccugguacuucagccccuuccccgaggacuacggcaagcagccgaagcucuggcugugcgaguacugccugaaguacaugaaguacgagaaguccuaccgcuuccaccucgggcagugccaguggcggcagccgcccggcaaggagaucuaccgcaagagcaacaucuccguguacgaggucgacgggaaggaccacaagaucuacugccagaaccugugccugcucgccaagcuguuccuggaccacaagacccucuacuucgacguggagcccuucguguucuacauccugacggaggucgaccggcagggcgcccacaucgugggcuacuucagcaaggagaaggagucccccgacgggaacaacguggccugcauccugacccucccgcccuaccagcgccggggcuacgggaaguuccugaucgcguucagcuacgagcuguccaagcucgagagcaccgucggcucccccgagaagccccugagcgaccuggggaagcucuccuaccgcagcuacuggagcugggugcugcuggagauccuccgggacuuccgcggcacccuguccaucaaggaccugagccagaugacguccaucacccagaacgacaucaucagcacccuccagucccugaacauggugaaguacuggaagggccagcacgucaucugcgugacccccaagcuggucgaggagcaccucaagagcgcccaguacaagaagccgcccaucacgguggacuccgugugccugaagugggccccgcccaagcacaagcaggucaagcugagcaagaaguga

SEQ ID NO: 31814 - RNA, 936 nt, Artificial Sequence
  derived and/or modified sequence opt1 from KATNA1__Homo_sapiens__NP_001191005
augagccugcucaugaucuccgagaacgugaagcuggcccgcgaguacgcccugcucggcaacuacgacagcgcgauggucuacuaccagggggugcuggaccagaugaacaaguaccuguacuccgugaaggacaccuaccuccagcagaaguggcagcaggucuggcaggagaucaacguggaggccaagcacgugaaggacaucaugaagacccuggagagcuucaagcuggacuccacgccccucaaggccgcccagcacgaccugccggccagcgagggcgaggucugguccaugcccgugcccguggagcggcgccccagcccggggccccggaagcgccaguccagccaguacuccgaccccaagagccacggcaaccggcccuccaccaccguccgcgugcaccggagcuccgcgcagaacgugcacaacgaccgcgggaaggccguccggugccgcgagaagaaggagcagaacaagggccgggaggagaagggcgugcugaugguggggccgcccggcaccgggaagacgcuccuggccaaggccgucgcgaccgagugcaagaccaccuucuucaacgugagcuccagcacgcugaccuccaaguaccgcggcgagagcgagaagcucgugcggcugcuguucgagauggcccgcuucuacagccccgccaccaucuucaucgacgagaucgacuccaucugcagccggcgcgggaccuccgaggagcacgaggccagccggcgcgucaaggccgagcuccuggugcagauggacggcgugggcgggacguccgagaacgacgaccccagcaagauggucauggugcuggcggccaccaacuucccgugggacaucgacgaggcccuccggcgccggcuggagaagcgcaucuacaucccccugcccuccggcaugcgccccuga

SEQ ID NO: 31815 - RNA, 1695 nt, Artificial Sequence
  derived and/or modified sequence opt1 from KATNAL2__Homo_sapiens__XP_005258414
augaagaagaucgagcagcgcaagacccggcccugcuucagcaccuccaacgagaaccgcgugcuggcccagugccucauggagcugagcuaccagacgcugaaguucacccaccaggcccgggaggcgugcgagaugcgcaccgaggcccggcgcaagaaccuccugauccugaucucccacuaccucacccaggagggcuacaucgacacggccaacgcccuggagcaggagaccaagcuggggcuccggcgcuucgaggucugcgacaacaucgaccuggagaccauccugauggaguacgagagcuacuacuucgugaaguuccagaaguacccgaagaucgugaagaaguccagcgacaccgccgagaacaaccucccccagcggucccgcggcaagacgcggcgcaugaugaacgacagcugccagaaccugcccaagaucaaccagcagcggccccgcuccaagaccaccgcggggaagaccggcgacaccaagagccugaacaaggagcacccgaaccaggaggucguggacaacacgcggcucgaguccgccaacuucgggcugcacaucagccgcauccggaaggacuccggcgaggagaacgcccacccccgccggggccagaucaucgacuuccaggggcugcucaccgacgccaucaagggcgcgaccagcgagcuggcccugaacacguucgaccacaaccccgaccccuccgagcgccuccugaagccgcugagcgccuucaucgggaugaacuccgagaugcgggagcucgccgccguggucagccgcgacaucuaccugcacaaccccaacaucaaguggaacgacaucaucggccuggacgcggccaagcagcucgugaaggaggccguggucuaccccauccgcuacccccagcuguucaccgggauccuguccccguggaagggccuccugcuguacggcccgcccgggaccggcaagacccuccuggccaaggccguggcgacggagugcaagaccaccuucuucaacaucagcgccagcaccaucguguccaaguggcgcggggacagcgagaagcugguccggguccucuucgagcuggcccgguaccacgcccccuccacgaucuuccuggacgagcucgagagcgugaugucccagcgcggcaccgccagcggcggggagcacgagggcucccugcggaugaagaccgagcugcucgugcagauggacgggcuggcgcgcagcgaggaccugguguucgugcucgccgccuccaaccugcccugggagcuggacugcgccaugcuccggcgccuggagaagcggauccuggucgaccugcccagccgcgaggcccggcaggcgaugaucuaccacuggcucccgcccguguccaagagccgcgcccuggagcugcacaccgagcucgaguacuccgugcugagccaggagacggagggcuacuccgggagcgacaucaagcuggucugccgggaggccgccaugcgccccgugcggaagaucuucgacgcgcucgagaaccaccaguccgagagcuccgaccugccccgcauccagcuggacaucgugaccaccgccgacuuccucgacguccugacccacacgaagcccagcgccaagaaccuggcccagcgguacagcgacuggcagcgcgaguucgaguccguguga

SEQ ID NO: 31816 - RNA, 1968 nt, Artificial Sequence
  derived and/or modified sequence opt1 from KATNB1__Homo_sapiens__NP_005877
auggccacccccguggucaccaagacggccuggaagcugcaggagaucguggcgcacgccagcaacguguccagccucguccugggcaaggccuccgggcgccugcucgccaccggcggggacgacugccgggugaaccuguggagcaucaacaagcccaacugcaucaugucccugaccggccacaccagccccguggaguccguccgccucaacacgcccgaggagcugaucguggccgggagccaguccggcagcauccgggugugggaccuggaggcggccaagauccuccgcacccugaugggccacaaggccaacaucugcucccuggacuuccaccccuacggggaguucgucgccagcggcucccaggacaccaacaucaagcucugggacauccggcgcaaggggugcguguuccgguaccgcggccacagccaggcggugcggugccugcgcuucuccccggacgggaaguggcuggccagcgccgccgacgaccacaccgucaagcucugggaccugacggccggcaagaugauguccgaguuccccggccacaccgggcccgugaacguggucgaguuccaccccaacgaguaccugcucgcgagcggcuccagcgaccggaccauccgcuucugggaccuggagaaguuccagguggugagcugcaucgagggggagccgggccccguccgguccgugcuguucaaccccgacggcugcugccucuacagcgggugccaggacucccugcgcguguacggcugggagcccgagcggugcuucgacgucgugcuggugaacugggggaaggucgccgaccucgccaucugcaacgaccagcugaucggcguggccuucagccaguccaacgucagcuccuacgugguggaccugacccgcgucacgcggaccgggaccguggcccgcgacccggugcaggaccaccggccccucgcgcagccccugcccaacccgagcgcgccccugcgccggaucuacgagcgccccuccaccacgugcagcaagccccagcgcgucaagcagaacuccgagagcgagcggcgcuccccgagcuccgaggacgaccgggacgagcgcgagagccgggccgagauccagaacgccgaggacuacaacgagaucuuccagcccaagaacuccaucagccgcaccccgccccggcgcuccgagcccuuccccgccccgcccgaggacgacgccgccaccgccaaggaggccgccaagcccagccccgcgauggacgugcaguuccccgugccgaaccucgagguccugccccggccgcccgugguggccagcacccccgcccccaaggccgagcccgcgaucauccccgccacgcgcaacgagccgaucggccugaaggccuccgacuuccuccccgccgucaagaucccccagcaggccgagcugguggacgaggacgcgaugagccagauccggaagggccacgacaccaugugcgugguccugaccucccgccacaagaaccucgacaccgugcgggccguguggacgaugggggacaucaagaccagcgucgacuccgccguggccaucaacgaccugagcguggucguggaccugcucaacaucgugaaccagaaggccucccuguggaagcuggaccucugcaccaccguccugccccagaucgagaagcugcuccagagcaaguacgaguccuacgugcagacgggcugcaccagccugaagcugauccuccagcgcuuccugccgcugaucaccgacaugcuggcggccccgcccuccgugggggucgacaucagccgggaggagcgccuccacaagugccggcugugcuacaagcagcugaaguccaucagcggccucgugaaguccaagagcgggcuguccggccgccacggcagcaccuuccgggagcugcaccuccugauggccagccuggacuga

SEQ ID NO: 31817 - RNA, 693 nt, Artificial Sequence
  derived and/or modified sequence opt1 from KAZALD1__Homo_sapiens__XP_005270251
augcugcccccgccccgccccgccgccgcgcucgcccugcccgugcugcuccugcugcucgucgugcugaccccgccgcccaccggcgcccggcccagccccgggcccgacuaccugcgccggggcuggaugcgccuccuggccgagggggagggcugcgcccccugccggcccgaggagugcgcggccccgcgcgggugccuggccggccgggugcgcgacgccugcggcugcugcugggagugcgcgaaccucgaggggcagcugugcgaccuggaccccuccgcccacuucuacggccacugcggggagcagcucgagugccggcuggacacgggcggggaccugagccgcggcgagguccccgagccccucugcgccugccggucccagagcccgcugugcggcuccgacgggcacaccuacagccagaucugccgccugcaggaggccgcccgggcgcgccccgacgccaaccucaccguggcccaccccggccccugcgaguccgggccgcagaucgugagccaccccuacgacaccuggaacgucacgggccaggacgugaucuucggcugcgagguguucgccuaccccauggccuccaucgaguggcggaaggacgggcuggacauccagcugcccggcgacgacccgcacaucagcguccagggguggacccccgagguguga

SEQ ID NO: 31818 - RNA, 2628 nt, Artificial Sequence
  derived and/or modified sequence opt1 from KAZN__Homo_sapiens__XP_011539377
augcgcgccgccgacagcggcuccugggagcgggugcgccagcuggcggcccagggggagcccgccccgagcugcggcgccggggccggccccgcgcggccgcccgggcccgccgccugcgagcagugcgucgacgccgcgggccccggcgaccgcccccgggccggggugccccgcgugcgggccgacggcgacugcucccagccgguccuccugcgcgaggaggugagccggcugcaggaggaggugcaccuccugcgccagaugaaggagaugcuggccaaggaccucgaggagucccagggcggcaagagcuccgagguccugagcgccaccgagcugcgggugcagcucgcgcagaaggagcaggagcuggcccgcgccaaggaggcccugcaggccaugaaggcggaccggaagcgccucaagggggagaagaccgaccuggugucccagaugcagcagcuguacgccacgcucgagagccgggaggagcagcugcgcgacuucauccggaacuacgagcagcaccgcaaggaguccgaggacgccgucaaggcccuggccaaggagaaggaccuccuggagcgggagaagugggagcugcgccggcaggcgaaggaggccaccgaccacgccaccgcccuccgcagccagcuggaccugaaggacaaccgcaugaaggagcucgaggccgagcuggcgauggccaagcagucccuggccacccucacgaaggacgugcccaagcggcacagccuggccaugcccggggagaccgugcugaacggcaaccaggagugggucgugcaggcggaccucccccugaccgccgccauccgccagucccagcagacccuguaccacagccacccgccccaccccgccgaccggcaggccgugcgcgucucccccugccacagccggcagccguccgugaucagcgacgcgagcgccgccgagggggaccgcuccagcacgcccuccgacaucaacagcccccggcaccgcacccacucccucugcaacggcgacagccccgggccggugcagaagaaccugcacaaccccaucguccagucccuggaggaccucgaggaccagaagcggaagaagaagaaggagaagaugggcuucggcagcaucucccgcguguucgcccgggggaagcagcgcaagagccuggaccccggccuguucgacgacuccgacagccagugcucccccacccggcagagccucucccugagcgagggggaggagcagauggaccgccugcagcaggucgagcucgugcggaccacgccgaugucccacuggaaggccggcaccgugcaggcguggcuggagguggucauggccaugcccauguacgugaaggccugcaccgagaacgucaagagcgggaaggugcugcucucccugagcgacgaggaccugcagcucggccugggcgugugcagcucccugcaccgccggaagcugcgccucgccaucgaggacuaccgggacgccgaggcggggcgcagccuguccaaggccgccgagcuggaccaccacugggucgccaaggcguggcucaacgacaucggccugagccaguacucccaggccuuccagaaccaccugguggacgggcgcaugcucaacagccugaugaagcgggaccuggagaagcaccucaacguguccaagaaguuccaccaggucagcauccugcugggcaucgagcuccuguaccaggugaacuucucccgcgaggcccugcaggagcggcgcgcccggugcgagacccagaacaucgaccccguggucuggacgaaccagcgcgugcucaagugggugcgggacaucgaccugaaggaguacgccgacaaccugaccaacagcgggguccacggcgcggugcucgugcuggagcccaccuucaacgccgaggccauggccaccgcccugggcaucccguccgggaagcacauccuccgccggcaccuggcggaggagaugagcgccgucuuccaccccgccaacuccacgggcauccgcgaggccgagcgguucgggacgcccccgggccgcgccagcuccgugacccgggcggggaaggaggagaacagcuccggccugaaguacaaggccggccgcgugagccucagcauggaccugcccgucucccccgccgaccccgggaagguguucuucagcccgcccggcuccagcguggcccccguccuggcgugcgagggcggggugcccggccgggugaccggggccucccgcaccgacgcccucgacgucccgagccggaaccugcacgacgcccugggcaccgugcacaaggcccccgcggggcuccgcguggcccccggcucccagagcgccgggcugaccugccugcacgagaaccaccucggccugcugcucaaccugcagauccugggccccacccucgucuccuggaagcggagcucccuggggcgcggcgggagcugcauccagcugggcugcccggagggguccggcgccgcccccaacagcgagccccagucccucaucagcaucugcgacuucuccgaccugacgaacagcaaggacgagcccuccggcgacagcaaccagaccguguga

SEQ ID NO: 31819 - RNA, 1872 nt, Artificial Sequence
  derived and/or modified sequence opt1 from KBTBD11__Homo_sapiens__NP_055682
auggagcacgccguggcccccugcguccuguacccgggcaccgagcccggggcggccggcgagagcgaguccgagggggccgccagccccgcccagacccccugcucccucggcgcgagccugugcuucuccagcggggaggaguccccgccccagagccuggccuccgccgccgagggcgcggccacgagcccgcccuccagcggcgggccgcgggugguggagcggcagugggaggccggcuccgccggggccgcgagccccgaggagcucgccucccccgaggagcgcgccugccccgaggagccggccgcccccagccccgagccccgggucuggcuggaggacccggcgucccccgaggagcccggcgagcccgccccggugccgcccggguucggcgccguguacggcgagcccgaccugguccucgaggugagcgggcgccggcugcgcgcccacaaggccgugcuggcggcccgguccgacuacuuccgcgcccgggccagccgcgacguccuccgggugcagggcgugagccugaccgcccugcgccuccugcuggcggacgccuacuccgggcggauggccggcguccgccccgacaacguggccgagguggucgcgggcgcccggcgccuccagcugcccggggccgcccagcgggccaccgacgcggugggcccccagcugagccucgccaacugcuacgaggugcuguccgccgccaagcgccagcggcugaacgagcuccgcgacgccgcguacugcuucaugagcgaccacuaccuggagguccugcgggagcccgccguguucgggcgccucuccggcgccgagcgcgaccugcugcuccggcgccggcugcgcgccgggcgggcccaccuccuggcggccgcccugggcccggccggcgagcgcgcggggagccggccccagucccccagcggcgacgccgacgcccgcggggacgccgccguguacugcuuccacgcggccgccggcgaguggcgggagcugacccgccucccggagggggcccccgcccggggcugcggccugugcguccuguacaacuaccucuucguggccgggggcguggcccccgccgggcccgacggccgcgcccggccguccgaccaggucuucugcuacaaccccgccacggacagcugguccgcggugcgcccccugcggcaggcccgcagccagcugcggcuccuggcccuggacgggcaccucuacgccgucggcggcgagugccugcuguccguggagcgcuacgacccccgggcggaccgcugggccccgguggcgccccucccccgcggggccuucgccgucgcgcacgaggccacgaccugccacggcgagaucuacgugagcgggggcucccuguucuaccggcugcucaaguacgacccccgccgggacgaguggcaggagugcccgugcagcuccagccgcgagcgguccgccgacaugguggcccuggacggcuucaucuaccgcuucgaccugagcgggagccggggcgaggcccaggcggccgggcccuccggcgucagcgugucccgcuaccacugccuggccaagcaguggagccccugcguggcgccccuccggcugcccgggggccccaccggccugcagcccuuccgcugcgccgcccucgacggggccaucuacugcgucucccgggccggcaccuggcgcuuccagcccgcccgggagggggaggccggcggggacgcgggccagggcgggggcuucgaggcccugggggccccgcuggacgugcgcggcgugcucauccccuucgcccugagccugcccgagaagcccccgcgcggggagcagggcgcgcccuga

SEQ ID NO: 31820 - RNA, 1377 nt, Artificial Sequence
  derived and/or modified sequence opt1 from KBTBD13__Homo_sapiens__NP_001094832
auggcccgcggcccccagacccuggugcaggucugggucgggggccagcuguuccaggccgaccgggcgcuccugguggagcacugcggguucuuccgcggccucuuccggagcgggaugcgcgagacccgggccgccgaggugcgccugggcgugcuguccgccggcggguuccgggccacgcuccaggugcugcgcggcgaccggccggcgcuggccgccgaggacgagcuccugcaggccgucgagugcgcggccuuccugcaggcccccgcccucgcccgcuuccuggagcacaaccugaccagcgacaacugcgcgcuccugugcgacgccgccgccgccuucgggcugcgggacguguuccacuccgcggcccucuucaucugcgacggcgagcgcgagcuggccgccgagcuggcccuccccgaggcgcgggccuacguggccgcccugcgccccagcuccuacgccgcggucagcacccacaccccggcccccggguuccuggaggacgccucccggacgcucugcuaccuggacgaggaggaggacgccuggcgcacccuggcggcccucccccuggaggccagcacccugcucgccggcguggccacccugggcaacaagcuguacaucgucgggggcgugcgcggggcguccaaggaggugguggagcucggcuucugcuacgaccccgacggcgggacguggcacgaguucccgagcccccaccagccccgguacgacaccgcccuggccggcuucgacgggcggcuguacgccaucggcggggaguuccagcgcacccccaucuccagcgucgagcgguacgacccggccgcgggcugcugguccuucguggccgaccucccccagcccgccgccggcgugcccugcgcccaggcgugcgggcgccuguucgucugccuguggcgcccggccgacaccacggccgugguggaguacgccguccggaccgacgcguggcuccccguggccgagcugcgccggccccagagcuacggccacugcaugguggcccaccgcgacucccuguacgucgugcggaacgggcccagcgacgacuuccuccacugcgccaucgacugccugaaccuggccaccggccaguggaccgcgcucccggggcaguucgucaacuccaagggcgcccuguucacggccguggugcgcggcgacaccgucuacaccgugaaccggauguucacccugcucuacgccaucgagggcgggacguggcgccugcugcgggagaaggccggguucccccgccccggcagccugcagaccuuccuccugcggcugcccccgggggcgcccggccccgugaccuccaccacggccgagcucuga

SEQ ID NO: 31821 - RNA, 1806 nt, Artificial Sequence
  derived and/or modified sequence opt1 from KBTBD8__Homo_sapiens__NP_115894
auggccgccagcgcggaccuguccaagagcucccccaccccgaacggcauccccagcuccgaccccgccagcgacgccauggaccccuuccacgccugcuccauccucaagcagcugaagaccauguacgacgaggggcagcugacggacaucguggucgagguggaccacggcaagaccuucagcugccaccgcaacgugcucgccgcgaucuccccguacuuccggagcauguucaccuccgggcugaccgagagcacgcagaaggagguccgcaucgugggcguggaggccgaguccauggaccugguccucaacuacgccuacaccagccgggugauccugaccgaggccaacgugcaggcgcuguucaccgccgccuccaucuuccagauccccagcauccaggaccagugcgccaaguacaugaucucccaccucgacccccagaacagcaucggggucuucaucuucgccgaccacuacggccaccaggagcugggcgaccgcuccaaggaguacauccggaagaaguuccugugcgugacgaaggagcaggaguuccuccagcugaccaaggaccagcugaucagcauccucgacagcgacgaccugaacguggaccgcgaggagcacgucuacgaguccaucauccggugguucgagcacgagcagaacgagcgcgaggugcaccuccccgagaucuucgcgaagugcauccgguucccgcucauggaggacaccuucaucgagaagaucccgccccaguucgcccaggccaucgccaagagcugcguggagaaggggcccuccaacaccaacggcugcacgcagcgccuggggaugaccgccagcgagaugaucaucugcuucgacgcggcccacaagcacuccggcaagaagcagaccguccccugccuggacaucgugaccgggcggguguucaagcucugcaagccgcccaacgaccugcgcgaggucggcauccuggugagccccgacaacgacaucuacaucgccggcggguaccggcccuccagcuccgaggugagcaucgaccacaaggccgagaacgacuucuggauguacgaccacuccacgaaccgcuggcucagcaagcccucccugcugcgggcccgcaucggcugcaagcucgucuacugcugcgggaagauguacgcgaucggcggccggguguacgagggggacggccgcaacagccugaaguccguggagugcuacgacagccgggagaacugcuggaccaccgucugcgccaugcccguggccauggaguuccacaacgccgucgaguacaaggagaagaucuacgugcugcagggggaguucuuccucuucuacgagccccagaaggacuacuggggcuuccugaccccgaugacggugccccgcauccaggggcuggccgcggucuacaaggacuccaucuacuacaucgccggcacgugcggcaaccaccagcggauguucaccguggaggccuacgacaucgagcucaacaaguggacccgcaagaaggacuuccccugcgaccagagcaucaaccccuaccugaagcuggugcuguuccagaacaagcugcaccuguucguccgcgccacccaggugaccguggaggagcacgucuuccggaccucccgcaagaacagccucuaccaguacgacgacaucgcggaccaguggaugaagguguacgagaccccggaccggcugugggaccuggggcgccacuucgagugcgccguggccaagcucuacccccagugccugcagaagguccuguga

SEQ ID NO: 31822 - RNA, 1146 nt, Artificial Sequence
  derived and/or modified sequence opt1 from KCMF1__Homo_sapiens__NP_064507
augagccgccacgagggcguguccugcgacgccugccugaaggggaacuuccggggccgccgguacaagugccucaucugcuacgacuacgaccugugcgccagcugcuacgaguccggggcgaccaccacgcgccacaccaccgaccaccccaugcagugcauccugacccgggucgacuucgaccucuacuacggcggggaggccuucagcguggagcagccccaguccuucacgugccccuacugcggcaagaugggcuacaccgagaccagccugcaggagcacgugaccuccgagcacgccgagacgagcaccgaggucaucugccccaucugcgccgcccugcccgggggcgaccccaaccacgugaccgacgacuucgcggcccaccucacccuggagcaccgcgcgccccgggaccuggacgaguccagcggggugcgccacguccggcgcauguuccaccccggccgggggcucggcggcccccgcgcccggcgcuccaacaugcacuucacgagcuccagcaccgggggccuguccagcucccagagcuccuacagcccgagcaaccgggaggccauggaccccaucgccgagcugcucucccagcugagcggggugcgccgguccgccggcggccagcugaacagcuccgggcccagcgccucccagcuccagcagcugcagaugcagcugcagcucgagcgccagcacgcccaggcggcccggcagcagcuggagaccgcccgcaacgccacccggcgcacgaacaccagcuccgugaccaccacgaucacccagagcaccgccaccacgaacaucgcgaacaccgaguccagccagcagacccugcagaacucccaguuccuccugacccgccugaacgaccccaagaugagcgagacggagcggcaguccauggagagcgagcgcgccgaccggucccucuucguccaggagcugcugcucagcacccuggugcgcgaggaguccagcagcuccgacgaggacgaccggggcgagauggccgacuucggggccaugggcugcguggacaucaugccgcuggacgucgcccucgagaaccugaaccugaaggagagcaacaaggggaacgagcccccgccgccgccccucuga

SEQ ID NO: 31823 - RNA, 1488 nt, Artificial Sequence
  derived and/or modified sequence opt1 from KCNA1__Homo_sapiens__NP_000208
augaccgugaugagcggcgagaacgucgacgaggccuccgccgcgcccgggcacccgcaggacggcagcuacccccgccaggccgaccacgacgaccacgagugcugcgagcggguggugaucaacaucuccgggcugcgcuucgagacccagcucaagacgcuggcccaguuccccaacacccugcucggcaaccccaagaagcggaugcgcuacuucgacccgcugcggaacgaguacuucuucgaccgcaaccggcccagcuucgacgccauccuguacuacuaccaguccgggggccgccuccggcgccccgucaacgugccccuggacauguucagcgaggagaucaaguucuacgagcugggcgaggaggccauggagaaguuccgggaggacgagggguucaucaaggaggaggagcgcccgcuccccgagaaggaguaccagcgccagguguggcugcuguucgaguaccccgaguccagcggccccgcgcgggucaucgccaucguguccgugauggucauccucaucagcaucgugaucuucugccuggagacccugccggagcucaaggacgacaaggacuucaccgggacggugcaccggaucgacaacaccaccgucaucuacaacuccaacaucuucaccgaccccuucuucaucguggagacgcugugcaucaucugguucagcuucgagcuggugguccgcuucuucgccugccccuccaagaccgacuucuucaagaacaucaugaacuucaucgacaucguggccaucauccccuacuucaucacccucggcaccgagaucgcggagcaggaggggaaccagaagggcgagcaggccacgagccuggccauccugcgggugauccgccucguccggguguuccgcaucuucaagcugucccggcacagcaagggccugcagauccucgggcagacccugaaggccuccaugcgcgagcugggccuccugaucuucuuccuguucaucggggugauccucuucagcuccgccgucuacuucgcggaggccgaggaggccgagagccacuucagcuccaucccggacgccuucuggugggccguggugagcaugaccaccgucggcuacggcgacauguaccccgugacgaucgggggcaagaucgucgggucccugugcgcgaucgccggcgugcugaccaucgcccuccccgugcccgucaucgugagcaacuucaacuacuucuaccaccgcgagaccgagggggaggagcaggcccagcugcugcacguguccagcccgaaccucgccuccgacagcgaccugucccggcgcagcuccagcaccauguccaagagcgaguacauggagaucgaggaggacaugaacaacuccaucgcgcacuaccggcaggucaacauccgcacggccaacugcaccaccgccaaccagaacugcgugaacaagagcaagcugcucaccgacguguga

SEQ ID NO: 31824 - RNA, 1962 nt, Artificial Sequence
  derived and/or modified sequence opt1 from KCNA4__Homo_sapiens__NP_002224
auggagguggccauggucagcgccgaguccagcggcugcaacucccacaugcccuacggguacgcggcccaggcccgcgcccgggagcgcgagcggcuggcccacagccgcgcggccgccgccgcggccguggccgccgccaccgcggccguggagggcuccgggggcagcgggggcggcucccaccaccaccaccagagccgcggggccugcaccucccacgacccgcagagcucccggggcagccggcgccggcgccggcagcgcuccgagaagaagaaggcccacuaccggcagagcuccuucccccacugcagcgaccucaugcccuccgggagcgaggagaagauccugcgcgagcuguccgaggaggaggaggacgaggaggaggaggaggaggaggaggaggagggccgguucuacuacagcgaggacgaccacggggacgagugcagcuacacggaccuccugccccaggacgagggcggcgggggcuacuccagcguccgcuacuccgacugcugcgagcggguggugaucaacgucagcgggcugcgcuucgagacccagaugaagacccucgcccaguucccggagacccugcugggcgaccccgagaagcggacgcaguacuucgacccccuccgcaacgaguacuucuucgaccggaaccgccccuccuucgacgcgauccuguacuacuaccagagcggcgggcgccugaagcggccggugaacgugcccuucgacaucuucaccgaggaggucaaguucuaccagcucggcgaggaggcccugcugaaguuccgcgaggacgagggguucgugcgggaggaggaggaccgcgcccuccccgagaacgaguucaagaagcagaucuggcugcuguucgaguaccccgaguccagcuccccggcccggggcaucgccaucgugagcguccucgugauccugaucuccaucgugaucuucugccuggagacccuccccgaguuccgcgacgaccgggaccuggucauggcgcugagcgccgggggccacggcgggcuccugaacgacaccuccgcgccccaccuggagaacagcggccacacgaucuucaacgaccccuucuucaucguggagaccgugugcaucgucugguucuccuucgaguucguggugcgcugcuucgccugcccgagccaggcccucuucuucaagaacaucaugaacaucaucgacaucgucuccauccugcccuacuucaucacccuggggaccgaccucgcccagcagcagggcgggggcaacggccagcagcagcaggccaugagcuucgccauccugcggaucauccgccuggugcggguguuccgcaucuucaagcucucccggcacagcaaggggcugcagauccugggccacacgcuccgcgccagcaugcgggagcuggggcugcucaucuucuuccuguucaucggcgucauccuguucuccagcgcgguguacuucgccgaggccgacgagcccaccacccacuuccaguccauccccgacgccuucuggugggccgucgugaccaugacgaccgugggguacggcgacaugaagccgaucaccgucggcgggaagaucgugggcagccucugcgcgaucgccggggugcugaccaucgcccugcccguccccgugaucguguccaacuucaacuacuucuaccaccgcgagacggagaacgaggagcagacccagcucacccagaacgccgucagcugccccuaccugccguccaaccugcucaagaaguuccggagcuccaccagcuccagccugggcgacaaguccgaguaccuggagauggaggagggcgugaaggagagccugugcgccaaggaggagaagugccaggggaagggcgacgacuccgagacggacaagaacaacugcagcaacgcgaaggccguggagaccgacgucuga

SEQ ID NO: 31825 - RNA, 1842 nt, Artificial Sequence
  derived and/or modified sequence opt1 from KCNA5__Homo_sapiens__NP_002225
auggagaucgcccuggugccccucgagaacggcggggccaugaccguccgcggcggggacgaggcgcgggccggcugcgggcaggccaccggcggcgagcugcagugcccgcccacggccgggcugagcgacggccccaaggagcccgccccgaaggggcgcggcgcgcagcgggacgccgacuccggggugcgcccccucccgccccugcccgaccccggcgugcggccccugcccccgcuccccgaggagcugccccgcccccggcgcccgccgcccgaggacgaggaggaggagggcgaccccgggcugggcaccgucgaggaccaggcccucgggaccgccagccugcaccaccagcgggugcacaucaacaucuccggccugcgcuucgagacccagcucggcacgcuggcgcaguuccccaacacccugcucggggaccccgccaagcggcugcgcuacuucgacccccugcggaacgaguacuucuucgaccgcaaccggcccagcuucgacggcauccucuacuacuaccaguccgggggccgccugcggcgcccggugaacgucagccuggacguguucgccgacgagauccgguucuaccagcucggggacgaggccauggagcgcuuccgggaggacgagggcuucaucaaggaggaggagaagccccugccccgcaacgaguuccagcgccagguguggcugaucuucgaguaccccgaguccagcggcuccgcccgggcgaucgccaucgucagcgugcucgugauccugaucuccaucaucaccuucugccuggagacccucccggaguuccgcgacgagcgggagcugcugcgccacccgcccgcgccccaccagccgcccgcccccgcccccggggccaacggcagcggggucauggccccgcccuccggccccacgguggcgccccuccugccccggacccuggccgaccccuucuucaucguggagacgaccugcgucaucugguucaccuucgagcuccuggugcgcuucuucgccugccccagcaaggccggguucucccggaacaucaugaacaucaucgacguggucgccaucuucccguacuucaucacccugggcaccgagcucgccgagcagcagcccggcgggggcgggggcgggcagaacggccagcaggccaugagccuggccauccugcgcgugauccggcucgugcgcgucuuccggaucuucaagcugucccgccacagcaagggccugcagauccucgggaagacccugcaggcguccaugcgggagcugggccuccugaucuucuuccuguucaucggggugauccucuucagcagcgccguguacuucgccgaggccgacaaccagggcacgcacuucuccagcauccccgacgcguucuggugggccgucgugaccaugaccaccgucggcuacggggacaugcgccccaucacggugggcgggaagaucgugggcucccugugcgccaucgccgggguccugaccaucgcccugccggugcccgugaucgucagcaacuucaacuacuucuaccaccgggagaccgaccacgaggagcccgcggugcucaaggaggagcagggcacccagucccagggccccgggcuggaccgcggcgugcagcggaaggucagcgggucccgcggcagcuucugcaaggccgggggcacgcuggagaacgccgacuccgcccggcgcggcagcugcccgcucgagaagugcaacgugaaggccaaguccaacguggaccugcgccggagccuguacgcgcucugccuggacaccucccgcgagaccgaccuguga

SEQ ID NO: 31826 - RNA, 1590 nt, Artificial Sequence
  derived and/or modified sequence opt1 from KCNA6__Homo_sapiens__XP_011519257
augcgcagcgagaagucccugacccucgccgcccccggcgaggugcgggggccggagggcgagcagcaggacgcgggggacuuccccgaggccggcgggggcggcgggugcugcagcuccgagcgccuggucaucaacaucagcggccugcgguucgagacccagcuccgcacccugucccuguuccccgacacccuccugggggaccccggccggcgcgugcgguucuucgacccgcugcgcaacgaguacuucuucgaccggaaccgccccagcuucgacgccauccucuacuacuaccaguccgggggccggcugcgccggcccgugaacgucccccuggacaucuuccucgaggagauccgcuucuaccagcugggcgacgaggcccuggccgcguuccgggaggacgaggggugccucccggagggcggggaggacgagaagccccugcccagccagcccuuccagcgccagguguggcuccuguucgaguacccggaguccagcggccccgcccggggcaucgccaucguguccguccuggugauccugaucagcaucgugaucuucugccucgagacccugccccaguuccgcgucgacgggcggggcgggaacaacggcggggugucccgcgugagccccgucucccggggcagccaggaggaggaggaggacgaggacgacuccuacaccuuccaccacggcaucacgccgggggagaugggcaccgggggcagcuccagccugagcacccucgggggcuccuucuucaccgaccccuucuuccugguggagacgcugugcaucgugugguucaccuucgagcuccugguccgcuucagcgccugccccuccaagcccgcguucuuccgcaacaucaugaacaucaucgaccugguggccaucuucccguacuucaucacccucggcaccgagcuggugcagcagcaggagcagcagcccgccagcgggggcgggggccagaacgggcagcaggccaugucccuggccauccuccgggucauccgccuggugcggguguuccgcaucuucaagcugagccggcacuccaagggccuccagauccugggcaagacgcugcaggcgagcaugcgcgagcucgggcugcugaucuucuuccucuucaucggcgucauccuguucuccagcgccguguacuucgccgaggccgacgacgacgacucccuguuccccagcauccccgacgccuucuggugggcgguggucaccaugaccaccgugggguacggcgacauguacccgaugacggucggcgggaagaucgugggcucccucugcgccaucgccggggugcugaccaucgcccugcccguccccgugaucgugagcaacuucaacuacuucuaccaccgggagaccgagcaggaggagcagggccaguacacccacgucacgugcgggcagcccgccccggaccuccgcgcgaccgacaacggccugggcaagcccgacuuccccgaggccaaccgggagcgccggccguccuaccugcccacgccccaccgcgccuacgccgagaagcggaugcugaccgagguguga

SEQ ID NO: 31827 - RNA, 1371 nt, Artificial Sequence
  derived and/or modified sequence opt1 from KCNA7__Homo_sapiens__NP_114092
auggagccccgcugcccgccgcccugcggcugcugcgagcggcuggugcucaacgucgccgggcugcgcuucgagacccgggcccgcacccugggccgguuccccgacacgcuccugggggaccccgcgcgccggggccgcuucuacgacgacgcccggcgcgaguacuucuucgaccggcaccgccccagcuucgacgccgugcuguacuacuaccaguccgggggccggcuccgccggcccgcccacgugccccuggacgucuuccuggaggagguggccuucuacggccucggggcggccgcccuggcccgccugcgggaggacgagggcugcccggugccgcccgagcgcccccucccccggcgcgcguucgcccggcagcuguggcuccuguucgaguuccccgagagcucccaggccgcccgcguccuggccguggugagcguccuggugauccucguguccaucgucguguucugccuggagacccugcccgacuuccgcgacgaccgggacgggaccggccucgcggccgccgccgccgcggggcccuuccccgcgccccugaacggcagcucccagaugcccggcaacccgccccgccugcccuucaacgaccccuucuucguggucgagacccucugcaucugcugguucagcuucgagcugcuggugcggcuccuggugugccccuccaaggccaucuucuucaagaacgucaugaaccugaucgacuucguggccauccucccguacuucguggcccuggggacggagcuggcccgccagcggggcgucgggcagcaggccaugagccucgccauccugcgcgugauccggcuggugcgcgucuuccggaucuucaagcucucccgccacagcaagggccugcagauccugggccagacccuccgggccuccaugcgcgagcuggggcugcucaucuucuuccuguucaucggcgugguccuguucagcuccgccguguacuucgcggagguggaccgggucgacagccacuucaccuccauccccgagagcuucuggugggccguggugaccaugacgaccgucggguacggcgacauggcccccgugaccgucgggggcaagaucgugggcucccucugcgccaucgcgggggugcugaccaucagccugcccgugccggucaucgugagcaacuucuccuacuucuaccaccgcgagacggagggcgaggaggccgggauguucagccacguggacaugcagcccugcggcccccucgaggggaaggccaacggcggccuggucgacggggaggugccggagcugcccccgccccugugggccccgcccggcaagcaccucgugaccgaggucuga

SEQ ID NO: 31828 - RNA, 1227 nt, Artificial Sequence
  derived and/or modified sequence opt1 from KCNAB1__Homo_sapiens__NP_003462
augcaccuguacaagcccgccugcgccgacaucccgagccccaagcucggccugcccaaguccagcgaguccgcgcugaagugccgcuggcaccucgccgugaccaagacccagccccaggccgccugcaagccgguccggcccagcggggccgcggagcagaaguacguggagaaguuccugcgcgugcacggcaucucccugcaggagacgacccgggccgagaccgggauggccuaccgcaaccucggcaagagcgggcugcgggucuccugccugggccucggcaccugggugacguucgggggccagaucagcgacgagguggccgagcgccugaugaccaucgcguacgaguccggggucaaccuguucgacaccgccgagguguacgccgccggcaaggccgaggugauccucgggagcaucaucaagaagaagggcuggcggcgcuccagccuggucaucaccacgaagcuguacuggggcgggaaggcggagaccgagcggggccucucccgcaagcacaucaucgaggggcugaagggcagccugcagcggcuccagcuggaguacguggacguggucuucgccaaccgccccgacuccaacacccccauggaggagaucgugcgggccaugacccacgugaucaaccagggcauggccauguacugggggacgagccgcugguccgccauggagaucauggaggcguacagcgucgcccggcaguucaacaugaucccgcccgugugcgagcaggccgaguaccaccuguuccagcgcgagaagguggagguccagcuccccgagcuguaccacaagaucggcgugggggccaugaccuggagcccccuggccugcggcaucaucuccgggaaguacggcaacggcgugccggagagcucccgggcgagccucaagugcuaccaguggcugaaggagcgcaucgucuccgaggaggggcggaagcagcagaacaagcugaaggaccucagccccaucgccgagcgccugggcugcacccugccccagcucgccguggccuggugccugcggaacgaggggguguccagcguccugcucggcuccagcacccccgagcagcugaucgagaaccugggggccauccaggugcucccgaagaugacgucccacgucgugaacgagaucgacaacauccugcgcaacaagcccuacagcaagaaggacuaccgcuccuga

SEQ ID NO: 31829 - RNA, 1203 nt, Artificial Sequence
  derived and/or modified sequence opt1 from KCNAB2__Homo_sapiens__XP_011540622
augcugagcaugaccuacuccgagagccuccgcuccgugagcucccggugccacagcgagugggcccugcaccccguccgccagaccgacacgcuggagcuccagcggcugcgcgaggugcgggccgcggcccaggcccgcaacauggaguccuuccugcggaugcacggccucagccuggacgggugcaccgcccagcgcaccggcaugaaguaccggaaccuggggaaguccggccuccgcgugagcugccuggggcugggcaccugggucacguucggcgggcagaucaccgacgagauggccgagcagcucaugacccuggcguacgacaacggcaucaaccuguucgacaccgccgagguguacgccgccgggaaggcggaggugguccucggcaacaucaucaagaagaagggguggcggcgcuccagccuggugaucacgaccaagaucuucuggggcggcaaggccgagaccgagcgggggcugucccgcaagcacaucaucgagggccucaaggccagccuggagcggcugcagcucgaguacguggacgucguguucgccaaccgcccggaccccaacacccccauggaggagacggugcgggccaugacccacgucaucaaccaggggauggcgauguacuggggcaccucccgcuggagcuccauggagaucauggaggccuacagcguggcccggcaguucaaccugacgcccccgaucugcgagcaggccgaguaccacauguuccagcgcgagaagguggagguccagcugcccgagcuguuccacaagaucggcgugggggccaugaccuggagcccccucgcgugcggcaucguguccgggaaguacgacagcggcaucccgcccuacucccgggccagccugaagggguaccaguggcucaaggacaagauccuguccgaggagggccgccgccagcaggccaagcugaaggagcuccaggccaucgccgagcggcugggcugcacccugccccagcucgcgaucgccuggugccugcgcaacgagggggucagcuccgugcugcucggcgccagcaacgccgaccagcugauggagaacaucggggccauccaggugcugcccaagcucuccagcuccaucauccacgagaucgacagcauccugggcaacaagcccuacuccaagaaggacuaccggagcuga

SEQ ID NO: 31830 - RNA, 1215 nt, Artificial Sequence
  derived and/or modified sequence opt1 from KCNAB3__Homo_sapiens__NP_004723
augcaggucagcaucgccugcaccgagcagaaccugcgcucccggagcuccgaggaccgccucugcggcccccggccggggcccggcgggggcaacgggggccccgccggcgggggccacgggaacccgcccggcgggggcggcagcgggcccaaggcgcgcgccgcccuggugccccggcccccggcccccgccggcgcgcugcgcgaguccaccgggcggggcaccggcaugaaguaccgcaaccucggcaagagcgggcugcggguguccugccuggggcucggcaccugggugaccuucgggagccagaucuccgacgagaccgccgaggacguccugacgguggccuacgagcacggcgugaaccuguucgacaccgccgaggucuacgcggccggcaaggccgagcgcacccucgggaacauccucaagagcaagggcuggcggcgcuccagcuacgugaucaccacgaagaucuucuggggcgggcaggccgagaccgagcgggggcugucccgcaagcacaucaucgagggccugcggggcagccuggagcgccugcagcucggguacguggacaucgucuucgccaaccgguccgaccccaacugccccauggaggagaucgugcgcgcgaugaccuacgugaucaaccagggccuggcccuguacugggggaccagccgguggggcgccgccgagaucauggaggccuacuccauggcgcgccaguucaaccucaucccgcccgucugcgagcaggccgagcaccaccuguuccagcgggagaagguggagaugcagcugcccgagcucuaccacaagaucggggugggcagcgucacgugguacccccuggccugcggccugaucaccuccaaguacgacgggcgcgugccggacacgugccgcgccagcaucaagggcuaccaguggcucaaggacaaggugcagagcgaggacgggaagaagcagcaggccaaggucauggaccugcugcccguggcgcaccagcucggcugcaccguggcccagcuggccaucgccuggugccugcgguccgagggcgucagcuccgugcuccugggggugagcuccgccgagcagcugaucgagcaccucggcgcgcugcagguccugagccagcucacgccccagaccgugauggagaucgacgggcugcugggcaacaagccccacuccaagaaguga

SEQ ID NO: 31831 - RNA, 2577 nt, Artificial Sequence
  derived and/or modified sequence opt1 from KCNB1__Homo_sapiens__XP_011527101
augcccgccggcaugaccaagcacgggagccgcuccaccagcucccugccgcccgagcccauggagaucgugcggagcaaggccugcucccgccggguccgccucaacgugggcgggcuggcgcacgaggugcuguggcggacgcucgaccgccugccccggacccgccugggcaagcuccgggacugcaacacccacgacagccugcuggaggucugcgacgacuacucccucgacgacaacgaguacuucuucgaccgccacccgggggccuucaccagcauccugaacuucuaccggacgggccgccugcacaugauggaggagaugugcgcccucuccuucagccaggagcuggacuacuggggcaucgacgagaucuaccuggaguccugcugccaggcccgguaccaccagaagaaggagcagaugaacgaggagcucaagcgcgaggccgagacccugcgggagcgcgagggggaggaguucgacaacacgugcugcgcggagaagcggaagaagcugugggaccuccuggagaagcccaacagcuccguggccgccaagauccuggccaucaucagcaucauguucaucgugcucuccaccaucgcgcugagccugaacacccuccccgagcugcagucccuggacgaguucggccagagcaccgacaacccccagcucgcccacgucgaggccgugugcaucgccugguucaccauggaguaccugcugcgcuuccucuccagcccgaagaaguggaaguucuucaaggggccccugaacgccaucgaccugcucgcgauccugcccuacuacgugaccaucuuccugacggagagcaacaaguccguccuccaguuccagaacgugcggcgcgugguccagaucuuccggaucaugcgcauccugcgcauccugaagcucgcccggcacagcaccggccugcagucccugggguucacccuccgccggagcuacaacgagcugggccugcucauccuguuccuggccaugggcaucaugaucuucuccagccucguguucuucgccgagaaggacgaggacgacaccaaguucaaguccauccccgccagcuucuggugggcgacgaucaccaugaccaccgugggguacggcgacaucuacccgaagacgcugcuggggaagaucgucggcggccugugcugcaucgccggggugcucgugaucgcccugcccauccccaucaucgucaacaacuucuccgaguucuacaaggagcagaagcgccaggagaaggccaucaagcggcgcgaggcccuggagcgggcgaagcgcaacggcagcaucguguccaugaacaugaaggacgccuucgcccggagcaucgagaugauggacaucguggucgagaagaacggggagaacaugggcaagaaggacaaggugcaggacaaccaccucucccccaacaaguggaaguggaccaagcgcacccugagcgagaccuccagcuccaagagcuucgagacgaaggagcagggguccccggagaaggcccggagcagcuccagcccccagcaccugaacgugcagcagcucgaggacauguacaacaagauggccaagacccagucccagcccauccugaacaccaaggagagcgcggcccaguccaagcccaaggaggagcuggagauggagagcaucccgucccccgucgcgccccuccccacccgcacggagggcgugaucgacaugcggagcauguccagcaucgacuccuucaucagcugcgccaccgacuucccggaggccacccgcuucucccacagcccccugaccucccugcccagcaagacgggcggguccaccgcccccgaggucggcuggcgcggggcccucggcgccagcgggggccgguucguggaggccaacccgagccccgacgcgucccagcacagcuccuucuucaucgagagccccaaguccagcaugaagaccaacaacccgcugaagcugcgggcccucaaggugaacuucauggagggcgaccccagcccccugcugcccguccucgggauguaccacgacccgcugcgcaaccggggcuccgccgccgccgcgguggccgggcuggagugcgccacccuccuggacaaggccgugcugucccccgagagcuccaucuacacgaccgccagcgcgaagaccccgccccgcucccccgagaagcacaccgccaucgccuucaacuucgaggccggcguccaccaguacaucgacgcggacaccgacgacgaggggcagcuccuguacagcguggacuccagcccgcccaagucccugcccggcagcacgucccccaaguucagcaccggcacccgcagcgagaagaaccacuucgaguccagcccccuccccaccucccccaaguuccugcggcagaacugcaucuacagcacggaggcccugaccgggaagggcccguccgggcaggagaagugcaagcucgagaaccacaucagccccgacgugcgcguccugcccggcggcggggcccacggcuccacccgggaccagagcaucuga

SEQ ID NO: 31832 - RNA, 2736 nt, Artificial Sequence
  derived and/or modified sequence opt1 from KCNB2__Homo_sapiens__NP_004761
auggccgagaaggcgcccccgggccugaaccgcaagaccagccgguccacccucagccugccgcccgagcccguggacaucauccgcuccaagacgugcagccggcgcgucaagaucaacgucgggggccugaaccacgaggugcucuggcggacccuggaccgccugccccggacccgccucgggaagcugcgggacugcaacacccacgagucccugcucgaggugugcgacgacuacaaccugaacgagaacgaguacuucuucgaccgccaccccggcgccuucacgagcauccugaacuucuaccggaccgggaagcuccacaugauggaggagaugugcgcccuguccuucggccaggagcuggacuacuggggcaucgacgagaucuaccucgagagcugcugccaggcccgcuaccaccagaagaaggagcagaugaacgaggagcugcggcgcgaggccgagaccaugcgggagcgcgagggggaggaguucgacaacacgugcugccccgacaagcggaagaagcugugggaccuccuggagaagcccaacuccagcguggccgcgaagauccuggccaucguguccauccucuucaucguccugagcacgaucgcccugucccucaacacccugccggagcugcaggagaccgacgaguucggccagcucaacgacaaccgccagcuggcccacguggaggcggugugcaucgccugguucaccauggaguaccugcuccgguuccugagcucccccaacaaguggaaguucuucaaggggccccugaacgucaucgaccuccuggccauccugcccuacuacgugacgaucuuccucaccgagagcaacaaguccgugcugcaguuccagaacguccgccggguggugcagaucuuccgcaucaugcgcauccugcggauccucaagcuggcccgccacagcaccggccugcagucccucggguucacccugcggcgcagcuacaacgagcugggccuccugauccuguuccucgccaugggcaucaugaucuucagcucccuggucuucuucgcggagaaggacgaggacgccaccaaguucaccagcaucccggccuccuucuggugggccaccaucaccaugacgaccgugggguacggcgacaucuaccccaagacccugcuggggaagaucgugggcggccucugcugcaucgccgggguccuggugaucgcgcugcccauccccaucaucgugaacaacuucagcgaguucuacaaggagcagaagcggcaggagaaggccaucaagcgccgggaggcccucgagcgcgccaagcggaacggcuccaucgucagcaugaaccugaaggacgccuucgcgcgcuccauggagcugaucgacguggccguggagaaggccggggagagcgccaacaccaaggacuccgccgacgacaaccaccucagcccgucccgguggaagugggcgcgcaaggcccugagcgagacguccagcaacaaguccuucgagaacaaguaccaggaggucagccagaaggacucccacgagcagcugaacaacaccagcuccagcagcccccagcaccucuccgcccagaagcuggagaugcuguacaacgagaucaccaagacccagccccacagccaccccaacccggacugccaggagaagcccgagcggcccuccgccuacgaggaggagaucgagauggaggagguggucugcccccaggagcagcucgcgguggcccagacggaggugaucgucgacaugaaguccaccagcagcaucgacuccuucaccagcugcgccaccgacuucacggagaccgagcgcuccccgcugcccccgcccagcgccucccaccuccagaugaaguuccccaccgaccugcccggcaccgaggagcaccagcgggcccgcgggcccccguuccugacgcugagccgggagaagggccccgcggcccgcgacggcacccucgaguacgcccccguggacaucaccgugaaccuggacgccuccgggagccagugcggccugcacagcccccuccaguccgacaacgccaccgacucccccaagagcagccugaagggguccaacccgcucaagagccggucccugaaggucaacuucaaggagaaccgcggcagcgcgccccagacgcccccguccaccgcccgcccccugcccgugaccaccgccgacuucagccugaccacgccccagcacaucuccaccauccuccuggaggagaccccgagccagggggaccggccccugcucggcaccgagguguccgcccccugccagggccccagcaaggggcuguccccgcgcuuccccaagcagaagcuguuccccuucagcucccgggagcgccggagcuucacggagaucgacaccggcgacgacgaggacuuccucgagcugcccggggcccgcgaggagaagcaggucgacuccagcccgaacugcuucgcggacaagcccuccgacggccgggacccccugcgcgaggaggggagcgugggcuccagcagcccccaggacaccggccacaacugccggcaggacaucuaccacgccguguccgaggucaagaaggacagcucccaggaggggugcaagauggagaaccaccucuucgccccggagauccacagcaaccccggcgacaccggguacugccccacgcgcgagaccuccauguga

SEQ ID NO: 31833 - RNA, 1758 nt, Artificial Sequence
  derived and/or modified sequence opt1 from KCNC1__Homo_sapiens__NP_001106212
augggccagggggacgagagcgagcgcaucgugaucaacgucggcgggacccggcaccagaccuaccgcuccacgcugcggacccuccccggcacccgccuggccuggcuggccgagccggacgcgcacagccacuucgacuacgacccccgggccgacgaguucuucuucgaccgccaccccgggguguucgcccacauccucaacuacuaccggaccggcaagcugcacugccccgccgacgugugcggcccgcuguacgaggaggagcucgccuucugggggaucgacgagacggacgucgagcccugcugcuggaugaccuaccgccagcaccgggacgcggaggaggcccuggacuccuucggcggggcgccccuggacaacagcgccgacgacgccgacgccgacggccccggggacuccggcgacggcgaggacgagcucgagaugaccaagcgccuggcccugagcgacuccccggacgggcggcccggcggguucuggcgccgguggcagccccgcaucugggcccucuucgaggaccccuacagcucccgguacgcccgcuacguggcguucgccagccuguucuucauccugguguccaucaccacguucugccucgagacccacgagcgguucaacccgaucgucaacaagaccgagaucgagaacgugcgcaacggcacccaggugcgguacuaccgcgaggccgagacggaggccuuccugaccuacaucgagggcgucugcguggugugguucaccuucgaguuccugaugcgggucaucuucugccccaacaagguggaguucaucaagaacagccucaacaucaucgacuucguggccauccugcccuucuaccuggaggucgggcucuccggccugagcuccaaggcggccaaggacgugcugggguuccuccgcgugguccgcuucgugcggauccugcgcaucuucaagcugacccggcacuucgugggccuccgcguccuggggcacacgcugcgggccagcaccaacgaguuccuccugcugaucaucuuccucgcccugggcgugcugaucuucgccaccaugaucuacuacgcggagcgcaucggcgcccagcccaacgacccguccgccagcgagcacacccacuucaagaacauccccaucggguucuggugggccguggucacgaugaccacccucggcuacggggacauguacccccagaccugguccggcaugcuggugggggcccugugcgcgcucgccggcguccugacgaucgccaugcccgugccggugaucgucaacaacuucggcauguacuacagccuggccauggcgaagcagaagcuccccaagaagaagaagaagcacaucccccggcccccgcagcuggggagccccaacuacugcaaguccguggugaacagcccccaccacuccacccagagcgacacgugcccccuggcccaggaggagauccucgagaucaaccgcgccgacuccaagcugaacggcgaggucgccaaggccgcgcuggccaacgaggacugcccgcacaucgaccaggcccucacccccgacgaggggcugcccuucacccggagcggcacccgcgagcgguacgggccgugcuuccugcuguccaccggcgaguacgccugcccgcccggcgggggcaugcgcaaggaccucugcaaggagagccccgugaucgccaaguacaugcccaccgaggcggugcgggucacguga

SEQ ID NO: 31834 - RNA, 1890 nt, Artificial Sequence
  derived and/or modified sequence opt1 from KCNC2__Homo_sapiens__NP_001247427
augggcaagaucgagaacaacgagcgcgugauccugaacgucgggggcacccggcacgagaccuaccgcagcacgcucaagacccugcccgggacccggcuggcccuccuggccuccagcgagccgcccggcgacugccugaccacggcgggggacaagcuccagcccuccccgccgccccugagcccgccgccccgcgccccgccccugucccccggccccggcgggugcuucgagggcggggccggcaacugcagcucccgcgggggccgggccagcgaccaccccggcgggggccgggaguucuucuucgaccgccaccccgggguguucgccuacgugcucaacuacuaccggaccggcaagcugcacugccccgcggacgucugcggcccccuguucgaggaggagcucgccuucugggggaucgacgagaccgacguggagcccugcugcuggaugaccuaccgccagcaccgggacgccgaggaggcccuggacaucuucgagacgcccgaccugaucggcggggaccccggcgacgacgaggaccucgcggccaagcgccuggggaucgaggacgccgccggccugggcgggcccgacggcaaguccgggcgguggcgccggcuccagccccgcaugugggcccuguucgaggaccccuacagcucccgggcggcccgcuucaucgccuucgccagccuguucuucauccucguguccaucaccaccuucugccuggagacccacgaggccuucaacaucgucaagaacaagacggagcccgugaucaacggcaccagcgugguccugcaguacgagaucgagaccgacccggcgcucaccuacguggagggggugugcgucgugugguucacguucgaguuccuggugcggaucgucuucucccccaacaagcuggaguucaucaagaaccuccugaacaucaucgacuucguggccauccugcccuucuaccucgaggugggccugagcggccuguccagcaaggccgccaaggacguccucggguuccugcgcguggugcgguucguccgcauccugcgcaucuucaagcucacccggcacuucgugggccugcgcgugcuggggcacacccuccgggccuccaccaacgaguuccugcugcucaucaucuuccuggcgcugggcguccucaucuucgccacgaugaucuacuacgccgagcgcgugggggcccagcccaacgacccgagcgccagcgagcacacccaguucaagaacauccccaucggcuucuggugggcggucgugaccaugaccacgcugggcuacggggacauguacccccagaccugguccggcaugcuggugggggcccucugcgcccuggccggcguccugaccaucgcgaugccggugcccgugaucgucaacaacuucggcauguacuacagccuggccauggccaagcagaagcucccccggaagcgcaagaagcacaucccgcccgcgccccaggccuccagccccaccuucugcaagacggagcugaacauggccugcaacuccacccagagcgacacgugccuggggaaggacaaccggcuccuggagcacaaccgcuccgugcugagcggcgacgacuccaccgggagcgagcccccgcucuccccgcccgagcggcugcccauccgccggagcuccacccgcgacaagaaccggcgcggcgagaccugcuuccugcucaccaccggggacuacacgugcgccagcgacggcggcauccggaaggugcuguaccgcaucuaccacgggcugcucaccgccgagaagggcaccgucgaguucucccacaccaaggacuacaccgggaaccggcugcugcuccugaacgugcccuga

SEQ ID NO: 31835 - RNA, 2274 nt, Artificial Sequence
  derived and/or modified sequence opt1 from KCNC3__Homo_sapiens__XP_006723266
augcugagcuccgugugcgucagcuccuuccgcggccggcagggggccagcaagcagcagcccgccccgcccccccagcccccggagucccccccccccccgccccuccccccccagcagcagcagccggcgcagcccggccccgccgccagccccgccgggccgcccgccccccgcggccccggggaccggcgcgcggagccgugccccggccugcccgccgccgccaugggccggcacgggggcgggggcggggacuccggcaagaucgugaucaacgugggcgggguccgccacgagaccuaccggagcacccugcgcacgcuccccggcacccggcuggcggggcugaccgagccggaggccgccgcccgcuucgacuacgaccccggcgccgacgaguucuucuucgaccggcaccccggcguguucgcguacgugcucaacuacuaccgcaccgggaagcugcacugccccgccgacgucugcggcccgcuguucgaggaggagcucggguucuggggcaucgacgagacggacguggaggccugcugcuggaugaccuaccggcagcaccgcgacgccgaggaggcccuggacuccuucgaggcgcccgaccccgccggggccgccaacgccgcgaacgccgccggcgcccacgacggcgggcuggacgacgaggccggcgcggggggcgggggccucgacggcgccgggggcgagcugaagcggcugugcuuccaggacgccgggggcggggccggcggcccgcccgggggcgcggggggcgccggcgggaccugguggcgccgguggcagccccgcgugugggcccucuucgaggaccccuacagcucccgggccgcccgcuacgucgcguucgccagccuguucuucauccugaucuccaucaccacguucugccucgagacccacgagggcuucauccacaucagcaacaagaccgugacccaggccuccccgauccccggggccccccccgagaacaucacgaacguggaggucgagaccgagccguuccugaccuacguggagggcgugugcgucgugugguucaccuucgaguuccugaugcggaucacguucugccccgacaagguggaguuccucaagagcucccugaacaucaucgacugcgucgccauccugcccuucuaccucgagguggggcugagcggccuguccagcaaggcggccaaggacgugcucggcuuccugcgcgucgugcgcuucgugcggauccugcgcaucuucaagcucacccggcacuucgucgggcugcgcgugcugggccacacccuccgggccagcaccaacgaguuccugcugcucaucaucuuccuggcccuggggguccucaucuucgccacgaugaucuacuacgcggagcgcaucggcgccgaccccgacgacauccugggguccaaccacaccuacuucaagaacaucccgaucggcuucuggugggccguggugaccaugaccacgcugggcuacggggacauguaccccaagaccuggagcggcaugcucgucggggcccugugcgcgcuggccggcgugcucaccaucgccaugcccgugcccgucaucgugaacaacuucgggauguacuacucccuggccauggccaagcagaagcugccgaagaagaagaacaagcacaucccccggcccccccagccgggcagccccaacuacugcaagcccgaccccccgccccccccgcccccccacccccaccacggcuccgggggcaucagcccgcccccccccaucaccccgcccuccaugggggugacggucgcgggcgccuaccccgccgggccccacacccacccgggccuccugcgcggcggggccggcgggcugggcaucaugggccugcccccccuccccgccccgggggagcccugcccccuggcgcaggaggaggugaucgagaucaaccgggccgacccccgcccgaacggcgaccccgccgccgccgcgcuggcccacgaggacugccccgccaucgaccagcccgccaugagcccggaggacaagucccccaucacccccgggagccggggccgcuacucccgggaccgcgcgugcuuccuccugaccgacuacgcccccagcccggacggguccauccggaaggccacgggcgcccccccccugccgccccaggacuggcgcaagcccggccccccgagcuuccuccccgaccugaacgccaacgcggccgccuggaucucccccuga

SEQ ID NO: 31836 - RNA, 1893 nt, Artificial Sequence
  derived and/or modified sequence opt1 from KCND2__Homo_sapiens__NP_036413
auggccgccggcguggcggccuggcugcccuucgcccgcgccgccgcgaucggguggaugccggucgccagcggccccaugcccgcgcccccgcggcaggagcgcaagcggacccaggacgcccucaucgugcugaacguguccgggacccgcuuccagaccuggcaggacacccuggagcgguaccccgacacccuccugggcagcuccgagcgcgacuucuucuaccaccccgagacccagcaguacuucuucgaccgggaccccgacaucuuccgccacauccugaacuucuaccggacggggaagcuccacuacccgcgccacgagugcaucagcgccuacgacgaggagcuggccuucuucggccugauccccgagaucaucggcgacugcugcuacgaggaguacaaggaccggcgccgggagaacgccgagcgccuccaggacgacgccgacaccgacaccgccggggaguccgcgcugcccaccaugacggcccggcagcgcgucuggcgggccuucgagaacccccacaccagcaccauggcccugguguucuacuacgugaccggcuucuucaucgccgucuccgugaucgcgaacguggucgagacggugccgugcgggagcucccccggccacaucaaggagcuccccugcggggagcgcuacgccguggccuucuucugccuggacaccgccugcgucaugaucuucaccguggaguaccugcuccggcuggccgcggcccccagccgcuaccgguucgugcgcuccgucaugagcaucaucgacgugguggccauccugccguacuacaucggccucgucaugaccgacaacgaggacguguccggcgccuucgugacgcugcgcgucuuccggguguuccgcaucuucaaguucagccggcacucccaggggcugcgcauccucggcuacacccucaagagcugcgccuccgagcugggguuccugcuguucagccugaccauggcgaucaucaucuucgccaccgugauguucuacgccgagaagggcuccagcgccagcaaguucacguccauccccgcggccuucugguacaccaucgucaccaugaccacgcucggcuacggggacauggugcccaagaccaucgccggcaagaucuucgggagcaucugcucccugagcggcguccuggugaucgcccuccccgugccggucaucguguccaacuucagccggaucuaccaccagaaccagcgcgccgacaagcggcgcgcgcagaagaaggcccggcuggcccgcauccgggccgccaaguccgggagcgcgaacgccuacaugcaguccaagcgcaacggccugcucagcaaccagcugcaguccagcgaggacgagcaggccuucguguccaagagcggcuccagcuucgagacccagcaccaccaccuccugcacugccuggagaagaccacgaaccacgaguucgucgacgagcaggucuucgaggaguccugcauggagguggccaccgugaaccggcccagcucccacagccccagccuguccagccagcagggggugaccuccacgugcugcagccgccggcacaagaagaccuuccgcauccccaacgccaacguguccggcagccaccagggguccauccaggagcucagcaccauccagauccggugcgucgagcgcaccccgcuguccaacagccgguccagccugaacgcgaagauggaggagugcgugaagcucaacugcgagcagcccuacgugaccacggccaucaucuccauccccacgcccccggucaccacccccgagggcgacgaccgccccgagagcccggaguacuccgggggcaacaucgugcgcgugagcgcccuguga

SEQ ID NO: 31837 - RNA, 390 nt, Artificial Sequence
  derived and/or modified sequence opt1 from KCNE1__Homo_sapiens__NP_001257334
augauccugagcaacaccaccgccgugacgcccuuccucaccaagcuguggcaggagaccguccagcagggcgggaacauguccggccuggcccgccggagcccgcgcuccagcgacgggaagcucgaggcgcuguacgugcugauggugcucggcuucuucggguucuucacccugggcaucaugcuguccuacauccggagcaagaagcucgagcacuccaacgaccccuucaacgucuacaucgagagcgacgccuggcaggagaaggacaaggccuacgugcaggcccgcgugcuggaguccuaccggagcugcuacgucguggagaaccaccuggccaucgagcagcccaacacgcaccuccccgagaccaagccgucccccuga

SEQ ID NO: 31838 - RNA, 372 nt, Artificial Sequence
  derived and/or modified sequence opt1 from KCNE2__Homo_sapiens__NP_751951
augagcacccuguccaacuucacccagacgcucgaggacguguuccgccggaucuucaucaccuacauggacaacuggcgccagaacaccaccgccgagcaggaggcccugcaggcgaaggucgacgccgagaacuucuacuacgugauccuguaccucauggugaugaucggcauguucagcuucaucaucgucgccauccugguguccacggucaagagcaagcggcgcgagcacuccaacgaccccuaccaccaguacaucguggaggacuggcaggagaaguacaagagccagauccugaaccucgaggaguccaaggccaccauccacgagaacaucggggccgcgggcuucaagaugagcccguga

SEQ ID NO: 31839 - RNA, 312 nt, Artificial Sequence
  derived and/or modified sequence opt1 from KCNE3__Homo_sapiens__NP_005463
auggagaccaccaacggcacggagaccugguacgagagccugcacgccgugcucaaggcccugaacgcgacccugcacuccaaccuccugugccgccccgggccgggccuggggcccgacaaccagaccgaggagcggcgcgccagccuccccggccgggacgacaacuccuacauguacauccuguucgucauguuccuguucgccgugacgguggggagccucauccugggcuacacccgcucccggaaggucgacaagcgcagcgaccccuaccacguguacaucaagaaccggguguccaugaucuga

SEQ ID NO: 31840 - RNA, 666 nt, Artificial Sequence
  derived and/or modified sequence opt1 from KCNE4__Homo_sapiens__NP_542402
augcacuuccugaccaucuaccccaacugcagcuccggcgugguccgcgcccagagccggaccgagcagaagaacccgcucgggcuggacgaccugggcauccagaaccucgggcagaccgugucccuggcccccgcgguggaggccgccagcaugcugaagauggagccccucaacuccacccaccccggcaccgccgccagcuccagcccgcuggagucccgcgcggccgggggcggcagcgggaacggcaacgaguacuucuacauccuggucgugauguccuucuacgggaucuuccucaucggcaucaugcugggguacaugaaguccaagcggcgcgagaagaaguccagccugcuccugcuguacaaggacgaggagcggcucuggggcgaggccaugaagccccugcccguggucagcggccugcgcagcguccaggugccccucaugcugaacaugcugcaggaguccguggccccggcgcucagcugcacccugugcuccauggagggggacagcgugagcuccgagagcuccagccccgacgugcaccugacgauccaggaggagggcgccgacgacgagcucgaggagaccuccgagacgccccugaacgagagcuccgaggggagcuccgagaacauccaccagaacagcuga

SEQ ID NO: 31841 - RNA, 429 nt, Artificial Sequence
  derived and/or modified sequence opt1 from KCNE5__Homo_sapiens__NP_036414
augaacugcagcgagucccagcgccugcggacccuccugagccgccugcuccuggagcugcaccaccggggcaacgccuccgggcucggcgccgggccccgcccgagcaugggcaugggggugguccccgaccccuucgugggccgggaggugaccuccgcgaagggcgacgacgccuaccuguacauccugcucaucaugaucuucuacgccugccuggccgggggccugauccucgccuacacgcgcagccggaagcuggucgaggcgaaggacgagcccucccaggccugcgccgagcacgagugggcccccgggggcgcgcugaccgccgacgccgaggccgccgcggggagccaggccgagggccgccggcagcucgccuccgagggccugccggcccuggcccagggggcggagcgcguguga

SEQ ID NO: 31842 - RNA, 1311 nt, Artificial Sequence
  derived and/or modified sequence opt1 from KCNG3__Homo_sapiens__NP_579875
augaccuucggccgcagcggggccgccuccgugguccugaacgugggcggggcgcgguacagccucucccgcgagcugcugaaggacuucccccuccggcgcgugagccggcugcacggcugccgcuccgagcgggacguccuggaggugugcgacgacuacgaccgcgagcggaacgaguacuucuucgaccgccacagcgaggccuucggguucauccuccuguacgugcggggccacggcaagcugcgcuucgccccgcggaugugcgagcucuccuucuacaacgagaugaucuacugggggcuggagggcgcccaccuggaguacugcugccagcgccggcucgacgaccgcaugagcgacaccuacacguucuacuccgccgacgagcccgggguccugggccgggacgaggcgcgccccgggggcgccgaggccgcccccagccggcgcuggcuggagcggaugcgccgcaccuucgaggagccgaccuccagccucgcggcccagauccuggccuccgugagcguggucuucgugaucguguccauggucgugcugugcgccagcacccuccccgacuggcggaacgccgcggccgacaaccgcucccuggacgaccggagccgcuacuccgccggccccgggcgggagcccagcggcaucaucgaggccaucugcaucgggugguucacggccgagugcaucgugcgcuucaucgucagcaagaacaagugcgaguucgugaagcggccgcugaacaucaucgaccuccuggcgaucacccccuacuacaucuccgugcugaugaccgucuucaccggcgagaacagccagcuccagcgcgccggcgugacgcugcgggugcugcgcaugaugcggaucuucugggucaucaagcucgcccgccacuucaucgggcugcagacccugggccucacccugaagcggugcuaccgcgagauggugaugcugcucguguucaucugcgucgccauggccaucuucuccgcgcugagccagcugcucgagcacgggcuggaccuggagaccuccaacaaggacuucacgagcauccccgccgccugcuggugggugaucaucuccaugaccaccgucggcuacggggacauguaccccaucaccgugccgggccggauccucggcggggugugcgucgugagcggcaucgugcugcuggcccuccccaucacguucaucuaccacuccuucguccagugcuaccacgagcugaaguuccgcagcgcccgguacucccgcagccuguccaccgaguuccucaacuga

SEQ ID NO: 31843 - RNA, 1560 nt, Artificial Sequence
  derived and/or modified sequence opt1 from KCNG4__Homo_sapiens__NP_758857
augcccaugccgagccgcgacggcgggcugcacccccggcaccaccacuacggcucccacagccccuggucccagcuccugagcucccccauggagaccccgagcaucaaggggcuguacuaccgccgggugcgcaaggucggcgcccucgacgccucccccguggaccugaagaaggagauccugaucaacgucgggggccggcgcuaccuccugcccuggagcacccuggaccgguucccccucucccgccugagcaagcugcggcucugccgcuccuacgaggagaucgugcagcugugcgacgacuacgacgaggacagccaggaguucuucuucgaccgguccccgagcgcguucggcgugaucguguccuuccuggccgccgggaagcucguccugcugcaggagaugugcgcccucagcuuccaggaggagcuggccuacuggggcaucgaggaggcgcaccuggagcgcugcugccuccggaagcugcugcgcaagcucgaggagcuggaggagcuggccaagcuccaccgggaggacgugcugcgccagcagcgggagacgcgccggcccgccucccacagcucccgcugggggcugugcaugaaccggcuccgcgagaugguggagaacccccagagcggccugcccgggaaggucuucgccugccugagcauccucuucguggcgaccaccgccgugucccugugcgucagcaccaugccggaccugcgcgccgaggaggaccagggcgagugcucccggaagugcuacuacaucuucaucguggagacgaucugcguggccugguucagccucgaguucugccugcgcuucguccaggcccaggacaagugccaguucuuccagggcccccugaacaucaucgacauccucgcgaucucccccuacuacgugagccuggccguguccgaggagcccccggaggacggggagcggcccagcggcuccagcuaccuggagaaggucgggcucgugcugcgcgugcugcgggcccuccgcauccuguacgucaugcggcuggcccgccacucccucggccugcagacccugggccugaccgugcggcgcugcacccgggaguucgggcuccugcuccuguuccuggccguggcgaucacgcuguucagcccccucgucuacguggccgagaaggaguccggccgcguccuggaguucaccagcauccccgccuccuacuggugggccaucaucagcaugaccaccgugggguacggcgacauggugccgcgguccguccccgggcagaugguggcccugagcuccauccucagcggcauccugaucauggcguuccccgccacgagcaucuuccacaccuucucccacagcuaccuggagcucaagaaggagcaggagcagcugcaggcccgccugcggcaccuccagaacaccggccccgccuccgagugcgagcugcuggacccgcacguggccagcgagcacgagcucaugaacgacgucaacgaccugauccuggaggggcccgcgcuccccaucaugcacauguga

SEQ ID NO: 31844 - RNA, 2889 nt, Artificial Sequence
  derived and/or modified sequence opt1 from KCNH1__Homo_sapiens__NP_002229
augaccauggccggcgggcgccggggccugguggcgccccagaacaccuuccucgagaacaucguccgccggagcaacgacacgaacuucgugcuggggaacgcccagaucguggacuggccgaucgucuacuccaacgacggcuucugcaagcugagcggguaccaccgcgccgaggugaugcagaaguccagcacgugcuccuucauguacggcgagcucaccgacaaggacaccaucgagaaggugcggcagaccuucgagaacuacgagaugaacagcuucgagauccugauguacaagaagaaccgcacccccgucugguucuucgugaagaucgcccccauccggaacgagcaggacaaggugguccuguuccucugcaccuucuccgacaucaccgccuucaagcagcccaucgaggacgacagcugcaagggcugggggaaguucgcccgccugacgcgggcgcugaccuccagccgcggcgugcuccagcagcuggccccguccgugcagaagggggagaacguccacaagcacagccggcuggccgaggugcuccagcugggcuccgacauccugccccaguacaagcaggaggcccccaagacgcccccgcacaucauccuccacuacugcguguucaagaccaccugggacuggaucauccugauccugaccuucuacaccgcgauccucguccccuacaacgugagcuucaagacccgccagaacaacguggccuggcuggucguggacuccaucguggacgucaucuuccugguggacaucgugcucaacuuccacacgaccuucgucgggcccgccggcgaggugaucagcgaccccaagcugauccggaugaacuaccugaagaccugguucgucaucgaccuccuguccugccugccguacgacgugaucaacgccuucgagaacguggacgagggcaucagcucccucuucagcagccugaaggucgugcgccugcuccggcuggggcgcguggcccggaagcuggaccacuacaucgaguacggcgcggccguccucgugcugcuggugugcgucuucgggcucgccgcccacuggauggccugcaucugguacuccaucggcgacuacgagaucuucgacgaggacaccaagacgauccgcaacaacagcuggcuguaccagcuggcgauggacaucggcacccccuaccaguucaacggguccggcagcgggaagugggagggcgggcccuccaagaacagcguguacaucuccagccucuacuucaccaugaccucccugacgagcgugggcuucggcaacaucgcccccuccaccgacaucgagaagaucuucgccgucgccaucaugaugaucgggagccugcucuacgccaccaucuucggcaacgugaccacgaucuuccagcagauguacgcgaacaccaaccgguaccacgagaugcugaacuccgugcgcgacuuccugaagcucuaccaggucccgaaggggcugagcgagcgggugauggacuacaucguguccaccuggagcaugucccgcggcaucgacaccgagaagguccugcagaucugccccaaggacaugcgcgccgacaucugcgugcaccucaaccggaagguguucaaggagcaccccgccuuccgccuggccagcgacgggugccugcgggcccuggcgauggaguuccagacgguccacugcgcccccggcgaccucaucuaccacgccggcgaguccguggacagccugugcuucguggucagcgggucccuggaggugauccaggacgacgagguggucgccauccucggcaagggggacguguucggcgacguguucuggaaggaggcgacccuggcccagagcugcgccaacguccgcgcccugaccuacugcgaccuccacgugaucaagcgggacgcccugcagaaggugcuggaguucuacaccgcguucucccacagcuucucccgcaaccucauccugacguacaaccugcggaagcgcaucgucuuccggaagaucagcgacgugaagcgcgaggaggaggagcggaugaagcgcaagaacgaggccccgcucauccugccgcccgaccaccccgugcggcgccuguuccagcgguuccgccagcagaaggaggcccggcucgccgccgagcgcgggggccgggaccuggacgaccuggacgucgagaagggcaacgugcucaccgagcacgcguccgccaaccacagccuggugaaggccuccgucgugaccgugcgcgagagccccgccacccccgucuccuuccaggccgcgagcaccuccggggugcccgaccacgccaagcugcaggcccccggcagcgagugccucgggccgaagggcggcgggggcgacugcgccaagcgcaaguccugggcgcgguucaaggacgccugcgggaaguccgaggacuggaacaagguguccaaggccgagagcauggagacgcugcccgagcgcaccaaggccagcggcgaggccacccugaagaagaccgacuccugcgacagcgggaucacgaaguccgaccuccggcuggacaacgucggcgaggcgcgcagcccccaggaccgguccccgauccuggccgaggugaagcacagcuucuaccccauccccgagcagacccuccaggccaccgugcuggagguccgccacgagcugaaggaggacaucaaggcccucaacgccaagaugaccaacaucgagaagcagcuguccgagauccugcggauccucacgagccgccgguccagccagagcccccaggagcuguucgagaucagccgcccgcagucccccgagagcgagcgggacaucuucggcgcguccuga

SEQ ID NO: 31845 - RNA, 3480 nt, Artificial Sequence
  derived and/or modified sequence opt1 from KCNH2__Homo_sapiens__NP_000229
augcccgugcgccggggccacgucgccccgcagaacaccuuccuggacaccaucauccgcaaguucgaggggcagagccggaaguucaucaucgccaacgcgcgcguggagaacugcgccgugaucuacugcaacgacggcuucugcgagcucugcggguacucccgggccgaggucaugcagcgccccugcacgugcgacuuccugcacggcccccggacccagcgccgggccgccgcgcagaucgcccaggcccugcucggggccgaggagcgcaagguggagaucgcguucuaccggaaggacggcagcugcuuccugugccugguggacgucgugcccgugaagaacgaggacggcgccgucaucauguucauccucaacuucgagguggugauggagaaggacauggucggguccccggcccacgacaccaaccaccgcggcccccccaccagcuggcuggcccccgggcgggccaagacguuccgccugaagcucccggcgcugcuggcccucaccgcccgggaguccagcgugcgcuccggcggggccggcggcgccggggcgcccggcgccguggucguggacguggaccugacccccgccgcccccagcuccgagagccuggcccucgacgaggucaccgcgauggacaaccacguggccgggcugggcccggccgaggagcggcgcgcccuggugggccccgggucccccccccggagcgccccgggccagcuccccuccccccgcgcgcacagccugaaccccgacgccuccgggagcuccugcagccuggcccggacgcgcucccgcgagagcugcgccagcguccggcgcgcguccagcgccgacgacaucgaggccaugcgggccggcgugcucccgccccccccccgccacgccuccaccggggcgaugcacccgcugcggagcggccugcucaacuccaccagcgacuccgaccuggugcgcuaccggaccaucagcaagaucccccagaucacgcugaacuucgucgaccucaagggcgaccccuuccuggccucccccaccagcgaccgcgagaucaucgccccgaagaucaaggagcggacccacaacgugaccgagaaggucacgcaggugcugucccucggggccgacgugcugcccgaguacaagcugcaggccccccgcauccaccgguggaccauccuccacuacagcccguucaaggcggucugggacuggcugauccugcuccuggugaucuacaccgccguguucacccccuacuccgccgccuuccugcucaaggagacggaggagggcccccccgccaccgagugcggguacgcgugccagccgcuggccgucguggaccugaucguggacaucauguucaucgucgacauccucaucaacuuccgcaccaccuacgugaacgccaacgaggagguggucagccaccccggccggaucgccgugcacuacuucaaggggugguuccugaucgacaugguggcggccauccccuucgaccugcucaucuucggcuccggcagcgaggagcugaucgggcugcucaagacggcccgccugcugcggcugguccgcguggcccggaagcucgaccgcuacuccgaguacggcgccgcggugcuguuccugcucaugugcaccuucgcccugaucgcccacuggcuggccugcaucugguacgccaucgggaacauggagcagccccacauggacagccggaucggcuggcuccacaaccugggggaccagaucggcaagccguacaacuccagcggccuggggggccccagcaucaaggacaaguacgucaccgcgcucuacuucaccuucuccagccugacguccgugggguucggcaacgugagccccaacaccaacuccgagaagaucuucagcaucugcgucaugcugaucggcucccucauguacgccagcaucuucgggaacguguccgccaucauccagcgccuguacagcggcaccgcccgcuaccacacccagaugcugcgggugcgcgaguucauccgguuccaccagauccccaacccgcuccgccagcggcuggaggaguacuuccagcacgccugguccuacacgaacgggaucgacaugaacgcgguccugaagggcuuccccgagugccuccaggccgacaucugccugcaccugaaccgcagccuccugcagcacugcaagcccuuccggggggccaccaagggcugccugcgcgcccucgcgaugaaguucaagaccacccacgcccccccgggcgacacgcuggugcacgccggggaccugcucaccgcccuguacuucaucucccggggcagcaucgagauccugcgcggggacguggucguggccauccucggcaagaacgacaucuucggggagccccugaaccuguacgcgcggcccggcaaguccaacggcgacgugcgcgcccucaccuacugcgaccugcacaagauccaccgggacgaccugcucgagguccuggacauguaccccgaguucagcgaccacuucugguccagccuggagaucaccuucaaccuccgcgacaccaacaugaucccggggagccccggcuccacggagcuggaggggggcuucagccggcagcgcaagcggaagcuguccuuccgccggcgcaccgacaaggacaccgagcagcccggggaggugagcgcccucggccccggccgggccggggccggcccguccagccgcgggcgccccggcgggcccuggggcgaguccccgagcuccggccccagcucccccgagagcuccgaggacgaggggcccggccggagcuccagcccgcugcgccuggugcccuucuccagcccccggcccccgggggagccccccggcggcgagccccucauggaggacugcgagaaguccagcgacaccugcaacccgcugagcggggcguucuccggcgucagcaacaucuucuccuucuggggggacagccgcggccggcaguaccaggagcugccccgcugccccgcccccacgccgucccuccugaacaucccccugagcucccccgggcggcgcccccggggcgacguggagagccgccucgacgcccugcagcggcagcugaaccgccucgagacccggcuguccgccgacauggccaccgugcugcagcuccugcagcgccagaugacccuggucccgcccgcguacagcgccgugacgacccccggccccgggccgaccuccaccagcccccuccugcccguguccccccugccgacgcucacccuggacagccugucccaggucagccaguucauggccugcgaggagcucccccccggcgccccggagcugccccaggaggggcccacccggcgccugucccuccccggccagcugggggcccugaccagccagccgcuccaccggcacggcuccgaccccggcagcuga

SEQ ID NO: 31846 - RNA, 3252 nt, Artificial Sequence
  derived and/or modified sequence opt1 from KCNH3__Homo_sapiens__NP_036416
augcccgccaugcgcggccugcucgccccgcagaacaccuuccuggacaccaucgcgacgcgguucgacgggacccacagcaacuucgugcugggcaacgcccaggucgccggccucuuccccgugguguacugcuccgacggcuucugcgaccugaccggguucagccgcgccgaggucaugcagcggggcugcgccugcuccuuccuguacggccccgacaccagcgagcucgugcgccagcagauccggaaggcgcuggacgagcacaaggaguucaaggccgagcugauccucuaccgcaaguccgggcugcccuucuggugccugcucgacgugaucccgaucaagaacgagaagggcgaggucgcccuguuccuggugagccacaaggacaucuccgagacgaagaaccgcgggggccccgaccgguggaaggagaccgggggcggccggcgccgguacgggcgcgcccggagcaagggcuucaacgcgaaccgccggcgcucccgggccgugcucuaccaccugagcgggcaccuccagaagcagcccaagggcaagcacaagcucaacaagggcgucuucggggagaagcccaaccugccggaguacaagguggccgccauccgcaagucccccuucauccugcuccacugcggcgcccugcgggcgaccugggacggguucauccugcucgccacccuguacguggccgucacggugcccuacagcgugugcgucuccaccgcccgcgagcccagcgccgcgcggggcccgcccuccgugugcgaccuggccguggagguccucuucauccuggacaucgugcugaacuuccgcaccaccuucgugagcaaguccgggcaggucguguucgcccccaagagcaucugccuccacuacgugacgaccugguuccugcuggacgucaucgccgcccuccccuucgaccugcugcacgcguucaaggugaacgucuacuucggcgcccaccuccugaagaccgugcgccugcuccggcugcugcgccuccugccgcggcuggaccgcuacucccaguacagcgccgugguccucacccugcugauggccguguucgcccugcuggcgcacuggguggccugcgucugguucuacaucgggcagcgggagaucgagagcuccgagagcgagcugcccgagaucggguggcugcaggagcucgcccgccggcuggagacgcccuacuaccuggugggccgccggcccgccgggggcaacuccagcgggcaguccgacaacugcagcuccagcuccgaggcgaacggcaccggccucgagcugcucgggggcccgagccugcgcuccgccuacaucaccagccuguacuucgcccuguccagccucaccuccgugggguucggcaacgucagcgccaacacggacaccgagaagaucuucuccaucugcaccaugcugaucggggcccugaugcacgcggugguguucggcaacgucaccgccaucauccagcggauguacgcccgccgguuccucuaccacagccgcacgcgggaccugcgcgacuacauccggauccaccgcauccccaagccccugaagcagcggaugcucgaguacuuccaggccaccugggccgugaacaacggcaucgacaccaccgagcugcugcagucccuccccgacgagcugcgcgcggacaucgccaugcaccuccacaaggaggugcugcagcugccgcuguucgaggccgccagccgcgggugccuccgggcccugagccuggcgcuccgccccgccuucugcacgcccggcgaguaccugauccaccagggggacgcccugcaggcccucuacuucgucugcuccggcagcauggaggugcugaagggcgggaccgugcuggcgauccucggcaagggggaccugaucggcugcgagcugccccggcgcgagcaggucgugaaggccaacgccgacgugaaggggcucaccuacugcguccugcagugccugcagcucgccggccugcacgacucccuggcccucuacccggaguucgcgccccgguucagccgcggccugcgcggggagcuguccuacaaccucggcgccgggggcgggagcgccgagguggacaccuccagccuguccggcgacaacacgcugaugagcacccucgaggagaaggagaccgacggcgagcaggggcccaccguguccccggcccccgccgacgagcccagcagcccccugcuguccccgggcugcacguccagcuccagcgcggccaagcuccugagcccccggcggaccgcgccccgcccccggcucgggggccgcgggcggccgggccgcgccggcgcccugaaggccgaggccgggcccuccgccccgccccgggcccuggagggccugcgccucccgcccaugcccuggaacgugccgcccgaccugagcccccgggucguggacgggaucgaggacggcugcggguccgaccagcccaaguucagcuuccgcgucggccaguccggccccgagugcagcuccagccccucccccgggcccgagagcggccugcucaccgugccccacgggccguccgaggcgcggaacaccgacacccuggacaagcugcgccaggccgugacggagcucagcgagcagguccugcagaugcgggagggccugcagucccuccgccaggccgugcagcuggugcuggcgccccaccgcgagggccccugcccgcgggccagcggggagggccccugccccgccuccaccagcgggcuccugcagccccugugcgucgacaccggcgccuccagcuacugccuccagccgcccgccggguccgugcugagcggcaccuggccccacccccgcccggggcccccgccccugauggcccccuggcccuggggcccgcccgccagccaguccagccccuggccccgggcgacggccuucuggaccuccaccagcgacuccgagccgcccgccagcggcgaccucugcuccgagcccagcacccccgccuccccgccgcccagcgaggagggggcccgcacgggccccgcggagcccgugucccaggccgaggccaccagcaccggggagcccccgcccggcuccggcgggcuggcccugcccugggacccccacagccucgagaugguccugaucggcugccacggguccggcaccgugcaguggacgcaggaggaggggaccggcguguga

SEQ ID NO: 31847 - RNA, 3054 nt, Artificial Sequence
  derived and/or modified sequence opt1 from KCNH4__Homo_sapiens__NP_036417
augcccgugaugaagggccugcucgccccgcagaacaccuuccuggacaccaucgccacgcgcuucgacgggacccacagcaacuuccugcucgcgaacgcccagggcacccggggguuccccaucgucuacugcuccgacggcuucugcgagcugaccggguacggccgcacggaggugaugcagaagaccugcagcugccgguuccuguacggccccgagaccuccgagcccgcccuccagcgccugcacaaggcccuggaggggcaccaggagcaccgggccgagaucugcuucuaccgcaaggacggcagcgcguucuggugccuccuggacaugaugccgaucaagaacgagaugggggaggugguccuguuccucuucuccuucaaggacaucacccagagcggcucccccgggcugggcccccagggcgggcggggcgacagcaaccacgagaacucccuggggcgccggggcgccacguggaaguuccgcagcgcccggcgccggucccgcaccgugcuccaccggcugaccggccacuucgggcgccggggccaggggggcaugaaggccaacaacaacguguucgagcccaagccgagcguccccgaguacaagguggcguccguggggggcagccgcugccugcuccugcacuacuccgucagcaaggccaucugggacggccugauccuccuggccaccuucuacguggccgugacgguccccuacaacgugugcuucuccggggacgacgacacccccaucaccagccggcacacccugguguccgacaucgccgucgagaugcucuucauccuggacaucauccugaacuuccgcacgaccuacgugagccagagcggccaggugaucuccgcgccgcggagcaucgggcuccacuaccuggccaccugguucuucaucgaccugaucgccgcccuccccuucgaccugcuguacaucuucaacaucaccgucacgucccucgugcaccugcugaagaccgugcgccuccugcgccugcuccggcugcugcagaagcucgagcgcuacagccagugcuccgccgucgugcugacccugcucaugagcguguucgcgcugcuggcccacuggauggccugcaucugguacgucaucggccggcgcgagauggaggccaacgacccccuccugugggacaucggguggcugcacgagcugggcaagcggcucgaggugcccuacgucaacggcuccguggggggcccgagccgccgguccgccuacaucgcggcccuguacuucacccugagcucccucacgagcgugggguucggcaacgucugcgccaacaccgacgccgagaagaucuucuccaucugcaccaugcugaucggggcccugaugcacgcggugguguucggcaacgucaccgccaucauccagcgcauguacagccggcgcucccucuaccacagccggaugaaggaccugaaggacuucauccgcgugcaccggcugccccgcccccucaagcagcggaugcuggaguacuuccagacgaccugggccgugaacuccggcaucgacgccaacgagcugcuccgcgacuuccccgacgagcugcgggcggacaucgccaugcaccugaaccgcgagauccuccagcugccgcuguucggggccgccagccggggcugccuccgcgcccugucccugcacaucaagaccagcuucugcgcgcccggggaguaccuccugcgccggggcgacgcccugcaggcccacuacuacgucugcagcggcucccucgaggugcugcgcgacaacauggugcuggccauccucgggaagggcgaccugaucggggccgacauccccgagcccggccaggagccggggcugggcgcggaccccaacuucguccucaagaccagcgccgacgugaaggcccugacguacugcggccugcagcagcucuccagccgggggcuggccgaggugcugcgccucuaccccgaguacggcgccgcguuccgggccgggcugccccgcgaccugaccuucaaccuccggcagggcuccgacaccagcgggcugucccgcuucagccgguccccgcgccugagccagccccgguccgagagccucggcuccagcuccgacaagacccugcccagcaucacggaggccgaguccggcgccgagccggggggcgggccccgcccccggcgcccccugcuccugccgaaccugagccccgcgcggccccgcggcagccucgucucccugcugggggaggagcuccccccguucagcgcccugguguccagccccucccugagccccucccucagccccgcccuggccggccagggccacuccgccagcccgcacgggcccccccggugcuccgcggccuggaagcccccgcagcugcucauccccccccugggcaccuucgggcccccggaccugagcccccgcaucguggacggcaucgaggacuccgggagcaccgccgaggcccccuccuuccgguucagccgccggcccgagcucccgcgcccccgcucccaggcccccccgaccggcacccggcccagccccgagcuggcguccgaggccgaggaggucaaggagaaggugugccgccugaaccaggagaucagccggcucaaccaggaggugagccagcugucccgcgagcugcggcacaucaugggccuccugcaggcccgccuggggcccccgggccaccccgccgggagcgccuggacgcccgaccccccgugcccccagcuccggccccccugccuguccccgugcgcgagccgccccccccccucccugcaggacaccacccucgccgagguccacugcccggccagcgugggcaccauggagacgggcaccgcccugcuggaccuccggcccuccauccugccccccuacccgagcgagcccgacccccuggggcccuccccggugcccgaggcgagcccccccaccccgucccuccugcgccacagcuuccagucccggagcgacaccuuccacuga

SEQ ID NO: 31848 - RNA, 2967 nt, Artificial Sequence
  derived and/or modified sequence opt1 from KCNH5__Homo_sapiens__NP_647479
augcccggcgggaagcgcggccugguggccccgcagaacaccuuccuggagaacaucguccggcgcagcuccgagagcuccuuccugcuggggaacgcccagaucguggacuggcccguggucuacagcaacgacggcuucugcaagcucuccggguaccaccgggcggacgugaugcagaaguccuccacgugcagcuucauguacggcgagcugaccgacaagaagaccaucgagaaggugcgccagaccuucgacaacuacgaguccaacugcuucgagguccugcucuacaagaagaaccggacccccgugugguucuacaugcagaucgcccccauccgcaacgagcacgagaaggugguccuguuccugugcacguucaaggacaucacccucuucaagcagccgaucgaggacgacagcaccaagggcuggaccaaguucgcccggcugacgcgcgcccugaccaacucccggagcgugcuccagcagcugacccccaugaacaagaccgaggugguccacaagcacucccgccuggccgaggugcuccagcuggggagcgacauccugccccaguacaagcaggaggcgcccaagacgccgccccacaucauccuccacuacugcgccuucaagaccaccugggacugggugauccugauccugaccuucuacacggccaucaugguccccuacaacguguccuucaagaccaagcagaacaacaucgccuggcucgugcuggacagcgucguggacgugaucuuccuggucgacaucgugcucaacuuccacaccaccuucgugggccccgggggcgaggucaucuccgacccgaagcugauccggaugaacuaccugaagacgugguucgugaucgaccuccugagcugccugcccuacgacaucaucaacgcguucgagaacgucgacgaggggaucuccagccucuucagcucccugaagguggugcgccugcuccggcugggccgcgucgcccggaagcuggaccacuaccucgaguacggcgccgccgugcuggugcugcucgucugcguguucgggcugguggcccacuggcuggcgugcaucugguacagcaucggcgacuacgaggucaucgacgaggugaccaacaccauccagaucgacuccuggcucuaccagcuggcccugagcaucgggacccccuaccgcuacaacacguccgccggcaucugggagggcgggcccagcaaggacucccucuacgugagcucccuguacuucaccaugaccagccugaccacgaucggcuucgggaacaucgccccgaccaccgacgucgagaagauguucuccguggccaugaugauggugggcagccuccuguacgcgaccaucuucgggaacgucacgaccaucuuccagcagauguacgccaacaccaaccgguaccacgagaugcugaacaacgugcgcgacuuccugaagcucuaccaggugcccaagggccuguccgagcgggucauggacuacaucgugagcaccugguccaugagcaagggcaucgacacggagaaggugcuguccaucugccccaaggacaugcgcgccgacaucugcguccaccucaaccggaagguguucaacgagcaccccgccuuccgccuggccagcgacgggugccugcgcgcgcucgccguggaguuccagaccauccacugcgccccgggcgaccugaucuaccacgccggggaguccgucgacgcccugugcuucguggugagcggcagccucgaggucauccaggacgacgaggugguggcgauccuggggaagggcgacgucuucggcgacaucuucuggaaggagaccacccuggcccacgccugcgccaacgugcgggcgcucaccuacugcgaccugcacaucaucaagcgcgaggcccugcucaaggugcuggacuucuacacggccuucgccaacuccuucagccggaaccugacccugaccugcaaccuccgcaagcggaucaucuuccgcaagaucuccgacgucaagaaggaggaggaggagcggcugcgccagaagaacgaggugacccucagcauccccguggaccaccccguccggaagcuguuccagaaguucaagcagcagaaggagcugcgcaaccagggguccacgcagggcgaccccgagcggaaccagcuccagguggagagccgcucccugcagaacggggccagcaucaccggcaccuccguggucaccgugagccagaucacgccgauccagaccucccuggcguacgugaagaccagcgagucccucaagcagaacaaccgggacgccauggagcugaagcccaacgggggcgccgaccagaagugccugaaggucaacagccccauccgcaugaagaacggcaacgggaagggcuggcuccggcugaagaacaacaugggggcccacgaggagaagaaggaggacuggaacaacgugaccaaggccgaguccaugggccugcucagcgaggaccccaaguccagcgacagcgagaacuccgugacgaagaacccgcugcgcaagaccgacagcugcgacuccggcaucaccaagagcgaccugcggcucgacaaggcgggggaggcccgcagcccccuggagcacagccccauccaggccgacgccaagcacccguucuaccccauccccgagcaggcccugcagaccacgcuccaggaggucaagcacgagcugaaggaggacauccagcugcucuccugccggaugaccgcgcuggagaagcaggucgccgagauccugaagauccucagcgagaaguccgugccccaggccagcucccccaagagccagaugccccuccaggugccgccccagaucccgugccaggacaucuucuccgugagccgccccgagucccccgagagcgacaaggacgagauccacuucuga

SEQ ID NO: 31849 - RNA, 2985 nt, Artificial Sequence
  derived and/or modified sequence opt1 from KCNH6__Homo_sapiens__NP_110406
augcccgugcgccggggccacgucgccccgcagaacaccuaccuggacaccaucauccgcaaguucgaggggcagagccggaaguuccucaucgccaacgcgcagauggagaacugcgccaucaucuacugcaacgacggcuucugcgagcuguucggguacucccgcguggaggugaugcagcagcccugcacgugcgacuuccugaccggccccaacacccccagcuccgccgucagccggcucgcccaggcccugcugggggcggaggagugcaagguggacauccucuacuaccgcaaggacgccuccagcuuccggugccugguggacgucgugccggugaagaacgaggacggcgccgucaucauguucauccugaacuucgaggaccucgcccagcugcuggcgaagugcuccagccgcucccucagccagcggcugcugucccagagcuuccucggcuccgaggggagccacggccgccccgggggccccgggcccggcaccggccgggggaaguaccgcacgaucucccagaucccgcaguucacccugaacuucguggaguucaaccuggagaagcaccggagcuccagcaccaccgagaucgagaucaucgcgccccacaagguggucgagcgcacgcagaacgugaccgagaaggugacccagguccucucccugggcgccgacgugcugcccgaguacaagcuccaggcgccccggauccaccgcuggaccauccugcacuacagcccguucaaggccgugugggacuggcugauccuccugcuggucaucuacacggccguguucacccccuacagcgccgccuuccuccuguccgaccaggacgagagccggcgcggggccugcuccuacacgugcagcccccugaccguggucgaccucaucguggacaucauguucguggucgacaucgugaucaacuuccggaccaccuacgucaacaccaacgacgagguggugucccacccccgccggaucgccguccacuacuucaagggcugguuccugaucgacaugguggccgccaucccguucgaccugcucaucuuccgcaccggcagcgacgagacgaccacccugaucgggcugcucaagaccgcccgccugcugcggcucgugcgcgucgcccggaagcuggaccgcuacuccgaguacggcgccgcggugcuguuccuccugaugugcacguucgcccugaucgcccacuggcucgccugcaucugguacgccaucgggaacguggagcggcccuaccuggagcacaagaucggcuggcuggacagccucgggguccagcugggcaagcgcuacaacggcuccgaccccgcgagcgggcccuccgugcaggacaaguacgugaccgcccuguacuucaccuucagcucccugaccagcgucggcuucgggaacguguccccgaacacgaacagcgagaagguguucuccaucugcgucaugcucaucggcagccugauguacgccuccaucuucgggaacgugagcgccaucauccagcggcuguacagcggcaccgcgcgcuaccacacccagaugcuccgggugaaggaguucauccgcuuccaccagauccccaacccccugcggcagcgccuggaggaguacuuccagcacgccugguccuacaccaacggcaucgacaugaacgccguccucaagggguuccccgagugccugcaggccgacaucugccugcaccuccaccgggcccugcugcagcacugcccggcguucagcggcgccgggaagggcugccuccgcgcccuggccgugaaguucaagacgacccacgccccgcccggggacacccuggugcaccucggcgacguccuguccacccuguacuucaucagccggggcuccaucgagauccuccgcgacgacgugguggucgcgauccuggggaagaacgacaucuucggcgagcccgugagccugcacgcccagcccgggaaguccagcgccgacgugcgggcccucacguacugcgaccugcacaagauccagcgcgccgaccugcucgagguccuggacauguaccccgcguucgccgaguccuucuggagcaagcuggaggugaccuucaaccuccgggacgccgccggcggccugcacuccagcccccgccaggcgccggggucccaggaccaccagggcuucuuccugagcgacaaccaguccgggagcccccacgagcucggcccccaguuccccuccaagggguacagccugcugggcccgggcagccagaacuccaugggggccggccccugcgcccccgggcaccccgacgccgccccgccccucagcaucuccgacgcgagcggccuguggcccgagcugcuccaggagaugcccccgcgccacuccccgcagagcccccaggaggaccccgacugcuggccccugaagcuggggucccggcucgagcagcugcaggcccagaugaaccgccuggagagccggguguccagcgaccucucccgcauccugcagcugcuccagaagcccaugccccagggccacgccagcuacauccuggaggcccccgccuccaacgaccuggcgcucgucccgaucgccagcgagaccaccucccccggcccccggcugccccagggguuccugccgcccgcccagacccccagcuacggcgaccucgacgacugcuccccgaagcaccgcaacagcagcccccggaugccccaccuggccguggccacggacaagacccuggcgcccuccagcgagcaggagcagccggaggggcucuggccgccccuggccagcccccugcacccccucgaggugcagggccugaucugcgggcccugcuucuccucccugcccgagcaccucggcagcguccccaagcagcuggacuuccagcgccacggcuccgacccgggguucgccggcagcugggggcacuga

SEQ ID NO: 31850 - RNA, 3591 nt, Artificial Sequence
  derived and/or modified sequence opt1 from KCNH7__Homo_sapiens__NP_150375
augcccgugcgccggggccacgucgccccgcagaacaccuuccuggggaccaucauccgcaaguucgagggccagaacaagaaguucaucaucgccaacgcgcgggugcagaacugcgccaucaucuacugcaacgacggguucugcgagaugacgggcuucagccgccccgacgugaugcagaagcccugcacgugcgacuuccuccacgggcccgagaccaagcggcacgacaucgcccagaucgcccaggcccugcugggcuccgaggagcgcaaggucgaggugaccuacuaccacaagaacggcagcaccuucaucugcaacacccacaucaucccggugaagaaccaggagggggucgcgaugauguucaucaucaacuucgaguacgugaccgacaacgagaacgccgccacccccgagcgggugaaccccauccuccccaucaagacggucaaccgcaaguucuucggcuucaaguucccggggcugcgggugcugaccuaccgcaagcagucccucccccaggaggaccccgacguggucgugaucgacagcuccaagcacagcgacgacuccguggccaugaagcacuucaagagccccaccaaggaguccugcagcccguccgaggcggacgacaccaaggcccugauccagcccagcaagugcagcccccuggucaacaucagcggcccccucgaccacuccagcccgaagcggcagugggaccgccuguaccccgacaugcugcaguccagcucccagcucagccacagccggucccgcgagagccugugcuccauccggcgcgccagcuccgugcacgacaucgagggguucggcgugcaccccaagaacaucuuccgggaccgccacgccagcgaggacaacggccggaacgucaaggggcccuucaaccacaucaaguccagccugcucggcuccacgagcgacuccaaccugaacaaguacagcaccaucaacaagaucccgcagcugacccucaacuucuccgaggugaagaccgagaagaagaacagcagcccgcccagcuccgacaagacgaucaucgcccccaaggugaaggaccgcacccacaacgucaccgagaaggugacccaggugcugagccugggggcggacguccuccccgaguacaagcugcagacgccccggaucaacaaguucaccauccugcacuacucccccuucaaggccgugugggacuggcucauccugcugcucgucaucuacaccgccaucuucacccccuacagcgccgccuuccugcugaacgaccgcgaggagcagaagcgccgggagugcggcuacagcugcuccccgcucaacgugguggaccugaucgucgacaucauguucaucaucgacauccugaucaacuuccgcacgaccuacgugaaccagaacgaggagguggucagcgaccccgcgaagaucgccauccacuacuucaagggcugguuccucaucgacaugguggccgccauccccuucgaccugcugaucuucggguccggcagcgacgagaccaccacgcucaucgggcugcugaagaccgcccggcuccugcgccuggugcgggucgcgcgcaagcucgaccgguacuccgaguacggcgccgccgugcugaugcugcucaugugcaucuucgcccugaucgcccacuggcuggcgugcaucugguacgccaucgggaacguggagcgcccguaccucaccgacaagaucggcuggcuggacagccugggccagcagaucgggaagcgguacaacgacuccgacagcuccagcggccccuccaucaaggacaaguacgucaccgcccuguacuucacguucagcucccucaccagcgugggguucggcaacgugucccccaacaccaacagcgagaagaucuucuccaucugcgucaugcugaucgggagccugauguacgccagcaucuucggcaacguguccgcgaucauccagcgccucuacagcggcaccgcccgguaccacaugcagaugcugcgcgugaaggaguucauccgguuccaccagauccccaacccgcugcgccagcggcucgaggaguacuuccagcacgccuggacguacaccaacgggaucgacaugaacaugguccugaagggcuuccccgagugccugcaggccgacaucugccuccaccugaaccagacccugcuccagaacugcaaggccuuccgcggggcguccaagggcugccugcgggcccuggccaugaaguucaagaccacccacgccccgcccggggacacgcucgugcacugcggcgacgugcugaccgcccuguacuuccucagccgcggcuccaucgagauccugaaggacgacaucgucguggcgauccuggggaagaacgacaucuucggcgagauggugcaccucuacgccaagcccggcaagagcaacgccgacguccgggcccugaccuacugcgaccugcacaagauccagcgcgaggaccuccuggaggugcuggacauguaccccgaguucuccgaccacuuccucaccaaccuggagcugacguucaaccuccgccacgagagcgccaaggcggaccugcugcggucccagagcaugaacgacuccgagggggacaacugcaagcuccgccggcgcaagcugagcuucgaguccgagggcgagaaggagaacagcaccaacgaccccgaggacuccgccgacaccauccggcacuaccagagcuccaagcgccacuucgaggagaagaagucccgguccagcagcuucaucuccagcaucgacgacgagcagaagccccuguucuccgggaucguggacagcuccccgggcaucgggaaggccagcggccucgacuucgaggagaccguccccacguccgggcgcaugcacaucgacaagcggagccacuccugcaaggacaucaccgacaugcgcagcugggagcgggagaacgcccacccccagcccgaggacuccagcccguccgcgcugcagcgcgccgccuggggcaucagcgagaccgaguccgaccugaccuacggcgagguggagcagcggcucgaccugcugcaggagcagcucaaccgccuggagagccagaugacgaccgacauccagaccauccugcagcuccugcagaagcagaccacgguggucccgcccgccuacuccauggugaccgccgggagcgaguaccagcggcccaucauccagcugaugcgcaccucccagcccgaggcgagcaucaagaccgaccggagcuucucccccagcucccagugccccgaguuccucgaccuggagaaguccaagcugaaguccaaggagagccucuccagcggcgugcaccugaacacggccuccgaggacaaccugaccagccuccugaagcaggacuccgaccugagccucgagcugcaccuccgccagcggaagaccuacguccaccccauccgccacccgucccugcccgacagcucccugagcaccguggggaucgugggccugcaccggcacgucuccgaccccgggcucccgggcaaguga

SEQ ID NO: 31851 - RNA, 3324 nt, Artificial Sequence
  derived and/or modified sequence opt1 from KCNH8__Homo_sapiens__NP_653234
augcccgugaugaagggccugcucgccccgcagaacaccuuccuggacaccaucgccacgcgcuucgacgggacccacagcaacuucauccuggcgaacgcccaggucgccaagggcuuccccaucguguacugcuccgacggguucugcgagcucgccggcuucgcccggaccgaggugaugcagaaguccugcuccugcaaguuccuguucggggucgagaccaacgagcagcugaugcuccagaucgagaagucccuggaggagaagacggaguucaagggcgagaucauguucuacaagaagaacggcagccccuucuggugccugcucgacaucgugcccaucaagaacgagaagggggacgugguccuguuccuggcgagcuucaaggacaucaccgacaccaaggugaagaucaccccggaggacaagaaggaggacaaggugaagggccgcucccgggccgggacgcacuucgacagcgcccgccggcgcucccgggccguccucuaccacaucagcggccaccuccagcgccgggagaagaacaagcugaagaucaacaacaacguguucguggacaagcccgcguuccccgaguacaaggucuccgacgccaagaaguccaaguucauccugcugcacuucagcaccuucaaggccgggugggacuggcugauccuccuggccaccuucuacguggccgugaccguccccuacaacgugugcuucaucggcaacgacgaccugagcacgacccgcuccaccaccgugagcgacaucgcggucgagauccucuucaucaucgacaucauccugaacuuccggacgaccuacguguccaagagcggccaggugaucuucgaggcccgcuccaucugcauccacuacgucaccaccugguucaucaucgaccugaucgccgcccucccguucgaccugcuguacgccuucaacgugacgguggucagccucgugcaccuccugaagaccguccggcugcugcgccugcuccggcugcugcagaagcucgaccgcuacagccagcacuccaccaucgugcugacccugcucaugagcauguucgcgcugcuggcccacuggauggccugcaucugguacgugaucgggaagauggagcgggaggacaacucccuccugaagugggaggucggcuggcugcacgagcucgggaagcgccuggagagccccuacuacggcaacaacacgcugggcgggcccuccauccggagcgccuacaucgccgcgcucuacuucacccuguccagccugaccuccgugggcuucgggaacgugagcgccaacaccgacgccgagaagaucuucuccaucugcacgaugcugaucggcgcccucaugcacgcccuggucuucgggaacgugaccgcgaucauccagcgcauguacagccgguggucccuguaccacacccgcaccaaggaccucaaggacuucauccgcgugcaccaccucccccagcagcugaagcagcggaugcuggaguacuuccagacgaccuggagcgucaacaacggcaucgacuccaacgagcugcugaaggacuucccggacgagcuccgcagcgacaucaccaugcaccugaacaaggagauccugcagcucucccuguucgagugcgccagccggggcugccugcgcucccucagccugcacaucaagaccagcuucugcgcccccggggaguaccugcuccggcagggcgacgcccugcaggcgaucuacuucgugugcuccgggagcauggaggugcugaaggacuccaugguccucgccauccugggcaagggggaccugaucggcgccaaccucagcaucaaggaccaggugaucaagacgaacgccgacgugaaggcccugaccuacugcgaccugcagugcaucauccucaagggccuguucgagguccuggaccucuaccccgaguacgcgcacaaguucguggaggacauccagcacgaccugaccuacaaccugcgcgaggggcacgaguccgacgugaucagccggcucuccaacaagagcauggucucccagagcgagcccaagggcaacgggaacaucaacaagcgccugccguccaucguggaggacgaggaggaggaggaggagggcgaggaggaggaggccgugagccugucccccaucugcacccgggggagcuccagccgcaacaagaaggucggcuccaacaaggccuaccucggccugagccugaagcagcucgccagcgggaccgugcccuuccacucccccauccgggugagccgcuccaacagcccgaagacgaagcaggagaucgacccgcccaaccacaacaagcggaaggagaagaaccugaagcugcagcucuccacccugaacaacgccggcccgcccgaccugagcccccgcaucgucgacgggaucgaggacggcaacuccagcgaggagucccagaccuucgacuucggcagcgagcggauccgcuccgagccccggaucagcccgccccucggggaccccgagaucggcgcggccgugcuguucaucaaggccgaggagaccaagcagcagaucaacaagcugaacuccgaggugacgacccucacccaggaggucagccagcuggggaaggacaugcgcaacgugauccagcugcucgagaacgugcugagcccccagcagcccagccgguucugcucccugcacagcaccuccgucugccccagccgcgagagccuccagacgcgcaccuccuggagcgcccaccagcccugccugcaccuccagaccggcggggccgcguacacccaggcccagcugugcuccagcaacaucacguccgacaucuggagcguggaccccuccagcgugggcuccagcccgcagcggaccggcgcccacgagcagaaccccgccgacuccgagcuguaccacagccccucccuggacuacagccccucccacuaccaggucgugcaggaggggcaccuccaguuccugcgcugcaucagcccgcacuccgacagcacccugacgccccuccaguccaucagcgcgacccugagcuccagcgugugcuccagcuccgagaccagccugcaccucguccugcccucccggagcgaggagggcuccuucagccaggggaccguguccagcuucucccuggagaaccuccccggcagcuggaaccaggaggggauggccuccgccagcaccaagccgcuggagaaccugccccucgagguggucacguccaccgccgaggugaaggacaacaaggccaucaacguguga

SEQ ID NO: 31852 - RNA, 684 nt, Artificial Sequence
  derived and/or modified sequence opt1 from KCNIP1__Homo_sapiens__NP_001030009
augggcgccgugauggggaccuucagcucccuccagaccaagcagcgccggcccagcaaggacaucgccuggugguacuaccaguaccagcgcgacaagaucgaggacgagcucgagaugacgauggucugccaccggccggagggccuggagcagcuggaggcgcagaccaacuucaccaagcgcgagcuccaggugcuguaccggggguucaagaacgagugccccuccggcguggucaacgaggacaccuucaagcagaucuacgcccaguucuucccccacggggacgccagcacguacgcccacuaccuguucaacgccuucgacaccacccagaccggcuccgugaaguucgaggacuucgugacggcgcucagcauccugcugcgcggcaccguccacgagaagcuccgguggaccuucaaccuguacgacaucaacaaggacggguacaucaacaaggaggagaugauggacaucgugaaggccaucuacgacaugaugggcaaguacaccuaccccgugcugaaggaggacacgccgcgccagcacgucgacguguucuuccagaagauggacaagaacaaggacgggaucgugacccucgacgaguuccuggaguccugccaggaggacgacaacaucaugcggagccugcagcuguuccagaacgucauguga

SEQ ID NO: 31853 - RNA, 858 nt, Artificial Sequence
  derived and/or modified sequence opt1 from KCNIP2__Homo_sapiens__NP_055406
augcgcggccaggggcggaaggagagccuguccgacagccgcgaccucgacggcuccuacgaccagcugaccgggcacccgcccggccccaccaagaaggcccugaagcagcgguuccucaagcugcugcccugcugcgggccccaggcccucccgagcguguccgagaucggccgcgucuuccgguuccugggcgacagcucccugcccagcgcgcucgccgcccccgccucccugcgcccccaccggccgcgccugcucgaccccgacagcguggacgacgaguucgagcuguccacggugugccaccggcccgaggggcuggagcagcuccaggagcagaccaaguucacccgcaaggagcugcagguccuguaccggggcuucaagaacgagugccccagcgggaucgugaacgaggagaacuucaagcagaucuacucccaguucuucccgcagggcgacagcuccaccuacgccacguuccucuucaacgcguucgacaccaaccacgacgggagcguguccuucgaggacuucgucgccggccugagcgugauccugcgcggcaccguggacgaccggcucaacugggccuucaaccuguacgaccugaacaaggacgggugcaucaccaaggaggagaugcucgacaucaugaaguccaucuacgacaugaugggcaaguacacguaccccgcccugcgcgaggaggcgccccgggagcacgucgagagcuucuuccagaagauggaccgcaacaaggacgggguggugaccaucgaggaguucaucgagagcugccagaaggacgagaacaucaugcgguccaugcagcuguucgacaacgucaucuga

SEQ ID NO: 31854 - RNA, 693 nt, Artificial Sequence
  derived and/or modified sequence opt1 from KCNIP3__Homo_sapiens__NP_001030086
augggcauccaggggauggagcucugcgccauggccguggucgugcuccuguucaucgcggugcugaagcaguucggcauccucgagcccaucagcauggaggacuccagcgacuccgagcuggagcugagcaccguccgccaccagccggaggggcucgaccagcugcaggcccagaccaaguucacgaagaaggagcugcagucccucuaccggggcuucaagaacgagugccccaccgggcugguggacgaggacaccuucaagcugaucuacgcccaguucuucccccagggcgacgccaccacguacgcccacuuccucuucaacgcguucgacgccgacggcaacggggccauccacuucgaggacuucguggucggccugagcauccugcuccgcgggaccgugcacgagaagcugaagugggccuucaaccuguacgacaucaacaaggacggcuacaucaccaaggaggagaugcucgcgaucaugaaguccaucuacgacaugauggggcggcacaccuaccccauccugcgcgaggacgccccggccgagcacguggagcgguucuucgagaagauggaccgcaaccaggacggcgucgugacgaucgaggaguuccuggaggccugccagaaggacgagaacaucaugagcuccaugcagcuguucgagaacgugaucuga

SEQ ID NO: 31855 - RNA, 678 nt, Artificial Sequence
  derived and/or modified sequence opt1 from KCNIP4__Homo_sapiens__NP_001030175
augagcggcugccgcaagcggugcaagcgcgagauccugaaguucgcccaguaccuccugcggcugcucaccgggucccugcacaccgacagcguggaggacgagcuggagauggccacgguccgccaccggcccgaggcccucgagcugcuggaggcccaguccaaguucaccaagaaggagcuccagauccuguaccgcggcuucaagaacgagugcccgagcgggguggugaacgaggagaccuucaaggagaucuacucccaguucuucccccagggcgacagcaccacguacgcccacuuccuguucaacgccuucgacaccgaccacaacggggccgucuccuucgaggacuucaucaagggccucagcauccugcugcggggcaccgugcaggagaagcucaacugggcguucaaccuguacgacaucaacaaggacggguacaucaccaaggaggagaugcuggacaucaugaaggccaucuacgacaugaugggcaagugcacguaccccgugcucaaggaggacgcgccccgccagcacgucgagaccuucuuccagaagauggacaagaacaaggacgggguggugaccaucgacgaguucaucgaguccugccagaaggacgagaacaucaugcggagcaugcagcuguucgagaacgucaucuga

SEQ ID NO: 31856 - RNA, 1140 nt, Artificial Sequence
  derived and/or modified sequence opt1 from KCNJ10__Homo_sapiens__NP_002232
augaccagcguggccaaggucuacuacucccagaccacgcagaccgagagccgcccccugaugggcccggggauccggcgccggcgcgugcucaccaaggacggccgguccaacgugcgcauggagcacaucgccgacaagcgguuccuguaccugaaggaccucuggaccacguucaucgacaugcaguggcgcuacaagcugcuccuguucagcgcgaccuucgccgggaccugguuccuguucggcgucgugugguaccugguggccgucgcccacggggaccuccuggagcuggacccgcccgccaaccacacccccugcguggugcagguccacacgcucaccggcgcguuccuguucucccuggagagccagaccaccaucggcuacggguuccgguacaucuccgaggagugcccccucgccaucgugcugcugaucgcccagcucgugcugacgaccauccuggagaucuucaucaccggcaccuuccucgccaagaucgcgcgccccaagaagcgggccgagacgauccgcuucagccagcacgccgucguggccucccacaacgggaagcccugccugaugauccggguggccaacaugcgcaagagccugcucaucggcugccaggucaccgggaagcugcugcagacccaccagaccaaggagggcgagaacauccggcucaaccaggugaacgugacguuccaggucgacaccgcguccgacagccccuuccugauccugccgcucaccuucuaccacgugguggacgagaccagcccccugaaggaccugccccuccgcuccggcgagggggacuucgagcugguccugauccucuccggcacgguggagagcaccuccgcgaccugccaggugcggaccagcuaccugcccgaggagauccuguggggguacgaguucacgccggccaucucccucagcgccagcggcaaguacaucgccgacuucucccuguucgaccaggucgugaaggucgccagccccuccggccugcgcgacagcaccgugcgguacggggaccccgagaagcucaagcuggaggagucccugcgcgagcaggccgagaaggagggcagcgcccucuccgugcggaucagcaacgucuga

SEQ ID NO: 31857 - RNA, 1173 nt, Artificial Sequence
  derived and/or modified sequence opt1 from KCNJ11__Homo_sapiens__NP_000516
augcugagccgcaagggcaucauccccgaggaguacgugcucacccggcuggccgaggacccggccaagccccgcuaccgggcgcgccagcggcgcgcccgguucgucuccaagaaggggaacugcaacguggcccacaagaacauccgcgagcagggccgguuccugcaggacguguucaccacgcucgucgaccugaaguggccccacacccugcucaucuucaccaugagcuuccugugcuccuggcuccuguucgccauggccugguggcugaucgcguucgcccacggggaccuggcccccagcgagggcaccgccgagccgugcgugacguccauccacagcuucuccagcgcguuccucuucuccaucgaggugcaggucaccaucggguucggcggccgcauggugaccgaggagugcccccuggccauccugauccucaucgugcagaacaucgucgggcugaugaucaacgccaucaugcugggcugcaucuucaugaagaccgcccaggcccaccggcgcgcggagacgcucaucuucagcaagcacgccgugaucgcccugcggcacgggcgccugugcuucaugcuccgggugggcgaccugcgcaaguccaugaucaucagcgccaccauccacaugcaggucgugcggaagaccaccucccccgagggggagguggucccccugcaccagguggacaucccgauggagaacggcgugggcgggaacagcaucuuccucgucgcgccccugaucaucuaccacgugaucgacgccaacagcccccuguacgaccucgcccccuccgaccugcaccaccaccaggaccuggagaucaucgugauccucgagggcgucguggagacgaccgggaucaccacccaggcccgcacguccuaccuggccgacgagauccuguggggccagcgguucgugccgaucgucgccgaggaggacggccgcuacagcguggacuacuccaaguucgggaacaccgucaaggugcccacgccccucugcaccgcgcggcagcuggacgaggaccacagccugcucgaggcccugacccuggccagcgcccgcggcccccuccgcaagcgguccgugccgauggccaaggcgaagcccaaguucagcaucucccccgacagccuguccuga

SEQ ID NO: 31858 - RNA, 1302 nt, Artificial Sequence
  derived and/or modified sequence opt1 from KCNJ12__Homo_sapiens__NP_066292
augaccgccgccagccgcgcgaaccccuacuccaucgugagcuccgaggaggacggccugcaccucgucaccaugagcggggccaacggcuucgggaacggcaaggugcacacgcggcgccggugccgcaaccgguucgugaagaagaacgggcagugcaacaucgaguucgccaacauggacgagaagucccagcgcuaccuggccgacauguucacgaccugcgucgacauccgguggcgcuacaugcugcucaucuucagccuggccuuccuggcguccuggcuccuguucggcaucaucuucugggugaucgccguggcccacggcgaccuggagccggccgaggggcggggccgcacccccugcgucaugcagguccacggguucauggcggccuuccucuucagcaucgagacccagaccaccaucggcuacgggcugcggugcgugaccgaggagugccccguggccguguucaugguggucgcccaguccaucgugggcugcaucaucgacagcuucaugaucggcgccaucauggcgaagauggcccgccccaagaagcgggcccagacgcuccucuucucccacaacgccguggucgcccugcgcgacgggaagcugugccucauguggcgggugggcaaccugcgcaagagccacaucguggaggcgcacguccgggcccagcugaucaagccgcgcgugaccgaggagggggaguacaucccccucgaccagaucgacaucgacgugggcuucgacaagggccuggaccggaucuuccuggucucccccaucaccauccuccacgagaucgacgaggccagcccccuguucgggaucucccgccaggaccuggagaccgacgacuucgagaucguggugauccucgagggcauggucgaggccacggccaugaccacccaggcgcggagcuccuaccuggccaacgagauccugugggggcaccgcuucgagccggugcuguucgaggagaagaaccaguacaagaucgacuacagccacuuccacaagaccuacgagguccccuccacgccccgcugcagcgccaaggaccugguggagaacaaguuccugcuccccagcgccaacuccuucugcuacgagaacgagcuggccuuccugagccgggacgaggaggacgaggcggacggcgaccaggacgggcgcucccgggacggccucagcccgcaggcccgccacgacuucgaccggcugcaggccggcgggggcgugcuggagcagcgccccuaccggcgcgaguccgagaucuga

SEQ ID NO: 31859 - RNA, 285 nt, Artificial Sequence
  derived and/or modified sequence opt1 from KCNJ13__Homo_sapiens__NP_001165887
auggacagcuccaacugcaaggugaucgcgccccugcucagccagcgcuaccggcgcauggucaccaaggacggccacuccacccugcagauggacggggcccagcggggccuggccuaccuccgcgacgccugggggauccugauggacaugcgguggcgcuggaugaugcugguguucagcgccuccuucgugguccacuggcucguguucgccgugcuguggugcuucugcggcgaggacugcccggccaagaaguccagcuucuucaacagccuguacuga

SEQ ID NO: 31860 - RNA, 1311 nt, Artificial Sequence
  derived and/or modified sequence opt1 from KCNJ14__Homo_sapiens__NP_037480
augggccuggcccgcgcccuccggcgccugagcggggcgcuggacuccggcgacagccgggccggggacgaggaggaggccggccccgggcucugccgcaacggcugggcccccgcccccgugcagucccccgucggccggcgccgggggcgcuucgugaagaaggacggccacugcaacgugcgguucgucaaccucgggggccagggggcgcgcuaccugagcgaccucuucacgaccugcguggacgugcgguggcgcuggaugugccugcuguucuccugcagcuuccucgccuccuggcugcuguucggccucgccuucuggcugaucgccagccugcacggcgaccucgcggcgcccccgccgcccgcccccugcuucucccacgucgccagcuuccuggccgccuuccuguucgcccucgagacccagaccuccaucggguacggcgugcggagcgugaccgaggagugccccgccgccgucgccgcgguggugcugcagugcaucgccgggugcguccuggacgccuucguggugggcgccgucauggccaagauggcgaagcccaagaagcgcaacgagacccucguguucuccgagaacgccguggucgcccugcgggaccaccgccugugccucauguggcgggugggcaaccugcgccggagccaccugguggaggcccacguccgcgcccagcuccugcagccccgggugacgcccgagggggaguacaucccgcuggaccaccaggacguggacgucggcuucgacgggggcaccgaccgcaucuuccucgugucccccaucaccaucguccacgagaucgacagcgcgagcccccuguacgagcuggggcgcgccgagcucgcccgggccgacuucgagcugguggugauccuggagggcauggucgaggcgaccgccaugacgacccagugccgcuccuccuaccuccccggcgagcugcugugggggcaccgguucgagccggugcuguuccagcgcggcagccaguacgagguggacuaccggcacuuccaccgcaccuacgagguccccgggacccccgugugcagcgccaaggagcuggacgagcgggccgagcaggccucccacagccugaaguccagcuuccccggcucccucacggcguucugcuacgagaacgagcuggcccugagcugcugccaggaggaggacgaggacgacgagaccgaggaggggaacggcguggagaccgaggacggcgccgccuccccgcgcguccucacccccacgcuggcccugacccucccgcccuga

SEQ ID NO: 31861 - RNA, 1128 nt, Artificial Sequence
  derived and/or modified sequence opt1 from KCNJ15__Homo_sapiens__XP_011527863
auggacgccauccacaucggcaugagcuccacgccccuggugaagcacaccgccggggcgggccucaaggccaaccgcccgcgggucaugagcaaguccgggcacagcaacgugcgcaucgacaagguggacggcaucuaccugcuguaccuccaggaccuguggaccaccgucaucgacaugaaguggcgguacaagcugacccucuucgccgccaccuucgugaugacgugguuccuguucggggugaucuacuacgccaucgcguucauccacggcgaccuggagcccggcgagcccaucuccaaccacacccccugcaucaugaaggucgacagccucaccggggccuuccuguucucccuggagagccagaccacgaucggcuacggggugcgcuccaucaccgaggagugcccgcacgccaucuuccuccugguggcccagcuggucaucaccacccucaucgagaucuucaucacgggcaccuuccuggcgaagaucgcccggcccaagaagcgcgccgagaccaucaaguucagccacugcgccgugaucaccaagcagaacgggaagcugugccucgugauccaggucgccaacaugcggaagucccugcugauccagugccagcucagcggcaagcugcugcagacgcacgugaccaaggagggcgagcgcauccuccugaaccaggcgaccgugaaguuccacgucgacuccagcuccgagagccccuuccugauccuccccaugaccuucuaccacgugcuggacgagacguccccgcugcgggaccucacgccccagaaccugaaggagaaggaguucgagcuggugguccuccugaacgccaccguggagagcaccuccgccgugugccagagccgcaccagcuacauccccgaggagaucuacuggggguucgaguucguccccguggugucccugagcaagaacggcaaguacgucgccgacuucucccaguucgagcagauccgcaagagcccggacugcaccuucuacugcgccgacuccgagaagcagcagcucgaggagaaguaccggcaggaggaccagcgggagcgcgagcugcggacccugcuccugcagcagagcaacguguga

SEQ ID NO: 31862 - RNA, 1362 nt, Artificial Sequence
  derived and/or modified sequence opt1 from KCNJ16__Homo_sapiens__NP_001278551
augcugaagauggugcucaccgagaaccccaaccaggagaucgccaccagccuggaguuccugcuccugcagaacuccccgggcagccugcgcgcccagcagcggauguccuacuacgggagcuccuaccacaucaucaacgcggacgccaaguaccccggcuacccgcccgagcacaucaucgccgagaagcgccgggcccgccggcgccuccugcacaaggacgggagcugcaacgucuacuucaagcacaucuucggcgaguggggguccuacgugguggacaucuucacgacccuggucgacaccaaguggcggcacauguucgugaucuucagccucuccuacauccugagcuggcugaucuucggcuccguguucuggcucaucgccuuccaccacggcgaccugcugaacgaccccgacaucacccccugcgucgacaacgugcacagcuucacgggggcguuccucuucucccuggagacccagaccaccaucggcuacggguaccgcugcgugacggaggagugcagcgucgccgugcugauggugauccuccaguccauccugagcugcaucaucaacaccuucaucaucggcgccgcccuggcgaagauggccaccgcccggaagcgcgcccagaccauccgguucuccuacuucgcccucaucgggaugcgcgacggcaagcugugccugauguggcggaucggcgacuuccgccccaaccacgucguggaggggacggugcgggcgcagcuccugcgcuacaccgaggacagcgagggccggaugaccauggccuucaaggaccugaagcucgucaacgaccagaucauccuggugacccccgugacgaucguccacgagaucgaccacgaguccccgcuguacgcccucgaccgcaaggccguggccaaggacaacuucgagauccuggugaccuucaucuacaccggggacagcaccggcacgagccaccagucccggagcuccuacgucccccgcgagauccuguggggccaccgguucaacgacgugcucgaggugaagcgcaaguacuacaaggucaacugccugcaguucgaggggagcguggaggucuacgcgcccuucugcuccgccaagcagcuggacuggaaggaccagcagcuccacaucgagaaggcgcccccggugcgcgagagcugcaccuccgacaccaaggcccggcgccggagcuucuccgccguggccaucgucagcuccugcgagaaccccgaggagaccacgaccagcgccacccacgaguaccgcgagacccccuaccagaaggcccugcugacgcucaaccggaucuccguggagagccagauguga

SEQ ID NO: 31863 - RNA, 1302 nt, Artificial Sequence
  derived and/or modified sequence opt1 from KCNJ18__Homo_sapiens__NP_001181887
augaccgccgccagccgcgcgaaccccuacuccaucgugagccuggaggaggacggccuccaccuggucaccauguccggggccaacggcuucgggaacggcaaggugcacacgcggcgccggugccgcaaccgguucgugaagaagaacgggcagugcaacaucgccuucgccaacauggacgagaagucccagcgcuaccuggccgacauguucacgaccugcgucgacauccgguggcgcuacaugcuccugaucuucucccuggcguuccucgccagcuggcugcuguucggcgugaucuucugggugaucgccgucgcccacggcgaccucgagccggcggaggggcacggccggacccccugcgugaugcagguccacggguucauggccgccuuccuguucuccaucgagacccagaccaccaucggcuacgggcugcgcugcgugaccgaggagugccucguggccguguucauggucguggcccagagcaucgugggcugcaucaucgacuccuucaugaucggcgcgaucauggccaagauggcccggcccaagaagcgcgcccagacgcugcuguucagccacaacgccgucguggcgcuccgggacgggaagcugugccugauguggcgcgugggcaaccuccggaagucccacaucgucgaggcccacgugcgcgcccagcugaucaagccccgggugaccgaggagggggaguacaucccgcuggaccagaucgacaucgacgucggcuucgacaagggccucgaccgcaucuuccuggugagccccaucaccauccugcacgagaucgacgaggccagcccccucuucgggaucagccggcaggaccuggagaccgacgacuucgagaucguggucauccuggagggcaugguggaggccacggcgaugaccacccaggcccgcuccagcuaccucgccaacgagauccugugggggcaccgguucgagcccguccuguucgaggagaagaaccaguacaagaucgacuacucccacuuccacaagaccuacgaggugccgagcacgccccgcugcuccgccaaggaccucguggagaacaaguuccugcugcccagcgccaacagcuucugcuacgagaacgagcucgcguuccugucccgcgacgaggaggacgaggccgacggcgaccaggacgggcggagccgcgacggccugagcccccaggcccggcacgacuucgaccgccuccaggccggcgggggcguccuggagcagcggccguaccgccggggguccgagaucuga

SEQ ID NO: 31864 - RNA, 1176 nt, Artificial Sequence
  derived and/or modified sequence opt1 from KCNJ1__Homo_sapiens__NP_000211
augaacgccagcucccgcaacguguucgacacccugauccggguccucaccgagagcauguucaagcaccuccgcaaguggguggugacgcgguucuucggccacucccgccagcgggcccgccuggucagcaaggacgggcggugcaacaucgaguucggcaacguggaggcgcagucccgcuucaucuucuucguggacaucuggaccaccguccuggaccugaaguggcgguacaagaugaccaucuucaucacggccuuccuggggagcugguucuucuucggccuccugugguacgccguggccuacauccacaaggaccugcccgaguuccacccguccgccaaccacacccccugcguggagaacaucaacgggcucaccagcgcguuccuguucucccuggagacccaggucacgaucggcuacggcuuccgcugcgugaccgagcagugcgccaccgccaucuuccuccugaucuuccagagcauccugggggugaucaucaacuccuucaugugcggcgccauccucgcgaagaucagccggcccaagaagcgcgccaagaccaucacguucuccaagaacgccgucaucagcaagcgcgggggcaagcugugccugcucauccggguggccaaccugcggaagucccugcucaucgggagccacaucuacggcaagcugcugaagaccaccgugacccccgagggcgagacgaucauccucgaccagaucaacaucaacuucgucguggacgccgggaacgagaaccuguucuucaucuccccgcugaccaucuaccacgugaucgaccacaacagccccuucuuccacauggcggccgagacccuccugcagcaggacuucgagcuggucguguuccucgacggcaccguggaguccacgagcgcgaccugccagguccgcaccagcuacgugcccgaggaggugcuguggggguaccgguucgcccccaucgucuccaagaccaaggagggcaaguaccgcguggacuuccacaacuucagcaagacggucgagguggagaccccgcacugcgccaugugccuguacaacgagaaggacgugcgggcccgcaugaagcggggcuacgacaaccccaacuucauccucuccgaggucaacgagaccgacgacaccaagauguga

SEQ ID NO: 31865 - RNA, 1284 nt, Artificial Sequence
  derived and/or modified sequence opt1 from KCNJ2__Homo_sapiens__XP_011523081
augggcagcgugcgcaccaaccgguacuccaucgucagcuccgaggaggacgggaugaagcuggccaccauggccguggcgaacggcuucgggaacggcaagagcaaggugcacacgcgccagcagugccggucccgcuucgucaagaaggacgggcacugcaacgugcaguucaucaacgugggcgagaagggccagcgguaccucgccgacaucuucacgaccugcgucgacauccgcuggcgguggaugcuggugaucuucugccuggccuucgugcucagcuggcuguucuucgggugcgucuucuggcugaucgcccuccugcacggcgaccuggacgccuccaaggaggggaaggcgugcgugagcgaggugaacuccuucaccgccgccuuccucuucagcaucgagacccagaccaccaucggcuacggguuccgcugcgucaccgacgagugccccaucgccguguucaugguggucuuccaguccaucgugggcugcaucaucgacgcguucaucaucggcgccgugauggccaagauggccaagccgaagaagcggaacgagacgcuggucuucagccacaacgccgugaucgcgaugcgcgacgggaagcugugccucauguggcgggugggcaaccugcgcaagucccaccuggucgaggcccacgugcgggcccagcuccucaagagccgcaucaccuccgagggggaguacaucccccuggaccagaucgacaucaacgugggcuucgacagcggcaucgaccggaucuuccuggucucccccaucaccaucgugcacgagaucgacgaggacagcccccuguacgaccuguccaagcaggacaucgacaacgccgacuucgagaucgucgugauccucgaggggaugguggaggccaccgcgaugacgacccagugccgcagcagcuaccuggccaacgagauccuguggggccaccgguacgagccgguccucuucgaggagaagcacuacuacaagguggacuacucccgcuuccacaagaccuacgaggugcccaacacgccccugugcagcgcccgggaccuggccgagaagaaguacauccucuccaacgccaacagcuucugcuacgagaacgaggucgcgcugaccuccaaggaggaggacgacagcgagaacggggugcccgaguccaccagcaccgacaccccgcccgacaucgaccugcacaaccaggccuccgugccccucgagccccgcccgcugcggcgcgagagcgagaucuga

SEQ ID NO: 31866 - RNA, 708 nt, Artificial Sequence
  derived and/or modified sequence opt1 from KCNJ3__Homo_sapiens__NP_001247437
augagcgcccugcgccggaaguucggcgacgacuaccagguggucaccaccuccagcuccgggagcggccuccagccccaggggccgggccaggacccccagcagcagcuggugcccaagaagaagcgccagcgguucguggacaagaacgggcgcugcaacguccagcacggcaaccugggcuccgagacgagccgguaccucuccgaccuguucaccacccugguggaccucaaguggcgcuggaaccuguucaucuucauccugaccuacacgguggccuggcuguucauggcgagcauguggugggucaucgccuacacccgcggggaccucaacaaggcccacgugggcaacuacacccccugcguggccaacgucuacaacuucccguccgccuuccuguucuucaucgagaccgaggcgacgaucggguacggcuaccgguacaucaccgacaagugccccgaggggaucauccucuuccuguuccagagcauccugggcuccaucguggacgccuuccucaucggcugcauguucaucaagaugagccagcccaagaagcgggccgagacccugauguucuccgagcacgccgugaucagcaugcgcgacgggaagcugacccucauguuccgggucggcaaccugcgcaacucccacauggugagcgcgcagauccggugcaagcugcucaagggguga

SEQ ID NO: 31867 - RNA, 1338 nt, Artificial Sequence
  derived and/or modified sequence opt1 from KCNJ4__Homo_sapiens__NP_690607
augcacggccacagccgcaacgggcaggcccacgugccccggcgcaagcggcgcaaccgguucgucaagaagaacggccagugcaacguguacuucgccaaccuguccaacaagagccagcgcuacauggcggacaucuucacgaccugcguggacacccgguggcgcuacaugcucaugaucuucuccgccgccuuccuggucagcuggcuguucuucgggcuccuguucuggugcaucgccuucuuccacggcgaccuggaggccuccccgggggugcccgcggccggcggccccgccgccgggggcgggggcgcggcccccguggccccgaagcccugcaucaugcacgucaacggguuccucggcgccuuccuguucagcguggagacccagaccaccaucggcuacggguuccggugcgugacggaggagugcccccuggccgucaucgcgguggugguccaguccaucgugggcugcgugaucgacagcuucaugaucgggaccaucauggccaagauggcccgccccaagaagcgggcccagacccuccuguucucccaccacgccgucaucagcgugcgcgacggcaagcugugccucauguggcgggugggcaaccugcgcaagucccacaucgucgaggcgcacgugcgggcccagcugaucaagccguacaugacccaggagggggaguaccucccccuggaccagcgcgaccugaacgugggcuacgacaucgggcucgaccggaucuuccuggucagccccaucaucaucgugcacgagaucgacgaggacagcccccuguacggcauggggaaggaggagcucgagagcgaggacuucgagaucguggucauccuggagggcaugguggaggccacggccaugaccacccaggcccgcuccagcuaccuggcguccgagauccucuggggccaccgguucgagccggucguguucgaggagaagucccacuacaagguggacuacucccgcuuccacaagaccuacgaggucgccgggacgcccugcugcagcgcccgggagcugcaggagagcaagaucaccgugcugcccgcgcccccgcccccgcccuccgccuucugcuacgagaacgagcucgcccugaugagccaggaggaggaggagauggaggaggaggccgccgccgcggccgccguggccgccggccuggggcucgaggcgggcuccaaggaggaggccgggaucauccgcaugcuggaguucggcagccaccuggaccucgagcgcaugcaggccucccugccccuggacaacaucagcuaccggcgcgaguccgccaucuga

SEQ ID NO: 31868 - RNA, 1260 nt, Artificial Sequence
  derived and/or modified sequence opt1 from KCNJ5__Homo_sapiens__XP_011541112
auggccggcgacagccgcaacgccaugaaccaggacauggagaucggggugacccccugggaccccaagaagauccccaagcaggcgcgggacuacguccccaucgccaccgaccgcacgcggcugcuggccgagggcaagaagccccgccagcgguacauggagaaguccgggaagugcaacgugcaccacggcaacgugcaggagaccuaccgcuaccugagcgaccuguucaccacccucgucgaccugaaguggcgguucaaccugcucguguucacgaugguguacaccgucaccuggcuguucuucggguucaucugguggcugaucgccuacauccgcggcgaccucgaccacgugggcgaccaggaguggaucccgugcguggagaaccuguccggguucgucagcgccuuccuguucuccaucgagaccgagacgaccaucggcuacggguuccgggugaucaccgagaagugccccgagggcaucauccuccugcuggugcaggcgauccucgggagcaucgucaacgccuucauggugggcugcauguucgugaagaucucccagcccaagaagcgcgccgagacccugauguucagcaacaacgccgucaucuccaugcgggacgagaagcugugccucauguuccgcgugggcgaccugcggaacagccacaucguggaggcguccauccgcgccaagcugaucaagagccggcagacgaaggagggggaguucaucccccucaaccagaccgacaucaacgucggcuucgacaccggggacgaccgccuguuccugguguccccgcucaucaucagccacgagaucaaccagaagucccccuucugggagaugagccaggcccagcugcaccaggaggaguucgagguggucgugauccuggagggcaugguggaggccaccggcaugacgugccaggcccgguccagcuacauggacaccgagguccucugggggcaccgcuucacccccgugcugacccuggagaagggcuucuacgaggucgacuacaacacguuccacgacaccuacgagaccaacacccccuccugcugcgcgaaggagcucgccgagaugaagcgggaggggcgccugcugcaguaccucccgagcccgccccugcugggcgggugcgccgaggccggccucgacgccgaggcggagcagaacgaggaggacgagcccaagggccucgggggcagccgggaggcccgcggguccguguga

SEQ ID NO: 31869 - RNA, 1272 nt, Artificial Sequence
  derived and/or modified sequence opt1 from KCNJ6__Homo_sapiens__NP_002231
auggccaagcugaccgagagcaugaccaacgugcucgagggcgacuccauggaccaggacgucgagagccccguggccauccaccagccgaagcugcccaagcaggcgcgcgacgaccugccccggcacaucucccgcgaccggacgaagcgcaagauccagcgguacgugcgcaaggacgggaagugcaacguccaccacggcaacgugcgggagaccuaccgcuaccucaccgacaucuucaccacgcugguggaccugaaguggcgguucaaccuccugaucuucgucaugguguacaccgugaccuggcuguucuucgggaugaucugguggcucaucgccuacauccgcggcgacauggaccacaucgaggaccccagcuggaccccgugcgucacgaaccugaacggguucguguccgccuuccuguucagcaucgagaccgagaccaccaucggcuacggcuaccgggugaucacggacaagugccccgaggggaucauccuccugcugauccaguccguccucggcagcaucgugaacgccuucaugguggggugcauguucgucaagaucucccagcccaagaagcgcgccgagacccugguguucagcacccacgcggugaucuccaugcgggacggcaagcugugccucauguuccgcgucggggaccugcggaacagccacaucguggaggccuccauccgcgccaagcugaucaagagcaagcagaccuccgagggcgaguucaucccccucaaccagacggacaucaacgugggcuacuacaccggggacgaccggcuguuccuggucagcccgcucaucaucucccacgagaucaaccagcagagccccuucugggagaucuccaaggcccagcugcccaaggaggagcuggagaucguggugauccucgagggcauggucgaggcgaccgggaugaccugccaggcccgcagcagcuacaucacguccgagauccuguggggcuaccgguucacccccgugcugacccucgaggacggcuucuacgaggucgacuacaacagcuuccacgagaccuacgagacguccaccccgagccuguccgccaaggagcuggccgagcucgccagccgcgcggagcugccccuguccuggagcguguccagcaagcucaaccagcacgccgagcuggagaccgaggaggaggagaagaaccuggaggagcagaccgagcggaacggggacguggccaaccucgagaacgaguccaaggucuga

SEQ ID NO: 31870 - RNA, 1275 nt, Artificial Sequence
  derived and/or modified sequence opt1 from KCNJ8__Homo_sapiens__XP_005253415
augcuggcccgcaagagcaucauccccgaggaguacgugcucgcccggaucgccgccgagaaccugcgcaagccgcggauccgcgaccggcugcccaaggcccgcuucaucgccaaguccggcgccugcaaccucgcgcacaagaacauccgggagcaggggcgcuuccugcaggacaucuucaccacccuggucgaccucaaguggcggcacacgcuggugaucuucaccaugagcuuccugugcuccuggcuccuguucgccaucaugugguggcugguggccuucgcccacggcgacaucuacgcguacauggagaaguccgggauggagaaguccggccucgagagcaccgucugcgugaccaacgugcgcagcuucacgagcgccuuccuguucuccaucgagguccaggugaccaucggguucggcggccggaugaugaccgaggagugcccccuggccaucaccgugcucauccugcagaacaucgucgggcugaucaucaacgccgugaugcucggcugcaucuucaugaagacggcccaggcgcaccgccgggccgagacccugaucuucagccgccacgccgugaucgccguccggaacgggaagcugugcuucauguuccgcgugggcgaccuccggaaguccaugaucaucagcgccuccgugcgcauccaggucgugaagaagaccaccacgcccgagggggagguggucccgauccaccagcuggacauccccguggacaaccccaucgagagcaacaacaucuuccugguggcgccccucaucaucugccacgucaucgacaagcgguccccgcuguacgacaucagcgccaccgaccuggccaaccaggaccucgaggugaucgugauccuggagggcgucguggagaccaccggcaucacgacccaggcccgcaccuccuacaucgccgaggagauccagugggggcaccgguucgucagcaucgugaccgaggaggagggcguguacuccgucgacuacagcaaguucgggaacacggugaagguggcggcgccccgcugcagcgcccgcgagcuggacgagaagcccuccauccucauccagacccugcagaaguccgagcugagccaccagaacagccuccggaagcgcaacuccaugcggcgcaacaacagcaugcggcgcaacaacuccauccggcgcaacaacagcucccugaugguccccaaggugcaguucaugaccccggagggcaaccagaacaccagcgaguccuga

SEQ ID NO: 31871 - RNA, 1371 nt, Artificial Sequence
  derived and/or modified sequence opt1 from KCNJ9__Homo_sapiens__XP_006711368
augcgcagccggcuggaggagcucaaguuccuggagggccgcuggcggaaccaggugcuggaccucgagaucgagccccugcaggacccccgccggcgccugggggcccagcggcgcgccgcgggcggguccagcuccggcccccggcgcacccccggggcccggagcgcccgccccgacgccgccgcgauggcccaggagaacgccgccuucuccccgggccaggaggagccgccccggcgccggggccgccagcgguacgucgagaaggacgggcgcugcaacgugcagcagggcaacgugcgggagaccuaccgcuaccucacggaccuguucaccacccuggucgaccuccaguggcggcugagccuccucuucuucgugcuggcguacgcccugaccuggcuguucuucggggccaucugguggcugaucgccuacggccgcggggaccuggagcaccucgaggacacggccuggacccccugcgugaacaaccugaacggcuucgucgcggccuuccuguucuccaucgagaccgagaccacgaucggcuacgggcaccgcgugaucaccgaccagugccccgagggcaucgugcuccugcugcuccaggccauccuggggagcauggucaacgccuucauggugggcugcauguucgugaagaucucccagcccaacaagcgggccgcgacccuggucuucagcucccacgccguggugagccuccgcgacggccggcugugccugauguuccgcgucggggaccuccgguccagccacaucguggaggccuccauccgcgccaagcugauccggagccgccagacccuggagggcgaguucaucccccuccaccagacggaccuguccgugggguucgacaccggcgacgaccggcuguuccucgucagcccccuggugaucucccacgagaucgacgccgcgagcccguucugggaggccagccgccgggcccuggagcgcgacgacuucgagaucguggucauccucgaggggaugguggaggccaccggcaugaccugccaggcccgguccagcuaccugguggacgagguccuguggggccaccgcuucacguccgugcucacccuggaggacggguucuacgaggucgacuacgcgagcuuccacgagaccuucgaggugcccacccccuccugcagcgcccgggagcuggccgaggccgcggcccgccucgacgcccaccuguacugguccauccccagccggcuggacgagaagguggaggaggagggcgccggggagggcgccgggggcgaggcgggcgccgacaaggagcagaacgggugccucccgccgcccgaguccgagagcaaggucuga

SEQ ID NO: 31872 - RNA, 1617 nt, Artificial Sequence
  derived and/or modified sequence opt1 from KCNK10__Homo_sapiens__NP_066984
auguucuuccuguacaccgacuucuuccucagccugguggccguccccgccgcggccccggugugccagcccaaguccgccaccaacggccagccgcccgcccccgcccccacgcccacgccccgccugagcaucuccagccgggcgaccguggucgcccgcauggaggggaccucccagggcgggcuccagaccgugaugaaguggaagaccguggucgccaucuucgugguggucgugguguaccuggucaccggcgggcugguguuccgggcccucgagcagccguucgagagcucccagaagaacaccaucgcgcuggagaaggccgaguuccugcgcgaccacgugugcgucagcccccaggagcucgagacgcugauccagcacgcccuggacgccgacaacgccggcgugucccccaucggcaacagcuccaacaacagcucccacugggaccucgggagcgcguucuucuucgccggcaccgugaucaccaccaucggguacggcaacaucgcccccuccacggagggcgggaagaucuucugcauccuguacgccaucuucggcaucccgcuguucggguuccuccuggccggcaucggggaccagcugggcaccaucuucggcaagagcaucgcgcgggucgagaagguguuccgcaagaagcaggucucccagaccaagauccgggugaucagcaccauccucuucauccuggccgggugcaucguguucgugacgauccccgccgucaucuucaaguacaucgagggcuggaccgcccuggaguccaucuacuucguggucgugacccucaccacggugggguucggcgacuucgucgccgggggcaacgcgggcaucaacuaccgcgagugguacaagccccuggugugguucuggauccugguggggcucgccuacuucgccgccguccugagcaugaucggcgacuggcugcgggugcucagcaagaagaccaaggaggaggugggggagaucaaggcccacgcggccgaguggaaggccaacgucaccgccgaguuccgcgagacccggcgccggcuguccguggagauccacgacaagcugcagcgcgcggccacgauccggagcauggagcgccggcgccucggccuggaccagcgggcccacucccuggacaugcucagccccgagaagcgcuccguguucgccgcccuggacaccgggcgguucaaggcgagcucccaggagagcaucaacaaccgcccgaacaaccugcgccucaagggccccgagcagcugaacaagcacggccagggggccuccgaggacaacaucaucaacaaguucggcagcaccucccggcugaccaagcgcaagaacaaggaccucaagaagacgcugcccgaggacguccagaagaucuacaagaccuuccggaacuacagccuggacgaggagaagaaggaggaggagaccgagaagaugugcaacuccgacaacagcuccaccgccaugcucacggacugcauccagcagcacgccgagcuggagaacgggaugauccccaccgacaccaaggaccgcgagccggagaacaacagccugcucgaggaccggaacuga

SEQ ID NO: 31873 - RNA, 1293 nt, Artificial Sequence
  derived and/or modified sequence opt1 from KCNK12__Homo_sapiens__NP_071338
augagcucccgcagcccccggccgccgccccgccggucccgccggcgccugccccggcccagcugcugcugcugcugcugccgccggucccaccucaacgaggacaccggccgcuucgugcugcuggccgcccucaucgggcuguaccuggucgcgggcgccaccguguucagcgcccucgagucccccggggaggccgaggcccgggcgcgcuggggcgccacgcugcggaacuucagcgccgcccacgggguggcggagcccgagcugcgcgccuuccuccggcacuacgaggccgcccuggccgcgggcguccgcgccgacgcccugcggccccgcugggacuucccgggcgccuucuacuucguggggaccguggucuccaccaucggcuucgggaugaccacgcccgccaccgugggcgggaaggcguuccucaucgccuacggccuguucggcugcgccgggaccauccuguucuucaaccucuuccuggagcggaucaucagccugcucgccuucaucaugcgcgccugccgggagcgccagcugcgccgguccggccugcuccccgcgaccuuccgccgggggagcgcccuguccgaggccgacagccuggccggcuggaagcccuccguguaccacguccuccugauccugggccucuucgccgugcugcugagcugcugcgcguccgccauguacacgagcguggaggggugggacuacgucgacucccucuacuucugcuucgugaccuucagcaccaucggcuucggggaccuggugagcucccagcacgccgccuaccgcaaccagggccuguaccggcucgggaacuuccuguucauccugcucggcgucugcugcaucuacagccuguucaacgugaucuccauccugaucaagcagguccucaacuggaugcugcgcaagcugagcugccggugcugcgcgcgcugcugcccggcccccggcgcgccccucgcccggcgcaacgccaucacccccgggucccggcugcgccggcgccuggccgcccucggcgccgacccggccgcccgggacagcgacgcggaggggcgccggcuguccggcgagcugaucagcaugcgcgaccucacggccuccaacaaggugagccuggcccugcugcagaagcagcucuccgagaccgccaacggguacccccggagcgugugcgugaacacccgccagaacggcuucuccggcggggucggcgcccuggggaucaugaacaaccgccuggcggagaccagcgccucccgguga

SEQ ID NO: 31874 - RNA, 969 nt, Artificial Sequence
  derived and/or modified sequence opt1 from KCNK16__Homo_sapiens__NP_001128577
augcccagcgccggccugugcuccugcuggggcgggcgcgugcucccgcugcugcucgccuacgucugcuaccugcugcucggggcgaccaucuuccagcugcuggagcggcaggccgaggcccagagccgcgaccaguuccagcucgagaagcugcgguuccuggagaacuacacgugccucgaccagugggccauggagcaguucguccaggugaucauggaggccugggugaagggcgugaaccccaaggggaacuccaccaaccccagcaacugggacuucggcuccagcuucuucuucgcgggcaccguggucaccaccaucggguacggcaaccuggcccccuccacggaggccggccagguguucugcguguucuacgcccugcucgggaucccgcugaacgucaucuuccugaaccaccucgggaccggccugcgcgcgcaccuggccgccaucgagcggugggaggaccgcccccggcgcagccaggugcuccaggugcugggccuggcccucuuccugacccuggggacccucgucauccugaucuucccgcccaugguguucucccacguggagggcuggagcuucuccgagggguucuacuucgccuucaucacgcugagcaccaucggcuucggcgacuacgucguggggcacccccucaacuucaucacccccuccggccugcugcccagccaggagcccuuccagaccccgcacgggaagcccgagucccagcagauccccggcagcuuccagaagguguccagcaugaacgucuggccccucuccgggaugcacagcccgggccuggcguucccccugcccgacugcaacauccccgaccaggagcgguuccgcccgcuccaccccggcgccuggaaguucuggccccugccccugccgagcuccaacagcaagugggcccccauguggcucggguccagcgcccagguguga

SEQ ID NO: 31875 - RNA, 816 nt, Artificial Sequence
  derived and/or modified sequence opt1 from KCNK17__Homo_sapiens__NP_001128583
auguaccgcccccgggcccgcgccgcgccggagggccgggugcgcgggugcgccguccccagcaccgugcugcuccugcuggccuaccucgccuaccuggcccugggcaccgggguguucuggacgcucgagggccgggcggcccaggacuccagccgcuccuuccagcgggacaagugggagcugcugcagaacuucacgugccucgaccgccccgcccuggacagccugauccgggacgucgugcaggccuacaagaacggggcgucccuccugagcaacaccaccuccaugggccgcugggagcuggugggcagcuucuucuucuccgucagcaccaucaccaccaucggguacggcaaccucucccccaacaccauggccgcccggcuguucugcaucuucuucgcccugguggggaucccgcucaaccuggugguccugaaccgccucggccaccugaugcagcagggggugaaccacugggccagccggcugggcggcacguggcaggaccccgacaaggcgcgcuggcucgccggguccggcgcccugcugagcgggcuccugcuguuccuccugcugccgccccuccuguucucccacauggagggcuggagcuacaccgagggcuucuacuucgccuucaucacccuguccaccgugggguucggcgacuacgucaucgccagcugccucaucuccgacacgcggaagcccaaccgcgacuggcagacccuggagcggaccagcaagagcuccgggggccugcucaaguaccgcuuccuggcggggcacggcggcagccaccuguga

SEQ ID NO: 31876 - RNA, 1155 nt, Artificial Sequence
  derived and/or modified sequence opt1 from KCNK18__Homo_sapiens__NP_862823
auggaggugagcggccacccccaggcccgccggugcugcccggaggcccuggggaagcuguuccccggccugugcuuccugugcuuccucgucaccuacgcgcuggugggggccguggucuucuccgccaucgaggacggccaggugcugguggccgccgacgacggggaguucgagaaguuccucgaggagcugugccgcauccugaacugcagcgagaccgucguggaggaccggaagcaggaccuccagggccaccuccagaaggugaagccccagugguucaaccgcacgacccacugguccuuccugagcucccucuucuucugcugcaccgucuucagcaccgugggcuacggguacaucuaccccgugacgcggcugggcaaguaccugugcaugcucuacgcgcuguucgggaucccgcugauguuccucguccugaccgacaccggcgacauccuggccaccauccucuccacgagcuacaaccgcuuccggaaguuccccuucuucacccgcccccugcuguccaaguggugccccaagagccucuucaagaagaagccggaccccaagcccgccgacgaggccgugccccagaucaucaucuccgcggaggagcugccggggcccaagcuggggaccugccccagccggcccuccugcagcauggagcuguucgagcgcucccacgcccucgagaagcagaacacccugcagcucccgccccaggccauggagcggagcaacuccugccccgagcuggugcugggccgccucagcuacuccaucaucagcaaccuggacgaggucggccagcaggucgagcggcuggacaucccccucccgaucaucgcccugaucguguucgccuacaucagcugcgcggccgccauccugcccuucugggagacgcagcucgacuucgagaacgccuucuacuucugcuucgugacccugaccaccaucggcuucggggacacggugcuggagcaccccaacuucuuccucuucuucuccaucuacaucaucgugggcauggagaucgucuucaucgccuucaagcuggugcagaaccgccugaucgacaucuacaagaacgugaugcuguucuucgcgaagggcaaguucuaccaccucgucaagaaguga

SEQ ID NO: 31877 - RNA, 1011 nt, Artificial Sequence
  derived and/or modified sequence opt1 from KCNK1__Homo_sapiens__NP_002236
augcugcagagccucgccggcuccagcugcgugcgccuggucgagcggcaccgcuccgccuggugcuucggguuccuggugcucggcuaccugcuguaccucguguucggggcggucguguucagcuccguggagcugcccuacgaggaccugcuccggcaggagcugcgcaagcugaagcggcgcuuccucgaggagcacgagugccugagcgagcagcagcuggagcaguuccucggccggguccuggaggccuccaacuacggggugagcgugcuguccaacgccagcggcaacuggaacugggacuucaccuccgcccucuucuucgccagcaccguccuguccacgaccggcuacgggcacaccgugccgcugagcgacggcgggaaggcguucugcaucaucuacuccgugaucggcauccccuucacccuccuguuccugacggccgucgugcagcgcaucaccgugcacgucacccggcgccccgugcucuacuuccacauccgguggggguucagcaagcaggucguggccaucgugcacgccgugcugcugggcuucgucaccguguccugcuucuucuucauccccgcggccguguucagcguccucgaggacgacuggaacuuccuggaguccuucuacuucugcuucaucagccugagcacgaucggccucggggacuacgugccgggcgagggguacaaccagaaguuccgcgagcuguacaagaucggcaucacgugcuaccugcuccugggccugaucgccaugcucgucgugcuggagaccuucugcgagcugcacgagcucaagaaguuccggaagauguucuacgugaagaaggacaaggacgaggaccagguccacaucaucgagcacgaccagcuguccuucagcuccaucaccgaccaggccgccgggaugaaggaggaccagaagcagaacgagcccuucguggcgacccagagcuccgccugcguggacggccccgccaaccacuga

SEQ ID NO: 31878 - RNA, 1269 nt, Artificial Sequence
  derived and/or modified sequence opt1 from KCNK2__Homo_sapiens__NP_001017424
augaugaacccccgcgccaagcgggacuucuaccuggccgcgccggaccuccuggaccccaagagcgccgcccagaacuccaagccccgccugagcuucuccaccaagcccaccgugcucgccagccgggucgaguccgacaccaccaucaacgugaugaaguggaagaccgugagcaccaucuuccuggucguggugcuguaccucaucaucggcgccacggucuucaaggcgcuggagcagccgcacgagaucucccagcgcaccaccaucgugauccagaagcagaccuucaucagccagcacuccugcgugaacagcacggagcuggacgagcucauccagcagaucgucgccgccaucaacgccgggaucaucccccugggcaacaccuccaaccagaucagccacugggaccugggguccagcuucuucuucgcgggcaccgugaucaccacgaucggguucggcaacaucagcccccggaccgagggcgggaagaucuucugcaucaucuacgcccuccugggcaucccccuguucggguuccuccuggccggcgugggggaccagcugggcaccaucuucggcaaggggaucgccaaggucgaggacaccuucaucaaguggaacgugucccagacgaagauccgcaucaucuccaccaucaucuucauccucuucggcugcgugcuguucgucgcccugccggcgaucaucuucaagcacaucgagggguggagcgcccucgacgccaucuacuucguggugaucacccugaccacgaucggcuucggcgacuacgucgccgggggcuccgacaucgaguaccuggacuucuacaagcccguggugugguucuggauccucgucgggcuggccuacuucgcggccgugcugagcaugaucggcgacuggcuccgggugaucagcaagaagaccaaggaggaggucggggaguuccgcgcccacgccgccgaguggaccgcgaacgugaccgccgaguucaaggagacgcggcgccggcuguccgucgagaucuacgacaaguuccagcgcgccaccagcaucaagcggaagcuguccgccgagcucgccggcaaccacaaccaggagcugacccccugccgccggacccugagcgugaaccaccucacguccgagcgcgacgugcugcccccgcugcucaagaccgagagcaucuaccugaacggccugacgccccacugcgcgggggaggagaucgccgucaucgagaacaucaaguga

SEQ ID NO: 31879 - RNA, 1185 nt, Artificial Sequence
  derived and/or modified sequence opt1 from KCNK3__Homo_sapiens__NP_002237
augaagcgccagaacgugcggacccuggcccucaucgucugcaccuucacguaccugcuggugggcgccgcgguguucgacgcccucgagagcgagcccgagcugaucgagcgccagcggcuggagcuccgccagcaggagcugcgggcccgcuacaaccugucccagggcggguacgaggagcucgagcgggucgugcugcgccugaagccgcacaaggccggggugcaguggcgguucgccggcagcuucuacuucgcgaucaccgucaucaccaccaucggguacggccacgccgcccccuccacggacggcgggaagguguucugcauguucuacgcccuccugggcaucccccugacccucgugauguuccagagccugggggagcgcaucaacacccugguccgguaccuccugcaccgcgcgaagaagggccuggggaugcggcgcgccgacguguccauggccaacauggugcucaucggcuucuucagcugcaucuccacccugugcaucggcgccgccgcguucagccacuacgagcacuggacguucuuccaggccuacuacuacugcuucaucacccugaccaccaucggguucggcgacuacgucgcccuccagaaggaccaggcccugcagacgcagccccaguacguggccuucuccuucguguacauccugaccgggcucaccgucaucggcgcguuccugaaccugguggugcuccgguucaugaccaugaacgccgaggacgagaagcgcgacgccgagcaccgggcccugcugacgcgcaacggccaggccgggggcgggggcgggggcggcagcgcgcacaccaccgacaccgccuccagcacggccgccgccgggggcgggggcuuccggaacgucuacgcggaggugcuccacuuccaguccaugugcagcugccugugguacaagucccgcgagaagcugcaguacagcaucccgaugaucaucccccgggaccucuccaccagcgacacgugcguggagcagucccacagcagccccgggggcggcgggcgcuacuccgacacccccagccgccggugccugugcuccggcgccccgcgcagcgccaucuccagcgucuccaccgggcugcacagccucuccaccuuccggggccugaugaagcgccggagcuccguguga

SEQ ID NO: 31880 - RNA, 1500 nt, Artificial Sequence
  derived and/or modified sequence opt1 from KCNK5__Homo_sapiens__NP_003731
augguggaccgcggcccccugcucaccagcgccaucaucuucuaccuggccaucggggcggccaucuucgagguccuggaggagccgcacuggaaggaggccaagaagaacuacuacacccagaagcuccaccuccugaaggaguuccccugccucggccaggaggggcuggacaagauccuggaggugguguccgacgccgccggccagggggucgcgaucacgggcaaccagaccuucaacaacuggaacuggcccaacgccaugaucuucgccgccaccgugaucaccacgaucggcuacgggaacguggcgcccaagaccccggccggccggcuguucugcgucuucuacgggcuguucggcgugccccugugccucaccuggaucagcgcccuggggaaguucuucggcggccgcgccaagcggcuggggcaguuccucaccaagcgcggcgugucccugcggaaggcccagaucacgugcaccgucaucuucaucguguggggcgugcugguccaccucgugaucccgcccuucguguucauggucaccgagggguggaacuacaucgagggccuguacuacagcuucaucaccaucuccacgaucggguucggcgacuucguggcgggggugaaccccagcgccaacuaccacgcccuguaccgcuacuucgucgagcucuggaucuaccugggccuggccuggcucucccuguucgugaacuggaaggugagcauguucgucgaggugcacaaggccaucaagaagcggcgccggcgccggaaggaguccuucgagagcagcccccacucccgcaaggcgcuccaggugaagggguccaccgccagcaaggacgucaacaucuucuccuuccugagcaagaaggaggagaccuacaacgaccugaucaagcagaucggcaagaaggccaugaagaccuccggcgggggcgagacggggcccggccccgggcugggcccgcagggcgggggccuccccgcccugccgcccagccuggugccccucgucguguacuccaagaaccgggugcccacccuggaggaggucagccagacccugcgcagcaaggggcacgugucccggagccccgacgaggaggccguggcgcgcgcccccgaggacuccagcccggcccccgaggucuucaugaaccagcucgaccggaucuccgaggagugcgagcccugggacgcccaggacuaccacccccugaucuuccaggacgccagcaucaccuucgugaacacggaggcgggccuguccgacgaggagaccagcaaguccagccucgaggacaaccuggccggggaggaguccccgcagcagggcgccgaggccaaggcgccccugaacaugggcgaguuccccagcuccagcgaguccaccuucaccagcacggaguccgagcucagcgugcccuacgagcagcugaugaacgaguacaacaaggccaacuccccgaaggggaccuga

SEQ ID NO: 31881 - RNA, 942 nt, Artificial Sequence
  derived and/or modified sequence opt1 from KCNK6__Homo_sapiens__NP_004814
augcgccggggcgcccugcucgccggggcgcuggccgccuacgccgccuaccuggugcucggcgcgcugcuggucgcccgccucgaggggccccacgaggcccggcugcgcgccgagcuggagacccuccgggcgcagcugcugcagcgcagcccgugcguggccgcccccgcccucgacgccuucguggagcggguccuggcggccggccgccuggggcggguggugcucgccaacgccuccggcagcgccaacgcguccgaccccgccugggacuucgccagcgcccuguucuucgccuccacccugaucacgaccgucggcuacggguacaccacgccccucaccgacgcgggcaaggccuucagcaucgccuucgcccugcugggggugccgaccaccaugcuccugcugaccgccuccgcgcagcgccucagccugcugcucacgcacgugccccuguccuggcugagcaugcgguggggcugggacccccgccgggccgccugcuggcaccucgucgcccugcugggggugguggucaccgugugcuuccucgugcccgcggucaucuucgcccaccuggaggaggccugguccuuccuggacgccuucuacuucugcuucaucagccucuccaccaucggccugggcgacuacgugccgggggaggcccccggccagcccuaccgcgcgcuguacaaggugcucgucaccguguaccuguuccuggggcucguggccaugguccuggugcugcagacguuccggcacgugagcgaccuccacggccugaccgagcugauccuccugcccccgcccugccccgccuccuucaacgccgacgaggacgaccgcgucgacauccugggcccccagccggagagccaccagcagcuguccgccagcucccacaccgacuacgcgagcaucccccgguga

SEQ ID NO: 31882 - RNA, 1125 nt, Artificial Sequence
  derived and/or modified sequence opt1 from KCNK9__Homo_sapiens__XP_011515404
augaagcgccagaacgugcggacccugagccucaucgucugcaccuucacguaccugcuggugggcgccgccguguucgacgcgcucgaguccgaccacgagaugcgcgaggaggagaagcugaaggccgaggagauccggaucaaggggaaguacaacaucagcuccgaggacuaccgccagcuggagcucgucauccugcagagcgagccccaccgggccggcgugcaguggaaguucgccggguccuucuacuucgccaucaccgugaucaccaccaucggcuacgggcacgcggccccgggcacggacgccggcaaggccuucugcauguucuacgcgguccuggggaucccccucacccuggugauguuccagagccugggcgagcgcaugaacaccuucgugcgguaccuccugaagcgcaucaagaagugcugcgggaugcggaacaccgacgucuccauggagaacauggugacggugggcuucuucagcugcauggggacccugugcaucggcgccgccgccuucucccagugcgaggaguggagcuucuuccacgccuacuacuacugcuucaucacccucaccacgaucggcuucggggacuacgucgcgcugcagaccaagggcgcccugcagaagaagccccucuacguggccuucuccuucauguacauccugguggggcugaccgucaucggcgccuuccucaaccugguggugcugcgcuuccucaccaugaacagcgaggacgagcggcgcgacgccgaggagcgggcgucccuggccggcaaccgcaacagcauggucauccacauccccgaggagccgcggcccucccgcccccgguacaaggccgacgugcccgaccugcagagcgugugcuccugcacgugcuaccgcagccaggacuacgggggccgguccgucgccccgcagaacagcuucagcgccaagcucgcgccccacuacuuccacuccaucagcuacaagaucgaggagaucucccccagcacccugaagaacucccuguuccccagcccgaucuccagcaucucccccgggcuccacagcuucaccgaccaccagcgccugaugaagcggcgcaaguccguguga

SEQ ID NO: 31883 - RNA, 3711 nt, Artificial Sequence
  derived and/or modified sequence opt1 from KCNMA1__Homo_sapiens__NP_001154824
auggccaacggcgggggcgggggcgggggcagcuccggcgggggcgggggcgggggcggcagcucccugcgcaugagcuccaacauccacgccaaccaccucagccuggacgcguccagcuccagcuccagcuccagcuccagcuccagcuccagcagcuccagcuccagcuccagcuccgugcacgagcccaagauggacgcccugaucaucccggucaccauggaggugcccugcgacagccgggggcagcgcauguggugggccuuccucgccuccagcauggugaccuucuucggcgggcuguucaucauccugcucuggcggacgcugaaguaccuguggaccgucugcugccacugcggcggcaagaccaaggaggcccagaagaucaacaacggguccagccaggcggacggcacccucaagcccguggacgagaaggaggaggccguggccgccgaggucggguggaugacguccgugaaggacugggcgggcgugaugaucagcgcccagacccugaccgggcgcguccugguggugcucgucuucgcccuguccaucggcgcccuggugaucuacuucaucgacagcuccaaccccaucgagagcugccagaacuucuacaaggacuucacccuccagaucgacauggccuucaacguguucuuccugcuguacuucggccuccgguucaucgcggccaacgacaagcugugguucuggcuggaggucaacuccgugguggacuucuucacggucccgcccguguucgugagcgucuaccucaaccgcagcuggcuggggcugcgguuccuccgcgcccugcggcugauccaguucuccgagauccuccaguuccugaacauccugaagaccagcaacuccaucaagcucgugaaccugcugagcaucuucaucuccaccuggcucaccgccgccggcuucauccaccugguggagaacagcggggaccccugggagaacuuccagaacaaccaggcgcugacguacugggagugcgucuaccuccugauggugaccauguccaccgucggcuacggggacguguacgccaagaccacgcugggccgccucuucaugguguucuucauccugggcgggcuggccauguucgccagcuacguccccgagaucaucgagcucaucggcaaccggaagaaguacgggggcuccuacagcgccguguccgggcgcaagcacaucguggucugcggccacaucacccuggagagcguguccaacuuccugaaggacuuccuccacaaggaccgggacgacgugaacgucgagaucguguuccugcacaacaucagcccgaaccuggagcucgaggcgcuguucaagcgccacuucacccagguggaguucuaccagggcuccguccugaacccccacgaccuggcccgggugaagaucgagagcgccgacgccugccucauccuggccaacaaguacugcgcggaccccgacgccgaggacgccuccaacaucaugcgcgugaucagcaucaagaacuaccaccccaagauccggaucaucacccagaugcugcaguaccacaacaaggcccaccuccugaacaucccgagcuggaacuggaaggagggggacgacgcgaucugccuggccgagcucaagcugggcuucaucgcccaguccugccuggcccaggggcucagcacgaugcuggccaaccuguucuccaugcgcagcuucaucaagaucgaggaggacaccuggcagaaguacuaccucgagggcgucuccaacgagauguacaccgaguaccugagcuccgcguucgugggccugagcuuccccaccgugugcgagcucugcuucgucaagcugaagcugcucaugaucgccaucgaguacaaguccgccaaccgggagagccgcauccugaucaaccccgggaaccaccugaagauccaggagggcacgcucggguucuucaucgccuccgacgccaaggaggugaagcgggcguucuucuacugcaaggccugccacgacgacaucaccgaccccaagcgcaucaagaagugcggcugcaagcgcccgaagaugagcaucuacaagcggaugcgccgggccugcugcuucgacugcgggcgcuccgagcgggacugcagcugcauguccggccgcgugcggggcaacgucgacacccuggagcgcgccuucccccugagcuccgugagcgugaacgacugcuccaccagcuuccgggccuucgaggacgagcagcccagcacgcucucccccaagaagaagcagcgcaacgggggcaugcggaacagcccgaacaccucccccaagcugaugcgccacgacccccugcucauccccgggaacgaccagaucgacaacauggacagcaacgucaagaaguacgacuccaccggcauguuccacuggugcgcgccgaaggagaucgagaaggugauccugacccggagcgaggccgccaugacggugcuguccgggcacgucguggugugcaucuucggcgacgucagcuccgcccucaucggccugcgcaaccuggugaugccccuccgggcgagcaacuuccacuaccacgagcugaagcacaucguguucgucggguccaucgaguaccugaagcgcgagugggagacccuccacaacuuccccaaggugagcauccugcccggcaccccgcugucccgggccgaccuccgcgccgugaacaucaaccugugcgacaugugcgucauccugagcgccaaccagaacaacaucgacgacaccucccuccaggacaaggagugcauccuggccagccugaacaucaaguccaugcaguucgacgacagcaucggggugcuccaggcgaacucccagggcuucacgccgcccgggauggaccggagcagccccgacaacucccccgugcacggcaugcugcgccagcccagcaucaccaccggcgucaacauccccaucaucaccgagcuggugaacgacaccaacgugcaguuccucgaccaggacgacgacgacgacccggacacggagcuguaccugacccagcccuucgccugcgggaccgccuucgccgucuccgugcucgacagccugauguccgccaccuacuucaacgacaacauccugacgcucauccgcacccuggugaccggcggggcgacccccgagcuggaggcccucaucgccgaggagaacgcccugcggggcggguacagcacgccccagacccuggccaaccgcgaccggugccgcgucgcgcagcucgcccugcuggacggcccguucgccgaccucggcgacgggggcugcuacggggaccuguucugcaaggcccugaagaccuacaacaugcucugcuucggcaucuaccggcugcgcgacgcgcaccuguccacccccagccagugcacgaagcgguacgugaucaccaacccgcccuacgaguucgagcucgugcccaccgaccugaucuucugccugaugcaguucgaccacaacgccggccagucccgcgccagccucucccacagcucccacagcucccagagcuccagcaagaaguccagcagcguccacuccauccccagcaccgccaaccggcagaaccgccccaagucccgggagagccgcgacaagcagaaguacgugcaggaggagcggcuguga

SEQ ID NO: 31884 - RNA, 576 nt, Artificial Sequence
  derived and/or modified sequence opt1 from KCNMB1__Homo_sapiens__NP_004128
auggugaagaagcuggugauggcccagaagcgcggcgagacccgggcccucugccugggggugaccaugguggucugcgcggugaucacguacuacauccuggugaccaccguccucccccuguaccagaaguccguguggacccaggagagcaagugccaccugaucgagacgaacauccgcgaccaggaggagcucaagggcaagaaggugccgcaguaccccugccugugggucaacgugagcgccgccgggcggugggccgugcuguaccacaccgaggacacccgcgaccagaaccagcagugcuccuacauccccggcagcgucgacaacuaccagaccgcccgggcggacguggagaaggugcgcgccaaguuccaggagcagcaggucuucuacugcuucuccgcgccccgggggaacgagacgagcgugcuguuccagcgccuguacggcccgcaggcccuccucuucucccuguucuggcccaccuuccugcucaccggcgggcugcugaucaucgccauggucaagagcaaccaguaccucuccauccuggccgcccagaaguga

SEQ ID NO: 31885 - RNA, 708 nt, Artificial Sequence
  derived and/or modified sequence opt1 from KCNMB2__Homo_sapiens__NP_001265840
auguucaucuggaccagcggccgcaccuccagcuccuaccggcacgacgagaagcgcaacaucuaccagaagauccgggaccacgaccugcucgacaagcgcaagacggugaccgcccugaaggccggggaggaccgggcgauccugcucggccuggccaugauggucugcagcaucaugauguacuuccugcucgggaucacccugcugcgcuccuacaugcagagcguguggaccgaggagucccagugcacgcuccugaacgccagcaucaccgagaccuucaacugcuccuucagcugcggccccgacugcuggaagcugucccaguaccccugccuccagguguacgucaaccugaccagcuccggggagaagcugcuccuguaccacacggaggagaccaucaagaucaaccagaagugcagcuacauccccaagugcggcaagaacuucgaggaguccaugagccuggugaacguggucauggagaacuuccggaaguaccagcacuucuccugcuacagcgaccccgagggcaaccagaaguccgugauccucaccaagcuguacagcagcaacgugcuguuccacucccucuucuggccgaccugcaugauggccgggggcgucgccaucguggcgauggugaagcugacgcaguaccugagccuccugugcgagcgcauccagcggaucaaccgcuga

SEQ ID NO: 31886 - RNA, 522 nt, Artificial Sequence
  derived and/or modified sequence opt1 from KCNMB3__Homo_sapiens__NP_001157149
augcagcccuucagcaucccggugcagaucacccugcagggcucccgccggcgccaggggcggaccgccuuccccgccagcggcaagaagcgcgagacggacuacuccgacggggacccccucgacguccacaagcggcugcccagcuccgcgggcgaggaccgcgccgugaugcugggguucgccaugaugggcuucagcgugcucauguucuuccugcugggcaccaccauccucaagccguucaugcuguccauccagcgggaggagagcacgugcaccgccauccacaccgacaucauggacgacuggcuggacugcgccuucacgugcgggguccacugccacggccaggggaaguaccccugccuccagguguucgugaaccugucccaccccggccagaaggcgcugcuccacuacaacgaggaggccguccagaucaaccccaagcgcgacgugaccgacugccgggugaaggagaagcagacccugaccgucagcgacgagcacaagcaguga

SEQ ID NO: 31887 - RNA, 633 nt, Artificial Sequence
  derived and/or modified sequence opt1 from KCNMB4__Homo_sapiens__NP_055320
auggccaagcugcgcguggccuacgaguacaccgaggcggaggacaagagcauccggcucggccuguuccugaucaucuccggggucgugagccucuucaucuucggcuucugcuggcugucccccgcccugcaggaccuccaggccaccgaggccaacugcacggugcugagcguccagcagaucggggagguguucgagugcaccuucacgugcggcgccgacugccgcgggaccucccaguacccgugcgugcaggucuacgugaacaacagcgaguccaacagccgggcgcugcuccacuccgacgagcaccagcugcugaccaaccccaagugcagcuacaucccgcccugcaagcgcgagaaccagaagaaccucgaguccgugaugaacuggcagcaguacuggaaggacgagaucggcagccagcccuucacgugcuacuucaaccagcaccagcggcccgacgacguccugcugcaccgcacccacgacgagaucgugcuccugcacugcuuccuguggccccucgugaccuucgucgugggcgugcugaucgucgugcugaccaucugcgccaagucccucgccgugaaggccgaggcgaugaagaagcggaaguucagcuga

SEQ ID NO: 31888 - RNA, 1632 nt, Artificial Sequence
  derived and/or modified sequence opt1 from KCNN1__Homo_sapiens__NP_002239
augaacagccacuccuacaacggcagcguggggcgcccccugggcuccgggccgggcgcccucgggcgggacccgcccgaccccgaggccggccacccgccccagccgccccacagccccggccugcaggucgugguggcgaaguccgagcccgcccgccccagccccggguccccgcggggccagccccaggaccaggacgacgacgaggacgacgaggaggacgaggccgggcgccagcgggccagcggcaagcccuccaacgucgggcaccgccugggccaccggcgcgcccucuucgagaagcggaagcgccugagcgacuacgcgcugaucuucggcauguucgggaucguggugauggucaccgagaccgagcucuccuggggcguguacacgaaggagagccuguacuccuucgcccugaagugccucaucagccuguccaccgccauccugcucgggcuggugguccuguaccacgcccgggagauccagcuguucaugguggacaacggcgcggacgacuggcgcaucgccaugaccugcgagcggguguuccucaucagccuggagcucgccgucugcgccauccaccccgugcccggccacuaccgcuucaccuggacggcccggcuggcguucaccuacgcccccuccguggccgaggccgacgucgacgugcugcucagcauccccauguuccugcgccuguaccuccuggggcgggugaugcugcuccacuccaagaucuucaccgacgccagcagccgcuccaucggcgcgcugaacaagaucaccuucaacacgcgguucgucaugaagacccugaugaccaucugccccgggaccgugcuccugguguucagcaucuccagcuggaucaucgccgccuggacgguccgcgugugcgagcgguaccacgacaagcaggaggugaccuccaacuuccugggcgccauguggcucaucagcaucaccuuccuguccaucggguacggcgacauggucccgcacaccuacugcggcaagggggugugccugcucacgggcaucaugggggccggcugcaccgcgcuggucguggccguggucgcccgcaagcuggagcucaccaaggccgagaagcacgugcacaacuucaugauggacacccagcugacgaagcgcgugaagaacgccgcggccaacguccugcgggagaccuggcucaucuacaagcacacccgccuggugaagaagcccgaccaggcccgggugcgcaagcaccagcggaaguuccugcaggccauccaccaggcgcagaagcuccgcagcgucaagaucgagcaggggaagcugaacgaccaggccaacacccugacggaccucgccaagacccagaccgugauguacgaccugguguccgagcugcacgcccagcacgaggagcuggaggcccggcucgcgacccuggagagccgccuggacgcccucggcgccucccugcaggcccugcccggccucaucgcccaggcgauccggcccccgcccccgccccugccgccccgccccgggcccggcccccaggaccaggccgcccggagcucccccugccgcuggacgcccgucgccccgagcgacugcggguga

SEQ ID NO: 31889 - RNA, 1740 nt, Artificial Sequence
  derived and/or modified sequence opt1 from KCNN2__Homo_sapiens__NP_067627
augagcuccugccgcuacaacggcggggugaugcggccccugagcaaccucuccgccagccgccggaaccugcacgagauggacuccgaggcccagccccugcagccgcccgcgagcgucggcgggggcgggggcgccuccagccccuccgccgccgccgcggccgccgccgcggugagcuccagcgcccccgagaucguggucuccaagcccgagcacaacaacagcaacaaccucgcccuguacggcaccgggggcgggggcuccaccgggggcggcgggggcgggggcggcagcgggcacggcuccagcuccgggaccaagagcagcaagaagaagaaccagaacaucggcuacaagcuggggcaccgccgggcccucuucgagaagcgcaagcggcuguccgacuacgcccugaucuucggcauguucggcaucguggugauggucaucgagacggagcucagcuggggcgcguacgacaaggccucccuguacagccuggcccucaagugccugaucucccugagcaccaucauccuccuggggcugaucaucguguaccacgcccgcgagauccagcuguucaugguggacaacggggccgacgacuggcggaucgcgaugaccuacgagcgcaucuucuucaucugccucgagauccuggucugcgccauccaccccauccccggcaacuacacguucaccuggaccgcccggcucgccuucuccuacgccccgagcaccacgaccgcggacguggacaucauccuguccauccccauguuccugcgccucuaccugaucgcccgggugaugcugcuccacagcaagcuguucaccgacgccuccagccgcuccaucggggcccugaacaagaucaacuucaacacccgguucgucaugaagacgcucaugaccaucugccccggcaccgugcugcugguguucagcaucucccucuggaucaucgccgcguggaccguccgcgccugcgagcgguaccacgaccagcaggacgugacgagcaacuuccugggcgccauguggcugaucuccaucaccuuccucagcaucggguacggcgacauggugcccaacaccuacugcgggaagggcgucugccugcugaccgggaucaugggcgccggcugcacggcgcucgugguggccgucguggcccgcaagcuggagcugaccaaggccgagaagcacgugcacaacuucaugauggacacccagcucaccaagcgggucaagaacgccgcggccaacgugcugcgcgagacguggcugaucuacaagaacaccaagcucgucaagaagaucgaccacgccaaggugcggaagcaccagcgcaaguuccugcaggccauccaccagcugcgcuccgugaagauggagcagcggaagcucaacgaccaggccaacacccuggucgaccuggcgaagacccagaacaucauguacgacaugaucagcgaccugaacgagcgcagcgaggacuucgagaagcggaucgugacgcucgagaccaagcuggagacccugaucggguccauccacgcccucccgggccugaucagccagaccauccgccagcagcagcgggacuucaucgaggcccagauggaguccuacgacaagcacgugacguacaacgccgagcgcagccgguccagcucccgccggcgccggagcuccagcaccgccccgcccaccuccagcgaguccagcuga

SEQ ID NO: 31890 - RNA, 2196 nt, Artificial Sequence
  derived and/or modified sequence opt1 from KCNN3__Homo_sapiens__NP_002240
auggacaccagcggccacuuccacgacuccggggugggcgaccuggacgaggaccccaagugcccgugccccagcuccggggacgagcagcagcagcagcagcagcagcagcagcagcagcagcccccgccgcccgccccgcccgccgcgccccagcagccccucggccccagccugcagccccagccgccccagcugcagcagcagcagcagcagcagcagcagcagcagcagcagcagccgccccacccccucucccagcuggcccagcugcagagccagcccguccaccccgggcuccugcacuccagccccaccgccuuccgcgccccgcccuccagcaacuccacggccauccugcaccccagcucccggcagggcagccagcucaaccugaacgaccaccuccucggccacucccccagcuccaccgcgaccagcgggccgggcgggggcucccgccaccggcaggccagcccccuggugcaccgccgggacagcaaccccuucaccgagaucgccauguccagcugcaaguacuccgggggcgugaugaagccccugagccgccucuccgccagccggcgcaaccugaucgaggcggagacggagggccagccgcugcagcuguucucccccagcaacccgcccgagaucgucaucuccagccgggaggacaaccacgcccaccagacccugcugcaccaccccaacgccacccacaaccaccagcacgccgggaccacggccuccagcaccaccuuccccaaggcgaacaagcgcaagaaccagaacaucggcuacaagcucgggcaccggcgcgcccuguucgagaagcggaagcgccuguccgacuacgcccucaucuucggcauguucggcaucguggugauggucaucgagaccgagcugagcugggggcuguacuccaaggacagcauguucucccucgcccugaagugccugaucagccucuccacgaucauccugcugggccucaucaucgccuaccacacccgggaggugcagcuguucgugaucgacaacggggcggacgacuggcgcaucgccaugaccuacgagcggauccuguacaucagccucgagaugcuggucugcgccauccaccccauccccggcgaguacaaguucuucuggaccgcccgccuggccuucagcuacacgcccucccgggcggaggccgacguggacaucauccucagcauccccauguuccugcgccuguaccucaucgcccgggugaugcugcugcacuccaagcuguucaccgacgccagcucccgcagcaucggggcccucaacaagaucaacuucaacacccgcuucgucaugaagacccugaugacgaucugccccggcaccgugcuccugguguucuccaucagccuguggaucaucgcggccuggaccguccgggugugcgagcgcuaccacgaccagcaggacgugaccuccaacuuccugggcgccauguggcucaucagcaucacguuccuguccaucggguacggcgacauggucccgcacaccuacugcgggaagggcgugugccugcucaccgggaucaugggcgccggcugcaccgcgcugguggucgccgugguggcccggaagcuggagcucacgaaggccgagaagcacguccacaacuucaugauggacacccagcugaccaagcgcaucaagaacgccgcggccaacgugcugcgggagaccuggcucaucuacaagcacacgaagcugcugaagaagaucgaccacgccaagguccgcaagcaccagcggaaguuccuccaggccauccaccagcugcgcagcgugaagauggagcagcggaagcuguccgaccaggccaacacccucguggaccugagcaagaugcagaacgucauguacgaccugaucaccgagcucaacgaccgcuccgaggaccuggagaagcagaucgggagccuggaguccaagcucgagcaccugaccgcgagcuucaacagccugccccuccugaucgccgacacgcugcggcagcagcagcagcagcuccuguccgccaucaucgaggcccgcggcgugagcguggccgucgggaccacccacacccccaucuccgacagccccaucggcguguccagcaccuccuucccgacgcccuacaccagcuccagcuccugcuga

SEQ ID NO: 31891 - RNA, 1284 nt, Artificial Sequence
  derived and/or modified sequence opt1 from KCNN4__Homo_sapiens__NP_002241
augggcggggaccuggugcucggccugggggcccugcgccggcgcaagcggcuccuggagcaggagaagucccuggccggcugggcgcucgugcuggccgggaccggcaucggccugauggugcuccacgccgagaugcugugguucgggggcugcagcugggcccuguaccucuuccuggugaagugcaccaucagcaucuccacguuccugcuccugugccugaucgucgccuuccacgcgaaggaggugcagcuguucaugaccgacaacgggcuccgcgacuggcggguggcccugaccggccgccaggccgcccagaucguccucgagcugguggugugcgggcugcaccccgcgccgguccggggcccgcccugcgugcaggaccucggcgcgccccugaccagcccccagcccuggcccggguuccugggccagggggaggcccuccugucccuggccaugcuccugcgccuguaccucgugccccgggccguccugcugcgcagcggcgugcuccugaacgccuccuaccggagcaucggcgcccugaaccaggugcgcuuccggcacugguucgucgccaagcucuacaugaacacgcacccggggcgccugcugcucggccugacccuggggcucuggcugaccaccgccugggugcuguccguggccgagcggcaggcggucaacgccacgggccaccucagcgacacccuguggcugauccccaucaccuuccugaccaucggguacggcgacguggugcccggcacgaugugggggaagaucgucugccucugcaccggcgugaugggggugugcugcaccgcccugcuggucgccguggucgcccgcaagcucgaguucaacaaggcggagaagcacgugcacaacuucaugauggacauccaguacaccaaggagaugaaggaguccgccgcccgggugcugcaggaggccuggauguucuacaagcacacgcgccggaaggagagccacgccgcgcgccggcaccagcgcaagcugcucgccgccaucaacgccuuccgccagguccggcugaagcaccgcaagcugcgggagcaggucaacuccaugguggacaucagcaagaugcacaugauccucuacgaccugcagcagaaccuguccagcucccaccgcgcgcucgagaagcagaucgacacccuggccggcaagcuggacgcccucaccgagcugcugagcaccgcccucgggccccggcagcugccggagcccucccagcagagcaaguga

SEQ ID NO: 31892 - RNA, 2031 nt, Artificial Sequence
  derived and/or modified sequence opt1 from KCNQ1__Homo_sapiens__NP_000209
auggccgccgcgagcuccccgccccgcgccgagcggaagcgcuggggcugggggcggcugcccggcgcccgccgggggagcgccggccucgccaagaagugccccuucucccuggagcuggcggagggcgggcccgccggcggggcccucuacgccccgaucgcgcccggcgcccccgggcccgccccgcccgccagccccgccgcgcccgccgccccgcccguggccuccgaccugggcccccggcccccggucagccuggacccccgcguguccaucuacagcacccgccggcccgugcucgcccgcacccacguccaggggcggguguacaacuuccuggagcgccccacgggcuggaagugcuucguguaccacuucgcggucuuccugaucgugcucgugugccugaucuucuccguccugagcaccaucgagcaguacgccgcccucgccaccggcacccuguucuggauggagaucgugcugguggucuucuucgggacggaguacguggugcggcucugguccgccggcugccgcagcaaguacgucgggcuguggggccggcugcgcuucgcgcggaagccgaucuccaucaucgaccucaucgugguggucgccagcaugguggugcugugcgucggcuccaagggccagguguucgccaccagcgccauccgcgggauccgguuccugcagauccuccgcaugcugcacguggaccggcagggcgggaccuggcgccugcucggguccgucguguucauccaccgccaggagcugaucaccacgcuguacaucggcuuccucggccugaucuucagcuccuacuucgucuaccuggccgagaaggacgcggugaacgagagcgggcggguggaguucggcagcuacgccgacgcccucugguggggcgucgugaccgugaccaccaucggguacggggacaaggucccccagacgugggugggcaagaccaucgccuccugcuucagcguguucgcgaucuccuucuucgcccugcccgccggcauccuggggagcggcuucgcccucaagguccagcagaagcagcgccagaagcacuucaaccggcagauccccgccgcggccucccugauccagaccgccuggcgcugcuacgccgccgagaacccggacagcuccaccuggaagaucuacauccggaaggcgccccgcagccacacgcugcucucccccagccccaagccgaagaaguccgugguggucaagaagaagaaguucaagcuggacaaggacaacggggugacccccggcgagaagaugcugaccgugccccacaucacgugcgacccgcccgaggagcggcgccucgaccacuucagcgucgacggguacgacuccagcgugcggaagucccccacccugcuggaggugagcaugccccacuucaugcgcaccaacuccuucgccgaggaccucgaccuggagggcgagacccugcucaccccgaucacgcacaucagccagcugcgggagcaccaccgcgccaccaucaaggucauccggcgcaugcaguacuucguggccaagaagaaguuccagcaggcccggaagcccuacgacgugcgcgacgucaucgagcaguacucccagggccaccugaaccucauggugcggaucaaggagcugcagcgccggcuggaccagagcaucgggaagcccagccuguucaucuccgugagcgagaaguccaaggaccgcggcagcaacaccaucggggcgcgccucaaccgggucgaggacaaggugacccagcuggaccagcgccuggcccucaucacggacaugcugcaccagcugcucucccugcacggcggcagcacccccggguccggcgggccgccccgggagggcggggcccacaucacccagcccugcggcagcggcggguccguggaccccgagcuguuccucccgagcaacacccugcccacguacgagcagcugaccgucccccgccggggccccgacgagggguccuga

SEQ ID NO: 31893 - RNA, 2535 nt, Artificial Sequence
  derived and/or modified sequence opt1 from KCNQ2__Homo_sapiens__NP_004509
auggugcagaagucccgcaacggcggggucuaccccggccccuccggggagaagaagcugaaggugggcuucguggggcucgaccccggcgcccccgacagcacccgggacggcgcccugcugaucgcgggguccgaggcccccaagcgcggcagcauccucuccaagccccgggccgggggcgccggggccggcaagccgcccaagcgcaacgcguucuaccggaagcugcagaacuuccuguacaacguccucgagcgcccccggggcugggccuucaucuaccacgccuacguguuccugcugguguucagcugccucguccuguccguguucagcaccaucaaggaguacgagaaguccagcgagggggcccuguacauccucgagaucgugacgaucgucguguucggcguggaguacuucguccgcaucugggcggccgggugcugcugccgguaccgcggcuggcggggccgccugaaguucgcccggaagcccuucugcgugaucgacaucauggugcugaucgccuccaucgccguccucgcggccgggagccagggcaacguguucgccaccuccgcccugcgcagccugcgguuccuccagauccugcgcaugauccggauggaccgccgcgggggcaccuggaagcugcucggguccguggucuacgcccacagcaaggagcuggugaccgcgugguacaucggcuuccugugccucauccuggccuccuuccugguguaccucgccgagaagggcgagaacgaccacuucgacacguacgccgacgcccuguggugggggcugaucacccucaccaccaucggcuacggggacaaguacccccagacguggaacggccggcugcuggcggccaccuucacccucaucggggucagcuucuucgcccugcccgccggcauccugggcagcggguucgcccucaaggugcaggagcagcaccggcagaagcacuucgagaagcgccgcaaccccgcggccggccugauccagagcgccuggcgguucuacgccaccaaccugagccgcacggaccuccacuccaccuggcaguacuacgagcggaccgugaccgucccgauguaccgccugaucccgccccugaaccagcucgagcugcugcggaaccucaagagcaaguccgggcuggcguuccgcaaggacccgccgcccgagcccagccccucccagaaggugagccugaaggaccgggucuucuccagcccccgcggcguggccgccaaggggaagggcagcccccaggcccagacggugcggcgcucccccuccgccgaccagagccucgaggacucccccagcaagguccccaaguccuggagcuucggcgaccggucccgcgcgcggcaggccuuccgcaucaagggggccgccagccggcagaacuccgaggaggccagccugcccggcgaggacaucguggacgacaagagcugccccugcgaguucgugaccgaggaccugacccccgggcugaaggucuccauccgcgcggugugcgugaugcgguuccucgucagcaagcgcaaguucaaggagucccugcggccguacgacgugauggacgugaucgagcaguacagcgccggccaccuggacaugcucucccgcaucaagagccugcagucccgcgucgaccagaucgugggccgggggcccgccaucaccgacaaggaccgcacgaagggccccgccgaggccgagcugccggaggaccccagcaugauggggcggcucggcaagguggagaagcagguccuguccauggagaagaagcuggacuuccucgugaacaucuacaugcagcgcauggggaucccgcccaccgagaccgaggcguacuucggcgccaaggagcccgagcccgccccgcccuaccacagccccgaggacucccgggagcacguggaccgccacggcugcaucgucaagaucgugcggagcuccagcuccaccgggcagaagaacuucagcgccccgcccgcggcgccgcccgugcagugcccgcccuccacgagcuggcagccccagagccacccccgccagggccacgggaccucccccgucggcgaccacgggagccuggugcggaucccgccgccgcccgcccacgagcgcucccugagcgccuacggcggcgggaaccgggccuccauggaguuccuccgccaggaggacacccccggcugccggccgcccgaggggaaccugcgcgacagcgacaccuccaucagcauccccuccguggaccacgaggagcuggagcggagcuucuccggcuucagcaucucccagagcaaggagaaccucgacgcccugaacuccugcuacgccgccgucgcccccugcgccaaggugcgccccuacaucgcggagggggagagcgacacggacuccgaccugugcacccccugcgggcccccgccccggagcgccaccggcgagggccccuucggcgacguggggugggccggcccccgcaaguga

SEQ ID NO: 31894 - RNA, 2259 nt, Artificial Sequence
  derived and/or modified sequence opt1 from KCNQ3__Homo_sapiens__NP_001191753
augaagcccgccgagcacgccaccauguuccugaucgugcucggcugccugauccuggcgguccucaccacguucaaggaguacgagaccgugagcggggacuggcugcugcuccuggagaccuucgccaucuucaucuucggcgccgaguucgcccugcgcaucugggccgcggggugcugcugccgguacaagggcuggcgcgggcggcucaaguucgcccgcaagccgcugugcaugcuggacaucuucgugcucaucgccuccguccccgugguggccgucggcaaccagggcaacgugcuggcgaccagccugcggucccuccgcuuccugcagauccugcggaugcuccgcauggaccggcgcgggggcacguggaagcugcuggggagcgccaucugcgcccacuccaaggagcucaucaccgccugguacaucggcuuccugacccugauccucagcuccuuccugguguaccuggucgagaaggacgugcccgagguggacgcccagggggaggagaugaaggaggaguucgagaccuacgcggacgcccucugguggggccugaucacgcuggccaccaucggcuacggggacaagacccccaagaccugggagggccggcucaucgccgccacguucagccugaucggggucuccuucuucgcgcugccggccggcauccucggcagcgggcuggcccugaaggugcaggagcagcaccgccagaagcacuucgagaagcggcgcaagcccgccgccgagcucauccaggcggccuggcgguacuacgccaccaaccccaaccgcaucgaccugguggccaccuggcgguucuacgaguccgucgugagcuuccccuucuuccgcaaggagcagcuggaggccgcguccagccagaagcucggccugcuggaccgggugcgccucuccaacccgcgggggagcaacaccaagggcaagcuguucacgccccugaacgucgacgccaucgaggagucccccagcaaggagcccaagccgguggggcucaacaacaaggagcgcuuccgcaccgccuuccggaugaaggccuacgcguucuggcaguccagcgaggacgccggcaccggcgaccccauggccgaggaccgcggguacggcaacgacuuccccaucgaggacaugauccccacccugaaggccgccauccgggcggugcgcauccugcaguuccggcucuacaagaagaaguucaaggagacgcugcgcccguacgacgucaaggacgugaucgagcaguacagcgccgggcaccuggacaugcugucccggaucaaguaccuccagacccgcaucgacaugaucuucacccccggcccgcccagcacccccaagcacaagaagucccagaaggggagcgccuucacguuccccucccagcagagcccccggaacgagcccuacguggcccgcccguccaccagcgagaucgaggaccaguccaugaugggcaaguucgucaagguggagcggcagguccaggacaugggcaagaagcuggacuuccugguggacaugcacaugcagcacauggagcgccuccaggugcaggucaccgaguacuaccccaccaaggggacgagcucccccgccgaggcggagaagaaggaggacaaccgguacagcgaccugaagaccaucaucugcaacuacuccgagaccgggcccccggagccgcccuacagcuuccaccaggugaccaucgacaaggugucccccuacggcuucuucgcccacgaccccgucaaccugccccgcggcgggcccagcuccggcaaggugcaggccacgccgcccagcuccgccaccaccuacguggagcggcccaccguccuccccauccugacgcugcucgacagccgcgugagcugccacucccaggccgaccugcagggcccguacagcgaccggaucagcccccgccagcggcgcuccaucacccgcgacuccgacacgccccugagccucauguccgugaaccacgaggagcuggagcggagccccuccggguucagcaucucccaggaccgcgacgacuacgucuucggcccgaacgggggcagcuccuggaugcgggagaagcgcuaccuggcggagggcgagaccgacaccgacaccgaccccuucacccccagcggguccaugccccucagcuccaccggcgacgggaucagcgacagcguguggaccccguccaacaagcccaucuga

SEQ ID NO: 31895 - RNA, 2772 nt, Artificial Sequence
  derived and/or modified sequence opt1 from KCNQ5__Homo_sapiens__NP_001153602
augccccgccaccacgccggcggggaggagggcggggccgcgggccugugggucaagagcggggccgccgccgccgcggccggcggcgggcggcucggcuccgggaugaaggacguggagagcggccgcgggcgggugcugcugaacuccgccgccgcgcgcggcgacggccuccugcugcucgggacccgggccgccacccugggcgggggcggcgggggccugcgcgagagccggcgcgggaagcagggcgcccggaugucccuccuggggaagccgcugagcuacacguccagccaguccugccgccggaacgugaaguaccgccggguccagaacuaccucuacaacgugcuggagcgcccccggggcugggccuucaucuaccacgcguucguguuccugcucgucuucggcugccugauccugagcguguucuccaccauccccgagcacaccaagcucgccagcuccugccugcugauccucgaguucgugaugaucgucguguucgggcuggaguucaucauccgcaucuggagcgccggcugcugcugccgguaccgcggguggcagggccggcugcgcuucgcccggaagcccuucugcgugaucgacaccaucguccucaucgccuccaucgcgguggugagcgccaagacgcaggggaacaucuucgccaccuccgcccugcgcagccugcgcuuccuccagauccugcggaugguccgcauggaccggcgcggcggcaccuggaagcugcucggguccgugguguacgcccacagcaaggagcugaucaccgcgugguacaucggcuuccugguccucaucuucagcuccuuccugguguaccugguggagaaggacgccaacaaggaguucagcacguacgccgacgcccucuggugggggaccaucacccugaccacgaucggcuacggggacaagaccccgcugaccuggcucggccggcugcuguccgccggcuucgcgcuccuggggaucagcuucuucgcccugcccgccggcauccucggguccggcuucgcccugaagguccaggagcagcaccgccagaagcacuucgagaagcggcgcaaccccgcggccaaccugauccagugcguguggcggagcuacgccgccgacgagaaguccgugagcaucgccaccuggaagccccaccucaaggcgcugcacacgugcuccccgaccaaccagaagcugagcuucaaggagcgcguccggauggccagcccccgcggccagagcaucaagucccggcaggccagcgugggggaccgccggucccccagcaccgacaucaccgccgagggcucccccacgaagguccagaaguccugguccuucaacgaccgcacccgguuccgcccgagccugcggcucaagagcucccagcccaagcccgugaucgacgccgacaccgcgcuggggaccgacgacguguacgacgagaagggcugccagugcgacgucagcguggaggaccugacgcccccgcucaagaccgugauccgcgccauccgcaucaugaaguuccacgucgccaagcggaaguucaaggagacccugcgccccuacgacgugaaggacgugaucgagcaguacuccgccgggcaccuggacaugcucugccggaucaagagccugcagacccgcgucgaccagauccugggcaagggccagaucacguccgacaagaagucccgggagaagaucaccgccgagcacgagaccaccgacgaccucagcaugcuggggcgcguggugaaggucgagaagcagguccagagcaucgaguccaagcuggacugccuccuggacaucuaccagcagguccugcggaagggcagcgcguccgcccucgcccuggccagcuuccagaucccgcccuucgagugcgagcagacguccgacuaccagagccccguggacuccaaggaccugagcggguccgcgcagaacagcggcugccucagccgcuccaccagcgccaacaucucccgggggcugcaguucauccugacccccaacgaguucagcgcccagaccuucuacgcccucucccccacgaugcacagccaggccacccaggugcccaucucccagagcgacggcuccgcgguggccgccaccaacaccaucgccaaccagaucaacaccgccccgaagcccgcggcccccacgacccugcagaucccgccgccccugcccgccaucaagcaccucccccgccccgagacccugcaccccaaccccgccggccugcaggagagcaucuccgacgugaccacgugccucguggccagcaaggagaacgugcaggucgcgcaguccaaccugaccaaggaccggagcaugcgcaaguccuucgacaugggcggggagacccugcucagcgugugcccgauggugcccaaggaccuggggaagucccugagcguccagaaccucauccgguccaccgaggagcugaacauccagcugagcggcagcgaguccagcgggucccgcggcagccaggacuucuaccccaaguggcgggaguccaagcuguucaucacggacgaggaggugggccccgaggagaccgagaccgacaccuucgacgccgccccgcagcccgcccgcgaggcggccuucgccagcgacucccuccggacggggcgcagccgguccagccaguccaucugcaaggccggcgagagcaccgacgcccugucccucccccacgugaagcugaaguga

SEQ ID NO: 31896 - RNA, 819 nt, Artificial Sequence
  derived and/or modified sequence opt1 from KCNRG__Homo_sapiens__NP_775876
augagcucccaggagcuggugacccucaacgucggcgggaagaucuucaccacgcgcuucagcaccaucaagcaguuccccgccucccggcuggcccgcaugcuggacggccgggaccaggaguucaagauggucgggggccagaucuucguggaccgcgacggggaccucuucagcuucauccuggacuuccugcggacccaccagcuccugcugccgaccgaguucuccgacuaccuccgccugcagcgggaggcgcuguucuacgagcuccgcagccugguggaccugcucaaccccuaccugcugcagccccggcccgcccucguggaggugcacuuccugucccgcaacacgcaggccuucuuccgggucuucggcagcugcuccaagaccaucgagaugcugaccggccgcaucaccguguucacggagcagccgagcgcccccaccuggaacgggaacuucuucccgccccagaugacccuccugccccugccgccccagcggcccuccuaccacgaccucguguuccagugcggcagcgacuccaccacggacaaccagaccgggguccgcuacgugagcaucaagcccgacaaccggaagcuggccaacggcaccaacgugcuggggcuccugaucgacacccugcucaaggagggcuuccaccuggucuccacgcgcaccgugagcuccgaggacaagaccgagugcuacagcuucgagcggaucaagucccccgaggugcugaucaccaacgagacgcccaagcccgagaccaucaucaucccggagcagagccagaucaagaaguga

SEQ ID NO: 31897 - RNA, 1581 nt, Artificial Sequence
  derived and/or modified sequence opt1 from KCNS1__Homo_sapiens__XP_005260466
augcugaugcuccuggugcgcggcacccacuacgagaaccugcggagcaaggucgugcuccccacgccccucgggggccgcuccaccgagaccuucgugagcgaguuccccgggcccgacaccggcauccgguggcgccgguccgacgaggcccugcgcgucaacgucgggggcgugcggcgccagcugagcgcccgggcgcuggcccgcuuccccggcacccggcuggggcgccuccaggccgccgccuccgaggagcaggcgcggcgccugugcgacgacuacgacgaggccgcccgggaguucuacuucgaccgccacccgggcuucuuccugagccuccugcacuucuaccggacggggcaccuccacgugcuggacgagcugugcguguucgccuucggccaggaggcggacuacugggggcugggcgagaacgcccucgccgccugcugccgcgcccgguaccuggagcgccggcugacccagccccacgcgugggacgaggacuccgacacccccagcuccguggaccccugcccggacgagaucagcgacguccagcgcgagcucgcccgcuacggcgccgcccggugcgggcgccugcggcgccggcuguggcucaccauggagaaccccggcuacucccugcccagcaagcuguucuccugcgugagcaucuccgugguccucgccagcaucgcggccaugugcauccacucccugcccgaguaccaggcccgcgaggccgccgcggccguggccgccguggccgcggggcggagcccggagggcguccgcgacgaccccgugcugcggcgccucgaguacuucugcaucgccugguucuccuucgaggugagcagccggcugcugcucgcccccuccacgcgcaacuucuucugccacccccugaaccugaucgacaucgucagcgugcucccguucuaccugacccugcucgccggcguggcgcugggggaccagggcgggaaggaguucggccaccuggggaaggucguccagguguuccggcucaugcgcaucuuccgggugcugaagcuggcccgccacuccaccggccuccggagccugggcgccacccugaagcacuccuaccgcgagguggggauccuccugcuguaccuggccgucggcgugagcguguucuccggggucgccuacacggcggagaaggaggaggacgugggcuucaacaccauccccgccugcugguggugggggaccgugagcaugaccacggucggcuacggcgacguggugcccgucaccguggccgggaagcucgccgccuccggcugcauccucgggggcauccugguggucgcgcugcccaucaccaucaucuucaacaaguucagccacuucuaccggcgccagaaggcccuggaggccgccgugcgcaacuccaaccaccaggaguucgaggaccugcucagcuccaucgacggggugagcgaggccucccuggagaccagccgggagacgucccaggagggccagagcgcggaccuggagucccaggccccgagcgagccgccccacccccagauguacuga

SEQ ID NO: 31898 - RNA, 1476 nt, Artificial Sequence
  derived and/or modified sequence opt1 from KCNS3__Homo_sapiens__XP_011531127
augguguucggcgaguucuuccaccgccccgggcaggacgaggagcuggucaaccucaacgugggcggguucaagcagagcguggaccaguccacccugcugcgguucccgcacacccgccucggcaagcugcugacgugccacagcgaggaggccauccucgagcugugcgacgacuacuccgucgccgacaaggaguacuacuucgaccggaaccccagccuguuccgcuacgugcucaacuucuacuacaccgggaagcugcacgugauggaggagcugugcgucuucuccuucugccaggagaucgaguacuggggcaucaacgagcuguucaucgacagcugcugcuccaaccgguaccaggagcgcaaggaggagaaccacgagaaggacugggaccagaagucccacgacgugagcaccgacagcuccuucgaggagagcucccuguucgagaaggagcuggagaaguucgacacccuccgguucggccagcugcgcaagaagaucuggauccggauggagaaccccgcguacugccugagcgccaagcucaucgccaucuccagccuguccgugguccuggccagcaucguggccaugugcgugcacuccaugagcgaguuccagaacgaggacggggaggucgacgaccccgugcucgagggcguggagaucgcgugcaucgccugguucacgggggagcuggccguccgccuggccgcggccccgugccagaagaaguucuggaagaacccccucaacaucaucgacuucgugagcaucauccccuucuacgccacccuggccguggacaccaaggaggaggaguccgaggacaucgagaacaugggcaaggucgugcagauccugcggcucaugcgcaucuuccggauccugaagcuggcccgccacagcguggggcuccggucccugggcgcgacccugcgccacagcuaccacgaggucggccuccugcuccucuuccuguccguggggaucagcaucuucuccgugcugaucuacagcgucgagaaggacgaccacacguccagccucaccuccauccccaucugcugguggugggccaccaucagcaugaccacggugggcuacggggacacccacccggucacccuggccggcaagcugaucgccuccacgugcaucaucugcggcauccucgugguggcccugcccaucaccaucaucuucaacaaguucagcaaguacuaccagaagcagaaggacaucgacgucgaccagugcuccgaggacgcgcccgagaagugccacgagcugcccuacuucaacauccgggacaucuacgcccagcgcaugcacaccuucaucaccagccucuccagcguggggaucguggucuccgacccggacagcaccgacgccagcuccaucgaggacaacgaggacaucugcaacacgaccagccuggagaacugcaccgccaaguga

SEQ ID NO: 31899 - RNA, 3708 nt, Artificial Sequence
  derived and/or modified sequence opt1 from KCNT1__Homo_sapiens__NP_065873
augccccugccggacggcgcccgcacccccgggggcgugugccgggaggcccgcgggggcggguacaccaaccggacguucgaguucgacgacggccagugcgcgccccgccggcccugcgccggcgacggggcccuccuggacaccgccggcuucaagaugagcgaccuggacuccgagguccucccgcugccgccccgcuaccgguuccgcgaccugcuccugggggaccccagcuuccagaacgacgaccggguccagguggaguucuacgugaacgagaacaccuucaaggagcgccugaagcuguucuucaucaagaaccagcgguccagccugcgcauccggcuguucaacuucucccucaagcugcugaccugccuccuguacaucgugcgcgugcugcucgacgaccccgcccugggcaucgggugcuggggcugccccaagcagaacuacagcuucaacgacuccagcuccgagaucaacugggcgcccauccugugggucgagcggaagaugacgcucugggccauccaggugaucguggccaucaucagcuuccuggagaccaugcugcucaucuaccuguccuacaagggcaacaucugggagcagaucuuccgcgucagcuucgugcuggagaugaucaacacccuccccuucaucaucaccaucuucuggccgccccugcggaaccuguucauccccguguuccucaacugcuggcuggccaagcacgcgcuggagaacaugaucaacgacuuccaccgcgccauccuccggacgcaguccgccauguucaaccagguccugauccuguucugcacccuccugugccugguguucaccgggaccugcggcauccagcaccucgagcgcgccggggagaaccugagccugcucacguccuucuacuucugcaucgugaccuucagcaccgucggcuacggcgacgugacccccaagaucuggccgucccagcugcugguggucaucaugaucugcguggcccucgugguccugccccugcaguucgaggagcucguguaccuguggauggagcggcagaaguccgggggcaacuacagccgccaccgcgcgcagacggagaagcacgugguccugugcgugagcagccugaagaucgaccuccugauggacuuccugaacgaguucuacgcccacccccggcuccaggacuacuacgucgugauccugugccccaccgagauggacgugcagguccgccgggugcugcagaucccgcucuggucccagcgcgugaucuaccugcaggggagcgcccugaaggaccaggaccucaugcgggccaagauggacaacggcgaggccugcuucauccuguccagccgcaacgaggucgaccggaccgcggccgaccaccagaccauccugcgcgccugggccgugaaggacuucgcccccaacugcccccucuacgugcagauccugaagcccgagaacaaguuccacgucaaguucgcggaccacguggugugcgaggaggagugcaaguacgccaugcuggcccucaacugcaucugcccggccacguccacccugaucacccugcucguccacaccagccgggggcaggagggccaggagucccccgagcaguggcagcgcauguacggccggugcagcgggaacgagguguaccacauccgcaugggcgacuccaaguucuuccgggaguacgagggcaagagcuucacguacgccgcguuccacgcccacaagaaguacggggugugccugaucgggcugaagcgcgaggacaacaaguccauccuccugaaccccggcccccggcacauccuggccgccagcgacacgugcuucuacaucaacaucaccaaggaggagaacuccgcguucaucuucaagcaggaggagaagcgcaagaagcgggccuucagcggccaggggcuccacgagggcccggcccgccugcccguccacuccaucaucgccagcauggggaccguggccauggaccugcagggcaccgagcaccggcccacccaguccgggggcggcgggggcgggagcaagcucgcgcugccgaccgagaacggcuccggcagccgccgccccagcaucgcccccgugcuggagcucgccgacuccagcgcccugcugcccugcgaccuccuguccgaccagagcgaggacgaggucaccccguccgacgacgaggggcugagcgugguggaguacgucaagggcuacccgcccaacucccccuacaucgggagcucccccacgcucugccaccuccugcccgugaaggcccccuucugcugccuccggcuggacaagggcugcaagcacaacagcuacgaggacgcgaaggccuacggguucaagaacaagcugaucaucguguccgccgagaccgccggcaacggccucuacaacuucaucgucccccugcgcgccuacuaccggagccgcaaggagcugaacccgaucgugcuccugcuggacaacaagcccgaccaccacuuccucgaggcgaucugcugcuuccccaugguguacuacauggagggguccgucgacaaccuggacagccugcuccagugcggcaucaucuacgccgacaaccuggugguggucgacaaggaguccaccaugagcgccgaggaggacuacauggccgacgcgaagaccaucgugaacgugcagacgauguuccggcuguuccccucccucagcaucaccaccgagcugacccacccgagcaacaugcgcuucaugcaguuccgggccaaggacuccuacagccuggcccucuccaagcuggagaagcgcgagcgggagaacgggagcaaccuggccuucauguuccgccuccccuucgccgcgggccgggucuucuccaucagcaugcuggacacccugcucuaccaguccuucgugaaggacuacaugaucacgaucacccgccugcugcucgggcuggacaccacccccggcagcggcuaccugugcgccaugaagaucacggagggggaccucuggauccggaccuacggccgccuguuccagaagcugugcuccagcuccgccgagauccccaucgggaucuaccggaccgagagccacguguucuccaccagcgagccgcacgaccuccgcgcccagucccagaucagcgucaacguggaggacugcgaggacacgcgggaggugaagggccccugggggucccgcgccggcaccggcgggagcucccagggccggcacaccgggggcggggaccccgcggagcacccccugcugcgccgcaagagccuccagugggcccggcgccugagccggaaggccccgaagcaggccggccgcgccgcggccgccgaguggaucucccagcagcggcugagccucuaccgccgguccgagcgccaggagcugagcgagcuggucaagaaccggaugaagcaccucggccugcccaccacgggguacgacgagaugaacgaccaccagaacacccuguccuacgugcucaucaacccgccgcccgacacccgccuggagcccagcgacaucguguaccugauccgguccgacccccucgcccacgucgcgagcuccagccagucccgcaagagcuccugcagccacaagcuguccagcugcaaccccgagacccgggacgagacgcagcuguga

SEQ ID NO: 31900 - RNA, 3336 nt, Artificial Sequence
  derived and/or modified sequence opt1 from KCNT2__Homo_sapiens__NP_001274748
augguggaccuggagagcgaggugcccccgcucccgccccgcuaccgguuccgcgaccugcugcucggcgaccagggguggcagaacgacgaccggguccagguggaguucuacaugaacgagaacaccuucaaggagcgccugaagcuguucuucaucaagaaccagcgguccagccuccgcauccggcuguucaacuucucccugaagcuccugagcugccugcucuacaucauccgcguccugcuggagaaccccucccagggcaacgaguggagccacaucuucugggugaaccggucccucccccugugggggcuccaggugagcgucgcccugaucucccuguucgagaccauccugcucggcuaccugagcuacaaggggaacaucugggagcagauccugcgcauccccuucauccucgagaucaucaacgccgugcccuucaucaucuccaucuucuggcccagccugcggaaccuguucgugccggucuuccucaacugcuggcuggcgaagcacgcccuggagaacaugaucaacgaccuccaccgcgccauccagcggacgcaguccgccauguucaaccaggugcugauccugaucagcacccuccugugccugaucuucacgugcaucugcggcauccagcaccucgagcgcaucggcaagaagcugaaccuguucgacucccucuacuucugcaucgugaccuucagcaccgucggguucggcgacgugacccccgagaccugguccagcaagcuguucguggucgccaugaucugcguggcgcuggugguccuccccauccaguucgagcagcuggccuaccuguggauggagcggcagaaguccgggggcaacuacagccgccaccgggcccagaccgagaagcacguggugcucugcgucagcucccugaagaucgaccugcucauggacuuccugaacgaguucuacgcccacccccgccugcaggacuacuacguggugauccugugcccgacggagauggacguccaggugcggcgcguccuccagauccccauguggagccagcgggugaucuaccugcagggguccgcgcugaaggaccaggaccuccugcgcgccaagauggacgacgccgaggccugcuucauccugagcucccgcugcgagguggaccggaccagcuccgaccaccagaccauccuccgcgccugggcggucaaggacuucgcccccaacugcccccuguacgugcagauccugaagccggagaacaaguuccacaucaaguucgccgaccacguggucugcgaggaggaguucaaguacgccaugcucgcccugaacugcaucugccccgcgaccagcacgcugaucacccuccuggugcacaccucccggggccaggagggccagcagagccccgagcaguggcagaagauguacgggcgcugcuccggcaacgagguguaccacaucguccuggaggagagcaccuucuucgccgaguacgaggggaaguccuucacguacgccagcuuccacgcccacaagaaguucggcgugugccucaucggcgugcggcgcgaggacaacaagaacauccugcugaaccccgggccgcgguacaucaugaacuccaccgacaucugcuucuacaucaacaucaccaaggaggagaacagcgccuucaagaaccaggaccagcagcgcaaguccaacgucagccgguccuucuaccacggccccagccgccuccccgugcacagcaucaucgcguccauggggaccguggccaucgaccugcaggacacgagcugccgguccgccagcggccccacccugucccucccgaccgaggggagcaaggagauccgccggcccuccaucgcccccguccuggagguggccgacaccagcuccauccagacgugcgaccugcucagcgaccaguccgaggacgagaccacccccgacgaggagaugagcuccaaccuggaguacgcgaagggcuacccgcccuacagccccuacaucggcuccagcccgaccuucugccaccuccugcacgagaaggugcccuucugcugccugcgccuggacaaguccugccagcacaacuacuacgaggacgccaaggccuacggguucaagaacaagcucaucaucgucgccgcggagacggccggcaacgggcuguacaacuucaucgugccccugcgggccuacuaccgccccaagaaggagcucaacccgaucgugcugcugcucgacaacccccuggacgaccugcuccggugcggcgucaccuucgccgccaacauggugguggucgacaaggagagcaccaugagcgcggaggaggacuacauggccgacgccaagaccaucgugaacgugcagacgcuguuccgccuguucuccagccucuccaucaucaccgagcugacccaccccgccaacaugcgguucaugcaguuccgcgccaaggacugcuacagccuggcgcucuccaagcuggagaagaaggagcgcgagcgggggagcaaccuggccuucauguuccgccuccccuucgccgccggccgggucuucuccaucagcaugcuggacacccugcucuaccaguccuucgugaaggacuacaugaucagcaucacgcgccugcugcucggccuggacaccaccccgggguccggcuuccugugcagcaugaagaucaccgccgacgaccucuggauccggaccuacgcgcgccuguaccagaagcugugcuccagcacgggggacgugcccaucggcaucuaccggaccgagucccagaagcucaccaccagcgagucccagaucagcaucuccgucgaggagugggaggacacgaaggacagcaaggagcaggggcaccaccgcagcaaccaccggaacuccaccagcuccgaccagagcgaccacccccugcugcgccggaaguccaugcagugggcccgccggcucagccgcaagggccccaagcacuccggcaagaccgccgagaagaucacccagcagcggcugaaccuguaccgccggagcgagcgccaggagcucgccgagcuggugaagaaccggaugaagcaccuggggcucuccacggugggcuacgacgagaugaacgaccaccagagcacccuguccuacauccugaucaacccgagccccgacacccgcaucgagcucaacgacgucguguaccugauccggcccgacccccuggcguaccucccgaacuccgagcccagccgccgcaacuccaucugcaacgugaccgggcaggacagccgggaggagacgcagcuguga

SEQ ID NO: 31901 - RNA, 3450 nt, Artificial Sequence
  derived and/or modified sequence opt1 from KCNU1__Homo_sapiens__NP_001027006
auguuccagaccaagcugcgcaacgagaccugggaggaccuccccaagaugagcugcacgaccgagauccaggccgccuucauccuguccagcuucgugaccuucuucuccggccugaucauccuccugaucuuccggcugaucuggcgcagcgucaagaaguggcagaucaucaaggggaccggcaucauccucgagcuguucacguccgggaccaucgcgcggagccacgugcgcucccugcacuuccagggccaguuccgggaccacaucgagaugcuccugagcgcccagaccuucguggggcagguccuggugauccucguguucguccuguccaucggcagccugaucaucuacuucaucaacuccgccgacccggugggcagcugcuccagcuacgaggacaagaccauccccaucgaccucguguucaacgccuucuucuccuucuacuucgggcugcgcuucauggccgcggacgacaagaucaaguucuggcuggagaugaacagcaucgucgacaucuucacgaucccgcccaccuucaucuccuacuaccucaagagcaacuggcugggccugcgguuccuccgcgcccugcggcugcucgagcugccccagauccugcagauccuccgcgccaucaagaccuccaacagcgugaaguucagcaagcugcuguccaucauccucagcaccugguucacggccgcgggguucauccaccugguggagaacuccggcgaccccuggcugaaggggcggaacagccagaacaucuccuacuucgagagcaucuaccucgucauggccaccaccuccaccgugggcuucggcgacguggucgccaagacgagccuggggcgcaccuucaucauguucuucacccugggcucccucauccuguucgccaacuacauccccgagaugguggagcuguucgccaacaagcggaaguacaccagcuccuacgaggcgcucaaggggaagaaguucaucguggucugcggcaacaucacgguggacagcgugaccgccuuccugcgcaacuuccugcgggacaaguccggcgagaucaacaccgagaucgucuuccucggggagacgcccccgagccuggagcuggagaccaucuucaagugcuaccucgccuacaccaccuucaucuccggcagcgccaugaagugggaggaccugcgccggguggccguggaguccgcggaggccugccugaucaucgccaacccccucugcagcgacucccacgccgaggacaucagcaacaucaugcgcguccugagcaucaagaacuacgacuccaccacgcggaucaucauccagauccugcagagccacaacaagguguaccugcccaagauccccuccuggaacugggacaccggggacaacaucaucugcuucgccgagcucaagcugggcuucaucgcgcaggggugccuggucccgggccucugcaccuuccugaccagccuguucguggagcagaacaagaaggugaugcccaagcagacguggaagaagcacuuccucaacuccaugaagaacaagauccugacccagcgccugagcgacgacuucgccggcauguccuuccccgaggucgcccggcucugcuuccugaagaugcaccuccugcugaucgccaucgaguacaagagccuguucaccgacggguucugcggccucauccugaacccgccgccccaggugcgcauccgcaagaacacccugggguucuucaucgccgagacgcccaaggacgugcggcgcgcccucuucuacugcuccgucugccacgacgacguguucauccccgagcugaucaccaacugcggcugcaagagccggucccgccagcacaucaccgugcccagcgucaagcggaugaagaagugccugaaggggaucuccagccgcaucuccggccaggacagcccgccccggguguccgcgagcaccagcuccaucagcaacuucaccacgcgcacccuccagcacgacguggagcaggacuccgaccagcuggacagcuccggcauguuccacuggugcaagcccaccagccuggacaaggucacccucaagcggacggggaaguccaaguacaaguuccgcaaccacaucguggccugcguguucggcgacgcccacagcgcgcccauggggcugcggaacuucgucaugccccugcgcgccuccaacuacacccggaaggagcucaaggacaucguguucaucggcagccuggacuaccugcagcgcgaguggcgguuccucuggaacuucccccagaucuacauccugcccgggugcgcccuguacuccggcgaccuccacgccgccaacaucgagcagugcagcaugugcgcggugcuguccccgccgccccagcccagcuccaaccagacccuggucgacaccgaggccaucauggccacgcucaccaucggcagccugcagaucgacuccagcuccgaccccagccccagcguguccgaggagacccccggguacaccaacggccacaacgagaaguccaacugccgcaaggugccgauccugacggagcucaagaaccccagcaacauccacuucaucgagcagcucgggggccuggagggcagccugcaggagaccaaccugcaccuguccaccgccuucagcaccgggacggucuucuccggcagcuuccucgacucccugcuggccaccgcguucuacaacuaccacgugcucgagcugcugcagaugcucgugaccgggggcgucagcucccagcuggagcagcaccuggacaaggacaagguguacgggguggccgacagcugcaccucccuccugagcggccggaaccgcugcaagcugggccuccugucccugcacgagacgauccucagcgacgucaacccccggaacaccuucgggcagcuguucugcggcucccuggaccucuucgggauccugugcgugggccuguaccgcaucaucgacgaggaggagcucaaccccgagaacaagcgcuucgugaucacccggccggccaacgaguucaagcugcugcccagcgaccucgucuucugcgccauccccuucuccaccgccugcuacaagcgcaacgaggaguucagccugcagaaguccuacgagaucgugaacaaggcgagccagacgaccgagacccacagcgacaccaacugcccgcccacgaucgacuccgugaccgagacccuguacagccccgucuacuccuaccagccccggaccaacagccucuccuuccccaagcagaucgccuggaaccagagccgcacgaacuccaucaucagcucccagaucccgcugggggacaacgccaaggagaacgagcggaagaccagcgacgagguguacgacgaggaccccuucgccuacuccgagccccuguga

SEQ ID NO: 31902 - RNA, 1503 nt, Artificial Sequence
  derived and/or modified sequence opt1 from KCNV1__Homo_sapiens__NP_055194
augcccagcuccggccgcgcccugcucgacagcccgcuggacuccgggagccugaccucccucgacagcuccguguucugcagcgagggcgagggggagccccuggcccugggcgacugcuucaccgucaacgucgggggcucccgguucgugcucagccagcaggcgcuguccugcuucccccacacgcgccugggcaagcucgccguggugguggccagcuaccggcgccccggggcccuggccgcggucccgagcccccuggagcucugcgacgacgccaaccccguggacaacgaguacuucuucgaccgguccucccaggccuuccgcuacgugcugcacuacuaccggaccggccgccugcacgucauggagcagcucugcgcccugagcuuccugcaggagauccaguacugggggaucgacgagcucuccaucgacagcugcugccgggaccgcuacuuccggcgcaaggagcuguccgagacccuggacuucaagaaggacaccgaggaccaggagagccagcacgagagcgagcaggacuucucccagggccccugcccgacggugcggcagaagcucuggaacauccuggagaagcccgggagcuccaccgcggcccgcaucuucggcgugaucagcaucaucuucgucgugguguccaucaucaacauggcccugaugagcgccgagcucuccuggcuggaccugcagcuccuggagauccuggaguacgucugcaucagcugguucaccggcgaguucgugcuccgguuccugugcgugcgcgaccggugccgcuuccugcggaagguccccaacaucaucgaccuccuggccauccugcccuucuacaucacccuccugguggagucccugagcgggucccagacgacccaggagcucgagaacgugggccgcaucguccaggugcugcggcugcuccgcgcgcugcgcaugcugaagcucgggcggcacagcaccggccugcgcucccugggcaugaccaucacgcagugcuacgaggagguggggcuccugcugcuguuccucagcgucggcaucuccaucuucagcaccguggaguacuucgccgagcaguccaucccggacaccaccuucacgagcguccccugcgccugguggugggccaccaccuccaugaccacggugggguacggcgacauccggcccgacaccaccaccgggaagaucguggccuucaugugcauccugagcggcauccugguccucgcgcugcccaucgccaucaucaacgaccgcuucagcgccugcuacuucacgcugaagcucaaggaggccgccgugcggcagcgcgaggcgcugaagaagcugaccaagaacaucgccaccgacuccuacaucagcgugaaccuccgggacgucuacgcccgcuccaucauggagaugcugcggcugaagggccgcgagcgggccagcacccgcuccagcgggggcgacgacuucugguucuga

SEQ ID NO: 31903 - RNA, 1638 nt, Artificial Sequence
  derived and/or modified sequence opt1 from KCNV2__Homo_sapiens__NP_598004
augcugaagcagagcgagcgccggcgcuccuggagcuaccggcccuggaacaccaccgagaacgagggcucccagcaccgccggagcaucugcucccucggggcccgcagcggcucccaggccagcauccacggguggaccgagggcaacuacaacuacuacaucgaggaggacgaggacggggaggaggaggaccaguggaaggacgaccuggcggaggaggaccagcaggccggcgaggugaccaccgccaagccggagggccccuccgacccgcccgcccugcucagcacccugaacgucaacgucgggggccacuccuaccagcuggacuacugcgagcucgccggguuccccaagacgcggcugggccgccuggcgaccagcaccucccggagccgccagcucucccugugcgacgacuacgaggagcagaccgacgaguacuucuucgaccgggaccccgccguguuccagcugguguacaacuucuaccucagcggggugcugcuggugcucgacggccugugcccccgccgguuccuggaggagcucggcuacuggggcguccgccugaaguacacgccccggugcugccgcaucugcuucgaggagcggcgcgacgagcuguccgagcggcucaagauccagcacgagcugcgcgcccaggcccagguggaggaggcggaggagcuguuccgggacaugcgcuucuacgggccgcagcgccggcgccucuggaaccugauggagaagcccuucagcuccguggccgccaaggccaucggggucgccagcagcaccuucgugcugguguccgucguggcgcucgcccugaacaccguggaggagaugcagcagcacagcggccagggcgagggcgggcccgaccugcggcccauccucgagcacgucgagaugcugugcaugggguucuucacccuggaguaccuccugcgccuggccuccacgccggaccuccggcgcuucgcccggagcgcccugaaccugguggaccucguggcgauccugccccuguaccuccagcugcugcucgagugcuucaccggcgaggggcaccagcgcggccagaccgucggcuccguggggaaggugggccagguccugcgggugaugcgccugaugcggaucuuccgcauccucaagcuggcccggcacagcaccgggcugcgcgccuucggcuucacgcugcggcagugcuaccagcaggucgggugccuccugcuguucaucgccaugggcaucuucaccuucuccgccgcgguguacagcguggagcacgacguccccuccaccaacuucaccacgaucccccacagcugguggugggccgccguguccaucagcaccgugggcuacggggacauguacccggagacccaccucggccgcuucuucgccuuccugugcaucgccuucgggaucauccugaacggcaugcccaucuccauccucuacaacaaguucagcgacuacuacuccaagcugaaggcguacgaguacaccacgauccggcgcgagcgcggggaggucaacuucaugcagcgggcccgcaagaagaucgccgagugccugcucggcagcaacccccagcugacgccccggcaggagaacuga

SEQ ID NO: 31904 - RNA, 942 nt, Artificial Sequence
  derived and/or modified sequence opt1 from KCTD10__Homo_sapiens__NP_114160
auggaggagaugagcggcgaguccguggucagcuccgccgugcccgccgcggccacccgcaccacgagcuucaaggggaccuccccgagcuccaaguacgugaagcugaacgucggcggggcccucuacuacaccaccaugcagacgcugaccaagcaggacaccaugcugaaggccauguucagcggccggauggaggugcucaccgacuccgagggguggauccugaucgaccgcugcggcaagcacuucggcacgauccugaacuaccuccgggacggggccgugccccugcccgagagccgccgggagaucgaggagcugcucgcggaggccaaguacuaccugguccagggccugguggaggagugccaggccgcccuccagaacaaggacaccuacgagcccuucugcaaggugccggucaucaccuccagcaaggaggagcagaagcugaucgcgaccuccaacaagcccgccgugaagcugcucuacaaccgcagcaacaacaaguacuccuacacgagcaacuccgacgacaacaugcugaagaacaucgagcuguucgacaagcucagccugcgguucaacgggcgcgugcuguucaucaaggacgucaucggcgacgagaucugcugcugguccuucuacgggcagggccggaagaucgccgaggugugcugcaccagcaucguguacgccaccgagaagaagcagaccaaggucgaguuccccgaggcccgcaucuacgaggagacgcucaacauccugcuguacgaggcgcaggacggccgggggcccgacaacgcccuccuggaggccaccggcggggccgccggccgcagccaccaccuggacgaggacgaggagcgggagcgcaucgagcgggugcgccggauccacaucaagcgcccggacgaccgggcgcaccuccaccaguga

SEQ ID NO: 31905 - RNA, 699 nt, Artificial Sequence
  derived and/or modified sequence opt1 from KCTD11__Homo_sapiens__NP_001002914
augcugggcgccauguuccgcgccgggacccccaugccgcccaaccucaacagccagggcgggggccacuacuucaucgaccgggacgggaaggccuuccgccacauccugaacuuccugcggcucggccgccuggaccugccccggggcuacggggagaccgcccuccugcgcgccgaggccgacuucuaccagauccggccccugcucgacgcccugcgcgagcuggaggcgucccagggcacgccggcccccaccgccgcccuccugcacgcggacguggacgucagcccccggcuggugcacuucuccgcccgccgggggccccaccacuacgagcucagcuccgugcaggucgacaccuuccgcgccaaccuguucugcaccgacagcgagugccugggcgcccuccgggcccgcuucgggguggcguccggcgaccgggccgagggcagcccgcacuuccaccuggagugggcgccccgccccguggagcugcccgaggucgaguacgggcggcucggccugcagccgcuguggaccgggggccccggcgagcgccgggaggugguggggacgcccuccuuccucgaggagguccugcgcguggcccuggagcacggcuuccggcucgacagcguguuccccgacccggaggaccugcugaacucccgcagccuccgcuucguccggcacuga

SEQ ID NO: 31906 - RNA, 978 nt, Artificial Sequence
  derived and/or modified sequence opt1 from KCTD12__Homo_sapiens__NP_612453
auggcccuggccgacagcacccgcggccuccccaacgggggcgggggcgggggcggcuccgggagcuccagcuccagcgcggagccgccccuguuccccgacaucguggagcugaacgucggcggccagguguacgugacccggcgcugcacggucguguccgugcccgacagccuccuguggcggauguucacccagcagcagccccaggagcuggcccgcgacuccaagggccgguucuuccucgaccgcgacggguuccuguuccgguacauccuggacuaccuccgcgaccugcagcugguccuccccgacuacuuccccgagcggagccgccugcagcgggaggccgaguacuucgagcugcccgagcucgugcgccggcugggcgccccgcagcagcccggccccgggcccccgcccucccgccggggcgugcacaaggaggggagccugggcgacgagcuccugccccugggcuacuccgagcccgagcagcaggagggggccagcgcgggcgccccgucccccacccucgagcuggccagccgcucccccagcgggggcgccgcggggccccugcucaccccgucccagagccuggacggcagccggcgcuccggcuacaucacgaucggguaccggggcagcuacaccaucgggcgcgacgcccaggccgacgccaaguuccggcgcgucgcccgcaucaccgugugcggcaagaccucccuggcgaaggagguguucggggacacgcucaacgagagccgggaccccgaccgcccgcccgagcgguacaccucccgcuacuaccugaaguucaacuuccuggagcaggccuucgacaagcucagcgaguccggcuuccacauggucgccugcagcuccaccgggaccugcgccuucgccagcuccacggaccagagcgaggacaagaucuggaccuccuacaccgaguacguguucugccgggaguga

SEQ ID NO: 31907 - RNA, 990 nt, Artificial Sequence
  derived and/or modified sequence opt1 from KCTD13__Homo_sapiens__NP_849194
augagcgccgaggccuccggccccgcggccgccgccgccccgagccuggaggcgcccaagcccuccgggcucgagcccggcccggccgccuacgggcugaagccccugacccccaacagcaaguacgugaagcucaacgucggcgggucccugcacuacaccacgcugcgcacccucaccggccaggacaccaugcugaaggccauguucagcggccggguggaggugcugacggacgccgggggcuggguccucaucgaccgcuccgggcggcacuucggcaccauccugaacuaccugcgcgacgggagcgugccccucccggaguccacccgggagcugggcgagcugcucggcgaggcgcgcuacuaccuggugcaggggcugaucgaggacugccagcucgcccugcagcagaagcgggagacccugagcccccucugccugauccccauggucacgagcccccgcgaggagcagcagcugcucgccuccaccuccaagccgguggugaagcugcugcacaaccggagcaacaacaaguacuccuacaccagcaccuccgacgacaaccuccugaagaacaucgagcuguucgacaagcucgcccugcgcuuccacggccggcuccuguuccugaaggacguccugggggacgagaucugcugcuggagcuucuacggccagggccgcaagaucgcggaggugugcugcacguccaucguguacgccaccgagaagaagcagaccaaggucgaguuccccgaggcccggaucuucgaggagacccucaacauccugaucuacgagacgccccgcgggcccgacccggcccugcucgaggccaccggcggggcggccggcgccgggggcgccggccgcggggaggacgaggagaaccgggagcaccgggugcgccggauccacgugcgccggcacaucacccacgacgagcgcccccacggccagcagaucgucuucaaggacuga

SEQ ID NO: 31908 - RNA, 705 nt, Artificial Sequence
  derived and/or modified sequence opt1 from KCTD15__Homo_sapiens__NP_076981
augccccaccgcaaggagcggccgagcggcuccagccugcacacccacggguccaccggcacggccgagggcgggaacaugagccgccucucccugacccggagccccgugagcccccuggccgcgcaggggaucccccucccggcccagcugaccaaguccaacgcccccguccacaucgacgugggcggccacauguacaccuccagccuggccacgcucaccaaguaccccgacucccgcaucagccggcuguucaacgggaccgagcccaucgugcuggacucccucaagcagcacuacuucaucgaccgcgacggcgagaucuuccgguacguccugagcuuccugcgcaccuccaagcuccugcugccggacgacuucaaggacuucagccuccuguacgaggaggcccgguacuaccagcugcagcccauggugcgcgagcucgagcgguggcagcaggagcaggagcagcgccggcgcucccgggcgugcgacugccuggugguccgcgugacgcccgaccugggggagcggaucgcccucagcggcgagaaggcccugaucgaggagguguuccccgagaccggggacgucaugugcaacuccgugaacgccggcuggaaccaggacccgacccacgugauccgcuucccccugaacggcuacugccggcucaacagcguccaggacgugcuguga

SEQ ID NO: 31909 - RNA, 1287 nt, Artificial Sequence
  derived and/or modified sequence opt1 from KCTD16__Homo_sapiens__XP_005268550
auggcccugagcggcaacugcucccgcuacuacccccgggagcaggggagcgccgugccgaacuccuuccccgaggucguggagcucaacgugggcgggcaggucuacuucacccgccacagcacccugaucuccaucccccacagccugcucuggaagauguucucccccaagcgggacacggcgaacgaccuggccaaggacagcaagggccgcuucuucaucgaccgggacggguuccuguuccgcuacauccucgacuaccugcgggaccgccagguggugcugccggaccacuuccccgagaagggccggcucaagcgcgaggccgaguacuuccagcugcccgaccuggucaagcuccugacccccgacgagaucaagcaguccccggacgaguucugccacagcgacuucgaggacgccucccagggcagcgacacccggaucugcccgcccuccagccugcuccccgccgaccgcaaguggggguucaucaccgugggcuaccggggguccugcacgcugggccgcgaggggcaggcggacgccaaguuccggcgcgugccccggauccuggucugcggccgcaucagccucgccaaggagguguucggcgagacccugaacgagucccgggaccccgaccgcgcccccgagcgguacaccagccgcuucuaccugaaguucaagcaccucgagcgcgcguucgacaugcuguccgagugcggguuccacaugguggccugcaacagcagcgucaccgccuccuucaucaaccaguacacggacgacaagaucuggagcuccuacaccgaguacguguucuaccgggagcccagccgcugguccccgagccacugcgacugcugcugcaagaacggcaagggggacaaggagggcgaguccggcaccagcugcaacgaccuguccaccagcuccugcgacagccaguccgaggccagcagcccccaggagacggugaucugcgggcccgucacccggcagaccaacauccagacccucgaccgccccaucaagaagggcccggugcagcugauccagcaguccgagaugcggcgcaaguccgaccugcuccggacgcugaccagcgggucccgcgagagcaacaugagcuccaagaagaaggccgugaaggagaagcugagcaucgaggaggagcucgagaagugcauccaggacuuccugaagaucaagauccccgaccgguuccccgagcgcaagcaccccuggcaguccgagcugcuccggaaguaccaccuguga

SEQ ID NO: 31910 - RNA, 2598 nt, Artificial Sequence
  derived and/or modified sequence opt1 from KCTD1__Homo_sapiens__NP_001136202
auggcccgcaugcccggcagcggggacugcaacaccuccgccggcgggagcgcguccgccgccgccgccgcggccgagaacaacggcgagcgcggggagggcgagcggggcgccgggggccgggggcgccggcacagccgcccgcacuacugcuccgccggcgaggaggaggaggaggaggaggaggaggacgagauccaggaggugcagaucaccggggacgaggaggaggaggaggacggcggcgggggccuggaggaggacgaggaggaggaggaggaggaggagauggggcucgacugggacgagccccuggagcccgaggacagcgcgggcgaggagcuggagcccgagccgguccacaugaucaacauggaccaguccgccgcccucgagcccgaggccccgccccggcugcuggcgccccgcgcccggggcgggccgcccggcgacgggagcgagcucgaccccgacgugcugcagcgccccgagcgggcccgccuguccgagaacacgcggcucgccacccgcuacgccgugcggaucuuccgcgaguaccugagcgagaaggcccagucccccgacuucgagaccauggacaagggcgcgcugugccggguccuccgcagcuucuacgccgaggcccgguccaagagcgggcagcuguacuccaagagcucccugaucagcauccgcuccagccucaaccgguaccugaacgagccgcccuacugccgcacccuggaccucacgaaggaccccgagcugcgcagcgccaaccugacccucgccgcggugauccggaagcuggaggagcagggcgccggccccgugguccagaagcaggccaucacccgcgccgaccugcggaagcucuacaccuccagcguguucuccacgaacacccccuucgggcugcugaacaaggugugguucgagaccugcauguacuucugcacccgcggccgggagaaccagcgcgagcucgaggaggacagcuucgggcuggccauggacgaggacggccggaaguucgucuacuucaagucccuggggcccuaccacaagagccgcuccagcuccuggagcaagaagcgggcggaguccagcgacgaggagaaccucccgcgcauguacgagacgggcaccgaguucugccccuacgccuccuucgugaaguaccugagcaagcggaacccccugugcaaggccuucuuccagcgcccccgggaccacugcuccgagggcgacgugaccugguacgagaacaaggccaucgggaagaaccuccugggcacccgcaugcagaugcugagcaaggcggccaagcucuccaagacguacaccaaccacugcaucggggccgucagcaucgccacccugaacuccaucgccggcaucgggaccaagcugggcagcccggcgccccagggcugcuacgccgaggcccucaacggggccgcccggcaccacagccaccacccgcccacgcaccccucccaccaccaccgcccccagcccccgagccugggcaacaccuacauccugcccaaggacucccagguggggcccgacgucaagagcgaggcggcccccaagcgggcccucuacgaguccguguucggcagcggcgagaucugcgggccgaccucccccaagcgccugugcauccggcccagcgagcccguggacgccguggucgugguguccgucaagcacgacccgcugccccuccugcccgaggccaacggccaccgcagcaccaacucccccacgaucgugagcccggcgaucgugucccccacccaggacagccgccccaacaugucccggccccugaucacccgcagcccggccagcccccucaacaaccaggggauccccacccccgcccagcugaccaaguccaacgccccgguccacaucgacgugggcgggcacauguacaccagcucccuggcgacccugaccaaguaccccgagagccggaucggccgccucuucgacggcacggagcccaucguccuggacucccugaagcagcacuacuucaucgaccgggacgggcagauguuccgcuacauccucaacuuccugcggaccagcaagcugcucauccccgacgacuucaaggacuacacccugcuguacgaggaggccaaguacuuccagcuccagccgaugcugcuggagauggagcgcuggaagcaggaccgggagaccggccgcuucucccggcccugcgagugccucguggugcgcgucgcccccgaccugggggagcggaucacgcugagcggcgacaagucccucaucgaggagguguucccggagaucggggacgugaugugcaacagcgucaacgccggcuggaaccacgacuccacccacgugauccgcuucccccugaacggcuacugccaccugaacagcgugcagguccucgagcggcugcagcagcgcggguucgagaucgugggcuccugcgggggcgggguggacagcucccaguucagcgaguacguccugcggcgcgagcuccggcgcacgccccgggugcccuccgugauccgcaucaagcaggagccgcuggacuga

SEQ ID NO: 31911 - RNA, 990 nt, Artificial Sequence
  derived and/or modified sequence opt1 from KCTD21__Homo_sapiens__XP_005273982
auggaguucgcccuggacgcccccagcugcgaggagccgcgcgagaacuaccagucccggaaggcggcccaccgcccccggaccgccacgccccucggcugggcccccacccugcgcccgccccggaaggccgcgcuggccgcccgcgggggccgggggugccgcgcccgggcgggcgggcuccugcccgccacccagagccccgccauguccgacccgaucacccugaacgugggcggcaagcucuacaccacgagccuggccacccugaccuccuuccccgacagcaugcucggggccauguucuccggcaagaugcccaccaagcgcgacagccaggggaacugcuucaucgaccgggacggcaaggucuuccgcuacauccugaacuuccugcggacgucccaccucgaccugcccgaggacuuccaggagauggggcugcuccgccgggaggcggacuucuaccaggugcagccgcugaucgaggcccugcaggagaaggagguggagcucagcaaggccgagaagaacgccaugcugaacaucacccugaaccagcgcguccagaccgugcacuucaccgugcgggaggcgccccagaucuacucccucagcuccagcuccauggaggucuucaacgccaacaucuucagcacguccugccuguuccugaagcuccugggcagcaagcuguucuacugcuccaacggcaaccucagcagcaucaccucccaccuccaggaccccaaccaccugacccuggacuggguggccaacguggaggggcugcccgaggaggaguacaccaagcagaaccugaagcgccucugggucgugccggccaacaagcagaucaacagcuuccagguguucgucgaggaggugcugaagaucgcccuguccgacggcuucugcaucgacagcucccacccccacgcccucgacuucaugaacaacaagaucauccggcugauccgcuaccgguga

SEQ ID NO: 31912 - RNA, 792 nt, Artificial Sequence
  derived and/or modified sequence opt1 from KCTD2__Homo_sapiens__NP_056168
auggccgagcugcagcucgaccccgccauggcgggccugggcggcgggggcgggagcggcgugggcgacgggggcgggccgguccgcggcccgcccagcccccggcccgccgggcccacgccccgcggccacggccggcccgccgccgccguggcgcagccgcuggagcccgggcccgggcccccggagcgcgccgggggcggcggggccgcccggugggugcgccucaacgucggcgggaccuacuucgugaccacccggcagacccugggccgcgagcccaaguccuuccugugccggcucugcugccaggaggaccccgagcuggacuccgacaaggacgagaccggggcguaccugaucgaccgcgaccccacguacuucggcccgauccucaacuaccugcggcacggcaagcugaucaucaccaaggagcucgccgaggagggggugcuggaggaggccgaguucuacaacaucgccagccugguccgccucgugaaggagcggauccgcgacaacgagaaccggaccucccagggccccgugaagcacgucuaccgcgugcugcagugccaggaggaggagcugacccagauggugagcacgauguccgacggguggaaguucgagcagcucaucagcaucggcuccagcuacaacuacgggaacgaggaccaggccgaguuccugugcgucgugucccgggagcugaacaacagcaccaacggcaucgugaucgagcccuccgagaaggcgaagauccuccaggagcgcggcagccggauguga

SEQ ID NO: 31913 - RNA, 2448 nt, Artificial Sequence
  derived and/or modified sequence opt1 from KCTD3__Homo_sapiens__NP_057205
auggccggcgggcacugcggcagcuuccccgccgcggccgccggguccggcgagaucgugcagcugaacgucgggggcacccgcuucagcaccucccggcagacgcucauguggaucccggacagcuucuucuccagccugcuguccggccgcaucagcacccuccgggacgagaccggggccaucuucaucgaccgcgaccccgccgcguucgcccccauccugaacuuccugcggaccaaggagcucgaccugcgcggcguguccaucaacgugcugcggcacgaggccgaguucuacgggaucacgccccucguccgccggcugcugcucugcgaggagcuggagcgcagcuccugcggcagcgugcuguuccacggguaccucccgccgcccggcauccccucccggaagaucaacaacaccgugcgcagcgccgacucccggaacggccugaacagcaccgagggggaggcgcgcggcaacgggacccagcccguccuguccggcacgggcgaggagaccgugcggcucggguuccccguggacccccgcaagguccugaucguggccggccaccacaacuggaucguggccgccuacgcccacuucgcggucugcuaccggaucaaggagagcuccggguggcagcaggucuucaccagccccuaccuggacuggaccaucgagcgcguggcccucaacgccaagguggugggcgggccgcacggcgacaaggacaagaugguggccgucgccagcgaguccagcaucauccugugguccgugcaggacggcgggagcggcuccgagaucgggguguucagccugggcguccccguggacgcgcuguucuucaucgggaaccagcugguggccacgucccacaccggcaaggucggcguguggaacgccgucacccagcacuggcagguccaggacguggugcccaucaccagcuacgacacggccggguccuuccugcuccugggcugcaacaacgggagcaucuacuacaucgacaugcagaaguucccccugcggaugaaggacaacgaccuccuggugaccgagcuguaccacgacccguccaacgacgccaucaccgcgcucagcguguaccugacccccaagacguccgucagcggcaacuggaucgagaucgccuacgggaccuccagcggcgccgugcgcgugaucguccagcaccccgagaccgugggcuccgggccccagcuguuccagaccuucacggugcaccggagcccggucaccaagaucaugcucuccgagaagcaccuggugagcgugugcgccgacaacaaccacguccgcaccuggaccgugacgcgcuuccggggcaugaucagcacccagcccggguccacgccccuggccagcuucaagauccucucccuggaggagaccgagagccacggcuccuacagcuccggcaacgacaucgggcccuucggcgagcgcgacgaccagcaggucuucauccagaagguggugccgaucaccaacaagcuguucgugcggcucagcuccaccgggaagcgcaucugcgagauccaggcggucgacugcaccaccaucagcuccuucacggugcgggagugcgagggcagcucccgcauggggagccggccccgccgguaccuguucaccggccacaccaacggcuccauccagaugugggaccugaccaccgccauggacauggugaacaagagcgaggacaaggacgucgggggccccacggaggaggagcuccugaagcugcucgaccagugcgaccuguccaccagccgcugcgccacccccaacaucagcccggccaccuccguggugcagcacagccaccuccgggaguccaacagcucccugcagcuccagcaccacgacacgacccacgaggcggccaccuacgggagcaugcgccccuaccgggagagcccccugcuggcccgcgcccggcgcaccgaguccuuccacuccuaccgggacuuccagacgaucaaccucaaccgcaacgucgagcgggccgugccggagaacggcaaccuggggcccauccaggcggaggugaagggcgccaccggcgagugcaacaucagcgagcgcaagucccccggggucgagaucaagagccugcgcgagcucgacuccggccuggaggugcacaagaucgccgagggguucagcgaguccaagaagcggagcuccgaggacgagaacgagaacaagaucgaguuccgcaagaagggcggguucgagggcggcggguuccugggccggaagaaggugcccuaccucgccagcuccccgagcaccagcgacgggggcaccgacucccccgggacggccagccccucccccaccaagaccaccccgagcccccgccacaagaaguccgacagcuccggccaggaguacagccuguga

SEQ ID NO: 31914 - RNA, 714 nt, Artificial Sequence
  derived and/or modified sequence opt1 from KCTD6__Homo_sapiens__NP_699162
auggacaacggcgacuggggguacaugaugaccgaccccgugacccugaacgucggcgggcaccucuacacgaccagccugaccacccugacgcgcuacccggacuccaugcucggcgccauguucgggggcgacuuccccaccgcccgggacccccagggcaacuacuucaucgaccgcgacgggccccuguuccgguacgugcugaacuuccuccgcaccagcgagcugacccugccgcucgacuucaaggaguucgaccugcugcggaaggaggcggacuucuaccagaucgagccccucauccagugccugaacgaccccaagccccuguacccgauggacacguucgaggagguggucgagcucuccagcacccgcaagcuguccaaguacagcaaccccguggccgugaucaucacccagcugaccaucacgaccaagguccacucccuccuggagggcaucagcaacuacuucaccaaguggaacaagcacaugauggacacccgggacugccagguguccuucacguucgggcccugcgacuaccaccaggaggugagccugcgcguccaccucauggaguacaucaccaagcagggcuucaccauccggaacacccgcgugcaccacauguccgagcgggccaacgagaacacgguggagcacaacuggaccuucugccgccuggcccggaagaccgacgacuga

SEQ ID NO: 31915 - RNA, 867 nt, Artificial Sequence
  derived and/or modified sequence opt1 from KCTD7__Homo_sapiens__NP_001161433
augguggucgugaccggccgcgagcccgacagccggcgccaggacggggccauguccagcuccgacgccgaggacgacuuccuggagccggcgacccccacggccacccaggccggccacgcccucccccugcugccccaggaguucccggagguggucccccucaacaucgggggcgcccacuucaccacccggcugagcacgcugcgcugcuacgaggacaccaugcucgcggccauguucuccgggcggcacuacauccccaccgacagcgagggccgcuacuucaucgaccgggacggcacccacuucggggacgugcugaacuuccugcgcuccggcgaccugcccccgcgggagcgcgugcgggccgucuacaaggaggcccaguacuacgcgaucgggccccuccuggagcagcucgagaacaugcagccccugaagggcgagaaggugcgccaggccuuccuggggcucaugcccuacuacaaggaccaccuggagcggaucguggagaucgcccgccugcgggccguccagcgcaaggcccgguucgcgaagcucaaggugugcguguucaaggaggagaugccgaucacgcccuacgagugcccccugcugaacagccuccgcuucgagcgguccgagagcgacggccagcuguucgagcaccacugcgaggucgacguguccuucggccccugggaggccguggccgacgucuacgaccugcuccacugccuggugaccgaccugagcgcccaggggcucaccguggaccaccagugcaucggcgucugcgacaagcaccuggugaaccacuacuacugcaagcgcccgaucuacgaguucaagaucaccugguga

SEQ ID NO: 31916 - RNA, 1170 nt, Artificial Sequence
  derived and/or modified sequence opt1 from KCTD9__Homo_sapiens__NP_060104
augcgccgggugacccuguuccucaacggcagccccaagaacgggaaggucguggccguguacggcacccuguccgaccugcucagcgucgccuccagcaagcuggggaucaaggcgacguccguguacaacggcaagggcgggcugaucgacgacaucgcccucauccgcgacgacgacgugcuguucgucugcgagggcgagccguucaucgacccccagaccgacagcaagccgcccgaggggcugcucggcuuccacaccgacuggcugacccugaacgucgggggccgguacuucacgaccacccgcuccacccucgugaacaaggagcccgacagcaugcuggcccacauguucaaggacaaggggguguggggcaacaagcaggaccaccggggcgccuuccugaucgaccgcucccccgaguacuucgagcccauccucaacuaccugcggcacgggcagcugaucgugaacgacggcaucaaccuccugggggugcuggaggaggcccgcuucuucggcaucgacagccucaucgagcaccuggaggucgcgaucaagaacucccagcccccggaggaccacagccccaucucccggaaggaguucgugcgcuuccugcucgccacgcccaccaagagcgagcugcggugccagggccugaacuucuccggggccgaccucagccgccuggaccugcgguacaucaacuucaagauggccaaccucucccgcugcaaccuggcgcacgccaaccugugcugcgccaaccucgagcgggccgaccugagcggcuccgugcuggacugcgccaaccuccagggggucaagaugcugugcagcaacgcggagggcgccagccugaagcucugcaacuucgaggaccccuccgggcugaaggccaaccuggagggcgccaaccucaagggcguggacauggaggggagccagaugaccggcaucaaccugcgcguggccacccugaagaacgcgaagcucaagaacugcaaccugcgcggggccacgcuggccggcaccgaccucgagaacugcgaccuguccgggugcgaccugcaggaggccaaccugcggggcagcaacgucaagggcgccaucuucgaggagaugcucaccccgcugcacaugucccagagcgugcgguga

SEQ ID NO: 31917 - RNA, 1509 nt, Artificial Sequence
  derived and/or modified sequence opt1 from KDELC1__Homo_sapiens__NP_076994
auguucggcacccugcuccuguacugcuucuuccuggccaccgugcccgcccucgcggagaccgggggcgagcgccagcugagcccggagaaguccgagaucugggggcccggccugaaggccgacgucgugcuccccgcccgguacuucuacauccaggccguggacaccagcgggaacaaguucaccuccagccccggcgagaaggucuuccaggugaagguguccgccccggaggagcaguucacccgcgucggcguccaggugcuggaccggaaggacgggagcuucaucgugcgcuaccggauguacgcguccuacaagaaccugaagguggagaucaaguuccagggccagcacguggccaagagccccuacauccucaaggggcccgucuaccacgagaacugcgacugcccccugcaggacuccgccgccuggcugcgcgagaugaacugcccggagacgaucgcgcagauccagcgggaccucgcccacuuccccgccguggaccccgagaagaucgccguggagauccccaagcgcuucggccagcggcagagccugugccacuacacccugaaggacaacaaggucuacaucaagacccacggggagcacgugggcuuccgcaucuucauggacgccauccuccugucccugacccggaaggugaagaugccggacgucgagcuguucgugaaccucggcgacuggccccuggagaagaagaaguccaacagcaacauccaccccaucuucagcuggugcggguccacggacagcaaggacaucgugaugcccaccuacgaccucaccgacuccguccuggagaccaugggccgcgugagccuggacaugauguccgugcaggcgaacacggggccgcccugggagagcaagaacagcaccgccgucuggcggggccgcgacucccggaaggagcgccucgagcuggugaagcugagccggaagcaccccgagcucaucgacgccgccuucaccaacuucuucuucuucaagcacgacgagaaccuguacggccccaucgucaagcacaucuccuucuucgacuucuucaagcacaaguaccagaucaacaucgacgggaccguggccgcguaccgccugccguaccuccuggugggcgacagcgucgugcugaagcaggacuccaucuacuacgagcacuucuacaacgagcuccagcccuggaagcacuacauccccgucaagagcaaccuguccgaccugcucgagaagcugaagugggccaaggaccacgacgaggaggccaagaagaucgccaaggccgggcaggaguucgcgcggaacaaccugaugggcgacgacaucuucugcuacuacuucaagcuguuccaggaguacgccaaccuccaggugagcgagccccagauccgcgaggggaugaagcggguggagccgcagacggaggacgaccuguuccccugcacgugccaccgcaagaagaccaaggacgagcucuga

SEQ ID NO: 31918 - RNA, 639 nt, Artificial Sequence
  derived and/or modified sequence opt1 from KDELR1__Homo_sapiens__NP_006792
augaaccuguuccgcuuccucggcgaccugagccaccuccuggccaucauccugcugcuccugaagaucuggaagucccggagcugcgccgggaucuccggcaagagccaggugcuguucgcggucguguucaccgcccgcuaccucgaccuguucaccaacuacaucucccuguacaacacgugcaugaagguggucuacaucgccugcagcuucaccaccguguggcucaucuacuccaaguucaaggccaccuacgacgggaaccacgacacguuccggguggaguuccuggucgugcccaccgccauccuggcguuccucgugaaccacgacuucaccccgcuggagauccuguggaccuucagcaucuaccucgaguccgucgccauccugccccagcuguucauggugagcaagacgggcgaggccgagaccaucaccucccacuaccucuucgcccuggggguguaccgcacccuguaccucuucaacuggaucuggcgguaccacuucgagggcuucuucgaccugaucgcgaucgucgccggccuggugcagacggugcucuacugcgacuucuucuaccuguacaucaccaagguccugaaggggaagaagcucagccugcccgccuga

SEQ ID NO: 31919 - RNA, 2172 nt, Artificial Sequence
  derived and/or modified sequence opt1 from KDM2A__Homo_sapiens__NP_001243334
augugcagcggccgcuuccagaacauccaggugaaccccgacuucccgcgggggcgcaucuccaacagcuuccggcgcaccuccagcaccgagaacaagacgaagacccugggcaagcuccaccaggagccccggcagcugcaguccgacgggaagcgcaagauccugcucgaggagcuggccaacagcgaccccaagcuggcccucaccggcguccccaucgugcaguggccgaagcgggacaagcugaaguuccccacccgccccaaggugcggguccccacgaucccgaucaccaagccccacaccaugaagcccgcgccccgccugaccccggugcggcccgccgccgccucccccaucgugagcggggcccgccggcgccggguccgcugccggaagugcaaggcgugcgugcagggcgagugcggcgugugccacuacugccgcgacaugaagaaguucgggggccccgggcggaugaagcaguccugcguccuccgccagugccuggccccgcggcugccccacagcgugacgugcucccucugcggcgagguggaccagaacgaggagacccaggacuucgagaagaagcugauggagugcugcaucugcaacgagaucguccaccccgggugccugcagauggacggcgagggccuccugaacgaggagcugcccaacugcugggagugcccgaagugcuaccaggaggacagcuccgagaaggcccagaagcgcaagauggaggagagcgacgaggaggccgugcaggcgaaggugcuccgcccccugcgguccugcgacgagccccugacgcccccgccccacagccccaccuccaugcuccagcugauccacgaccccgucagcccgcgcgggauggugacccgguccagccccggcgccgggcccagcgaccaccacuccgccagccgcgacgagcgguucaagcgccggcagcugcuccgccugcaggccaccgagcggaccauggugcgcgagaaggagaacaacccguccggcaagaaggagcugagcgaggucgagaaggccaagauccggggcuccuaccucaccgugacgcugcagcgccccaccaaggagcugcacgggaccagcaucgugcccaagcuccaggcgaucaccgccuccagcgccaaccugcggcacagcccccgcguccuggugcagcacugcccggcccggacgccccagcgcggcgacgaggaggggcucggcggggaggaggaggaggaggaggaggaggaggaggaggacgacuccgccgaggagggcggcgcggcccggcugaacgggcgcggcuccugggcccaggacggggacgagagcuggaugcagcgggagguguggauguccgucuuccgcuaccugagccgccgggagcucugcgagugcaugcgcgugugcaagaccugguacaaguggugcugcgacaagcggcuguggaccaagaucgaccugucccgcugcaaggccaucgucccccaggcccucagcggcaucaucaagcggcagcccgugucccuggaccugagcuggaccaacaucuccaagaagcagcucacguggcuggugaaccgccugccggggcucaaggaccugcugcucgcgggcugcagcuggagcgccgucuccgcccugagcaccuccagcugcccccugcugcggacccucgaccugcgcugggccgugggcaucaaggacccccagauccgggaccugcucacgcccccggccgacaagcccgggcaggacaaccgcuccaagcugcggaacaugaccgacuuccgccuggcgggccucgacaucaccgacgccacccugcggcugaucauccgccacaugccccuccugagccggcuggaccucucccacugcagccaccugaccgaccaguccagcaaccugcucacggccgugggguccagcacccgcuacucccugaccgagcugaacauggccggcugcaacaagcucaccgaccagacgcugaucuaccugcggcgcaucgcgaacgucacccucaucgaccugcgggggugcaagcagaucacccgcaaggccugcgagcacuucaucagcgaccuguccaucaacagccucuacugccuguccgacgagaagcugauccagaagaucagcuga

SEQ ID NO: 31920 - RNA, 3798 nt, Artificial Sequence
  derived and/or modified sequence opt1 from KDM2B__Homo_sapiens__NP_001005366
auggaggccgagaaggacagcggccgccggcugcgccccaucgaccggcagcgcuacgacgagaacgaggaccucuccgacguggaggagaucgucagcgugcggggguucucccuggaggagaagcugcgcagccagcucuaccagggcgacuucgugcacgccauggaggggaaggacuucaacuacgaguacguccagcgggaggcgcugcgcgugccccugaucuuccgggagaaggacggccucgggaucaagaugcccgaccccgacuucaccgugcgcgacgucaagcugcuggugggcucccggcgccucguggacgucauggacgugaacacccagaagggcacggagaugagcaugucccaguucgugcgguacuacgagacccccgaggcccagcgcgacaagcuguacaacgucaucagccuggaguucucccacaccaagcucgagcaccuggugaagcggcccaccguggucgaccugguggacuggguggacaacauguggccccagcaccucaaggagaagcagacggaggccaccaacgccaucgccgagaugaaguaccccaaggucaagaaguacugccugaugagcgugaaggggugcuucaccgacuuccacaucgacuucggcgggaccuccgugugguaccacgucuuccgcggcgggaagaucuucuggcugaucccgcccacgcuccacaaccuggcgcuguacgaggagugggugcucagcggcaagcaguccgacaucuuccugggcgaccggguggagcgcugccagcggaucgagcugaagcagggguacaccuucuucauccccagcggcuggauccacgccgucuacacccccguggacucccucgucuucgggggcaacauccugcacagcuucaacgugcccaugcagcugcgcaucuacgagaucgaggaccggacccgcgugcagccgaaguuccgcuaccccuucuacuacgagaugugcugguacguccucgagcgguacguguacugcgugacgcagcgcucccaccugacccaggaguaccagcgggagagcaugcugaucgacgcgccccgcaagcccuccaucgacggcuucagcagcgacuccuggcucgagauggaggaggaggccugcgaccagcagccgcaggaggaggaggagaaggacgaggagggggagggccgggaccgcgcccccaagccgcccaccgacgggagcaccucccccacgagcacccccuccgaggaccaggaggcccugggcaagaagcccaaggcccccgcccugcgguuccucaagcgcacccugagcaacgaguccgaggagagcgugaaguccaccacgcuggccguggacuacccgaagacccccaccgggagccccgcgaccgagguguccgccaaguggacgcaccucaccgaguucgagcugaagggccugaaggcccucgucgagaagcuggagagccugcccgagaacaagaagugcgugccggagggcaucgaggacccccaggcccuccuggagggggugaagaacguccugaaggagcacgccgacgacgaccccucccucgcgaucaccggcgugccgguggucaccuggcccaagaagacgcccaagaaccgggccguggggcgccccaagggcaagcuggggccggccagcgccgugaagcuggccgcgaaccggaccaccgccggcgcccgccggcgccggacccgcugccggaagugcgaggccugccuccgcacggagugcggcgagugccacuucugcaaggacaugaagaaguucgggggccccgggcggaugaagcaguccugcaucaugcgccagugcaucgcccccguccugccccacaccgcggugugccuggugugcggcgaggccgggaaggaggacaccgucgaggaggaggagggcaaguucaaccugaugcucauggagugcagcaucugcaacgagaucauccacccgggcugccugaagaucaaggaguccgaggggguggugaacgacgagcugcccaacugcugggagugccccaagugcaaccacgccggcaagaccgggaagcagaagcgcggccccggcuucaaguacgccagcaaccucccggggucccugcugaaggagcagaagaugaaccgggacaacaaggagggccaggagcccgcgaagcgccggagcgagugcgaggaggcgccccgccggcgcagcgacgagcacuccaagaaggugcccccggacgggcuccugcggcgcaagagcgacgacguccaccuccggaagaagcgcaaguacgagaagccccaggagcuguccggccggaagcgccugaagcccgggaaggaggacaagcuguuccggaagaagcgccggagcuggaagaacgccgaggaccgcauggcccucgccaacaagccccugcggcgcuucaagcaggagccggaggacgagcugcccgaggccccgcccaagacgcgggaguccgaccacagccgcuccagcucccccaccgccggccccagcaccgagggcgccgaggggcccgaggagaagaagaaggugaagaugcggcgcaagcgccggcucccgaacaaggagcugucccgcgagcugagcaaggagcucaaccacgagauccagcggaccgagaacucccuggccaacgagaaccagcagcccaucaagagcgagcccgaguccgagggcgaggagcccaagcgcccgcccgggaucugcgagcggccccaccgcuucagcaagggccugaacgggacgccccgggagcuccgccaccagcugggcccgucccugcggagcccgccccgcgucaucagccggcccccgcccuccgugagcccgcccaagugcauccagauggagcgccacgugauccggcccccgcccaucagcccgccgcccgacucccucccccuggacgacggcgccgcgcacgucaugcaccgcgagguguggauggccguguucuccuaccugagccaccaggaccucugcgucugcaugcgggugugccgcaccuggaaccgguggugcugcgacaagcgccuguggacccggaucgaccugaaccacugcaaguccaucacgccccucaugcugagcgggaucauccgccgccagcccgugucccuggaccucagcuggaccaacaucuccaagaagcagcugagcuggcugaucaaccggcuccccggccugcgcgaccugguccucuccgggugcagcuggaucgccguguccgcccugugcagcuccagcugcccccugcuccggacccuggacgugcagugggucgagggccugaaggacgcccagaugcgcgaccuccugagcccgcccaccgacaaccggcccgggcagauggacaaccgcuccaagcugcggaacaucguggagcuccgccuggcgggccuggacaucaccgacgccagccuccggcugaucauccgccacaugccccugcucuccaagcugcaccugagcuacugcaaccacgugaccgaccaguccaucaaccuccugacggccgucggcaccaccacccgggacagccugacggagaucaaccucuccgacugcaacaaggugaccgaccagugccugagcuucuucaagcgcugcgggaacaucugccacaucgaccugcgguacugcaagcaggucaccaaggagggcugcgagcaguucaucgccgagauguccagcuuccaggggcgcuccugcagcaccacgcggcucggcgacgaguga

SEQ ID NO: 31921 - RNA, 3966 nt, Artificial Sequence
  derived and/or modified sequence opt1 from KDM3A__Homo_sapiens__NP_060903
auggugcugacccucggcgagagcuggcccguccugguggggcgccgguuccugucccucagcgccgccgacggcuccgacgggagccacgacuccugggacguggagcgcgucgcggaguggccguggcugagcggcaccauccgggccgugucccacacggacgugaccaagaaggaccugaaggucugcguggaguucgacggggagagcuggcgcaagcggcgcuggaucgagguguacucccuccugcggcgcgccuuccuggucgagcacaaccucgugcuggccgagcggaagucccccgagaucuccgagcgcaucgugcaguggcccgccaucaccuacaagccccugcucgacaaggcgggccugggcagcaucaccuccguccgguuccugggggaccagcagcgcguguuccucagcaaggaccugcugaagccgauccaggacgugaacucccuccggcugagccugacggacaaccagaucgucuccaaggaguuccaggcccucaucgugaagcaccuggacgagagccaccuccugaagggcgacaagaaccuggugggguccgaggucaagaucuacagccuggaccccagcacccagugguucuccgccaccgugaucaacggcaaccccgccagcaagacccuccaggugaacugcgaggagauccccgcgcugaagaucgucgacccgucccugauccacguggaggugguccacgacaaccucgugacgugcgggaacagcgcccgcaucggcgccgucaagcggaaguccagcgagaacaacggcacccugguguccaagcaggccaagagcugcuccgaggccagccccuccaugugccccgugcagagcguccccaccaccguguucaaggagauccugcucgggugcacggcggccaccccgcccuccaaggacccccgccagcagagcacgccccaggccgccaacuccccgcccaaccugggcgccaagaucccccaggggugccacaagcagagccugcccgaggagaucuccagcugccucaacaccaaguccgaggcgcugcggaccaagccggacgugugcaaggccggccugcucagcaagagcucccagaucggcaccggggaccugaagauccugaccgagcccaagggcagcugcacccagcccaagacgaacaccgaccaggagaaccgccucgaguccgucccccaggcccugaccgggcugccgaaggagugccuccccaccaaggccagcuccaaggccgagcuggagaucgcgaacccgcccgagcugcagaagcaccucgagcacgcccccagccccuccgacgugagcaacgcccccgaggugaaggccggcgucaacuccgacagcccgaacaacugcuccgggaagaagguggagcccagcgcccuggcgugccggucccagaaccugaaggagagcuccgugaaggucgacaacgagagcugcugcucccgcagcaacaacaagauccagaacgcccccagccggaaguccgugcugacggaccccgccaagcucaagaagcugcagcagagcggcgaggccuucgugcaggacgacuccugcgucaacaucguggcgcagcugccgaagugccgcgagugccgccucgacagccugcggaaggacaaggagcagcagaaggacucccccguguucugccgcuucuuccacuuccggcgccugcaguucaacaagcacggcguccuccggguggagggguuccugacccccaacaaguacgacaacgaggccaucggccuguggcucccccugaccaagaacguggucgggaucgaccuggacaccgccaaguacauccucgccaacaucggcgaccacuucugccagauggugaucagcgagaaggaggccauguccacgaucgagccgcaccgccagguggcguggaagcgggccgucaagggggugcgcgagaugugcgacgugugcgacaccaccaucuucaaccugcacugggucugcccccggugcggcuucggcgugugcguggacugcuaccgcaugaagcggaagaacugccagcagggggccgccuacaagaccuucagcuggcugaagugcgucaagucccagauccacgagcccgagaaccucaugcccacgcagaucaucccgggcaaggcccuguacgacgugggggacaucgugcacagcguccgcgcgaaguggggcaucaaggccaacugccccugcuccaaccggcaguucaagcuguucagcaagcccgccuccaaggaggaccucaagcagaccagccuggccggggagaagcccacccugggcgccgugcuccagcagaacccguccgugcuggagcccgcggccgucggcggggaggccgccagcaagcccgcgggcuccaugaagcccgccugcccggccagcaccagcccccugaacuggcucgccgaccugacgagcgggaacgugaacaaggagaacaaggagaagcagcccaccaugcccauccugaagaacgagaucaagugccucccgccccugcccccgcugagcaaguccagcaccgugcuccacaccuucaacuccaccauccugacgcccgucagcaacaacaacuccggcuuccugcgcaaccuccugaacagcuccaccggcaagaccgagaacgggcugaagaacacccccaagauccucgacgacaucuucgccagccuggugcagaacaagacgaccuccgaccugagcaagcggccccagggccucaccaucaagccguccauccugggguucgacacgccccacuacuggcugugcgacaaccgccuccugugccugcaggaccccaacaacaagagcaacuggaacguguuccgggagugcuggaagcagggccagcccgucaugguguccggggugcaccacaagcucaacagcgagcuguggaagccggaguccuuccgcaaggaguucggcgagcaggaggucgaccuggugaacugccggaccaacgagaucaucaccggcgcgaccgugggggacuucugggacggcuucgaggacguccccaaccgccucaagaacgagaaggagcccauggugcugaagcugaaggacuggcccccgggggaggacuuccgcgacaugaugcccagccgguucgacgaccucauggccaacaucccccugcccgaguacacccgccgggacggcaagcugaaccucgccucccgccugccgaacuacuucgugcggcccgaccuggggcccaagauguacaacgccuacggccucaucacgcccgaggaccgcaaguacggcaccaccaaccugcaccuggacgucagcgacgccgcgaacgugauggucuacguggggaucccgaagggccagugcgagcaggaggaggaggugcucaagaccauccaggacggggacuccgacgagcugacgaucaagcgguucaucgagggcaaggagaagcccggggcccuguggcacaucuacgccgccaaggacaccgagaagauccgcgaguuccucaagaaggucagcgaggagcagggccaggagaaccccgccgaccacgaccccauccacgaccagagcugguaccuggaccggucccugcgcaagcggcuccaccaggaguacggcgugcaggggugggcgaucgugcaguuccugggcgacgucguguucaucccggccggggcgccccaccaggugcacaaccuguacagcugcaucaaggucgccgaggacuucgugucccccgagcacgugaagcacugcuucuggcucacccaggaguuccgcuaccugagccagacccacacgaaccacgaggacaagcugcaggucaagaacgugaucuaccacgccgugaaggacgccgucgccaugcucaaggccuccgagagcuccuucggcaagcccuga

SEQ ID NO: 31922 - RNA, 5286 nt, Artificial Sequence
  derived and/or modified sequence opt1 from KDM3B__Homo_sapiens__NP_057688
auggccgacgccgccgccagccccgugggcaagcggcugcuccugcuguucgccgacaccgccgccuccgccagcgccuccgcccccgccgccgccgccgccagcggggaccccggccccgcccuccggacccgggccuggcgggccgggaccgugcgcgccauguccggcgccgugccccaggaccuggccaucuucguggaguucgacgggugcaacuggaagcagcacagcugggugaaggugcacgccgaggaggugaucguccugcuccuggagggcucccuggugugggcgccccgggaggaccccgugcuccugcagggcauccgcgucagcaucgcccaguggcccgcccugaccuucacgccccugguggacaagcuggggcugggcuccgugguccccguggaguaccuccuggaccgggagcugcgcuuccucagcgacgccaacgggcugcaccuguuccagaugggcaccgacucccagaaccagauccuccuggagcacgccgcccugcgggagaccgugaacgcccucaucagcgaccagaagcugcaggagaucuucucccgcgggcccuacagcguccagggccaccgggugaagaucuaccagcccgagggcgaggagggguggcuguacggcguggucucccaccaggacagcaucacccgccucauggagguguccgugaccgagagcggggagaucaaguccgucgacccccggcugauccacgugaugcugauggacaacagcaccccgcagagcgagggcggcacccucaaggccgugaaguccagcaaggggaagaagaagcgcgaguccaucgagggcaaggacgggcggcgccgcaagagcgccuccgacagcggcugcgaccccgcguccaagaagcugaagggggaccgcggcgaggucgacagcaacggcuccgacgggggcgaggccagccgggggcccuggaagggcgggaacgccuccggcgagcccggccuggaccagcgcgccaagcagccgcccagcaccuucgugccccagaucaaccggaacauccgcuucgcgaccuacaccaaggagaacgggcgcacgcucgucgugcaggacgagcccgugggcggggacacccccgccuccuucacccccuacagcaccgccacgggccagacgccccuggcccccgaggucgggggcgccgagaacaaggaggcgggcaagacccuggagcaggucgggcagggcaucguggccuccgccgccgucgugaccacggccagcuccaccccgaacaccgugcggaucagcgacaccgggcucgcggccggcacgguccccgagaagcagaagggcucccgcagccaggccagcggggagaacucccggaacagcauccuggccuccagcggcuucggggcgccccugcccuccagcucccagccgcucaccuucggcagcgggcgcucccagagcaacggcgugcuggcgaccgagaacaagccccugggcuucuccuucgggugcagcuccgcccaggaggcccagaaggacaccgaccucagcaagaaccuguucuuccagugcaugucccagacgcugcccaccagcaacuacuucaccaccguguccgagagccucgccgacgacagcuccagccgggacuccuucaagcagagccuggagucccugagcuccggccucugcaaggggcgcagcguccugggcacggacaccaagccgggguccaaggcgggcagcuccguggaccggaaggugcccgccgagagcaugcccacccugacccccgccuucccgcgcucccugcucaacgcccggacgcccgagaaccacgagaaccuguuccugcagccgcccaagcucagccgcgaggagccguccaaccccuuccuggccuucgucgagaagguggagcacagccccuucuccagcuucgcgucccaggccagcggcagcuccagcuccgccaccaccgugaccagcaaggucgcccccuccuggccggagagccacuccagcgccgacuccgcgagccuggccaagaagaagccccucuucaucaccacggacuccagcaagcugguguccggggugcugggcagcgcccucaccuccgggggccccagccuguccgccauggggaacggccggagcuccagccccaccagcucccugacccagccgaucgagaugcccacgcucagcuccagccccaccgaggagcgccccaccgucggcccggggcagcaggacaacccccugcugaagaccuucuccaacguguucggccggcacagcgggggcuuccucuccagccccgccgacuucucccaggagaacaaggcgcccuucgaggccgugaagcgcuucagccuggacgagcggucccuggccugccgccaggacagcgacuccagcacgaacuccgaccucagcgaccuguccgacagcgaggagcagcugcaggccaagaccgggcucaagggcaucccggagcaccugaugggcaagcuggggcccaacggcgagcgguccgcggagcuccugcugggcaagagcaaggggaagcaggcccccaagggccgcccgcggaccgcgccccugaaggucgggcagagcgugcugaaggacguguccaaggucaagaagcugaagcagagcggcgagcccuuccuccaggacggguccugcaucaacguggcgccccaccuccacaagugccgcgagugccgccuggagcgguaccgcaaguucaaggagcaggagcaggacgacagcaccguggccugccgguucuuccacuuccgccggcucaucuucacgcgcaagggcguccugcggguggagggguuccuguccccgcagcagagcgaccccgacgcgaugaaccucuggauccccuccagcucccuggccgagggcaucgaccuggagaccagcaaguacauccucgccaacgugggcgaccaguucugccagcuggucauguccgagaaggaggccaugaugaugguggagccccaccagaagguggccuggaagcgcgcgguccgcggggugcgcgagaugugcgacgugugcgagaccacccuguucaacauccacugggucugccggaagugcggcuucggggugugccucgacugcuaccgccugcgcaagagccgcccgcgguccgagacggaggagaugggcgacgaggagguguucagcuggcugaagugcgccaaggggcagucccacgagcccgagaaccucaugcccacccagaucauccccggcaccgcccuguacaacaucggcgacaugguccacgccgcccgcgggaaguggggcaucaaggcgaacugcccgugcaucagccggcagaacaaguccgugcugcgccccgccgugaccaacgggaugagccagcuccccuccaucaaccccagcgccagcuccggcaacgagacgaccuucagcgggggcggcgggccggcccccgucaccacccccgagcccgaccacgugccgaaggccgacuccacggacauccggagcgaggagccccugaagaccgacuccagcgcguccaacagcaacuccgagcugaaggccauccggccgcccugcccggacaccgcgccgcccagcuccgcccuccacuggcuggcggaccuggccacccagaaggccaaggaggagacgaaggaggccggcagccuccgguccgugcugaacaaggagagccacucccccuucgggcuggacagcuucaacuccaccgccaaggucagcccgcucacccccaagcuguucaacucccugcuccugggccccaccgcgagcaacaacaagacggagggcagcucccugcgcgaccuccugcacagcgggccgggcaagcugccccagacgccccucgacaccgggauccccuucccgcccguguucuccaccagcuccgccggcgucaagagcaaggccucccugcccaacuuccuggaccacaucaucgccagcgucguggagaacaagaagacguccgacgccagcaagcgcgcgugcaaccucaccgacacccagaaggaggucaaggagauggugauggggcugaacgugcuggacccccacaccucccacagcuggcucugcgacggccggcugcugugccuccacgacccguccaacaagaacaacuggaagaucuuccgcgagugcuggaagcagggccagcccguccuggugagcggggugcacaagaagcugaaguccgagcucuggaagcccgaggccuucagccaggaguucggcgaccaggacgucgaccuggugaacugccggaacugcgccaucaucuccgacgugaagguccgcgacuucugggacggguucgagaucaucugcaagcggcugcgcagcgaggacggccagcccauggugcucaagcugaaggacuggccgcccggggaggacuuccgggacaugaugcccacccgcuucgaggaccugauggagaaccucccccugccggaguacacgaagcgggacggccgccugaaccucgccagccggcugcccuccuacuucgugcgccccgaccugggccccaagauguacaacgccuacgggcucaucaccgcggaggaccggcgcgucggcaccaccaaccugcaccuggacgugagcgacgccgugaacgucaugguguacguggggaucccgaucggcgagggggcccacgacgaggagguccucaagacgaucgacgagggcgacgccgacgaggugaccaagcagcggauccacgacggcaaggagaagcccggggcgcuguggcacaucuacgccgccaaggacgccgagaagauccgcgagcugcugcggaaggugggcgaggagcaggggcaggagaacccgcccgaccacgacccgauccacgaccaguccugguaccucgaccagacccugcgcaagcggcuguacgaggaguacggcguccaggggugggccaucgugcaguuccucggcgacgcgguguucauccccgccggcgcgccccaccagguccacaaccuguacagcugcaucaagguggccgaggacuucgugucccccgagcacgucaagcacugcuuccgccugacccaggaguuccgccaccucagcaacacgcacaccaaccacgaggacaagcuccaggugaagaacaucaucuaccacgccgugaaggacgcggucgggacccugaaggcccacgaguccaagcucgcccggagcuga

SEQ ID NO: 31923 - RNA, 3291 nt, Artificial Sequence
  derived and/or modified sequence opt1 from KDM4B__Homo_sapiens__NP_055830
augggcagcgaggaccacggggcccagaaccccuccugcaagaucaugaccuuccgcccgaccauggaggaguucaaggacuucaacaaguacguggccuacaucgagagccagggcgcgcaccgggccgggcuggccaagaucaucccccccaaggaguggaagccccgccagacguacgacgacaucgacgacgucgugaucccggcccccauccagcagguggucaccggccaguccgggcucuucacccaguacaacauccagaagaaggccaugaccgugggcgaguaccggcgccuggcgaacagcgagaaguacugcacgccccggcaccaggacuucgacgaccuggagcgcaaguacuggaagaaccucaccuucgugucccccaucuacggcgccgacaucagcgggucccuguacgacgacgacgucgcccaguggaacaucggcagccugcggaccauccucgacaugguggagcgcgagugcgggaccaucaucgagggcgugaacacgccguaccuguacuucgggauguggaagaccaccuucgccuggcacaccgaggacauggaccuguacuccaucaacuaccuccacuucggcgagcccaagagcugguacgcgaucccccccgagcacggcaagcggcuggagcgccuggccaucggguucuucccgggcuccagccaggggugcgacgccuuccuccggcacaagaugacgcugaucucccccaucauccugaagaaguacggcauccccuucagccgcaucacccaggaggccggcgaguucaugaucaccuuccccuacggguaccacgccggcuucaaccacggguucaacugcgcggaguccaccaacuucgccacgcuccgguggaucgacuacggcaaggucgccacccagugcaccugccgcaaggacauggugaagaucagcauggacguguucguccggauccugcagccggagcgcuacgagcuguggaagcaggggaaggaccucaccgugcuggaccacacgcggcccaccgcccugaccucccccgagcucagcuccuggagcgccagccgcgcgucccugaaggccaagcugcuccggcgcagccaccggaagcgcucccagcccaagaagccgaagcccgaggaccccaaguuccccggcgagggcaccgccggggccgcccugcuggaggaggcgggcgggagcgugaaggaggaggccggcccggaggucgaccccgaggaggaggaggaggagccccagccccucccgcacgggcgcgaggccgagggcgccgaggaggacggccgggggaagcugcgccccacgaaggccaaguccgagcggaagaagaagagcuucggccugcuccccccgcagcugcccccccccccggcgcacuuccccuccgaggaggcccuguggcuccccagcccccuggagccgcccgugcuggggcccggccccgccgccauggaggaguccccgcuccccgcgccccugaacgugguccccccggaggugcccagcgaggagcuggaggccaagccccgccccaucaucccgaugcucuacguggucccccggcccgggaaggccgccuucaaccaggagcacguguccugccagcaggccuucgagcacuucgcgcagaagggccccaccuggaaggagccggugagccccauggagcugaccggccccgaggacggggccgccuccagcggcgccgggcgcauggagaccaaggcccgggcgggcgagggccaggccccguccacguucagcaagcugaagauggagaucaagaagucccgccggcacccccucgggcgcccccccacccggagcccgcuguccgucgugaagcaggaggccagcagcgacgaggaggccucccccuucagcggcgaggaggacgucuccgaccccgacgcccugcgcccccuccugagccugcaguggaagaaccgggcggccuccuuccaggccgagcgcaaguucaacgccgcggccgcccggaccgagccguacugcgccaucugcacccucuucuaccccuacugccaggcccugcagacggagaaggaggcgcccaucgccagccugggggagggcugccccgccacccugccguccaagagccgccagaagacccggccccucauccccgagaugugcuucaccuccgggggcgagaacacggagccccugccggccaacagcuacaucggcgacgacgggaccuccccccugaucgccugcggcaagugcugccuccaggugcacgcgagcugcuacgggauccgccccgagcuggugaacgagggcuggaccugcucccggugcgccgcccacgccuggaccgccgagugcugccugugcaaccuccgcgggggcgcgcugcagaugaccacggaccgccgguggauccacgucaucugcgccaucgccgugcccgaggcccgcuuccugaacgugaucgagcggcacccggucgacaucagcgcgauccccgagcagcgcuggaagcucaagugcguguacugccggaagcgcaugaagaagguguccggcgccugcauccagugcagcuacgagcacugcuccaccagcuuccacgucaccugcgcccacgccgccggggugcugauggagcccgacgacuggcccuacguggucagcaucaccugccugaagcacaaguccggcgggcacgcggugcagcuccugcgggccgugagccugggccaggucgugaucacgaagaaccgcaacgggcucuacuaccggugccgcgugaucggcgccgccucccagaccugcuacgaggucaacuucgacgacggcagcuacuccgacaaccuguacccggagagcaucaccucccgggacugcgugcagcuggggccccccagcgagggcgagcucguggagcugcgcuggaccgacgggaaccuguacaaggccaaguucaucuccagcgucacgucccacaucuaccagguggaguucgaggacggcagccagcucaccgugaagcggggggacaucuucacccuggaggaggagcugcccaagcgcguccggucccgccucagccuguccaccggcgcgccgcaggagcccgccuucagcggcgaggaggccaaggccgccaagcggccccgcguggggacgccgcuggcgaccgaggacuccggccggagccaggacuacguggccuucgucgagucccuccugcaggugcaggggcgccccggcgcccccuucuga

SEQ ID NO: 31924 - RNA, 2442 nt, Artificial Sequence
  derived and/or modified sequence opt1 from KDM4C__Homo_sapiens__NP_001140167
auggagguggccgaggucgagagcccccugaacccguccugcaagaucaugaccuuccgccccagcauggaggaguuccgggaguucaacaaguaccucgccuacauggaguccaagggcgcgcaccgcgccgggcuggccaaggugaucccgcccaaggaguggaagccgcggcagugcuacgacgacaucgacaaccugcucauccccgcccccauccagcagauggugaccggccagagcgggcuguucacgcaguacaacauccagaagaaggccaugaccgucaaggaguuccgccagcuggcgaacuccggcaaguacugcacgccccgguaccucgacuacgaggaccuggagcgcaaguacuggaagaaccugaccuucguggccccgaucuacggggccgacaucaacggcagcaucuacgacgagggcguggacgaguggaacaucgcccggcucaacaccguccuggacgugguggaggaggagugcgggaucuccaucgagggcgucaacacccccuaccuguacuucgggauguggaagaccaccuucgcguggcacacggaggacauggaccucuacagcaucaacuaccugcacuucggcgagcccaaguccugguacgccaucccgcccgagcacgggaagcgccuggagcggcucgcccagggcuucuuccccagcuccagccagggcugcgacgccuuccugcgccacaagaugacccugaucucccccagcgugcucaagaaguacgggauccccuucgacaagaucacccaggaggccggcgaguucaugaucaccuucccguacggguaccacgcgggcuucaaccacggcuucaacugcgccgaguccacgaacuucgccaccgugcgguggaucgacuacgggaaggucgccaagcugugcacgugccgcaaggacauggugaagaucagcauggacaucuucgugcggaaguuccagcccgaccgcuaccagcuguggaagcagggcaaggacaucuacaccaucgaccacaccaagcccacccccgccuccaccccggaggucaaggcguggcuccagcggcgccggaaggugcgcaaggccagccgguccuuccagugcgcccgcagcaccagcaagcggcccaaggccgacgaggaggaggagguguccgacgaggucgacggggccgaggugcccaaccccgacagcgugacggacgaccugaaggucuccgagaaguccgaggcggccgugaagcugcgcaacaccgaggccagcagcgaggaggaguccagcgccucccgcaugcaggucgagcagaaccucagcgaccacaucaagcuguccggcaacagcugccuguccaccagcgugaccgaggacaucaagacggaggacgacaaggccuacgcguaccgguccgugccgagcaucuccagcgaggccgacgacuccaucccccucagcagcggguacgagaagcccgagaaguccgaccccagcgagcuguccuggcccaagagccccgaguccugcagcuccgucgccgagagcaacggcgugcugaccgagggcgaggaguccgacguggagagccacgggaacggccucgagcccggggagaucccggccguccccuccggcgagcgcaacagcuucaaggugcccuccaucgcggagggggagaacaagaccagcaaguccuggcggcacccccugagccgcccgcccgcccggucccccaugacccuggugaagcagcaggcccccagcgacgaggagcucccggagguccugagcaucgaggaggagguggaggagacggaguccugggccaagccccugauccaccucuggcagaccaagagccccaacuucgccgcggagcaggaguacaacgccaccguggcccgcaugaagccccacugcgccaucugcacccugcugaugccguaccacaagcccgacuccagcaacgaggagaacgacgcccggugggagacgaagcucgacgaggucgugaccuccgagggcaagaccaagccccugauccccgagaugugcuucaucuacagcgaggagaacaucgaguacuccccgcccaacgcguuccuggaggaggacggcaccagccuccugaucuccugcgccaagugcugcgugcgcguccacgccagcugcuacgggauccccucccacgagaucugcgacggcuggcugugcgcccggugcaagcgcaacgccuggacggcggagugcugccucugcaaccugcgcgggggcgcccugaagcagaccaagaacaacaagugggcccacgugaugugcgccguggcgguccccgaggugcgguucaccaacgugccggagcggacccagaucgacgucgggcgcaucccccuccagcggcugaagcugggccgccugggcaucuga

SEQ ID NO: 31925 - RNA, 5073 nt, Artificial Sequence
  derived and/or modified sequence opt1 from KDM5A__Homo_sapiens__NP_001036068
auggccgggguggggcccggcggguacgccgccgaguucgugcccccgcccgagugccccguguucgagcccuccugggaggaguucaccgacccccuguccuucaucggccgcauccggccccucgccgagaagaccgggaucugcaagauccgcccgcccaaggacuggcagccgcccuucgccugcgaggugaaguccuuccgguucacgccccggguccagcggcugaacgagcuggaggccaugacccgcgugcggcuggacuuccuggaccagcuggccaaguucugggagcugcagggcuccacccugaagauccccguggucgagcgcaagauccuggaccucuacgcgcugagcaagaucguggccuccaagggcggguucgagauggugaccaaggagaagaaguggagcaaggucggcucccggcugggguaccuccccggcaaggggacgggcagccugcugaagucccacuacgagcgcauccucuaccccuacgagcuguuccagagcggcgugucccugaugggggugcagaugcccaaccucgaccugaaggagaaggucgagccggaggugcugagcaccgacacccagaccucccccgagcccggcacgcggaugaacauccuccccaagcgcacccggcgcgugaagacccagagcgaguccggggacgucagccggaacaccgagcugaagaagcugcagaucuucggcgccggccccaaggugguggggcucgccaugggcacgaaggacaaggaggacgaggucacccgccggcgcaaggugaccaaccgguccgacgccuucaacaugcagaugcgccagcggaaggggacccugagcgugaacuucgucgaccuguacgugugcauguucugcggccgcgggaacaacgaggacaagcuccugcugugcgacggcugcgacgacuccuaccacacguucugccucaucccgccccugcccgacgugcccaagggcgacuggcgcugccccaagugcgucgccgaggagugcagcaagccccgggaggccuucggguucgagcaggccgugcgcgaguacacccugcagagcuucggcgagauggccgacaacuucaaguccgacuacuucaacaugcccguccacauggugccgaccgagcucguggagaaggaguucuggcggcuggucagcuccaucgaggaggacgugaucguggaguacggggcggacaucagcuccaaggacuucggcagcggguuccccgucaaggacggccgccggaagauccugcccgaggaggaggaguacgcccucuccggcuggaaccugaacaacaugccggugcuggagcagagcgugcucgcccacaucaacgucgacaucuccgggaugaaggugcccuggcuguacgugggcaugugcuucagcuccuucugcuggcacaucgaggaccacuggagcuacuccaucaacuaccugcacuggggcgagcccaagaccugguacggcguccccagccacgccgccgagcagcucgaggaggugaugcgcgagcuggcgccggagcuguucgagucccagcccgaccuccugcaccagcuggugacgaucaugaaccccaacguccucauggagcacggggugcccguguaccggaccaaccagugcgccggcgaguucgucgugaccuucccccgcgccuaccacagcggcuucaaccagggguacaacuucgccgaggccgucaacuucugcaccgcggacuggcugcccaucggccggcagugcgucaaccacuaccgccggcugcgccggcacugcguguucucccacgaggagcugaucuucaagauggccgccgaccccgagugccucgacguggggcuggccgccauggucugcaaggagcugacccucaugaccgaggaggagacccgccugcgggagagcguggugcagaugggcguccugauguccgaggaggagguguucgagcucgugcccgacgacgagcgccagugcagcgcgugccggaccacgugcuuccugagcgcccugaccugcuccugcaacccggagcgccucgucugccuguaccaccccaccgaccugugccccugccccaugcagaagaagugccuccgguaccgcuacccgcuggaggaccugcccagccuccuguacggcgugaaggugcgcgcccaguccuacgacaccugggucagccgggugacggaggcccuguccgcgaacuucaaccacaagaaggaccucaucgagcugcgcgugaugcuggaggacgccgaggaccggaaguaccccgagaacgaccucuuccgcaagcugcgggacgccgucaaggaggccgagaccugcgccagcguggcgcagcugcuccuguccaagaagcagaagcaccgccagagccccgacuccgggcggacccgcaccaagcugacgguggaggagcucaaggccuucguccagcagcuguucagccugccgugcgugaucucccaggcccgccaggugaagaaccuccuggacgacgucgaggaguuccacgagcgcgcccaggaggccaugauggacgagacccccgacagcuccaagcugcagaugcucaucgacaugggcagcucccuguacguggagcugcccgagcucccccggcugaagcaggagcugcagcaggcgcgcuggcucgacgaggugcggcugacccugagcgacccgcagcaggucacccucgacgugaugaagaagcugaucgacuccggggugggccuggcgccccaccacgccgucgagaaggccauggccgagcuccaggagcugcugaccgugagcgagcgcugggaggagaaggcgaaggugugccuccaggcccggccccgccacagcgucgccucccuggagagcaucgugaacgaggccaagaacaucccggcguuccugcccaacguccucucccugaaggaggcccugcagaaggcccgggaguggacggccaagguggaggccauccagagcggguccaacuacgcguaccucgagcagcuggagagccuguccgccaagggccgccccauccccgugcggcucgaggcccugccgcaggucgagagccagguggccgccgcgcgcgccuggcgggagcgcaccggccgcaccuuccugaagaagaacuccagccacacccuccuccaggugcugagcccccggacggacaucggggucuacggcagcgggaagaaccgccggaagaaggugaaggagcucaucgagaaggagaaggagaaggaccuggaccuggagccccucuccgaccuggaggagggccuggaggagacccgcgacaccgccaugguggucgccguguucaaggagcgggagcagaaggagaucgaggccaugcacagccuccgcgcggccaaccuggccaagaugaccaugguggaccggaucgaggaggucaaguucugcaucugccgcaagacggccuccggguucaugcugcagugcgagcucugcaaggacugguuccacaacagcugcgugccccugccgaaguccagcucccagaagaagggcagcagcuggcaggcgaaggaggugaaguuccugugcccccucugcaugcggucccgccggccccgccuggagaccauccugagccuccuggucucccugcagaagcuccccgugcggcugccggagggcgaggcccugcagugccucaccgagcgcgccaugagcuggcaggaccgggcccgccaggcccuggcgaccgacgagcuguccagcgcccucgccaagcuguccgugcugagccagcggauggucgagcaggccgcccgcgagaagacggagaagaucaucuccgcggagcuccagaaggccgccgccaaccccgaccugcaggggcaccuccccagcuuccagcaguccgccuucaaccggguggugagcuccgucagcuccagcccccgccagaccauggacuacgacgacgaggagaccgacuccgacgaggacauccgcgagaccuacggcuacgacaugaaggacacggcgagcgugaaguccagcagcucccucgagccgaaccuguucugcgacgaggagauccccaucaagagcgaggagguggucacccacauguggaccgcccccuccuucugcgccgagcacgccuacagcuccgccagcaaguccugcagccagggguccagcacgccccggaagcagccgcgcaagagcccccuggugccccggagccuggagcccccggugcucgagcugucccccggcgcgaaggcccagcuggaggagcucaugauggucggggaccugcuggaggugagccucgacgagacgcagcacaucuggcgcauccugcaggccacccacccgcccuccgaggaccgguuccugcacaucauggaggacgacagcauggaggagaagccgcucaaggugaagggcaaggacuccagcgagaagaagcgcaagcggaagcuggagaaggucgagcagcuguucggcgaggggaagcagaaguccaaggagcucaagaagauggacaagccccgcaagaagaagcugaagcugggcgccgacaagagcaaggagcucaacaagcuggcgaagaagcuggccaaggaggaggagcggaagaagaagaaggagaaggccgccgccgcgaagguggagcucgugaaggagagcaccgagaagaagcgcgagaagaagguccuggacauccccuccaaguacgacuggagcggggccgaggaguccgacgacgagaacgccgugugcgccgcccagaacugccagcggccgugcaaggacaagguggacuggguccagugcgacggcgggugcgacgagugguuccaccaggugugcgugggcgucagccccgagauggcggagaacgaggacuacaucugcaucaacugcgccaagaagcagggccccgugucccccgggccggcgccgccgcccagcuucaucauguccuacaagcugccgauggaggaccucaaggagaccagcuga

SEQ ID NO: 31926 - RNA, 4635 nt, Artificial Sequence
  derived and/or modified sequence opt1 from KDM5B__Homo_sapiens__NP_006609
auggaggccgccaccacccugcaccccggcccgcgccccgcgcucccccucgggggccccgggccgcugggcgaguuccugcccccgcccgagugccccguguucgagcccagcugggaggaguucgccgaccccuucgccuucauccacaagauccggcccaucgccgagcagacggggaucugcaagguccgcccgccgcccgacuggcagccgcccuucgccugcgacguggacaagcugcacuucacgccccggauccagcgccugaacgagcucgaggcgcagacccgggugaagcugaacuuccuggaccagaucgccaaguacugggagcuccagggcuccacccugaagaucccccacgucgagcgcaagauccuggaccucuuccagcugaacaagcugguggccgaggagggcggguucgccguggucugcaaggaccggaaguggaccaagaucgcgaccaagaugggcuucgcccccgggaaggccgugggcagccacauccgcgggcacuacgagcggauccucaaccccuacaaccuguuccuguccggcgacagccuccgcugccugcagaagcccaaccugaccaccgacacgaaggacaaggaguacaagccccacgacaucccccagcggcaguccgugcagccgagcgagaccugcccgcccgcccgccgggccaagcgcaugcgggcggaggccaugaacaucaagaucgagcccgaggagaccaccgaggcccgcacgcacaaccuccggcgccggaugggcugccccacccccaagugcgagaacgagaaggagaugaaguccagcaucaagcaggagcccaucgagcgcaaggacuacaucgucgagaacgagaaggagaagccgaagucccggagcaagaaggccaccaacgccguggaccuguacgugugccugcucugcggguccggcaacgacgaggaccgccugcugcucugcgacgggugcgacgacagcuaccacaccuucugccugaucccgccccugcacgacguccccaagggcgacuggcgcugccccaagugccucgcgcaggagugcuccaagccccaggaggccuucggcuucgagcaggccgcccgggacuacacgcugcgcaccuucggggagauggccgacgcguucaagagcgacuacuucaacaugcccgugcacauggugcccaccgagcuggucgagaaggaguucuggcggcucguguccaccaucgaggaggacgugacggucgaguacggcgccgacaucgccagcaaggaguucggguccggcuucccggugcgcgacgggaagaucaagcugagccccgaggaggaggaguaccuggacuccggcuggaaccucaacaacaugcccgugauggagcagagcguccuggcccacaucaccgccgacaucugcggcaugaagcugcccuggcucuacguggggaugugcuucagcuccuucugcuggcacaucgaggaccacuggagcuacuccaucaacuaccugcacuggggcgagccgaagaccugguacggggugcccggcuacgcggccgagcagcuggagaacgucaugaagaagcucgcccccgagcuguucgugagccagcccgaccugcuccaccagcuggucaccaucaugaacccgaacacgcugaugacccacgaggugcccguguaccggaccaaccagugcgccggggaguucgucaucaccuucccccgcgcguaccacuccggcuucaaccagggcuucaacuucgccgaggccgugaacuucugcacgguggacuggcucccccuggggcggcagugcgucgagcacuaccgccugcugcaccgguacugcguguucagccacgacgagaugaucugcaagauggccuccaaggccgacgugcucgacgucgugguggcgagcaccguccagaaggacauggccaucaugaucgaggacgagaaggcccugcgcgagaccgugcggaagcugggcgugaucgacuccgagcgcauggacuucgagcuccugccggacgacgagcggcagugcgucaagugcaagaccacgugcuucaugagcgccaucuccugcagcugcaagcccgggcugcucgugugccugcaccacgugaaggagcugugcuccugcccgcccuacaaguacaagcuccgcuaccgguacacccuggacgaccuguaccccaugaugaacgcccucaagcugcgcgcggagagcuacaacgagugggcccugaacgucaacgaggcccucgaggccaagaucaacaagaagaagucccuggugagcuucaaggcccugaucgaggaguccgagaugaagaaguuccccgacaacgaccuccugcggcaccuccgccuggugacccaggacgcggagaagugcgccagcgucgcccagcagcugcugaacggcaagcggcagacccgcuaccgcuccgggggcggcaagagccagaaccagcucacggugaacgagcugcggcaguucgugacccagcuguacgcccuccccugcguccugagccagaccccgcugcucaaggaccugcugaaccgcguggaggacuuccagcagcacucccagaagcuccugagcgaggagacccccuccgcggccgagcugcaggaccuccuggacgugagcuucgaguucgacgucgagcugccccagcucgccgagaugcggauccgccuggagcaggcccgguggcuggaggaggugcagcaggccugccucgaccccuccagccugacccuggacgacaugcgccggcucaucgaccugggggugggccuggcgccguacuccgccgucgagaaggccauggcccgccuccaggagcugcugacggugagcgagcacugggacgacaaggccaagucccuccugaaggcgcggccccgccacagccugaacucccucgccaccgccgugaaggagaucgaggagauccccgccuaccugcccaacggggccgcgcugaaggacagcguccagcgggcccgcgacuggcuccaggacguggagggccugcaggccggcgggcgggugccgguccuggacacccucaucgagcuggugacccgcggccgguccauccccgugcaccugaacagccucccccgccuggagacgcuggucgccgaggugcaggcguggaaggagugcgccgugaacaccuuccucaccgagaacucccccuacagccugcuggagguccucugcccgcggugcgacaucgggcugcugggccucaagcgcaagcagcggaagcugaaggagccccugcccaacgggaagaagaaguccaccaagcucgagagccugagcgaccuggagcgcgcccucacggaguccaaggagaccgccagcgccauggcgacccugggcgaggcccggcugcgcgagauggaggcccuccagucccugcgccuggccaacgagggcaagcuccugagcccccugcaggacguggacaucaagaucugccucugccagaaggccccggcggcccccaugauccagugcgagcugugccgggacgccuuccacaccuccugcguggccguccccagcaucucccaggggcugcgcaucuggcucugcccccacugccggcgcagcgagaagccgccccuggagaagauccugccccuccuggccucccugcagcggauccgcgugcggcugcccgagggcgacgcgcuccgcuacaugaucgagcggacggugaacuggcagcaccgcgcccagcagcugcugagcuccgggaaccucaaguucguccaggaccgggugggcagcgggcugcuguacucccgcuggcaggccagcgccggccagguguccgacaccaacaaggucagccagccgcccggcaccaccuccuucagccuccccgacgacugggacaaccggacguccuaccugcacagccccuucagcaccgggcgcuccugcaucccgcugcacggcgugagccccgaggucaacgagcuccugauggaggcccagcugcuccaggugucccugcccgagauccaggagcuguaccagacccuccuggcgaagccgagccccgcccagcagaccgaccgguccagccccgugcgccccuccagcgagaagaacgacugcugccgggggaagcgcgacggcaucaacucccuggagcggaagcucaagcgccgccuggagcgggaggggcugagcuccgagcgcugggagcgggucaagaagaugcgcacgccgaagaagaagaagaucaagcucagccaccccaaggacaugaacaacuucaagcuggagcgggagcgcuccuacgagcuggugcggagcgccgagacccacucccuccccagcgacaccuccuacagcgagcaggaggacuccgaggacgaggacgccaucugccccgcggugagcugccugcagccggagggcgacgaggucgacugggugcagugcgacggcagcugcaaccagugguuccaccaggugugcgucggggugucccccgagauggccgagaaggaggacuacaucugcgugcgcugcaccgucaaggacgcccccagccggaaguga

SEQ ID NO: 31927 - RNA, 4140 nt, Artificial Sequence
  derived and/or modified sequence opt1 from KDM5C__Homo_sapiens__NP_001140174
auggagcccggcagcgacgacuuccugcccccgcccgagugccccguguucgagcccuccugggccgaguuccgcgacccccucggguacaucgccaagauccggcccaucgcggagaaguccggcaucugcaagauccggcccccggccaucgucguggaggagggcggguacgaggccaucugcaaggaccgccgcugggcccggguggcccagcgccugaacuacccgcccgggaagaacaucggcucccugcuccggagccacuacgagcgcaucgucuaccccuacgagauguaccaguccggcgcgaaccuggugcagugcaacacccggcccuucgacaacgaggagaaggacaaggaguacaagccccacagcaucccccugcgccaguccgugcagcccagcaaguucaacuccuacgggcggcgcgccaagcggcuccagccggaccccgagcccaccgaggaggacaucgagaagaaccccgagcugaagaagcugcagaucuacggcgccgggccgaagaugaugggccucgggcugauggccaaggacaagacccugcgcaagaaggacaaggagggccccgagugcccgcccaccgucguggugaaggaggagcucggcggggacgucaagguggagagcaccucccccaagaccuuccuggagagcaaggaggagcugucccacagccccgagcccugcacgaagaugaccaugcggcuccgccggaaccacuccaacgcgcaguucaucgagagcuacgugugccgcaugugcucccggggcgacgaggacgacaagcugcugcucugcgacgggugcgacgacaacuaccacaucuucugccugcugcccccgcuccccgagauccccaagggcgucuggcgcugcccgaagugcgugauggccgagugcaagcggccgcccgaggccuucggcuucgagcaggccacccgcgaguacacccugcagagcuucggggagauggccgacuccuucaaggcggacuacuucaacaugcccgugcacaugguccccacggagcugguggagaaggaguucuggcgccucgugaacagcaucgaggaggacgucaccguggaguacggcgccgacauccacagcaaggaguucggguccggcuuccccgugagcgacuccaagcggcaccugacccccgaggaggaggaguacgccaccagcggguggaaccugaacgucaugcccgugcucgagcaguccgugcugugccacaucaacgccgacaucagcggcaugaaggucccguggcuguacgugggcauggucuucuccgccuucugcuggcacaucgaggaccacuggagcuacuccaucaacuaccuccacuggggcgagcccaagacgugguacggggugcccagccuggcggccgagcaccuggaggaggugaugaagaagcucacccccgagcuguucgacagccagccggaccugcuccaccagcuggucacccugaugaaccccaacacccucaugagccacggggugcccgugguccgcacgaaccagugcgccggcgaguucgugaucaccuucccccgggccuaccacuccggguucaaccagggcuacaacuucgccgaggcggugaacuucugcaccgccgacuggcugccggccggccgccagugcaucgagcacuaccggcgccugcggcgcuacugcgucuucagccacgaggagcucaucugcaagauggccgccugccccgagaagcuggaccugaaccucgcggccgccgugcacaaggagauguucaucauggugcaggaggagcggcgccugcggaaggcccugcucgagaaggggaucaccgaggcggagcgcgaggccuucgagcugcugcccgacgacgagcggcagugcaucaagugcaagacgaccugcuuccuguccgcccucgccugcuacgacugccccgacggccuggucugccugagccacaucaacgaccucugcaagugcuccagcucccgccaguaccugcgguaccgcuacacccuggacgagcucccggccaugcugcacaagcugaaggugcgggcggagagcuucgacaccugggccaacaaggugcgcgucgcccucgagguggaggacgggcggaagcgcagccuggaggagcugcgcgcccucgaguccgaggcccgggagcgccgguuccccaacagcgagcugcugcagcagcucaagaacugccuguccgaggcggaggccugcgugagccgcgcccugggccucgucuccgggcaggaggccggcccccaccggguggccggccugcagaugacgcugaccgagcuccgcgcguuccuggaccagaugaacaaccugcccugcgccaugcaccagaucggggacgugaagggcguccucgagcaggucgaggccuaccaggccgaggcgcgggaggcccuggccagccugccguccagccccgggcuccugcagucccugcucgagcgcggccggcagcugggcguggaggugcccgaggcccagcagcugcagcgccagguggagcaggcccgguggcucgacgaggugaagcgcacccuggcgccgagcgcccggcgcgggacccuggccgucaugcggggccuccugguggccggggccuccguggcgcccagccccgccgucgacaaggcccaggccgagcugcaggagcuccugacgaucgccgagcgcugggaggagaaggcgcaccugugccucgaggcccggcagaagcacccgcccgccacccuggaggccaucauccgcgaggcggagaacauccccgugcaccuccccaacauccaggcccugaaggaggcccuggccaaggcccgggcguggaucgccgacguggacgagauccagaacggcgaccacuaccccugccuggacgaccucgaggggcuggucgccgugggccgcgaccugccggugggccucgaggagcugcggcagcuggagcuccagguccugaccgcccacuccuggcgcgagaaggccagcaagaccuuccugaagaagaacuccugcuacacgcuccuggaggugcugugccccugcgcggacgccgggagcgacuccaccaagcgcagccgguggauggagaaggagcucggccuguacaagagcgacaccgagcugcucgggcuguccgcccaggaccugcgcgaccccggcagcgugaucgucgccuucaaggagggggagcagaaggagaaggagggcauccuccagcugcggcgcaccaacuccgccaagcccagcccgcuggcguccagcuccacggccagcuccaccaccagcaucugcgugugcggccaggugcucgccggggccggcgcccugcagugcgaccugugccaggacugguuccacgggcggugcgucuccgugccccgccuccugagcagcccccggcccaacccgaccuccagcccccugcucgcguggugggagugggacaccaaguuccugugcccccugugcaugcgcucccggcgcccccggcucgagacgauccuggcccugcucguggcccugcagcgccugccgguccggcuccccgagggcgaggcccugcagugccugaccgagcgcgcgaucuccuggcaggggcgggcccgccaggcccucgccagcgaggacgugaccgcccugcugggccggcucgcggagcugcgccagcggcugcaggccgagccccgccccgaggagccgcccaacuaccccgccgcccccgccuccgacccgcuccgcgagggcagcgggaaggacaugcccaaggugcagggccugcuggagaacggggacagcgucaccucccccgagaagguggcgccggaggagggcagcgaccuggagcuccuguccagccugcucccccagcugacggggcccgugcuggagcuccccgaggccacccgggccccgcuggaggagcugaugauggagggcgaccuccuggaggucacccuggacgagaaccacuccauccccgagagccucgacuucugcauccugacgccccgcuacugcuccgaccugagcuccuggggccccgccccggggguguucccgcccugguga

SEQ ID NO: 31928 - RNA, 4713 nt, Artificial Sequence
  derived and/or modified sequence opt1 from KDM5D__Homo_sapiens__NP_001140177
auggagcccggcugcgacgaguuccugccgccgcccgagugccccguguucgagcccagcugggccgaguuccaggacccccucggguacaucgccaagauccgccccaucgcggagaaguccggcaucugcaagauccggcccccggccgacuggcagccgcccuucgccgucgagguggacaacuuccgcuucacgccccgggugcagcgccugaacgagcuggaggcccagacccgggucaagcucaacuaccuggaccagaucgccaaguucugggagauccaggggagcucccugaagauccccaacguggagcgcaagauccucgaccuguacagccuguccaagaucgugaucgaggagggcggguacgaggcgaucugcaaggaccggcgcugggcccgggucgcccagcgccuccacuacccgcccggcaagaacaucggcagccugcugcggucccacuacgagcgcaucaucuaccccuacgagauguuccagagcggggccaaccacgugcagugcaacacccaccccuucgacaacgaggugaaggacaaggaguacaagccccacuccaucccccuccggcagagcguccagcccuccaaguucagcuccuacagccgccgggcgaagcgccugcagccggaccccgagcccaccgaggaggacaucgagaagcaccccgagcugaagaagcuccagaucuacggcccggggcccaagaugaugggccuggggcugauggccaaggacaaggacaagaccgugcacaagaaggugaccugcccgcccacggucaccgugaaggacgagcaguccggcggcgggaacgugagcuccacccuccugaagcagcaccugagccucgagcccugcaccaagacgaccaugcagcugcggaagaaccacuccagcgcccaguucaucgacagcuacaucugccaggucugcucccgcggcgacgaggacgacaagcuccuguucugcgacgggugcgacgacaacuaccacaucuucugccugcugccgccccuccccgagaucccccggggcaucuggcgcugccccaagugcauccuggccgagugcaagcagcccccggaggccuucggcuucgagcaggcgacccaggaguacagccugcaguccuucggggagauggccgacagcuucaaguccgacuacuucaacaugcccgugcacauggugcccaccgagcucgucgagaaggaguucuggcggcuggugagcuccaucgaggaggacgugacggucgaguacggcgccgacauccacagcaaggaguucggguccggcuuccccgugagcaacuccaagcagaaccugagcccggaggagaagcgccagucccucaccgugcugacccgccugaucagcuccuucugggcccaggccguccucccgcccuggccgcccaaggugcuggggcugcaggaguacgcgaccagcggcuggaaccucaacgucaugcccgugcuggaccaguccgugcugugccacaucaacgccgacaucagcggcaugaagguccccuggcucuacguggggaugguguucuccgccuucugcuggcacaucgaggaccacuggagcuacagcaucaacuaccugcacuggggcgagcccaagacgugguacgggguccccucccuggccgccgagcaccucgaggaggugaugaagaugcugacccccgagcuguucgacagccagcccgaccuccugcaccagcuggugacccugaugaaccccaacacccucaugucccacggcgucccgguggugcggacgaaccagugcgcgggggaguucgucaucaccuucccccgcgccuaccacagcggcuucaaccagggcuacaacuucgccgaggccgugaacuucugcaccgccgacuggcugcccgcggggcggcagugcaucgagcacuaccgccggcugcgccgguacugcguguucucccacgaggagcucaucugcaagauggccgccuuccccgagacccuggaccugaaccucgccgucgcggugcacaaggagauguucaucauggugcaggaggagcgccggcugcgcaaggcccugcucgagaagggcgucacggaggccgagcgggaggccuucgagcugcugccggacgacgagcgccagugcaucaagugcaagacgaccugcuuccucagcgcccuggcgugcuacgacugccccgacgggcuggugugccucucccacaucaacgaccugugcaagugcagcuccagccggcaguaccugcgcuaccgguacacccucgacgagcugcccaccaugcugcacaagcucaagauccgcgccgaguccuucgacaccugggccaacaaggugcgggucgcccuggagguggaggacggccgcaagcggagcuucgaggagcugcgcgcccucgaguccgaggcgcgcgagcggcgcuucccgaacagcgagcugcugcagcggcucaagaacugccuguccgagguggaggccugcaucgcccagguccuggggcucgugagcggccagguggcccgcauggacacgccccagcugacccugaccgagcuccggguccugcuggagcagaugggcucccuccccugcgccaugcaccagaucggggacgugaaggacgugcuggagcaggucgaggcguaccaggccgaggcccgcgaggcccuggcgacccuccccagcagcccgggccugcugcggucccuccuggagcgcgggcagcagcugggcguggaggugcccgaggcccaccagcuccagcagcaggucgagcaggcccaguggcuggacgaggugaagcaggcccuggcccccagcgcgcaccggggcucccucgugaucaugcaggggcugcuggucaugggcgccaagaucgccagcucccccagcguggacaaggcccgcgccgagcuccaggagcugcugaccaucgcggagcggugggaggagaaggcccacuucugccucgaggcccgccagaagcacccgcccgccacccuggaggccaucauccgggagacggagaacauccccgugcaccuccccaacauccaggcgcugaaggaggcccugaccaaggcccaggccuggaucgcggacgucgacgagauccagaacggggaccacuacccgugccuggacgaccucgagggccugguggccguggggcgcgaccugcccgucggccucgaggagcugcggcagcuggagcuccaggugcugaccgcccacuccuggcgcgagaaggccagcaagaccuuccugaagaagaacuccugcuacacccuccuggaggugcugugccccugcgccgacgcgggcagcgacuccacgaagcggagccgcuggauggagaaggcccucgggcuguaccagugcgacaccgagcugcucggccuguccgcccaggaccugcgggaccccgggagcgucaucguggccuucaaggagggcgagcagaaggagaaggaggggauccuccagcugcgccggaccaacuccgccaagccgagcccccuggcgcccucccucauggccagcucccccaccagcaucugcgugugcggccaggucccggccggcgugggggugcugcagugcgaccugugccaggacugguuccacggccagugcgucagcgugccccaccuccugacgucccccaagcccagccugaccuccagcccgcuccuggccuggugggagugggacaccaaguuccugugcccccucugcaugcgcucccgccggccccgccuggagaccauccuggcccuccuggucgcgcugcagcggcugcccgugcgccucccggagggggaggcccugcagugccugacggagcgggccaucggcuggcaggaccgcgcccggaaggcccucgcgagcgaggacgugaccgcccugcugcgccagcucgccgagcugcggcagcagcugcaggccaagccccgccccgaggaggcguccgucuacaccagcgccaccgccugcgacccgauccgggagggguccggcaacaacaucagcaaggugcagggccuccuggagaacggggacuccgugacgagccccgagaacauggcccccggcaagggguccgaccuggagcuccugagcucccugcucccccagcugaccggcccgguccuggagcuccccgaggccauccgcgcgccccuggaggagcugaugauggagggggaccuccuggaggugacccuggacgagaaccacagcaucuggcagcuccugcaggccggccagcccccggaccuggaccggauccgcacccuccuggagcuggagaaguucgagcaccagggcucccggacgcgcagccgggcccucgagcgccggcgccgccggcagaagguggaccaggggcgcaacgucgagaaccuggugcagcaggagcugcaguccaagcgggcccgcagcagcggcaucaugucccagguggggcgggaggaggagcacuaccaggagaaggccgaccgcgagaacauguuccucacccccagcaccgaccacucccccuuccugaagggcaaccagaacagccugcagcacaaggacuccggcagcuccgcggccugccccagccucaugccgcugcugcagcucuccuacagcgacgagcagcagcuguga

SEQ ID NO: 31929 - RNA, 4362 nt, Artificial Sequence
  derived and/or modified sequence opt1 from KDM6A__Homo_sapiens__NP_001278344
augaaguccugcggcgugucccuggccaccgccgcggccgccgccgccgcguucggggacgaggagaagaagauggccgccggcaaggccagcggggaguccgaggaggcgagccccucccucaccgccgaggagcgcgaggcccugggcgggcuggacagccgccucuucggcuucguccgcuuccacgaggacggcgcccggacgaaggcccugcuggggaaggcggugcgcugcuacgagucccucauccugaaggccgagggcaagguggagagcgacuucuucugccagcuggggcacuucaaccuccugcuggaggacuaccccaaggcccucuccgccuaccagcgguacuacagccugcaguccgacuacuggaagaacgccgcguuccuguacggccucgggcuggucuacuuccacuacaacgccuuccagugggccaucaaggccuuccaggaggugcuguacguggaccccagcuucugccgcgccaaggagauccaccuccggcugggccugauguucaaggucaacaccgacuacgaguccagccucaagcacuuccagcuggcgcugguggacugcaaccccugcacccucuccaacgccgagauccaguuccacaucgcccaccuguacgagacccagcgcaaguaccacagcgccaaggaggccuacgagcagcugcuccagacggagaaccuguccgcccaggugaaggccaccguccugcagcagcucggcuggaugcaccacaccguggaccugcugggggacaaggccaccaaggagagcuacgccauccaguaccuccagaagucccuggaggcggaccccaacagcggccagagcugguacuuccuggggcggugcuacuccagcaucggcaaggugcaggacgccuucaucuccuaccgccagagcaucgacaaguccgaggccagcgccgacacguggugcuccaucggcguccucuaccagcagcagaaccagccgauggacgcccugcaggcguacaucugcgccgugcagcuggaccacgggcacgccgccgccuggauggaccucggcacccuguacgagagcugcaaccagccccaggacgcgaucaagugcuaccugaacgccacccgguccaagagcugcuccaacaccagcgcccucgccgcccgcaucaaguaccugcaggcgcagcugugcaaccucccccaggggucccugcagaacaagacgaagcugcuccccagcaucgaggaggccuggucccugccgauccccgccgagcugaccagccggcagggcgccaugaacaccgcgcagcaggccugcaagccccaccaccccaacaccgagccggugcuggggcucucccagacgcccaucagccagcagucccugccccugcacaugauccccagcagccaggucgacgaccucuccagcccggccaagcggaagcggaccagcagccccaccaagaacaccuccgacaacuggagcggcggccacgcggugucccacccgcccgugcagcagcaggcccacagcuggugccugacgccccagaagcugcagcaccucgagcagcugcgcgcgaaccggaacaaccugaaccccgcccagaagcucaugcuggagcagcuggagucccaguucgugcucaugcagcagcaccagaugcgccccaccgggguggcccaggugcggagcaccggcauccccaacgggccgaccgccgacuccagccugcccacgaacuccgucagcggccagcagccccagcuggcccucacccgcgugcccuccgugagccagccggggguccggcccgcgugccccggccagccgcuggccaacggccccuucuccgccgggcacgugcccugcagcaccagccgcacccugggcuccacggacaccauccucaucgggaacaaccacaucaccggcagcggguccaacggcaacguccccuaccugcagcgcaacgcccugacccucccgcacaaccggacgaaccugaccagcuccgccgaggagcccuggaagaaccagcugagcaacuccacccagggccuccacaaggggcagagcucccacagcgcgggccccaacggggagcgcccccuguccagcaccggcccgucccagcaccuccaggccgccggcagcgggauccagaaccagaacggccaccccacgcugcccuccaacagcgugacccagggggccgcgcugaaccaccuguccagccacaccgccaccuccggcgggcagcagggcaucacccucacgaaggagagcaagcccagcggcaacauccugaccgugccggagaccucccggcacaccggggagacgcccaacagcaccgccuccgucgagggccugcccaaccacgugcaccagaugaccgccgacgccgugugcagccccucccacggggacagcaaguccccgggccuccugagcuccgacaacccccagcugagcgcgcuccugauggggaaggccaacaacaacgucggcaccggcacgugcgacaaggugaacaacauccaccccgccgugcacaccaagaccgacaacuccgucgccagcucccccagcuccgccaucagcaccgcgacgccgucccccaagagcaccgagcagaccaccacgaacuccgugaccagccugaacagcccccacuccgggcuccacaccaucaacggcgaggggauggaggagagccagucccccaugaagaccgaccugcugcucgugaaccacaagccgagcccccagaucauccccuccaugagcgucuccaucuacccgagcuccgccgaggugcugaaggccugccgcaaccugggcaagaacgggcucagcaacuccagcauccugcuggacaagugcccgccgccccggccgcccuccagccccuacccgccccuccccaaggacaagcugaacccgcccacgcccuccaucuaccuggagaacaagcgcgacgccuucuucccgccccuccaccaguucugcaccaaccccaacaaccccgugaccgucauccggggccuggccggcgcgcugaagcucgaccuggggcuguucagcaccaagacgcucguggaggccaacaacgagcacaugguggagguccgcacccagcugcugcagcccgccgacgagaacugggaccccaccggcaccaagaagaucuggcacugcgaguccaaccggagccacacgaccaucgccaaguacgcccaguaccaggcguccagcuuccaggagagccuccgcgaggagaacgagaagcggucccaccacaaggaccacagcgacuccgagagcaccuccagcgacaacuccgggcgccggcgcaagggccccuucaagaccaucaaguucgggacgaacaucgaccugagcgacgacaagaaguggaagcugcagcuccacgagcugaccaagcugcccgccuucgugcggguggucuccgccggcaaccuccugagccacgugggccacaccauccuggggaugaacaccgugcagcucuacaugaagguccccggcucccgcacgcccgggcaccaggagaacaacaacuucugcagcgugaacaucaacaucggccccggcgacugcgagugguucgugguccccgagggguacuggggcgugcugaacgacuucugcgagaagaacaaccugaacuuccucaugggguccugguggcccaaccuggaggaccuguacgaggccaacgugcccgucuaccgguucauccagcgccccggcgaccucguguggaucaacgcggggaccgugcacuggguccaggccaucggcuggugcaacaacaucgccuggaacgugggcccgcugaccgccugccaguacaagcuggccguggagcgguacgaguggaacaagcuccagagcgucaaguccaucgugcccauggugcaccugagcuggaacauggcgcgcaacaucaaggucuccgaccccaagcuguucgagaugaucaaguacugccuccugcgcacccugaagcagugccagacccuccgggaggcccugaucgccgccgggaaggagaucaucuggcacggccgcacgaaggaggagccggcccacuacugcagcaucugcgagguggagguguucgaccuccuguucgucaccaacgaguccaacagccggaagaccuacaucgugcacugccaggacugcgcgcgcaagaccagcgggaaccuggagaacuucgugguccuggagcaguacaagauggaggaccucaugcaggucuacgaccaguucacgcuggccccgccccugcccuccgccagcuccuga

SEQ ID NO: 31930 - RNA, 5049 nt, Artificial Sequence
  derived and/or modified sequence opt1 from KDM6B__Homo_sapiens__NP_001073893
augcaccgcgccguggaccccccgggcgcccgggcggcccgcgaggccuucgcccuggggggccucagcugcgccggggcgugguccagcugccccccccaccccccgccccgguccgccuggcugcccggcgggcgcugcagcgccuccaucggccagcccccgcugcccgccccccuccccccgagccacggcuccagcuccgggcaccccagcaagcccuacuacgcgcccggcgccccgaccccccggccccugcacgggaagcuggagucccuccacggcugcguccaggcccugcugcgcgagcccgcccagccggggcucugggagcagcugggccagcuguacgagagcgagcacgacuccgaggaggccacccggugcuaccacagcgcgcuccgcuacggcggguccuucgccgagcugggcccccggaucgggcgccugcagcaggcccagcucuggaacuuccacacgggcagcugccagcaccgggccaaggugcugcccccccuggagcagguguggaaccuccugcaccuggagcacaagcgcaacuacggcgccaagcgggggggcccgcccgucaagcgcgcggccgagccccccguggugcagccggucccccccgccgcccucuccgggccgagcggcgaggaggggcugucccccggcggcaagcggcgccgggggugcaacagcgagcagaccggccugccccccgggcucccgcugcccccccccccgcugcccccccccccgcccccccccccgcccccccccccgccccuccccggccuggccaccagccccccguuccagcugaccaagcccgggcucugguccacgcugcacggcgacgcguggggccccgagcgcaaggggagcgccccgcccgagcggcaggagcagcgccacucccugccccaccccuacccguaccccgcccccgccuacaccgcccaccccccgggccaccggcucgugcccgcggccccccccgggccgggcccccgcccccccggggccgagagccacggcugccugccggccacccgcccccccggcuccgaccugcgggagagccgcgugcagcggucccgcauggacagcuccgucagccccgcggccaccacggccugcgugccguacgcccccucccggccccccgggcucccgggcaccaccaccagcuccagcuccagcuccagcuccaacacggggcugcgcggcguggagcccaaccccggcauccccggggccgaccacuaccagaccccggcgcuggaggucagccaccacggccggcucgggcccagcgcccacuccagccgcaagcccuuccugggcgccccggccgccaccccccaccugucccucccccccgggccgagcucccccccccccccgcccugcccccggcugcugcgccccccgcccccccccgcguggcucaagggcccggccugccgggccgcccgcgaggacggcgagauccuggaggagcuguucuucgggaccgagggccccccccggcccgccccgcccccccucccccaccgcgagggguuccugggcccgcccgcgagccgguucuccguggggacgcaggacagccacaccccccccaccccgcccacccccacgaccuccagcuccaacagcaacuccggcagccacuccagcuccccggccggccccgugagcuucccccccccgcccuaccuggcccgcagcaucgacccccugccccggccgcccucccccgcccagaacccccaggacccgccccucgucccccugacccuggcgcuccccccggccccccccagcuccugccaccagaacaccagcggguccuuccgccggcccgagagcccgcgcccccgcguguccuuccccaagacgcccgaggugggcccggggccccccccgggcccccugagcaaggccccccagcccgucccgcccggggugggcgagcugcccgcccggggcccccgccucuucgacuucccgcccaccccccuggaggaccaguucgaggagcccgccgaguucaagauccugccggacgggcucgcgaacaucaugaagaugcuggacgaguccauccggaaggaggaggagcagcagcagcacgaggccggcguggccccccagcccccccugaaggagccguucgccagccuccagucccccuuccccaccgacaccgcccccacgaccaccgcgccggccgucgccgugaccacgaccaccaccacgaccaccaccaccacggccacccaggaggaggagaagaagcccccccccgcccugccgcccccccccccgcuggcgaaguucccccccccgagccagccccagccccccccgcccccccccccgucccccgccagccuccugaagucccuggccagcgugcucgaggggcagaaguacugcuaccgcggcaccggggccgcggucuccacccggcccggcccccugccgacgacccaguacagccccggcccccccuccggggccaccgcccugccgcccaccagcgccgcccccagcgcgcagggcuccccccagccgagcgccuccagcuccagccaguucuccacgagcgggggccccugggcccgcgagcggcgcgccggcgaggagcccgugcccgggccgaugacccccacccagccccccccgccccucucccugcccccggcccggagcgaguccgagguccuggaggagaucagccgcgcgugcgagacccucguggagcgggugggccgcuccgccacggaccccgccgaccccgucgacaccgccgagcccgccgacagcgggaccgagcggcugcugccgcccgcgcaggccaaggaggaggccggcgggguggccgccguguccggcagcugcaagcgccggcagaaggagcaccagaaggagcaccgccggcaccgccgggcgugcaaggacuccgucggccgccggccccgcgaggggcgcgccaaggccaaggccaaggugcccaaggagaagagccggcgcgugcucggcaaccuggaccugcaguccgaggagauccaggggcgggagaagagccgcccggaccucggcggggcgagcaaggccaagccccccaccgcccccgccccgcccuccgcccccgcgcccagcgcccagccgacgccccccuccgccagcguccccggcaagaaggcccgggaggaggccccgggcccccccggggugucccgcgcggacaugcugaagcugcggagccucuccgagggccccccgaaggagcugaagauccgccugaucaagguggagagcggggacaaggagaccuucaucgccuccgaggucgaggagcggcgccuccggauggccgaccugaccaucagccacugcgccgccgacguggugcgcgcgucccggaacgccaaggucaagggcaaguuccgcgagagcuaccugucccccgcccagagcgugaagcccaagaucaacaccgaggagaagcucccccgggagaagcugaacccgcccacgcccuccaucuaccuggagagcaagcgcgacgccuucuccccggugcuccugcaguucugcaccgacccccggaaccccaucaccgucauccgcgggcuggcgggcagccuccggcugaaccugggccucuucuccaccaagacgcugguggaggccagcggggagcacaccguggagguccgcacccaggugcagcagcccagcgacgagaacugggaccugaccggcacgcgccagaucuggccgugcgaguccagccggucccacaccaccaucgccaaguacgcccaguaccaggccagcuccuuccaggagagccuccaggaggagaaggaguccgaggacgaggagagcgaggagcccgacuccaccacggggaccccccccagcuccgcgccggaccccaagaaccaccacaucaucaaguucggcaccaacaucgaccugagcgacgccaagcgcuggaagccccagcugcaggagcuccugaagcugcccgccuucaugcgggugaccuccacgggcaacaugcucagccacgucgggcacaccauccugggcaugaacaccgugcagcuguacaugaaggugccggggucccgcacccccggccaccaggagaacaacaacuucugcagcgucaacaucaacaucgggcccggcgacugcgagugguucgccgugcacgagcacuacugggagaccaucuccgccuucugcgaccggcacggcguggacuaccucacggggagcugguggcccauccuggacgaccuguacgcguccaacaucccggucuaccgcuucgugcagcggcccggcgaccucguguggaucaacgccgggaccguccacugggugcaggccaccggcuggugcaacaacaucgccuggaacguggggccccugaccgccuaccaguaccagcuggcgcucgagcgcuacgaguggaacgaggucaagaacgugaagagcaucgugcccaugauccacgucagcuggaacguggcccggacggugaagaucuccgacccggaccuguucaagaugaucaaguucugccugcuccagagcaugaagcacugccagguccagcgcgagucccuggugcgggccggcaagaagaucgccuaccagggccgcgugaaggacgagcccgcguacuacugcaacgagugcgacgucgagguguucaacauccuguucgugaccagcgagaacgggucccggaacaccuaccucguccacugcgagggcugcgcccgccggcgcagcgccgggcugcagggcguggugguccuggagcaguaccggaccgaggagcucgcccaggccuacgacgcguucacgcuggugcgcgcccggcgcgcccgggggcagcgccgccgggcccugggccaggccgcgggcaccggguucggcucccccgccgcccccuucccggagccccccccggccuucagcccccaggcccccgcguccaccagccgcuga

SEQ ID NO: 31931 - RNA, 4071 nt, Artificial Sequence
  derived and/or modified sequence opt1 from KDR__Homo_sapiens__NP_002244
augcagagcaaggugcugcucgccgucgcccuguggcugugcguggagacccgcgcggccuccgugggccuccccagcgucucccuggaccugccccggcucagcauccagaaggacauccugaccaucaaggccaacacgacccugcagaucacgugccgcgggcagcgggaccucgacuggcuguggcccaacaaccaguccggcagcgagcagcgcguggaggugaccgagugcuccgacgggcuguucugcaagacccucaccauccccaaggucaucggcaacgacaccggggccuacaagugcuucuaccgggagaccgaccuggccagcgugaucuacguguacguccaggacuaccgcucccccuucaucgcgagcguguccgaccagcacggcguggucuacaucacggagaacaagaacaagaccguggugaucccgugccugggcagcaucuccaaccucaacgucagccugugcgcccgguaccccgagaagcgcuucgugcccgacgggaaccggaucuccugggacagcaagaagggcuucaccauccccuccuacaugaucagcuacgccgggaugguguucugcgaggccaagaucaacgacgaguccuaccagagcaucauguacaucgucgugguggucggcuaccgcaucuacgacguggugcugagcccgucccacgggaucgagcucagcgucggcgagaagcuggugcugaacugcaccgcgcggacggagcucaacgucggcaucgacuucaacugggaguaccccuccagcaagcaccagcacaagaagcuggugaaccgcgaccugaagacccaguccgggagcgagaugaagaaguuccucuccacccugaccaucgacggcgugacgcggagcgaccaggggcuguacacgugcgccgccuccagcggccucaugaccaagaagaacuccaccuucguccgcgugcacgagaagcccuucguggccuucggcagcgggauggagucccuggucgaggccaccgugggcgagcgggugcgcauccccgcgaaguaccugggguacccgccgcccgagaucaagugguacaagaacggcaucccccucgagagcaaccacaccaucaaggccgggcacguccugaccaucauggagguguccgagcgggacaccggcaacuacacggugauccugaccaacccgaucagcaaggagaagcagucccacgucgugagccucguggucuacgugccgccccagaucggcgagaagucccugaucagccccguggacagcuaccaguacgggaccacccagacgcugaccugcaccgucuacgccaucccgccgccccaccacauccacugguacuggcagcucgaggaggagugcgccaacgagcccucccaggccgugagcgugaccaaccccuaccccugcgaggaguggcgcuccgucgaggacuuccagggcgggaacaagaucgaggugaacaagaaccaguucgcgcugaucgagggcaagaacaagacggugagcacccuggucauccaggccgccaacguguccgcccucuacaagugcgaggccgugaacaaggucgggcggggcgagcgcgugaucagcuuccacgugacccggggccccgagaucacccugcagcccgacaugcagcccacggagcaggaguccgucagccuguggugcaccgcggaccgcuccaccuucgagaaccucaccugguacaagcuggggccccagccccugccgauccacgugggcgagcuccccacccccgugugcaagaaccuggacacgcuguggaagcucaacgccaccauguucagcaacuccaccaacgacauccugaucauggagcugaagaacgccagccugcaggaccagggggacuacgucugccucgcccaggaccgcaagaccaagaagcggcacugcguggugcgccagcugacgguccuggagcggguggcccccaccaucaccggcaaccucgagaaccagaccacguccaucggggagagcaucgagguguccugcaccgcgagcggcaacccgccgccccagaucaugugguucaaggacaacgagacccuggucgaggacuccggcaucgugcugaaggacgggaaccgcaaccucaccauccggcgcgugcggaaggaggacgagggccuguacacgugccaggccugcagcguccuggggugcgccaagguggaggccuucuucaucaucgagggcgcgcaggagaagaccaaccucgagaucaucauccuggugggcaccgccgucaucgccauguucuucuggcugcuccuggugaucauccugcgcaccgugaagcgggccaacgggggcgagcucaagacgggguaccugagcaucgucauggaccccgacgagcugccccucgacgagcacugcgagcgccugcccuacgacgccuccaagugggaguucccccgggaccgccugaagcucggcaagccccuggggcggggcgcguucggccaggugaucgaggccgacgccuucgggaucgacaagaccgcgaccugccgcaccguggccgucaagaugcugaaggagggcgccacgcacagcgagcaccgggcccucauguccgagcugaagauccugauccacaucgggcaccaccucaacguggucaaccugcugggcgccugcaccaagcccgggggcccccucauggugaucguggaguucugcaaguucggcaaccugagcaccuaccugcgcuccaagcggaacgaguucguccccuacaagaccaagggggcccgcuuccggcagggcaaggacuacgugggggccauccccguggaccucaagcgccgccuggacagcaucacguccagccaguccagcgcguccagcggcuucgucgaggagaagucccugagcgacguggaggaggaggaggccccggaggaccucuacaaggacuuccugacccuggagcaccucaucugcuacuccuuccagguggccaaggggauggaguuccuggccagccggaagugcauccaccgcgaccuggcggcccggaacauccuccuguccgagaagaacgucgugaagaucugcgacuucggccuggcccgcgacaucuacaaggaccccgacuacgugcggaagggcgacgcccgccucccccugaaguggauggcccccgagaccaucuucgaccgggucuacaccauccagagcgacgugugguccuucggggugcugcucugggagaucuucagccugggcgcgagcccguaccccggggucaagaucgacgaggaguucugccgccggcugaaggagggcacgcgcaugcgggcccccgacuacaccacccccgagauguaccagaccaugcucgacugcuggcacggggagccgucccagcgccccacguucagcgagcugguggagcaccugggcaaccuccugcaggccaacgcccagcaggacggcaaggacuacaucgugcugcccaucuccgagacccucagcauggaggaggacuccgggcugagccugccgaccucccccgucagcugcauggaggaggaggaggugugcgaccccaaguuccacuacgacaacaccgccggcaucucccaguaccuccagaacagcaagcggaagucccgccccgugagcgucaagacguucgaggacaucccgcuggaggagcccgaggugaaggugauccccgacgacaaccagaccgacuccgggaugguccuggcgagcgaggagcucaagacccuggaggaccggaccaagcugucccccagcuucggcggcauggugccguccaagagccgcgaguccguggccagcgaggggagcaaccagaccuccggcuaccagagcggguaccacuccgacgacacggacaccaccgucuacagcuccgaggaggccgagcuccugaagcugaucgagaucggcgugcagaccgggagcacggcccagauccuccagcccgacuccggcaccacccugagcuccccgcccguguga

SEQ ID NO: 31932 - RNA, 999 nt, Artificial Sequence
  derived and/or modified sequence opt1 from KDSR__Homo_sapiens__NP_002026
augcugcuccuggccgccgcguuccugguggccuucguccuccugcuguacauggugagcccccucaucagcccgaagccccuggcccugcccggcgcccacguggucgugaccgggggcagcuccgggaucggcaagugcaucgccaucgagugcuacaagcagggggcguucaucacccucguggcccgcaacgaggacaagcugcugcaggccaagaaggagaucgagaugcacagcaucaacgacaagcaggucgugcucugcaucuccguggacgucagccaggacuacaaccagguggagaacgugaucaagcaggcccaggagaagcugggccccgucgacaugcuggugaacugcgcgggcauggccguguccgggaaguucgaggaccucgaggucagcacguucgagcggcugauguccaucaacuaccugggcagcguguacccgucccgcgccgugaucaccaccaugaaggagcggcgcgucgggcggaucguguucgugagcucccaggccggccagcucgggcuguucggcuucaccgccuacagcgcguccaaguucgccauccgcggccuggccgaggcccuccagauggaggucaagcccuacaacguguacaucacgguggccuacccgcccgacaccgacacccccggguucgcggaggagaaccggaccaagccccuggagacgcgccugaucagcgagaccaccuccgucugcaagcccgagcaggucgccaagcagaucgugaaggacgccauccagggcaacuucaacagcucccucgggagcgacggcuacaugcugagcgcccugaccugcggcauggcccccgugacguccaucaccgaggggcuccagcaggucgugaccaugggccuguuccggaccaucgcgcuguucuaccucgggagcuucgacuccaucgugcgccggugcaugaugcagcgcgagaaguccgagaacgccgacaagacggccuga

SEQ ID NO: 31933 - RNA, 1875 nt, Artificial Sequence
  derived and/or modified sequence opt1 from KEAP1__Homo_sapiens__NP_036421
augcagcccgacccgcgccccagcggcgccggggccugcugccgguuccugccccuccagucccagugccccgagggcgcgggggacgccgugauguacgccagcaccgagugcaaggccgaggucaccccgucccagcacggcaaccgcacguucagcuacacccuggaggaccacaccaagcaggccuucgggaucaugaacgagcugcggcucucccagcagcugugcgacgugacccuccaggugaaguaccaggacgcgcccgccgcccaguucauggcccacaaggucgugcuggcgagcuccagccccguguucaaggccauguucacgaacggccugcgcgagcagggcauggaggucguguccaucgaggggauccaccccaaggugauggagcggcugaucgaguucgccuacaccgccagcaucuccaugggcgagaagugcguccuccacgugaugaacggggccgugauguaccagaucgacagcgucgugcgcgcgugcuccgacuuccuggugcagcagcuggacccgagcaacgccaucggcaucgccaacuucgccgagcagaucgggugcgucgagcuccaccagcgggcccgcgaguacaucuacaugcacuucggcgagguggcgaagcaggaggaguucuucaaccugucccacugccagcuggugacccucaucagccgggacgaccugaacguccgcugcgaguccgagguguuccacgccugcaucaacugggugaaguacgacugcgagcagcggcgcuucuacguccaggcccugcuccgggccgugcgcugccacagccugacccccaacuuccugcagaugcagcuccagaagugcgagauccugcaguccgacagccggugcaaggacuaccuggugaagaucuucgaggagcucacgcugcacaagcccacccaggucaugcccugccgcgccccgaaggugggccggcugaucuacaccgccgggggcuacuuccgccagagccucuccuaccuggaggcguacaaccccagcgacgggaccuggcugcggcucgccgaccugcaggucccccgcuccggccuggccggcugcguggugggcgggcuccuguacgccgucgggggccggaacaacagccccgacgggaacacggacuccagcgcgcuggacugcuacaacccgaugaccaaccaguggucccccugcgcccccaugagcgugccccgcaaccgcaucggcgugggcgucaucgacgggcacaucuacgccgugggcgggucccacggcugcauccaccacaacagcguggagcgguacgagccggagcgcgacgaguggcaccucgucgcccccaugcugacccggcgcaucggggugggcguggcgguccugaaccggcuccuguacgccgugggcggguucgacggcaccaaccgccugaacuccgccgagugcuacuaccccgagcggaacgaguggcgcaugaucacggccaugaacaccauccggagcggggccggcgugugcguccuccacaacugcaucuacgcggccgggggcuacgacggccaggaccagcugaacuccguggagcgcuacgacguggagaccgagaccuggacguucgucgcccccaugaagcaccggcgcagcgcccuggggaucaccgugcaccagggccggaucuacgugcucgggggcuacgacggccacaccuuccuggacuccgucgagugcuacgacccggacaccgacacguggagcgaggugacccgcaugaccuccgggcggagcggcgugggggucgccgugaccauggagcccugccgcaagcagaucgaccagcagaacugcacgugcuga

SEQ ID NO: 31934 - RNA, 2199 nt, Artificial Sequence
  derived and/or modified sequence opt1 from KEL__Homo_sapiens__NP_000411
auggagggcggggaccagagcgaggaggagccccgcgagcggucccaggccggcgggaugggcacccuguggagccaggaguccaccccggaggagcgccuccccguggaggggagccggcccugggccgucgcgcgccgggugcugacggccauccugauccucggccugcugcucugcuucuccgugcugcuguucuacaacuuccagaacugcggcccccgcccgugcgagaccagcgucugccucgaccugcgggaccacuaccuggccuccgggaacaccagcguggcccccugcaccgacuucuucuccuucgccugcggccgcgcgaaggagacgaacaacagcuuccaggagcucgccaccaagaacaagaaccggcugcgccggauccuggaggugcagaacuccuggcaccccgggagcggcgaggagaaggccuuccaguucuacaacuccugcauggacacccucgccaucgaggcggccgggaccggcccccugcgccaggucaucgaggagcugggcggguggcggaucagcggcaaguggacgucccucaacuucaaccgcacccugcggcugcucaugagccaguacgggcacuucccguucuuccgcgccuaccugggcccccaccccgccagcccccacaccccggugauccagaucgaccagcccgaguucgacgugccccugaagcaggaccaggagcagaagaucuacgcccagaucuuccgggaguaccucaccuaccugaaccagcugggcacgcuccucgggggcgaccccuccaagguccaggagcacuccagccugagcaucuccaucaccagccgccucuuccaguuccugcggccgcuggagcagcgccgggcgcaggggaagcuguuccagauggugaccaucgaccagcugaaggagauggcccccgccaucgacuggcuguccugccuccaggccaccuucacgcccaugagccugucccccagccagucccuggugguccacgacguggaguaccucaagaacaugagccagcugguggaggagaugcugcucaagcagcgcgacuuccugcagucccacaugauccugggccucgucgugacccugagcccggcccuggacucccaguuccaggaggcgcgccggaagcucagccagaagcugcgcgagcugaccgagcagccgcccaugcccgcccggccccgcuggaugaagugcguggaggagaccgggacguucuucgagcccacccuggccgcccucuucguccgggaggccuucggccccuccacccgcagcgcggccaugaagcuguucaccgccauccgggacgcccugaucacgcgccuccggaaccugcccuggaugaacgaggagacccagaacauggcccaggacaagguggcgcagcuccagguggagaugggcgccuccgagugggcccugaagccggagcuggcccgccaggaguacaacgacauccagcuggggagcuccuuccuccagagcguccuguccugcgugcggagccugcgcgcgcggaucgugcagagcuuccuccagccccacccccagcaccgcuggaaggucuccccgugggacgugaacgccuacuacagcgucuccgaccacgugguggucuuccccgccggccugcugcagccgcccuucuuccaccccggguacccccgggccgugaacuucggcgccgcggggagcaucauggcccacgagcuccugcacaucuucuaccagcugcuccugcccggcggcugccuggccugcgacaaccacgcccuccaggaggcccaccugugccugaagcgccacuacgcggccuucccccucccgucccggaccagcuucaacgacucccugaccuuccuggagaacgccgccgacgucgggggccucgccaucgcgcugcaggccuacagcaagcgccugcuccggcaccacggggagacggugcugcccucccuggaccucagcccccagcagaucuucuuccgcuccuacgcccaggugaugugccgcaagcccagcccgcaggacucccacgacacccacagcccgccccaccuccgggugcacggcccccuguccagcacccccgccuucgcgcgcuacuuccggugcgcccgcggggcccugcugaaccccuccagccggugccagcugugguga

SEQ ID NO: 31935 - RNA, 1059 nt, Artificial Sequence
  derived and/or modified sequence opt1 from KERA__Homo_sapiens__XP_011536083
auggccggcaccaucugcuucaucaugugggugcuguucaucaccgacacggucuggagccgcuccgugcgccagguguacgagguccacgacagcgacgacuggaccauccacgacuucgagugccccauggagugcuucugcccgcccuccuuccccaccgcccucuacugcgagaaccgggggcugaaggagauccccgcgaucccgagccggaucugguaccuguaccuccagaacaaccugaucgagaccauccccgagaagcccuucgagaacgccacgcagcugcgcuggaucaaccucaacaagaacaagaucaccaacuacggcaucgagaagggggcccugucccagcugaagaagcuccuguuccuguuccucgaggacaacgagcuggaggaggugcccagcccgcugccccggucccucgagcagcugcagcuggcccgcaacaaggugagccggaucccccagggcaccuucuccaaccucgagaaccugacccugcucgaccugcagaacaacaagcuggucgacaacgccuuccagcgcgacacguucaaggggcucaagaaccugaugcagcugaacauggcgaagaacgcccuccggaacaugcccccgcgccugcccgccaacaccaugcagcuguuccucgacaacaacagcaucgagggcauccccgagaacuacuucaacgugauccccaagguggccuuccugcggcugaaccacaacaagcucuccgacgagggccugccgagccgcggguucgacgucuccagcauccuggaccuccagcugucccacaaccagcugaccaaggugccccggaucagcgcgcaccuccagcaccuccaccuggaccacaacaagaucaaguccgugaacgucagcgugaucugccccucccccagcaugcugccggccgagcgcgacagcuucuccuacggcccccaccuccgguaccugcgccuggacgggaacgagaucaagccgcccauccccauggcccugaugaccugcuuccggcugcuccaggccgugaucaucuga

SEQ ID NO: 31936 - RNA, 654 nt, Artificial Sequence
  derived and/or modified sequence opt1 from KHDC3L__Homo_sapiens__NP_001017361
auggacgcgccccgccgguucccgacccuggugcagcucaugcagcccaaggccaugcccgucgaggugcugggccaccuccccaagcgcuucagcugguuccacuccgaguuccugaagaacccgaaggugguccggcuggagguguggcugguggagaagaucuucgggcgcggcggggagcggaucccccacguccagggcaugagccagauccucauccacgugaaccgccuggaccccaacggggaggccgagauccugguguucggccggcccuccuaccaggaggacaccaucaagaugaucaugaaccucgccgacuaccaccgccagcugcaggccaagggcagcgggaaggcccuggcccaggacgucgcgacgcagaaggccgagacccagcgguccagcaucgaggugcgcgaggccggcacccagcgguccguggagguccgcgaggccgggacccagcggagcguggaggugcaggaggucggcacgcagggguccccgguggaggugcaggaggcgggcacccagcagagccuccaggccgccaacaaguccggcacccagcgcagccccgaggccgccuccaaggcggucacccagcgguuccgcgaggacgcccgggaccccgugacgcgccuguga

SEQ ID NO: 31937 - RNA, 1050 nt, Artificial Sequence
  derived and/or modified sequence opt1 from KHDRBS2__Homo_sapiens__NP_689901
auggaggaggagaaguaccugcccgagcucauggccgagaaggacagccuggaccccuccuucgugcacgccagccgccugcucgcggaggagaucgagaaguuccagggcuccgacgggaagaaggaggacgaggagaagaaguaccuggacgucaucagcaacaagaacaucaagcuguccgagcgggugcucauccccgugaagcaguaccccaaguucaacuucgucggcaagcugcuggggccccgcggcaacagccucaagcggcugcaggaggagaccggggccaagauguccauccugggcaagggcagcaugcgcgacaaggccaaggaggaggagcuccggaaguccggggaggccaaguacgcccaccugagcgacgagcugcacgugcucaucgagguguucgcgccgcccggcgaggccuacucccgcaugagccacgcccuggaggagaucaagaaguuccugguccccgacuacaacgacgagauccggcaggagcagcuccgcgagcuguccuaccugaacgggagcgaggacuccggccgggggcgcggcauccggggccgcgggauccggaucgcccccaccgcgccgagccgcggccgcgggggcgccaucccgcccccgcccccgcccggccggggcgugcucacgccccggggguccaccgugacccgcggggcccugcccgucccgcccguggcccggggcgugcccacgccccgcgcccgcggggcgcccaccguccccggcuaccgggcgccgcccccgcccgcccacgaggccuacgaggaguacggcuacgacgacggguacggcggggaguacgacgaccagaccuacgagaccuacgacaacagcuacgccacccagacgcaguccgugcccgaguacuacgacuacggccacggggugagcgaggacgccuacgacagcuacgcccccgaggagugggccaccacccgcuccagccugaaggccccgccccagcgguccgcccgcggcggcuaccgggagcaccccuacgggcgcuacuga

SEQ ID NO: 31938 - RNA, 1041 nt, Artificial Sequence
  derived and/or modified sequence opt1 from KHDRBS3__Homo_sapiens__NP_006549
auggaggagaaguaccugcccgagcucauggccgagaaggacagccuggaccccuccuucacccacgcccugcgccucgugaaccaggagaucgagaaguuccagaagggcgaggggaaggacgaggagaaguacaucgacgucgugaucaacaagaacaugaagcugggccagaaggugcugauccccgucaagcaguuccccaaguucaacuucguggggaagcuccugggcccccgggggaacagccugaagcgccuccaggaggagacccugacgaagauguccauccugggcaagggcagcaugcgggacaaggcgaaggaggaggagcuccgcaaguccggggaggccaaguacuuccaccugaacgacgaccugcacgugcucaucgaggucuucgccccgcccgccgaggccuacgcgcggaugggccacgcccuggaggagaucaagaaguuccugauccccgacuacaacgacgagauccgccaggcccagcuccaggagcugaccuaccugaacgggggcagcgagaacgccgacgugcccgugguccgggggaagcccacccuccgcacccggggcgugcccgcgcccgccaucacgcgcggccgcgggggcgugaccgcccgccccgucggggugguggucccgcggggcacccccacgccccgcggcgugcuguccacccgggggcccgugagccgcggccgggggcugcucaccccgcgcgcccggggcgucccgcccaccggguaccggcccccgcccccgccgcccacccaggagacguacggcgaguacgacuacgacgacggcuacgggaccgccuacgacgagcaguccuacgacagcuacgacaacuccuacagcacccccgcgcaguccggcgccgacuacuacgacuacgggcacggccugagcgaggagaccuacgacuccuacgggcaggaggaguggacgaacagccggcacaaggcccccuccgcccgcaccgccaagggcguguaccgcgaccagcccuacggccgguacuga

SEQ ID NO: 31939 - RNA, 897 nt, Artificial Sequence
  derived and/or modified sequence opt1 from KHK__Homo_sapiens__NP_000212
auggaggagaagcagauccugugcgugggccucgucgugcuggacgugaucagccuggucgacaaguaccccaaggaggacuccgagauccgcugccucagccagcgguggcagcgcgggggcaacgccuccaacagcugcaccgugcugucccugcucggggcccccugcgcguucaugggcagcauggcccccgggcacguggccgacuucguccuggacgaccugcggcgcuacuccguggaccuccgguacaccguguuccagacgaccggcagcguccccaucgccaccgugaucaucaacgaggccuccggcagccgcaccauccuguacuacgaccggucccugcccgacgugagcgcgacggacuucgagaaggucgaccucacccaguucaaguggauccacaucgaggggcgcaacgccuccgagcaggucaagaugcugcagcggaucgacgcccacaacacccgccagccgcccgagcagaagauccgggugagcguggagguggagaagccccgcgaggagcuguuccagcuguucggcuacggggacguggucuucguguccaaggacguggccaagcaccucggcuuccagagcgcggaggaggcccugcgggggcucuacggccgcguccggaagggcgccgugcuggugugcgccugggccgaggagggggcggacgcccugggccccgacgggaagcuccugcacuccgacgccuucccgccgccccgcgucguggacacccugggcgccggcgacacguucaacgccagcgucaucuucucccucagccaggggcggagcgugcaggaggcgcugcgcuucggcugccagguggccgggaagaagugcggccugcagggguucgacggcaucgucuga

SEQ ID NO: 31940 - RNA, 2136 nt, Artificial Sequence
  derived and/or modified sequence opt1 from KHSRP__Homo_sapiens__NP_003676
augagcgacuacuccaccggcgggcccccgcccggcccccccccgcccgccgggggcgggggcggcgccgggggcgcggggggcgggccccccccgggcccccccggcgccggggaccgcggcgggggcggccccgggggcgggggcccggggggcggcagcgccgggggccccucccagccccccgggggcgggggcccgggcauccggaaggacgccuucgccgacgcggugcagcgcgcccggcagaucgccgccaagaucgggggcgacgcggccaccacggucaacaacagcacccccgacuucggguucggcgggcagaagcgccagcuggaggacggcgaccagcccgaguccaagaagcucgccagccagggcgacuccaucagcucccagcuggggcccauccacccgcccccccggaccagcaugaccgaggaguaccgcgugcccgacggcaugguggggcugaucaucggccggggcggggagcagaucaacaagauccagcaggacuccggcugcaagguccagaucagcccggacuccgggggccuccccgagcgcagcgugucccugacgggggcccccgagagcgugcagaaggccaagaugaugcuggacgacaucgucucccggggccgcggcgggcccccgggccaguuccacgacaacgcgaacgggggccagaacgggaccgugcaggagaucaugauccccgccggcaaggccggccucgugaucgggaagggcggggagaccaucaagcagcugcaggagcgggccggcgucaagaugauccugauccaggacgggagccagaacaccaacguggacaagccccuccgcaucaucggcgacccguacaaggugcagcaggccugcgagauggucauggacauccugcgggagcgcgaccagggcggguucggcgaccggaacgaguacgggucccgcaucggcgggggcaucgacgugcccgugccccggcacagcgucggcguggugaucgggcgcagcggcgagaugaucaagaagauccagaacgacgcggggguccggauccaguucaagcaggacgacggcacgggccccgagaagaucgcccacaucauggggccgcccgaccgcugcgagcacgccgcccggaucaucaacgaccugcuccagucccugcgcagcggcccccccgggccgcccggcgggcccggcaugcccccgggcgggcgcggccgggggcgcggccaggggaacuggggcccccccggcggggagaugaccuucuccauccccacccacaagugcggccuggugaucgggcggggcggggagaacgugaaggccaucaaccagcagaccggcgcguucgucgagaucagccgccagcucccgcccaacggcgaccccaacuucaagcuguucaucauccggggguccccccagcagaucgaccacgccaagcagcugaucgaggagaagaucgagggcccgcucugccccguggggcccggccccggcgggccgggccccgccgggcccaugggcccguucaaccccgggcccuucaaccagggccccccgggcgcccccccccacgccgggggccccccgccccaccaguaccccccccagggguggggcaacacguacccgcaguggcagccccccgcgccccacgacccgagcaaggccgccgccgcggccgccgaccccaacgccgccugggcggccuacuacucccacuacuaccagcagccccccgggccggugcccggccccgcccccgccccggccgcgccccccgcccagggcgagcccccgcagccccccccgaccgggcagagcgacuacaccaaggccugggaggaguacuacaagaagaucggccagcagccccagcagcccggggcccccccgcagcaggacuacaccaaggccugggaggaguacuacaagaagcaggcgcaggucgccacgggcgggggccccggcgccccccccgggucccagccggacuacagcgccgcgugggccgaguacuaccgccagcaggccgccuacuacggccagacccccgggcccggcgggccccagccgccccccacccagcagggccagcagcaggcccaguga

SEQ ID NO: 31941 - RNA, 1947 nt, Artificial Sequence
  derived and/or modified sequence opt1 from KIAA0020__Homo_sapiens__NP_055693
auggaggugaagggcaagaagcaguucaccggcaagagcaccaagacggcccaggagaagaaccgcuuccacaagaacuccgacagcggguccagcaagaccuuccccacccggaaggucgccaaggagggcgggccgaaggugaccucccgcaacuucgagaaguccaucacgaagcuggggaagaagggcgugaagcaguucaagaacaagcagcagggcgacaagagccccaagaacaaguuccagcccgcgaacaaguucaacaagaagcggaaguuccagcccgacgggcgcagcgacgaguccgccgccaagaagccgaagugggacgacuucaagaagaagaagaaggagcucaagcagagccggcagcuguccgacaagaccaacuacgacaucgucgugcgcgccaagcagaugugggagauccugcggcgcaaggacugcgacaaggagaagcgggugaagcucaugagcgaccugcagaagcugauccagggcaagaucaagaccaucgccuucgcgcacgacuccacccgcgucauccagugcuacauccaguacgggaacgaggagcagcggaagcaggccuucgaggagcuccgcgacgaccugguggagcugagcaaggccaaguacucccggaacaucgugaagaaguuccucauguacggcagcaagccccagaucgccgagaucauccgcuccuucaaggggcacguccggaagaugcugcgccacgcggaggccagcgccaucguggaguacgccuacaacgacaaggccauccuggagcagcggaacaugcucacggaggagcuguacggcaacaccuuccagcuguacaaguccgcggaccaccgcacccucgacaaggugcuggagguccagcccgagaagcuggagcucaucauggacgagaugaagcagauccugacccccauggcccagaaggaggccgugaucaagcacagccuggugcacaaggucuuccucgacuucuucacguacgccccgcccaagcugcggagcgagaugaucgaggccauccgcgaggcggugguguaccuggcccacacccacgacggcgcccgggucgccaugcacugccucuggcacgggacccccaaggaccgcaaggugaucgugaagaccaugaagacguacgucgagaagguggccaacggccaguacucccaccuggugcugcucgcggccuucgacugcaucgacgacaccaagcuggucaagcagaucaucaucagcgagaucaucuccagccugcccuccaucgugaacgacaaguacgggcgcaagguccuccuguaccugcucagcccgcgggaccccgcccacaccgugcgcgagaucaucgaggugcugcagaagggcgacggcaacgcccacuccaagaaggacaccgagguccggcgccgggagcugcucgagagcaucucccccgcccugcugagcuaccuccaggagcacgcgcaggagguggugcuggacaaguccgccugcguccuggugagcgacauccucggguccgccacgggcgacgugcagcccaccaugaacgccaucgcgagccuggccgccaccgggcugcacccgggcgggaaggacggcgagcuccacaucgccgagcaccccgccggccaccugguccugaaguggcucaucgagcaggacaagaagaugaaggagaacgggcgcgagggcugcuucgcgaagacccugguggagcacguggggaugaagaaccugaaguccugggccagcgucaaccggggcgccaucauccuguccagccuccugcaguccugcgaccuggagguggccaacaaggugaaggccgcgcucaagagccugauccccacgcuggagaagaccaagagcaccuccaaggggaucgagauccuccuggagaagcugagcaccuga

SEQ ID NO: 31942 - RNA, 300 nt, Artificial Sequence
  derived and/or modified sequence opt1 from KIAA0040__Homo_sapiens__NP_055471
auggagcgcaucagcgccuucuucuccagcaucugggacaccauccugaccaagcaccaggagggcaucuacaacacgaucugccucggggugcugcugggccucccccugcuggucaucaucacccuccuguucaucugcugccacugcugcugguccccgcccgggaagcggggccagcagcccgagaagaacaagaagaagaagaagaagaagaagaagaaggacgaggaggaccuguggaucagcgcccagcccaagcuccugcagauggagaagcgcccgucccugcccguguga

SEQ ID NO: 31943 - RNA, 6708 nt, Artificial Sequence
  derived and/or modified sequence opt1 from KIAA0100__Homo_sapiens__NP_055495
augccccuguucuucagcgcccugcuggugcugcugcugguggcccugagcgcccuguuccuggggcgcuggcugguggugcggcuggccaccaaguggugccagcgcaagcugcaggccgagcugaagaucgggagcuuccgguucuucuggauccagaacgucucccucaaguuccagcagcaccagcagaccguggagaucgacaaccuguggaucagcagcaagcugcugagccacgaccugccccacuacguggcccugugcuucggcgaggugcgcauccggaccgaccuccagaagguguccgaccugagcgcccccuucucccagagcgcggggguggaccagaaggagcuguccuucagccccucccuccugaagaucuucugccagcuguucagcauccacgucgacgccaucaacaucauggugcucaagguggacaccuccgagagccuguggcacauccagaucucccgcagccgguuccugcucgacuccgacggcaagcgccugaucugcgaggucagccugugcaagaucaacagcaaggugcucaaguccgggcagcuggaggacacgugccugguggagcucagccuggcccuggaccucugccugaaggucggcaucuccagccggcaccugaccgccaucaccguggacguguggacccuccacgcggagcugcacgagggccuguuccagucccagcuccugugccaggggcccagccuggccuccaagcccguccccugcagcgaggugaccgagaaccucguggagcccacccugcccggccuguuccuccugcagcagcugccggaccaggucaaggugaagauggagaacaccuccgugguccugagcaugaacucccagaagcgccaccucaccuggacccugaagcugcuccaguuccuguaccaccgggacgaggaccagcugccccuccgcagcuucaccgccaacuccgacauggcccagaugagcaccgagcugcugcucgaggacgggcugcugcucucccagagccggcagcgcaucgugugccugaacucccugaaggccagcguccaggugaccaccaucgaccucuccgcgagccuggugcugaacacgugcaucauccacuaccggcaccaggaguucagccacuggcuccaccuccuggcccucgagacgcagggcuccagcucccccguccugaagcagcgcaagaagcggaccuucccccagauccuggcccccaucaucuucagcaccuccaucagcaacgugaacaucuccauccagcucggggacacgccgcccuucgcccugggcuucaacagcaucucccuggacuaccagcaccuccgcccccagagcauccaccagcggggcgugcugacggucgaccaccugugcuggcgcgugggguccgacagccacauccagcgggcgccccacccgcccaacaugcacguguggggcgaggcccucguccuggacuccuucacccugcaggggagcuacaaccagccccucggccuguccagcacccaguccgacacccuguuccucgacugcacgauccgcggccuccagguggaggccagcgacacgugcgcccagugccugagccgcauccucucccugauggggccgcagagcggcaaguccgccgugagccggcacuccagcuucggggaguccgucagccugcucuggaagguggaccugaagguggaggacaugaaccuguucacccucuccgcccuggucggcgcgagcgaggugcgccuggacacccucacgauccugggguccgccgagaccagcaccgugggcauccagggccugguccucgcccuggugaaguccgugaccgagaagaugcagcccugcugcaaggcccccgacauccccacgccgguccugagccucuccaugcugagcaucaccuaccacuccagcauccggucccuggaggugcagugcggggccggccucacccugcugugguccccgcccgaccacauguaccucuaccagcacgugcuggcgacccugcagugccgcgaccuccugcgggccacggucuuccccgagaccgugccgagccuggcccucgagaccuccgggaccaccagcgagcuggagggccgcgcccccgagccccugccgcccaagcggcuccugaaccugacgcucgagguguccaccgcgaagcugaccgccuucgucgccgaggacaaguucaucacccuggccgccgagagcgugucccucagccgccacgggggcucccugcaggcguacugccccgagcuggccgccggcuucgacgggaacagcaucuucaacuucaaggagguggagguccagcuccugcccgagcuggaggagaugauccuccaccggaacccguuccccgcccugcagacgcugcgcaaccggguguggcuccuguccuucggcagcguguccgucgaguuccccuaccaguacgacuucagccgcacccuggacgaggccgugggggugcagaaguggcucaagggccugcaccaggggacccgggcgugggccucccccagcccggucccccugccgcccgaccuccugcugaagguggagcacuucuccuggguguuccucgacgacgucuucgaggugaagcugcacgacaacuacgagcugaugaaggacgagagcaaggaguccgccaagcgccugcagcuccuggacgccaagguggccgcgcugcggaagcagcacggcgagcuccugccggcccgcaagaucgaggagcuguacgccagccucgagcggaagaacaucgagaucuacauccagcgcucccggcgccuguacggcaacacccccaugcgccgggcccugcucacguggagccuggcggggcuggagcucgucgcccuggccgacgccagcuuccacggccccgagcacgugguggagcagguccaggagcuggaccccggguccccguucccgcccgagggccucgaccuggugauccaguggugccgcaugcugaagugcaacgucaagagcuuccucguccggauccgcgacuacccccgguaccuguucgagauccgcgacuggcggcugaugggccgccucguggggaccgagcaguccggccagccgugcagccggcgccggcagauccugcaccuggggcuccccuggggcaacguggccgucgagcgcaacaugccgccccugaaguucuaccacgacuuccacuccgagaucuuccaguacaccguggucugggggccgugcugggaccccgcguggacccugaucggccagugcguggaccuccugacgaagcccagcgccgacccguccccgccccugcccuggugggacaagagccggcuccuguuccacggcgacuggcacauggacaucgagcaggccaaccugcaccagcucgccaccgaggaccccuacaacaccaccgagaacaugcacugggaguggucccaccugagcuuccacuggaagcccgggcaguucguguucaagggcgaccuggacaucaacguccgcacggccuccaaguacgacgacugcugcuuccuccaccuccccgaccugugcaugacccucgaccugcaguggcugugccacgggaacccccacgaccaccacagcgugacccuccgggcgccggaguuccugcccgaggugccccugggccagcuccacgacuccuaccgcgccuuccggagcgagaaccugaaccuguccaucaagauggaccucacccgccacagcgggacgaucucccagccccggauccugcuguacagcuccacccuccgcuggaugcagaacuucugggccaccuggaccagcgucacgcggccgaucugccgcggcaagcuguucaacaaccugaagcccagcaagaagaagcucggccagcacuacaagcagcuguccuacaccgcccuguucccccagcuccaggugcacuacugggccagcuucgcgcagcagcgcgggauccagaucgagugcucccagggccacguguucacccgggggacccagcgccugaucccccaggccggcacggucaugcggcgccugaucagcgacugguccgugacccagauggugagcgaccucucccaggucaccgugcaccugauggccagcccgaccgaggagaacgccgaccacugccuggacccccucgugacgaagacccaccuccugucccucagcucccugaccuaccagcggcacagcaaccgcaccgcggaggaggagcuguccgcccgggacggggaccccacguuccacacccaccagcuccaccuggucgaccugcgcaucagcuggaccaccaccaaccgggacaucgccuucggccucuacgacggcuacaagaaggccgccgugcugaagcgcaaccuguccacggaggcgcucaaggggcugaagaucgacccccagaugccggccaagaagcccaagcggggcgugcccaccagcgccuccgcgccgccccgcgucaacacccccagcuucuccgggcagcccgacaagggcagcagcgggggcgccuacaugcugcagaagcucaucgaggagaccgaccgguucgugguguucacggaggaggaguccggcaugagcgaccagcugugcgggaucgcggccugccagaccgacgacaucuacaaccgcaacugccugaucgagcucgucaacugccagauggugcugcggggcgccgagaccgaggggugcgugaucgucuccgccgccaaggcgcagcugcuccagugccagcaccaccccgccugguacggcgacacccugaagcagaagacgagcuggaccugccugcucgacggcaugcaguacuucgccaccaccgaguccagccccacggagcaggacgggcgccagcuguggcuggaggugaagaacaucgaggagcaccggcagcgcucccucgacagcgugcaggagcugauggaguccggccaggccgucgggggcauggugaccaccaccacggacuggaaccagcccgccgaggcgcagcaggcccagcagguccagcggaucaucagccgcugcaacugccgcauguacuacaucuccuacagccacgacaucgaccccgagcuggccacccagaucaagccgcccgagguccucgagaaccaggagaaggaggaccugcugaagaagcaggagggggccguggacaccuucacccucauccaccacgagcuggagaucuccacgaaccccgcgcaguacgccaugauccuggacaucgugaacaaccuccugcugcacgucgagcccaagcggaaggagcacagcgagaagaagcagcgcgugcgguuccagcuggagaucuccagcaacccggaggagcagcgcuccagcauccuccaccuccaggaggccgugcggcagcacgucgcccagauccgccagcuggagaagcagauguacuccaucaugaagucccuccaggacgacagcaagaacgagaaccugcuggaccucaaccagaagcugcagcugcagcucaaccaggagaaggccaaccugcagcuggaguccgaggagcucaacauccugauccggugcuucaaggacuuccagcugcagcgcgcgaacaagauggagcuccggaagcagcaggaggacgugagcgugguccgccggaccgaguucuacuucgcccaggcccgcuggcggcugaccgaggaggacggccagcugggcaucgccgagcucgagcugcagcgcuuccuguacuccaaggugaacaagagcgacgacaccgccgagcaccuccuggagcuggggugguucacgaugaacaaccuccugcccaacgcgguguacaaggucgugcugcggccccaguccagcugccaguccggccgccagcucgcccugcggcuguucagcaaggugcgcccgcccgucgggggcaucuccgugaaggagcacuucgaggugaacgucgugccccucaccauccagcugacccaccaguucuuccaccggaugaugggguucuucuuccccggccgcagcguggaggacgacgaggucggcgacgaggaggacaaguccaagcuggugaccacggggauccccgucgugaagccccggcagcucaucgccaccgacgacgccgugccccugggccccgggaagggcgucgcccaggggcugacccgcagcuccggcgugcgccggagcuuccgcaagucccccgagcacccgguggacgacaucgacaagaugaaggagcgggcggccaugaacaacagcuucaucuacaucaagaucccccaggucccccucugcguguccuacaagggcgagaagaacagcguggacuggggcgaccugaaccugguccuccccugccuggaguaccacaacaacaccuggacguggcuggacuucgccauggccgugaagcgcgacagccggaaggcgcucguggcccaggucaucaaggagaagcugcgccugaaguccgccaccggcagcgaggugcgggggaagcucgagaccaaguccgaccugaacaugcagcagcaggaggaggaggagaaggcccgccugcucaucggccugagcgugggcgacaagaacccggggaagaaguccaucuucggccggcgcaaguga

SEQ ID NO: 31944 - RNA, 198 nt, Artificial Sequence
  derived and/or modified sequence opt1 from KIAA0101__Homo_sapiens__NP_001025160
auggugcgcaccaaggccgacagcguccccggcaccuaccggaaggugguggccgcgcgcgccccgcggaagguccugggguccagcacguccgccaccaacagcaccuccgugagcucccgcaaggagcacgugcucugcaaccugaucacccagaugaugaagaagaaccggacguucagcuucaucuucgaguga

SEQ ID NO: 31945 - RNA, 3480 nt, Artificial Sequence
  derived and/or modified sequence opt1 from KIAA0196__Homo_sapiens__NP_055661
augcuggacuuccucgccgagaacaaccugugcggccaggccauccugcgcaucgugagcugcgggaacgcgaucaucgccgagcuccugcggcuguccgaguucauccccgccgucuuccgccucaaggaccgggccgaccagcagaaguacggcgacaucaucuucgacuucagcuacuucaaggggccggagcugugggaguccaagcuggacgccaagcccgagcuccaggaccuggacgaggaguuccgcgagaacaacaucgagaucgugacccgguucuaccuggcguuccagagcgugcacaaguacaucgucgaccucaaccgcuaccuggacgaccugaacgagggcguguacauccagcagacccucgagacggugcugcugaacgaggacgggaagcagcuccugugcgaggcccuguaccucuacggcgucaugcugcuggugaucgaccagaagaucgagggcgaggugcgggagcgcaugcucgucuccuacuaccgguacagcgccgcccgcuccagcgcggacuccaacauggacgacaucugcaagcugcugcggagcaccggguacuccagccagcccggcgccaagcgccccuccaacuacccggagagcuacuuccagcgggugcccaucaacgaguccuucaucagcauggugaucgggcgccuccgguccgacgacaucuacaaccaggucagcgccuacccccugcccgagcaccgcuccaccgcccuggccaaccaggcggccaugcucuacgugauccuguacuucgagccgagcauccugcacacccaccaggccaagaugcgggagaucguggacaaguacuuccccgacaacugggucaucagcaucuacaugggcaucacggugaaccucguggacgccugggagcccuacaaggccgcgaagaccgcccugaacaacacccuggaccucuccaacguccgcgagcaggccagccgguacgccaccguguccgagcgcgugcacgcccagguccagcaguuccugaaggagggguaccugcgggaggagauggugcucgacaacauccccaagcugcugaacugccuccgcgacugcaacguggcgauccgcuggcugaugcugcacacggccgacagcgccugcgacccgaacaacaagcggcuccgccagaucaaggaccagauccugaccgacucccgguacaacccccgcauccuguuccagcuccugcuggacaccgcccaguucgaguucauccugaaggagauguucaagcagaugcucagcgagaagcagaccaagugggagcacuacaagaaggagggcuccgagcggaugacggagcuggccgacgucuucagcggcgugaagccccugacccgcgucgagaagaacgagaaccuccaggcgugguuccgggagaucuccaagcagauccugagccugaacuacgacgacuccaccgccgccgggcgcaagaccgugcagcucauccaggcccuggaggaggugcaggaguuccaccagcuggagagcaaccuccaggucugccaguuccuggcggacacgcggaaguuccugcaccagaugauccgcaccaucaacaucaaggaggaggugcucaucaccaugcagaucgugggcgaccuguccuucgccuggcagcugaucgacagcuucaccuccaucaugcaggagagcauccgggucaaccccuccauggugacgaagcuccgcgccaccuuccugaagcuggccagcgcccucgaccugccgcugcuccggaucaaccaggcgaacucccccgaccugcugagcgugagccaguacuacuccggggagcucgucagcuacgugcgcaaggugcugcagaucauccccgaguccauguucaccagccugcucaagaucaucaagcugcagacccacgacaucaucgagguccccacgcggcuggacaaggacaagcuccgcgacuacgcccagcugggcccgcgguacgagguggccaagcugacccacgccaucuccaucuucaccgagggcauccucaugaugaagaccacgcugguggggaucaucaaggucgaccccaagcagcugcucgaggacggcauccgcaaggagcuggugaagcggguggccuucgcgcugcaccgcgggcucaucuucaacccccgcgccaagcccagcgagcugaugccgaagcugaaggagcucggcgccaccauggacggguuccaccgguccuucgaguacauccaggacuacgucaacaucuacggccugaagaucuggcaggaggaggugagccgcaucaucaacuacaacguggagcaggagugcaacaacuuccugcggaccaagauccaggacuggcaguccauguaccagagcacccacauccccauccccaaguucacgcccgucgacgaguccgugaccuucaucggccgccucugccgggagauccugcgcaucaccgacccgaagaugaccugccacaucgaccagcugaacacgugguacgacaugaagacccaccaggaggugaccagcucccgccucuucagcgagauccagaccacccuggggacguucggccugaacgggcucgaccggcugcugugcuucaugaucgucaaggagcuccagaacuuccuguccauguuccagaagaucauccugcgggaccgcaccgugcaggacacccucaagacccugaugaacgccgugagcccccugaaguccaucgucgccaacagcaacaagaucuacuucagcgcgaucgccaagacgcagaagaucuggaccgccuaccucgaggccaucaugaaggugggccagaugcagauccugcggcagcagaucgcgaacgagcugaacuacuccugccgcuucgacagcaagcaccucgccgccgcccuggagaaccugaacaaggcccuccuggcggacaucgaggcccacuaccaggaccccucccugccguaccccaaggaggacaacacccuccuguacgagaucaccgccuaccuggaggccgccgggauccacaacccccucaacaagaucuacaucacgaccaagcggcugcccuacuucccgaucgugaacuuccuguuccucaucgcgcagcugcccaagcugcaguacaacaagaaccucggcauggucugccgcaagcccaccgaccccguggacuggccgccccuggugcugggccuccugacccugcucaagcaguuccacagccgguacacggagcaguuccuggcccugaucgggcaguucaucugcuccaccgucgagcagugcaccagccagaagauccccgagauccccgccgacguggugggcgcccuccuguuccuggaggacuacguccgcuacaccaagcucccgcggcgcguggccgaggcgcacgugcccaacuucaucuucgacgaguuccggacgguccuguga

SEQ ID NO: 31946 - RNA, 2784 nt, Artificial Sequence
  derived and/or modified sequence opt1 from KIAA0226__Homo_sapiens__NP_001139114
augcagagcauccuguaccacggccucauccgcgaccaggccugccggcgccagaccgacuacuggcaguucgugaaggacauccgguggcugagcccccacagcgcccugcacgucgagaaguucaucuccgugcacgagaacgaccagagcuccgcggacggggccagcgagcgcgccguggccgagcucuggcugcagcacucccugcaguaccacugccucagcgcccagcugcggccgcugcucggcgaccgccaguacauccggaaguucuacaccgacgcggccuuccugcuguccgacgcccacgucacggccaugcuccagugccuggaggcgguggagcagaacaacccccgccugcucgcccagaucgacgccagcauguucgcccggaagcacgagagcccccugcuggugaccaagucccagucccucaccgcccugcccagcuccaccuacacgccgcccaacagcuacgcgcagcacuccuacuucgggagcuucuccagccugcaccagagcguccccaacaacggcuccgagcgccggagcaccuccuucccccucagcgggccgccccgcaagccccaggagucccggggccacgugagccccgccgaggaccagaccauccaggccccgcccguguccgucagcgcccuggcccgcgacagcccccugacccccaacgagauguccuccagcacgcucaccuccccgaucgaggcgagcuggguguccagccagaacgacucccccggcgacgccagcgaggggcccgaguaccuggccaucggcaaccuggacccccgggggcgcaccgccuccugccagagccacagcuccaacgccgagagcuccagcuccaaccucuucagcuccagcuccagccagaagccggacuccgcggccagcucccugggcgaccaggagggcgggggcgagagccagcuguccagcgugcuccggcgcuccagcuucagcgaggggcagacccugacggucaccuccggcgccaagaagucccacauccggucccacagcgacaccuccaucgccagccgcggggcccccggcggcccccggaacaucaccaucaucguggaggaccccaucgcggaguccugcaacgacaaggccaagcugcgcgggccgcuccccuacagcggccaguccagcgagguguccacgcccagcucccuguacauggaguacgagggcgggcgcuaccugugcagcggggagggcauguuccggcgccccuccgagggccagagccucaucuccuaccugagcgagcaggacuucggguccugcgccgaccuggagaaggagaacgcccacuucagcaucagcgagucccucaucgcggccaucgagcugaugaagugcaacaugaugagccagugccuggaggaggaggaggucgaggaggaggacuccgaccgggagauccaggagcucaagcagaagauccgccugcggcgccagcagauccggaccaagaaccugcucccgauguaccaggaggccgagcacggcagcuuccgcgugaccuccagcuccagccaguucuccagccgggacuccgcccagcugagcgacuccgggagcgccgacgagguggacgaguucgagauccaggacgcggacauccgccggaacaccgccuccagcuccaagagcuucgucuccagccagagcuucucccacugcuuccugcacagcacguccgccgaggccguggccaugggccuccugaagcaguucgaggggaugcagcugcccgcggccagcgagcuggaguggcucgugcccgagcacgacgccccgcagaagcugcugcccauccccgacucccuccccaucagcccggacgacggccagcacgccgacaucuacaagcugcgcauccggguccgcggcaaccuggagugggccccgccccggccccagaucaucuucaacgugcaccccgcgcccacccgcaagaucgccguggccaagcagaacuaccggugcgccgggugcggcauccgcaccgaccccgacuacaucaagcggcuccgcuacugcgaguaccuggggaaguacuucugccagugcugccacgagaacgcgcagauggccauccccucccgcguccugcggaagugggacuucagcaaguacuacguguccaacuucagcaaggaccuccugaucaagaucuggaacgacccgcuguucaacguccaggacaucaacuccgcccucuaccgcaaggugaagcugcugaaccaggugcggcuccugcgcguccagcugugccacaugaagaacauguucaagaccugccggcucgccaaggagcugcuggacagcuucgacacggugcccggccaccucaccgaggaccugcaccuguacucccucaacgaccugaccgccacccgcaagggggagcugggcccccggcucgcggagcugacgcgcgccggcgccacccacguggagcggugcaugcugugccaggccaagggguucaucugcgaguucugccagaacgaggacgacaucaucuuccccuucgagcuccacaagugccggaccugcgaggagugcaaggccugcuaccacaaggcgugcuucaagagcggcuccugcccgcgcugcgagcgccugcaggcccggcgcgaggcccuggcccggcagagccucgaguccuaccugagcgacuacgaggaggagcccgccgaggcgcuggcccucgaggccgccguccuggaggcgaccuga

SEQ ID NO: 31947 - RNA, 1908 nt, Artificial Sequence
  derived and/or modified sequence opt1 from KIAA0226L__Homo_sapiens__NP_001273691
auggugagccaguccaccguccgccaggacagccccguggagccgugggagggcaucuccgaccacagcgggaucaucgacggcagcccccggcugcucaacaccgaccacccgcccugccagcuggacauccgccugaugcggcacaaggccguguggaucaacccccaggacguccagcagcagccccaggaccuccagucccaggugcccgccgcggggaacuccggcacccacuucgugaccgacgccgccagccccuccgggccgagccccuccugccugggcgacagccuggccgagaccacccucuccgaggacacgaccgacagcgucggcuccgccagcccccacggguccagcgagaaguccagcagcuucucccugagcuccaccgaggugcacauggugcgccccggcuacagccaccgggucucccugccgaccagccccgggauccucgcgacgucccccuaccccgagaccgacagcgccuucuucgagccgucccaccugaccagcgccgccgacgagggcgcgguccaggugucccgccggaccaucagcuccaacagcuucucccccgagguguucgugcugcccguggacgucgagaaggagaacgcccacuucuacguggccgacaugaucaucagcgccauggagaagaugaagugcaacauccucucccagcagcagacggagagcugguccaaggaggugagcgggcugcugggcagcgaccagcccgacuccgagaugaccuucgacaccaacaucaagcaggagagcggcuccagcaccuccagcuacuccggguacgagggcugcgccguccuccaggugagcccggugacggagacccgcaccuaccacgacgucaaggagaucugcaagugcgacguggacgaguucgugauccuggagcugggggacuucaacgacaucaccgagacgugcuccugcagcugcuccagcuccaagagcgucaccuacgagcccgacuucaacuccgcggagcuccuggccaaggagcuguaccggguguuccagaagugcuggauccucagcgucgugaacucccagcuggccggcagccugagcgccgccggcuccaucguggucaacgaggagugcgugcgcaaggacuucgagagcuccaugaacgugguccaggagaucaaguucaagagccggauccgcgggaccgaggacugggcgccgccccgguuccagaucaucuucaacauccacccgccccucaagcgcgaccuggugguggccgcccagaacuucuucugcgccggcugcgggacccccgucgagcccaaguucgugaagcggcugcgcuacugcgaguaccucggcaaguacuucugcgacugcugccacuccuacgccgagagcugcauccccgcgcggauccugaugaugugggacuucaagaaguacuacguguccaacuucagcaagcagcugcucgacuccaucuggcaccagcccaucuucaaccugcugagcaucgggcagucccucuacgccaaggccaaggagcuggaccgcgucaaggagauccaggagcagcuguuccacaucaagaagcuccugaagacgugccgguucgccaacagcugcgugaaggagcgcgcccuguucgugaacuucgcgcggauccgccucuccagcucccacuuccgccagcagcacgucgaggacgugcagcgggccggccuggccuucaccaacagcgccuccagcccgcccuccgcgcccggcgugcgcgggagccagcggggcgagaacuucuggaaggucuggccccugcagcagcacgacgcccccgaguacugcgagaaggacugcagcacgugccucaugaucaccccgaucugcguguacuacugguga

SEQ ID NO: 31948 - RNA, 4188 nt, Artificial Sequence
  derived and/or modified sequence opt1 from KIAA0232__Homo_sapiens__NP_001094060
auguaccccaucugcaccguggucguggacggccugccgagcgaguccagcuccagcuccuaccccgggcccgugagcgucuccgagaugagccuccugcacgcccugggccccgugcagaccuggcucgggcaggagcuggagaagugcggcaucgacgccaugaucuacacgcgcuacgugcugucccuccugcugcacgacagcuacgacuacgaccuccaggagcaggagaacgacaucuuccuggggugggagaagggcgcguacaagaaguggggcaaguccaagaagaagugcagcgaccugacccucgaggagaugaagaagcaggccgccguccagugccugcgguccgccagcgacgaguccagcgggaucgagacccugguggaggagcucugcucccgccugaaggaccugcagagcaagcaggaggagaagauccacaagaagcucgagggcuccccgagccccgaggccgagcugagcccgcccgcgaaggaccagguggagauguacuacgaggccuucccgccccuguccgagaagcccgucugccuccaggagaucaugaccguguggaacaagagcaaggugugcuccuacagcuccagcuccagcuccagcacggccccgcccgccuccaccgacaccagcucccccaaggacugcaacagcgaguccgaggucaccaaggagcggagcuccgaggugcccacgaccgugcacgagaagacccagagcaaguccaagaacgagaaggagaacaaguucagcaacgggaccaucgaggagaagcccgcgcuguacaagaagcagauccgccacaagcccgagggcaagauccggccccgcagcugguccagcggguccagcgaggccggcuccagcuccagcggcaaccagggggagcugaaggccuccaugaaguacgucaaggugcggcacaaggcccgcgagauccggaacaagaagggccgcaacgggcagagccggcucucccugaagcacggcgagaaggccgagcgcaacauccacacgggcagcuccagcuccagcuccagcgggagcgugaagcagcugugcaagcggggcaagcgcccccucaaggagaucgggcggaaggaccccggcuccaccgaggggaaggaccuguacauggagaaccgcaaggacaccgaguacaaggaggagccgcugugguacaccgagcccaucgcggaguacuucgucccccucagccggaaguccaagcuggagacgaccuaccgcaaccggcaggacaccagcgaccugaccuccgaggccguggaggagcucagcgaguccgugcacggccugugcaucagcaacaacaaccugcacaagacguaccucgccgccggcaccuucaucgacgggcacuucgucgagaugcccgccgugaucaacgaggacaucgaccugaccggcaccucccugugcagccucccggaggacaacaaguaccuggacgacauccaccuguccgagcucacgcacuucuacgagguggacaucgaccagagcaugcuggaccccggggcguccgagaccaugcagggcgagagccgcauccugaacaugauccggcagaaguccaaggagaacaccgacuucgaggccgagugcugcaucguccucgacgggauggagcugcagggcgagcgcgccaucuggaccgacagcacguccagcgugggcgccgaggggcuguuccuccaggaccugggcaaccuggcccaguucugggagugcugcuccagcagcuccggggacgcggacggcgagagcuucgggggcgacucccccguccgccugagccccauccucgacuccaccgugcugaacagccaccuccucgccggcaaccaggagcuguucuccgacaucaacgaggggagcggcaucaacuccugcuucagcguguucgagguccagugcuccaacagcgugcugccguucuccuucgagacccucaaccuggggaacgagaacaccgacagcuccgccaacaugcugggcaagacgcagagccggcuccugaucuggaccaagaacuccgccuucgaggagaacgagcacugcagcaaccuguccacccgcacgugcagccccuggagccacuccgaggagacgcggagcgacaacgagacccucaacauccaguucgaggaguccacccaguucaacgccgaggacaucaacuacguggucccccgcgugagcuccaacuacguggacgaggagcugcuggacuuccuccaggacgagaccugccagcagaacagccggacccugggcgagaucccgacgcuggucuucaagaagaccuccaagcucgagagcgugugcgggauccagcuggagcagaagaccgagaacaagaacuucgagaccacccaggugugcaacgagagcccccacggcgacggguacagcuccggcgucaucaaggacaucuggaccaagauggcggacaccaacagcguggccaccguggagaucgagcgcacggacgccgagcuguucuccgccgacgucaacaacuacugcugcugccucgacgcggaggccgagcuggagacccugcaggagcccgacaaggccgugcggcgcagcgaguaccaccucugggaggggcagaaggagucccuggagaagcgggccuucgccagcuccgagcugagcaacguggacggcggcgacuacaccacccccuccaagccgugggacgucgcgcaggacaaggagaacacguucauccucgggggcguguacggggagcugaagaccuucaacagcgacggcgagugggccguggucccgcccagccacaccaaggggucccugcuccagugcgccgccagcgacguggugaccaucgccggcacggacgucuucaugacccccggcaacuccuucgcgcccgggcaccgccagcuguggaagcccuucgugagcuucgagcagaacgaccagcccaaguccggcgagaacgggcugaacaagggcuucagcuucaucuuccacgaggaccuccugggggccugcggcaacuuccagguggaggaccccggccuggaguacuccuucagcuccuucgaccucagcaacccguucucccagguccugcacguggagugcagcuucgagcccgaggggaucgccuccuucagccccuccuucaagcccaagagcauccugugcuccgacagcgacuccgagguguuccacccgcggaucugcggcgucgaccgcacccaguaccgggccauccgcaucagcccccggacccacuuccgccccaucagcgccuccgagcucagccccgggggcggguccgagagcgaguucgaguccgagaaggacgaggcgaacaucccgauccccagccagguggacaucuucgaggacccccaggccgaccugaagccccuggaggaggacgccgagaaggagggccacuacuacggcaaguccgagcucgagagcgggaaguuccugccgcggcugaagaaguccggcauggagaaguccgcccagacgucccucgacagccaggaggaguccaccgggauccugagcgugggcaagcagaaccagugccuggagugcuccaugaacgagagccucgagaucgaccuggaguccagcgaggcgaacugcaagaucauggcccagugcgaggaggagaucaacaacuucugcggcugcaaggccgggugccaguuccccgccuacgaggacaaccccgucuccagcggccagcuggaggaguucccggugcucaacaccgacauccaggggaugaaccgcagccaggagaagcagaccuggugggagaaggcccuguacagcccccuguuccccgcguccgagugcgaggagugcuacacgaacgccaagggcgaguccgggcucgaggaguaccccgacgccaaggagaccccgagcaacgaggagcggcugcuggacuucaaccgcguguccagcgucuacgaggcccgcugcaccggcgagcgggacuccggcgccaagagcgacggguuccgcggcaagaugugcuccagcgcguccagcaccuccgaggagacggggagcgagggcgggggcgagugggugggccccuccgaggaggagcuguucagccggacccaccuguga

SEQ ID NO: 31949 - RNA, 3192 nt, Artificial Sequence
  derived and/or modified sequence opt1 from KIAA0319__Homo_sapiens__NP_001161846
augacccgccugggcuggcccagcccgugcugcgcccggaagcagugcuccgaggggcgcaccuacagcaacgccgugaucucccccaaccucgagacgacccggaucaugcgcgucagccacaccuuccccgugguggacugcaccgcggccugcugcgaccuguccagcugcgaccuggccuggugguucgagggccggugcuaccucgucuccugcccccacaaggagaacugcgagccgaagaagauggggcccauccgcagcuaccugacguucgugcugcggcccgugcagcgccccgcccagcuccuggacuacggcgacaugaugcugaaccggggguccccgagcggcaucuggggcgacucccccgaggacauccgcaaggaccucaccuuccuggggaaggacuggggccuggaggagaugagcgaguacuccgacgacuaccgggagcucgagaaggaccugcugcagcccagcgggaagcaggagccccgcggcuccgccgaguacaccgacugggggcuccugccgggcagcgagggcgcguucaacuccagcgucggggacucccccgccgugcccgccgagacccagcaggaccccgagcugcacuaccucaacgagagcgccagcacgccggcgcccaagcugcccgagcgguccgugcugcucccccugccgaccacccccagcuccggcgagguccuggagaaggagaaggccagccagcuccaggagcaguccagcaacuccagcgggaaggaggugcugaugcccucccacagccugcccccggccucccucgagcugagcuccgugaccgucgagaagucccccgugcugacggugacccccggcagcaccgagcacagcauccccaccccgcccacguccgccgcccccagcgaguccaccccgagcgagcuccccaucagccccaccaccgcgccccgcacggucaaggagcugaccguguccgccggcgacaaccugaucaucacccucccggacaacgagguggagcugaaggccuucgucgcccccgccccgcccguggagaccacguacaacuacgaguggaaccugaucagccaccccaccgacuaccagggggagaucaagcagggccacaagcagacccucaaccugucccagcugagcguggggcucuacgucuucaaggugaccguguccagcgagaacgcguucggcgagggguucgucaacgugacggucaagcccgcccggcgcgugaaccugccgcccguggccgucgugagcccccagcugcaggagcucacccugccccugaccuccgcccucaucgacggcucccagagcaccgacgacacggagaucguguccuaccacugggaggagaucaacggccccuucaucgaggagaagaccagcgucgacucccccgugcugcggcugagcaaccucgacccggggaacuacuccuuccgccugaccgugaccgacagcgacggcgccacgaacuccaccaccgcggcccugaucgucaacaacgccguggacuacccgcccguggccaacgccgggcccaaccacaccaucacccugccccagaacagcaucacgcucaacggcaaccagagcuccgacgaccaccagaucguccuguacgaguggagccuggggcccggcuccgagggcaagcacguggugaugcaggggguccagacccccuaccuccaccugagcgcgaugcaggagggcgacuacaccuuccagcugaaggugaccgacuccagccggcagcaguccacggccguggucaccgugaucgugcagcccgagaacaaccgcccgcccgucgccguggccgggcccgacaaggagcucaucuucccgguggagagcgcgacccuggacggcuccagcuccagcgacgaccacgggaucgucuucuaccacugggagcacgugcggggccccuccgccguggagauggagaacaucgacaaggccaucgccaccgucacgggccuccagguggggaccuaccacuuccgccugaccgugaaggaccagcagggccugagcuccaccagcacgcugaccgucgccgugaagaaggagaacaacuccccgccccgcgcgcgggccgggggccgccacgugcucguccugcccaacaacagcaucacccuggacggcucccggagcaccgacgaccagcgcaucgugagcuaccucuggauccgggacgggcagucccccgccgccggcgacgugaucgacgggagcgaccacuccgucgcccugcagcugacgaaccucguggagggcguguacaccuuccaccuccgcgucaccgacagccagggggcguccgacaccgacacggccaccguggaggugcagcccgacccccgcaagagcggccuggucgagcugacccuccaggugggcguggggcagcugaccgagcagcggaaggacacgcugguccggcagcuggccgugcugcucaacgugcuggacuccgacaucaagguccagaagauccgcgcccacagcgaccuguccaccgugaucguguucuacguccagagccggccgcccuucaaggugcucaaggccgcggaggucgcccgcaaccugcacaugcggcuguccaaggagaaggccgacuuccuccuguucaaggugcugcgcguggacaccgccggcugccuccugaagugcagcgggcacggccacugcgacccccugaccaagcggugcaucugcucccaccucuggauggagaaccugauccagcgcuacaucugggacggggagagcaacugcgagugguccaucuucuacgucacggugcuggcguucacccucaucgugcugaccggcggcuucaccuggcugugcaucugcugcugcaagcggcagaagcgcacgaagauccggaagaagaccaaguacaccauccucgacaacauggacgagcaggagcgcauggagcugcgccccaaguacgggaucaagcaccggagcaccgagcacaacuccagccugauggucuccgagagcgaguucgacagcgaccaggacacgaucuucucccgcgagaagauggagcggggcaacccgaaggugagcaugaacggguccauccgcaacggcgccagcuucuccuacugcagcaaggaccgguga

SEQ ID NO: 31950 - RNA, 2547 nt, Artificial Sequence
  derived and/or modified sequence opt1 from KIAA0319L__Homo_sapiens__XP_011540484
auggagaagcgccugggcgugaagcccaacccggccagcuggauccucuccggguacuacuggcagaccagcgccaaguggcugcggucccuguaccucuucuacacgugcuucugcuucagcguccuguggcuguccaccgacgcgagcgagucccgcugccagcagggcaagacccaguucggggugggccuccggagcgggggcgagaaccaccuguggcugcucgagggcacccccucccugcagagcugcugggccgccugcugccaggacuccgccugccacguguucugguggcuggaggggaugugcauccaggccgacugcagccgcccccaguccugccgggcguuccgcacccacagcuccaacagcaugcucgucuuccugaagaaguuccagacggccgacgaccugggcuuccuccccgaggacgacgugccgcaccuccuggggcugggcuggaacugggccuccuggcggcagagcccgccccgcgccgcgcugcggcccgccguguccagcagcgaccagcagucccugauccgcaagcuccagaagcgggggagccccuccgacgucgugacccccaucgugacccagcacagcaaggucaacgacuccaacgagcugggcggccugaccacgagcggguccgccgaggugcacaaggccaucaccaucagcagcccccucaccaccgaccugacggccgagcuguccggcgggcccaagaacguguccguccagccggagaucagcgagggccucgcgaccacccccuccacccagcaggucaagagcuccgagaagacgcagaucgccgugccccagcccguggccccgagcuacuccuacgccacccccacgccccaggccagcuuccaguccaccagcgcgcccuacccggugaucaaggagcugguggucagcgccggcgaguccgugcagaucacccugcccaagaacgaggugcagcucaacgccuacguccugcaggagccgcccaagggggagaccuacaccuacgacuggcagcugaucacccacccccgcgacuacagcggcgagauggaggggaagcacucccagauccucaagcugagcaagcugacgcccggccucuacgaguucaaggugaucguggaggggcagaacgcccacggcgagggcuacgucaacgugaccgucaagcccgagccccggaagaaccgcccgcccaucgccaucgugagcccccaguuccaggagaucucccugccgaccaccuccacggugaucgacgggagccaguccaccgacgacgacaagaucguccaguaccacugggaggagcugaagggcccccuccgggaggagaagaucagcgaggacaccgcgauccugaagcuguccaagcucgugcccgggaacuacaccuucagccugacgguggucgacuccgacggcgccaccaacagcaccaccgccaaccugacggugaacaaggccguggacuacccgcccgucgccaacgcggggcccaaccaggugaucacccucccccagaacuccaucacccuguucggcaaccagagcaccgacgaccacggcaucaccuccuacgaguggagccugagccccuccagcaaggggaagguggucgagaugcagggcgugcgcacgccgacccuccagcuguccgccaugcaggagggggacuacaccuaccagcugaccgugacggacaccaucggccagcaggccaccgcccaggucaccgugaucgugcagcccgagaacaacaagccgccccaggcggacgccgggcccgacaaggagcugacgcuccccgucgacagcaccacccuggacggcuccaagagcuccgacgaccagaagaucaucagcuaccugugggagaagacccagggccccgacggggugcagcucgagaacgccaacuccagcguggccacggucaccggccuccagguggggaccuacguguucacccugacggucaaggacgagcggaaccugcagucccagagcuccgugaacgugaucgucaaggaggagaucaacaagcccccgaucgccaagaucaccggcaacguggugaucacccugcccaccagcacggcggagcuggacggcuccaagagcuccgacgacaaggggaucgucagcuaccucuggacccgcgacgagggcucccccgccgccggggaggugcugaaccacagcgaccaccaccccauccuguuccucagcaaccugguggagggcaccuacaccuuccaccugaaggucacggacgccaagggggaguccgacaccgaccggaccaccguggaggugaagccggacccccgcaagaacaaccucgucgagaucauccuggacaucaacgugagccagcugacggagcggcucaagggcauguucauccgccagaucggcgugcugcuggggguccucgacuccgacaucaucgugcagaagauccagcccuacaccgagcagcgcaagaucagcuccguggaggccagccugaaguga

SEQ ID NO: 31951 - RNA, 3213 nt, Artificial Sequence
  derived and/or modified sequence opt1 from KIAA0355__Homo_sapiens__NP_055501
auguacugcugcagcgcccaggacuccaagauggacuacaagcgccgguuccugcucggcgggagcaagcagaaggugcagcagcaccagcaguaccccaugccggagcugggccgcgcccuguccgcgccccucgccagcaccgccaccaccgcgccccuggggucccugaccgccgccggcagcugccaccacgccaugccccacaccaccccgaucgccgacauccagcaggggaucuccaaguaccucgacgcccugaacgucuucugccgggcgagcacguuccugaccgaccucuucuccaccguguuccgcaacagccacuacuccaaggccgccacccagcugaaggacgugcaggagcacgucauggaggccgccagccggcugacguccgcgaucaagcccgagaucgccaagaugcucauggagcugagcgccggcgccgccaacuucaccgaccagaaggaguucucccugcaggacaucgaggugcucggccgcugcuuccugaccgugguccaggugcacuuccaguuccugacccacgcgcuccagaaggugcagcccgucgcccacagcugcuucgccgaggugaucgugcccgagaagaagaacuccgggagcggcgggggccuguccgggaugggccacacgccggaggucgaggaggccgugcggagcuggcgcggcgccgcggaggccaccagccggcugcgcgagcgggggugcgacggcugccucgccgggaucgaggugcagcagcuguucugcucccagagcgccgccauccccgagcaccagcugaaggagcucaacaucaagaucgacuccgcgcugcaggccuacaagaucgcccuggagagccucggccacugcgaguacgccaugaaggcgggcuuccaccugaaccccaaggccaucgaggccucccugcaggggugcugcagcgaggccgaggcccagcagaccggccgccggcagacgccgccccagcccaugcagugcgagcuccccaccguccccgugcagaucgggucccacuuccugaagggcgugagcuucaacgaguccgcggccgacaaccugaagcucaagacccacaccaugcugcagcugaugaaggaggccgggugcuacaacggcaucaccagccgcgacgacuuccccgucacggaggugcucaaccaggugugccccuccaccuggcggggcgccugcaagaccgccguccagcugcuguucgggcaggcgggccucgugguggucgacaccgcccagaucgagaacaaggaggccuacgcgccccagaucagccuggaggggucccgcaucgugguccaggugcccagcacguggugccugaaggaggacccggccaccaugucccuccugcagcggagccuggaccccgagaagacccucggccugguggacguccuguacaccgccgugcucgaccugaaccgcuggcgggccgggcgcgagcaggcccugcccugcauccagauccagcugcagcgggagaucugcgacuucggcaaccaggccgaccuccccuccggcaacgggaacaagagcuccggcgggcugcagaagacguucagcaagcugaccagccgcuucaccaagaaggcguccugcaccagcuccagcuccagcacgaacuacuccauccagaacaccccgagcaagaacaucuucaucgccggcugcuccgaggagaaggccaagaugcccgggaacaucgacacccgccuccagagcauccugaacaucggcaacuucccccggaccacggaccccucccagagcgcccagaacuccagcaacaccguggccaacggcuuccugauggagcgccgggagaacuuccuccacggggacgacggcaaggacgagaaggggaugaaccugccgaccgaccaggagaugcaggaggucaucgacuuccuguccggcuucaacaugggccagagccaccaggggagcccccucgugacccgccacaacuccgcggccaccgccauggugacggagcagaaggccggcgccaugcagccccagcagccgagccugcccgucccgcccccgccccgggcgccccaggccggggcccacacgccccugaccccgcagcccggccucgcgccccagcagcagucccccaagcagcagcagccccaggugcaguacuaccagcaccuccugcagccgaucgggccccagcagcccccgccccagccccgcgcccccggcaagugggugcacggcagcucccagcagccggcccaggccgucggggccggccugagcccccuggggcaguggcccggcaucuccgaccugagcuccgaccucuacagccuggggcugguguccagcuacauggacaacgugauguccgagguccucggccagaagccccagggcccgcggaacaacaccuggcccaaccgcgaccagagcgacgggguguucggcaugcugggggagauccugcccuucgacccggccgugggcuccgaccccgaguucgcgcgguacgucgccggggugagccaggccaugcagcagaagcgccaggcccagcacggccggcgccccggcaacccccgggggaacuggccgcccauggacgacgcccaccgcaccuggcccuuccccgaguucuucaccgagggcgacgggcuccacggcgggugguccggcgcgcagggcgacagcgccuccagcuccgacgagaccagcagcgccaacggggacucccuguucagcauguucuccggcccggaccugguggccgccgucaagcagcggcgcaagcacagcuccggggagcaggacaccagcacgcuccccuccccgccccugcugaccaccguggaggacgugaaccaggacaacaagaccaagacguggccgcccaaggcgcccuggcagcaccccagcccccuccccuccacccugcccagccccuccgccccgcuguacgccgucaccagccccggcucccaguggaacgacaccaugcagaugcuccagagccccgugugggccgccacgaacgacugcuccgcggccgccuucagcuacgugcagacgcccccgcagcccccgcccccgcccgcccacaaggccgcgcccaagggcuucaaggccuuccccgggaagggcgagcggcgccccgccuaccugccccaguacuga

SEQ ID NO: 31952 - RNA, 1704 nt, Artificial Sequence
  derived and/or modified sequence opt1 from KIAA0391__Homo_sapiens__NP_001243607
augaccuucuaccuguucggcauccgcagcuuccccaagcucuggaaguccccguaccuggggcugggccccgggcacagcuacgugucccucuuccuggccgaccggugcggcauccgcaaccagcagcggcuguucagccucaagaccaugagcccccagaacacgaaggccaccaaccugaucgcgaaggcccgcuaccugcggaaggacgagggguccaacaagcaggucuacuccgugccccacuucuuccucgccggcgccgccaaggagcgcagccagaugaacucccagaccgaggaccacgcgcuggccccggugcggaacaccauccagcugcccacgcagccccucaacagcgaggagugggacaagcugaaggaggaccugaaggagaacaccggcaagaccuccuucgagagcuggaucaucucccagauggccgggugccacagcuccaucgacgucgccaagagccuccuggcguggguggccgccaagaacaacggcaucguguccuacgaccugcucgucaaguaccuguaccugugcguguuccacaugcagaccagcgaggugaucgacgucuucgagaucaugaaggcccgcuacaagacgcucgagccccggggguacucccugcugauccgcggccucauccacagcgaccgguggcgcgaggcccugcugcuccuggaggacaucaagaaggugaucaccccgagcaagaagaacuacaacgacugcauccagggggcgcugcuccaccaggacgugaacaccgccuggaaccuguaccaggagcugcucggccacgacaucguccccaugcuggagacccugaaggccuucuucgacuucggcaaggacaucaaggacgacaacuacuccaacaagcuccuggacauccugagcuaccuccggaacaaccagcuguaccccggggaguccuucgcccacagcaucaagacgugguucgaguccggccagugcagcgggugcggcaagaccaucgaguccauccagcugagccccgaggaguacgagugccucaagggcaagaucaugcgcgacgugaucgacgggggcgaccaguaccggaagaccaccccgcaggagcugaagcgcuucgagaacuucaucaagucccggccgcccuucgacguggucaucgacgggcugaacguggccaagauguuccccaaggugcgcgagagccagcuccugcugaacgucgugucccagcucgcgaagcggaaccugcgccugcuggugcucggccggaagcacaugcugcgccgcagcucccaguggagccgggacgagauggaggagguccagaagcaggccuccugcuucuucgccgacgacaucagcgaggacgaccccuuccugcucuacgccacgcugcacuccgggaaccacugccgcuucaucacccgggaccugaugcgcgaccacaaggccugccuccccgacgcgaagacccagcggcuguucuucaaguggcagcagggccaccagcuggccaucgugaaccgcuuccccggcagcaagcucaccuuccagcggauccuguccuacgacacggugguccagaccaccggggacagcuggcacauccccuacgacgaggaccugguggagcgcugcagcugcgaggucccgaccaaguggcucugccugcaccagaagacguga

SEQ ID NO: 31953 - RNA, 4935 nt, Artificial Sequence
  derived and/or modified sequence opt1 from KIAA0586__Homo_sapiens__NP_001231118
auguucuggugcggcaccugcuucgugaccaacaacaugaaggggagcgaggucucccuggagaagaagaagaagaucaagaugcccgugaagcgccuccgggagguggucagccagaaccacggcgaccaccuggugcugcucaaggacgagcugccgugcgugccccccgcccuguccgccaacaagcgccuccccgucgggacgggcaccagccugaacgggaccucccggggcagcuccgaccugaccagcgcgcgcaacugcuaccagccgcuccuggagaaccccaugguguccgagagcgacuucuccaaggacguggccguccaggugcugccccucgacaagaucgaggagaacaacaagcagaaggccaacgacaucuucaucagccaguacacgaugggccagaaggacgcccugcggaccgugcugaagcagaacgucucccucugccugaccggguggagcgaccacuccggcgugaucaccacgcacugcagccuguaccuccugcgccugaugcgguccagccaccucucccugcccagcagcugggacuaccgcgcccaguccaugccgguguucaaggaggucaaggugcaccugcucgaggacgcggggaucgagaaggacgccgugacccaggagacccggaucagccccuccggcaucgacagcgccaccacggucgccgcggccaccgccgccgccaucgcgaccgccgccccccugaucaaggugcaguccgaccuggaggccaaggugaacagcgucaccgagcuccuguccaagcugcaggagacggacaagcaccuccagcgcgugaccgagcagcagaccagcauccagcggaagcaggagaagcugcacugccacgaccacgagaagcagaugaacguguucauggagcagcacauccgccaccuggagaagcuccagcagcagcagaucgacauccagacccacuucaucuccgccgcgcugaagacgagcuccuuccagcccgucagcaugccguccagccgggccguggagaaguacuccgucaagcccgagcaccccaaccuggggagcugcaaccccucccucuacaacaccuucgccagcaagcaggccccgcugaaggagguggaggacaccuccuucgacaagcagaagagcccccuggagacccccgccccccgccgguucgcgccggugcccgucagccgcgacgacgagcucuccaagcgggagaaccugcuggaggagaaggagaacauggaggugagcugccaccgcggcaacgugcggcuccuggagcagauccugaacaacaacgacucccucacgcgcaagagcgaguccagcaacaccaccucccugacccggagcaagaucggcuggacgcccgagaagaccaaccgcuuccccuccugcgaggagcuggagaccaccaaggucacgaugcagaagagcgacgacgugcuccacgaccuggggcagaaggagaaggagaccaacuccauggugcagccgaaggagagccuguccaugcugaagcuccccgaccugccccagaacagcgucaagcugcagaccaccaacacgacccgcuccgugcucaaggacgccgagaagauccugcggggcgugcagaacaacaagaagguccuggaggagaaccucgaggccaucauccgcgccaaggacggggccgcgauguacagccugaucaacgcccuguccaccaaccgggagaugagcgagaagauccgcauccggaagaccguggacgaguggaucaagaccaucagcgccgagauccaggacgagcucucccgcacggacuacgagcagaagcgguucgaccagaagaaccagcgcaccaagaagggccagaacaugaccaaggacauccggaccaacacgcaggacaagaccgugaacaagagcgucaucccccgcaagcacucccagaagcagaucgaggagcacuuccggaaccugccgaugcgcggcaugcccgccagcucccugcagaaggagcggaaggaggggcuccugaaggcgaccaccgugauccaggacgaggacuacaugcugcagguguacggcaagcccgucuaccaggggcaccgcagcacgcucaagaagggcccguaccugcgguucaacucccccagccccaagucccgcccccagcggccgaaggugaucgagcgcgugaaggggaccaaggucaagagcauccggacccagaccgacuucuacgccacgaagcccaagaagauggacuccaagaugaagcacagcgugcccgugcugccccacggcgaccagcaguaccucuucuccccgagccgcgagaugcccaccuucuccggcacccuggaggggcaccugauccccauggccauccuccugggccagacccagagcaacuccgacacgaugcccccggccggggucaucgugagcaagccccaccccgugaccgucaccaccuccauccccccgagcagccgcaagguggagacgggcgugaagaagcccaacaucgccaucgucgagaugaaguccgagaagaaggaccccccccagcugaccgugcaggugcucccgagcgucgacaucgacuccaucagcaacuccagcgcggacgugcuguccccccugagcucccccaaggaggccagccuccccccggugcagaccuggaucaagacccccgagaucaugaaggucgacgaggaggaggugaaguuccccgggacgaacuucgacgagaucaucgacgugauccaggaggaggagaagugcgacgagaucccggacuccgagcccauccuggaguucaaccggagcgucaaggccgacuccaccaaguacaacggcccccccuucccgcccguggccagcaccuuccagcccaccgccgacauccuggacaaggugaucgagcgcaaggagacgcucgagaacucccugauccagugggucgagcaggagaucaugagccggaucaucuccggccuguuccccgugcagcagcagaucgcgccgagcaucuccgugagcgucagcgagaccuccgagccccucaccagcgacaucguggaggggaccuccagcggcgcccugcagcuguucguggacgccgggguccccgugaacuccaacgugaucaagcacuucgucaacgaggcccucgccgagacgaucgcggugaugcugggcgaccgcgaggccaagaagcaggggcccgucgccaccggcgugagcggcgacgccuccaccaacgagaccuaccugccggcgcgggugugcacgccccuccccaccccccagccgaccccccccugcagccccuccagcccggccaaggagugcguccuggugaagacccccgacuccagccccugcgacuccgaccacgacauggccuuccccgugaaggagaucugcgccgagaagggggacgacaugccggccaucaugcuggucaacacccccacggugacccccaccaccacgcccccgcccgcggccgccguguucacccccacccucagcgacaucuccaucgacaagcugaaggucagcuccccggagcugcccaagcccuggggcgacggggaccucccccuggaggaggagaacccgaacagcccccaggaggagcugcacccccgcgccaucgugauguccguggccaaggacgaggagcccgagagcauggacuucccggcgcagcccccccccccggagcccguccccuucaugcccuucccggccggcaccaaggcccccagccccucccagaugcccggcagcgacuccagcacgcucgaguccacccugagcgugaccgugaccgagacggagacccuggacaagccgaucuccgagggggagauccucuucagcugcggccagaagcuggcccccaagauccuggaggacaucgggcucuaccugaccaaccugaacgacucccucagcuccacccugcacgacgccgucgagauggaggacgacccccccagcgagggccaggugauccggaugucccacaagaaguuccacgcggacgccauccugagcuucgccaagcagaaccaggaguccgccgugagccagcaggcggucuaccacuccgaggaccucgagaacagcgugggggagcuguccgagggccagcgcccgcagcugacggccgccgccgagaacauccucaugggccacagccuguacaugcagccccccgugaccaacacccagagccuggaccagcagugcgaccccaagccgcucucccggcaguucgacaccgucagcggguccaucuacgaggacagcugcgccucccacggccccaugagccugggggagcuggagcucgagcccaacuccaagcuggugcugccgacgacccuccugaccgcgcaggagaacgacgugaaccugcccgucgccgccgaggacuucagccaguaccagcucaagcagaaccaggacgugaagcagguggagcacaagcccucccagagcuaccugcgcguccggaacaaguccgacaucgcccccagccagcagcagguguccccgggcgacauggaccgcacccagaucgagcugaaccccuaccucacgugcguguucagcgggcugggcguccacgugaagaagguguccugcaucggcaagcuggggcucuggcgguucgucauccagaucaucagcuccccccgcugggagagcuccgccacccugcgguucaccgacgcgcccugccaggacgugagcgacgccgccgugagcgagccgcgcggccugcucuccgucagcgagucccagcacaacgccgggggccacgggguguucggcggccgguaccugcugaacgggaagcgccagcccgcccagugccucugccacugguucuga

SEQ ID NO: 31954 - RNA, 3828 nt, Artificial Sequence
  derived and/or modified sequence opt1 from KIAA0825__Homo_sapiens__NP_001139150
auggacugggacgacgaguacagccacaacuccuucgaccugcacugccuccugaacagcuuccccggcgaccuggaguucgagcagaucuucuccgacaucgacgagaagaucgagcagaacgccgccagcaucaagcacugcaucaaggagauccaguccgagaucaacaagcagugcccgggggugcagcuccagaccaccaccgacugcuucgaguggcugaccaacuacaacuacagcaccuccgagagcuccuucaucagccacggcgaccugaucaaguucuucaagacccuccaggaccugcugaagaacgagcagaaccaggaggagaugacgcucgaccugcugugggaccucuccugccacagcuccgucagcuuccccuccacccugagcgggaccuccuuccacuuccugagccgcaccucccuccacagcguggaggacaacagcuccauggacgucaagagcaugugggacgacauccggcugcaccuccgccgguuccucguguccaagcugcagagccacaacgagaucaacaacucccagcagaagauccugcucaagaagcagugccugcagcagcuccuguuccuguaccccgagagcgaggugaucaucaaguaccagaacauccagaacaagcugcucgcgaaccugcuguggaacugcuuccccuccuacaaccgcgacagcaaccucgacgugaucgcccacggcuaccaguccacgaugcugaagcuguacagcgucaucaaggaggacuucaacacccucugcgagauccuggccccguccagcauggugaaguucaucaaggagaccuaccuggacaccgugacggaggagauggccaaguuccucgagaacuucugcgagcugcaguuccgggagaacgccguccgcguggugaagaccuccaagagcuccagcaagcaccgcggggcgguccacgcccuggugaccaccgagugcccccagaagggccggaacuucucccucccccuggacaagguggaguuccugagccagcucaucaaguccuucaugaagcuggagaagggcguccaggagcuguucgacgagauccuccugagccugaagaucacgcgggacaccagcgggauccucgagaaguccgaccgcgagguggugauggagaagccccgggccaacgagaccaacaucccgagcgagcagucccugcccggcaaggaggccacccugcuggacuucggguggcgcagcgcguucaaggaggucucccuccccauggcccacugcguggugacggccaucgagggcuucagcaccaagauccugcagcaggagcagaacgagcgguccagcgccgucuccuacgccaugaaccuggugaacgugcagcaggucuggcaggacagccacauguuccccgaggaggagcagccgaagaagaucgggaaguucugcuccgacaucauggagaagcucgacaccaugcugccccuggcgcucgccugccgcgacgacagcuuccaggagauccgggccaaccugguggaggccugcugcaaggucgccaccgcggugcugcagcgccuccaggagcgggccaaggaggugcccuccaaggcgccccugaagaaccugcacacguaccucagcaccgccgucuacguguuccagcacuucaagcgcuacgacaaccugaugaaggagaugaccaagaagccgaucuuccuggugcucguccagcgguaccaggaguucaucaacacccugcaguuccaggugacgaacuacugcgugcgcgucugcgccaccuccauccugcaggacgccgagagccaccacugggacgacuacaaggccuucuacgagggcgagcggugcuccuucagcauccagauguggcacuacuucugcuggagccuccacuacgaccuguggaccauccugccgcccaagcucgcccaggagauccugguggaggugcuggagaagucccucagccugcuggccucccgcuacgcccgcgcgcaccccagccggaagcgcacgccccagcuccggcuggacgucaccaccauccugaucugcaccgagaacaugcucugguccgugugcaccagcgugcagaagcugcugaacccccaccagcacacggacgacaagaucuucaagauccacacccacugcaacaaccucuucaccacccuggucauccugaccagcccccucacggagcuguacaagaccuuccagcacggccuggacgagagcgccuccgacagccucaaguccuucuucaagcagccccuguacugggugagcugcaucucccacuucuacccgagccugcuccgcacccccuccgccgggggccugaaggccgaggggcagcugaagcuccugcugagccagccccggugcaacuggaaccuccugcuggagacccuccugcaccacgacggccugcuccugcgcauccugcucaaguccagcaagcaggucuccgacacggagaacaaccugaaccagggccccagccugauggaggcgaucuucaagauccucuaccacugcagcuucuccccgcagaccuucgccaacguguucgugagcuacauggaggaggagcagcugugggacuuccuguacaacauccccguguccacgugcgucgaguacgagcucgaggugauccggugccugcgccuggcccucaccgacgccaucaaggacaccgugcagcagaucgucagcgugauguccagccggcgcaacugcgagaccaaccugaacaagcacaucgugcccgacugccugcucgaguccaugccgaaggaguggaacuacagccccaaggagaccaaccggaaggaguccugcaagagcuucacccgccugacggcccaggcggucuccaucgugaucagcaagcugcccaccgugaucgccugccugcccccgcccgucaaguacuucuucuuccuguccgagcggaagaugagcaagaaguucguggagcugaagaaggccgggcuccugguguggaaccugaucgucaucaucugccgcaucuucgaggacggcaacaccguggagcuccugaccggggccucccuggaccgguggagcaaggagaagcucggccugaucugcaugugccugaaguccaucaugggggaccagacgagcauccacaaccagaugauccagaaggugauccaguccaucgagcagcagaagcccaacuggaucgagcgccagcuccugaaggcccggaagcugagcaccgagugcgcguucaugaccaucgagaaguccaccgcccuccaggagggcgacgucgcccuggagcugacggagcagaagaucaacaccauggugcucgaccugugccacaagcccggcgggcgcgaguaccugcggcagaucuaccacaucaugcagcucaacgaggaguaccugaaggagcagcuguucuccaugaacagcuccgaggagaagccgcugcccauccgcccccucaagaccacccugcgcagcaucgaggaccagcccuccgccuucaacccguuccacguguacaaggccuucagcgagaacaugcuggaccaggucuccaucacgaaguggaacuggaacugggcgaagcuccugcccaacuaccugcggcucgacaagaugaccuucagcgugcugcugaagaaccgcugggagaugaagaaggacgagacccucgaggaggaggagaaggccauccuggagcaccugaagcagaucugcacgccccagaacuccagcgccuccgacaacaucgaggagcaguga

SEQ ID NO: 31955 - RNA, 1845 nt, Artificial Sequence
  derived and/or modified sequence opt1 from KIAA0907__Homo_sapiens__NP_055764
augagcgccggcuccgccacccaccccggggcgggcgggcgccggagcaagugggaccagccggcccccgcgccccuccuguuccugcccccggccgcccccggcggggaggugaccuccagcggcggcucccccgggggcacgaccgccgcccccagcggggcccuggacgccgcggccgccgucgccgccaagaucaacgcgaugcucauggccaagggcaagcugaagccgacccagaacgccuccgagaagcugcaggcccccgggaagggccucaccagcaacaaguccaaggacgaccuggugguggccgaggucgagaucaacgacgugccccugacgugccgcaaccuccugacccggggccagacccaggacgagaucagccgccuguccggggcggccgugagcacccggggccgcuucaugacgaccgaggagaaggccaaggucgggcccggcgaccggccgcucuaccugcacgugcagggccagacccgcgagcugguggaccgggccgucaaccgcaucaaggagaucaucaccaacgggguggugaaggccgcgacgggcaccucccccaccuucaacggggccaccgucacgguguaccaccagcccgcccccaucgcccagcucagcccggccgugucccagaagccgcccuuccagagcggcaugcacuacguccaggacaagcuguucguggggcuggagcacgcggugcccaccuucaacgucaaggagaagguggagggccccggcugcuccuaccuccagcacauccagaucgagaccggggccaagguguuccugcggggcaaggggagcggcugcaucgagcccgccuccgggcgcgaggccuucgagcccauguacaucuacaucagccaccccaagccggagggccuggcggccgccaagaagcucugcgagaaccugcugcagaccguccacgccgaguacagccgguucgugaaccagaucaacacggccgugccccuccccggcuacacccagcccuccgcgaucagcuccgucccgccccagcccccguacuaccccagcaacggguaccaguccggcuaccccguggugcccccgccccagcagcccgugcagcccccguacggggugcccagcaucgucccgcccgccgugucccuggcccccggcgugcugcccgcccuccccaccggggugcccccgguccccacccaguaccccaucacgcagguccagcccccggccagcaccggccagucccccaugggcgggcccuucauccccgcggccccggucaagaccgcccugcccgccggcccccagccgcagccccagccccagcccccgcugcccagccagccccaggcccagaagcgccgguucaccgaggagcuccccgacgagcgcgaguccgggcugcugggcuaccagcacggcccgauccacaugacgaaccucgggaccggcuucagcucccagaacgagaucgagggggcgggcagcaagcccgccuccagcuccgggaaggagcgggagcgcgaccggcagcugaugcccccgcccgccuuccccgugaccggcaucaagaccgagagcgacgagcgcaacggcuccgggacgcugaccggcagccacgacuaccccgccaagaagaugaagaccaccgagaagggguucggccucguggcguacgccgccgacagcuccgacgaggaggaggagcacgggggccacaagaacgccagcuccuucccccagggcuggagccugggguaccaguacccguccagccagccccgggccaagcagcagaugcccuucuggauggcgcccuga

SEQ ID NO: 31956 - RNA, 4833 nt, Artificial Sequence
  derived and/or modified sequence opt1 from KIAA0922__Homo_sapiens__NP_001124479
auggccggccugcgccggccccagccggggugcuacugccgcaccgccgcggccgugaaccuccugcugggcgucuuccaggugcuccugcccugcugccggcccgggggcgcccaggggcaggccaucgagccccugccgaacguggucgagcucuggcaggccgaggagggcgagcugcugcuccccacccagggcgacagcgaggaggggcuggaggagcccucccaggagcagagcuucuccgacaagcuguucagcggcaaggggcuccacuuccagcccuccgugcuggacuucggcauccaguuccuggggcacccgguggcgaagauccuccacgccuacaaccccagccgcgacuccgaggucguggugaacagcgucuucgccgccgcgggccacuuccacgugccccccgugccgugccgggucauccccgccaugggcaagacguccuuccgcaucaucuuccugcccaccgaggaggggagcaucgaguccagccuguucaucaacaccuccagcuacggcgugcucuccuaccacgugagcgggaucggcacccggcgcaucuccacggagggcagcgccaagcagcugcccaacgccuacuuccugcucccgaagguccaguccauccagcugagccagaugcaggccgagaccaccaacaccagccugcuccaggugcagcuggagugcucccugcacaacaaggugugccagcagcucaaggggugcuaccuggagagcgacgacguccugcggcuccagauguccaucauggugacgauggagaacuucagcaaggaguucgaggagaacacccagcaccugcuggaccaccucuccaucguguacgucgcgaccgacgagagcgagaccuccgacgacagcgccgugaacauguacauccugcacuccggcaacagccugaucuggauccaggacauccgccacuucucccagcgggacgcccucagccugcaguucgagcccgugcugcuccccacguccaccaccaacuucaccaagaucgccagcuucacgugcaaggccgcgaccuccugcgacagcgggaucaucgaggacgucaagaagaccacccacacgcccacccugaaggccugccuguucuccagcguggcccagggcuacuuccgcauggacuccagcgccacccaguuccacaucgagacccacgagaacacgagcgggcucugguccaucugguaccggaaccacuucgaccgcagcgucgugcugaacgacguguuccuguccaaggagaccaagcacaugcucaagauccugaacuucaccggcccgcuguuccucccccccggcugcuggaacaucuucagccugaagcuggccgucaaggacaucgcgaucaaccuguucaccaacguguuccucacgaccaacaucggggccaucuucgccaucccccugcagaucuacuccgccccgaccaaggagggcagccugggguucgaggugaucgcccacugcggcaugcacuacuucauggggaaguccaaggcgggcaaccccaacuggaacggcagccucucccuggaccagagcaccuggaacgucgacuccgagcuggccaacaagcucuacgagcgguggaagaaguacaagaacggggacgugugcaagcgcaacgugcugggcacgacccgguucgcccaccugaagaagagcaaggaguccgagagcuucgucuucuuccucccccgccugaucgccgagcccgggcugaugcucaacuucuccgcgaccgcccugcggagccgcaugaucaaguacuucguggugcagaacccguccagcuggcccgucagccugcagcuccugccccugucccucuacccgaagcccgaggcccuggugcaccugcuccaccggugguucggcaccgacaugcagaugaucaacuucacgaccggggaguuccagcugaccgaggccugccccuaccugggcacccacagcgaggagucccgcuucggcauccuccaccugcaccugcagccccucgagaugaagcgcgugggggucguguucaccccggccgacuacggcaaggugacgagccugauccugauccggaacaaccucaccgucaucgacaugaucgggguggagggcuucggcgcgcgcgagcugcugaagguggggggccggcuccccggggccggcgggucccugcgcuucaagguccccgagagcacccugauggacugccggcgccagcucaaggacuccaagcagauccugagcaucaccaagaacuucaagguggagaacaucggcccccugccgaucacgguguccagccucaagaucaacggcuacaacugccagggguacggcuucgagguccuggacugccaccaguucucccuggaccccaacaccagccgggacaucuccaucguguucacccccgacuucaccagcuccugggugauccgcgaccucagccuggucacggccgccgaccuggaguuccgguucacccucaacgugacccugccccaccaccugcucccgcugugcgccgacgugguccccgggcccuccugggaggagagcuucuggcgccugaccguguucuucgugucccucagccugcugggcgucauccucaucgcguuccagcaggcccaguacauccugauggaguucaugaagacgcggcagcgccagaacgccagcuccagcucccagcagaacaacgggcccauggacgugaucagcccgcacuccuacaagagcaacugcaagaacuuccuggacaccuacggccccuccgacaagggccgggggaagaacugccuccccgugaacaccccccagagccgcauccagaacgccgccaagcgguccccggcgaccuacggccacagccagaagaagcacaagugcuccgucuacuacagcaagcacaagacguccaccgccgccgccagcuccaccagcaccacgaccgaggagaagcagaccuccccccuggggagcucccugcccgcggccaaggaggacaucugcaccgacgccaugcgcgagaacuggaucagccuccgguacgccagcggcaucaacgugaaccugcagaagaaccugacgcuccccaagaaccugcugaacaaggaggagaacacccucaagaacaccaucguguucuccaacccgagcuccgagugcagcaugaaggaggggauccagaccugcauguuccccaaggagacggacaucaagaccuccgagaacaccgccgaguucaaggagcgcgagcugugcccccugaagaccagcaagaagcucccggagaaccaccugccccggaacuccccccaguaccaccagcccgaccugccggagaucagccgcaagaacaacggcaacaaccagcagguccccgugaagaacgagguggaccacugcgagaaccucaagaaggucgacacgaagcccuccagcgagaagaagauccacaagaccucccgcgaggacauguucagcgagaagcaggacauccccuucguggagcaggaggacccguaccggaagaagaagcugcaggagaagcgcgagggcaaccugcagaaccucaacugguccaagagccggaccugccgcaagaacaagaagcgggggguggcgcccgucucccgcccccccgagcagagcgaccugaagcuggugugcuccgacuucgagcggagcgagcucuccagcgacaucaacgugcgcagcuggugcauccaggaguccacccgggaggucugcaaggccgacgccgagaucgccagcucccugccggccgcgcagcgcgaggccgagggcuacuaccagaagcccgagaagaagugcguggacaaguucugcagcgacuccagcuccgacugcgggagcuccagcggcuccgugcgggccagccgcggguccuggggcagcugguccagcacguccagcuccgacggcgacaagaagcccauggucgacgcccagcacuuccugcccgccggggacagcgugagccagaacgacuucccguccgaggcgcccaucagccucaaccugucccacaacaucugcaaccccaugaccgucaacagccugccccaguacgccgagccguccugccccagccuccccgccggccccaccgggguggaggaggacaagggccuguacuccccgggcgaccuguggcccaccccccccgugugcgucaccagcucccucaacugcacgcuggagaacggggugccgugcgugauccaggagagcgcccccguccacaacuccuucaucgacuggagcgcgaccugcgagggccaguucuccagcgccuacugcccccuggagcucaacgacuacaacgccuucccggaggagaacaugaacuacgccaacggguuccccugccccgccgacgugcagaccgacuucaucgaccacaacucccagagcaccuggaacacgcccccgaacaugcccgcggccuggggccacgccuccuucaucagcuccccccccuaccugaccagcacccggagccuguccccgaugagcgggcucuucggcuccaucugggccccccagagcgacguguacgagaacugcugccccaucaaccccaccacggagcacuccacccacauggagaaccaggccgucgugugcaaggaguacuacccgggcuucaaccccuuccgcgcguacaugaaccuggacaucuggaccaccacggccaaccggaacgccaacuucccccugagccgcgacuccagcuacugcgggaacguguga

SEQ ID NO: 31957 - RNA, 2751 nt, Artificial Sequence
  derived and/or modified sequence opt1 from KIAA1024__Homo_sapiens__NP_056021
auggagaccagccaggagaccucccuguuccucgugaagauccuggaggagcuggacagcaagcagaacacggucuccuaccaggaccucugcaagagccugugcgcccgcuucgaccugucccagcucgccaagcugcggagcgugcuguucuacaccgcgugccucgaccccaacuucccggccacccuguucaaggacaagaugaagugcaccgugaacaaccagcaguccaagaagaucauggucgccgccgacaucgugacgaucuucaaccugauccagaugaacggcggggccgcgaaggagaagcuccccaccggccgccagaaggugcggaagaaggaggccagcuucgaguccugccgcagcgacaccgagaucugcaacgccgccgagugcgagccccugaacugcgagcuguccgagcggagcuucucccgcggguaccccauccggcagagcuccaagugccgcaagauggacugcaaggacugcccgcaguucguccccgcgagcgagcccaacuuccuccugggcguguccaaggaggugaagaaccgggccgccagccuggaccgccuccaggcccuggcccccuacuccgucaccagcccgcagcccugcgagaugcagcggacguacuuccccaugaacaucgagaacgagagcaucuccgaccaggacagccugcccaucaaccaguccaucaaggagaccuucaucagcaacgaggagccguucguggugcaguccugcguccagaagcgcaacaucuucaaggaggacuuccacaaccucauggcggugagccccucccugguggggcccaucagcaaggccgagaacgagcaccgggagccccagucccgcaaggagccgcacaagccgcccuucuucaaccacagcuucgagaugcccuacaacucccaguaccugaaccccgucuacagccccgugcccgacaagcggcgcgccaagcacgagucccucgacgaccugcaggccagcaccuacuucggccccaccccggugaugggcacgcaggaggcccggcgcugccuggggaagcccaacaagcagacccccuggcccgcgaaguccuggagccucaacaccgaggaggucccggacuucgagcgguccuucuucaaccgcaaccccagcgaggagaagcugcacuaccccaacgccuccagccagaccccgaacuuccccgcccccgagcggcgccccacguaccuggugccgaaggaccagcagcccauccuccccaucgccuacgccgcgaagcagaacggccugaaguccaaggagaucuccagccccguggaccuggagaagcacgagccggucaagaaguucaaggacaaguccaucaacugcaccagcgggcagcucuccagcgacaccuccagcgugggcacccagacggagcacgugcuggagcccaagaagugccgcgaccugugcaccuccgggcagggcaaguacagcgaccggcacaccaugaagcacuccgacgacgacagcgagaucgucuccgacgacaucagcgacaucuuccgcuuccucgacgacauguccaucagcggcuccaccggggugauccagagcagcugcuacaacuccacgggcagccugucccagcugcacaagagcgacugcgacuccagccccgagcacaaccucaccaagaucgccaacgggguccccaacuccaagggcgacaagggcaaccggccggagaacacccaccacagcgaggaggagcugaagaccuccgugugcaagcuggugcuccgcaucggggagaucgagcggaagcuggagagccuguccggcguccgcgacgagaucagccaggugcucgggaagcugaacaagcuggaccagaagaugcagcagcccgagaagguguccguccagaucgaccucaacagccugacguccgagggccccagcgacgacuccgccagcccccggauguuccacgcccacuccgggagccacggcccgaagcuggagaacaaccccgacuggugcugcagcgacgccuccggcagcaacuccgagagccugcgcgugaaggcgcucaagaagucccuguucacccggcccagcucccgcagccugaccgaggagaacuccgccaccgagagcaagaucgccuccaucagcaacagcccccgggacuggcgcacgaucaccuacaccaaccggguggggcucaacgaggaggagaucaaggacaccggcccgggggacaacaaggacuggcaccgcaagagcaaggaggccgaccggcaguacgacaucccgccccagcaccgccugcccaagcagcccaaggacggcuuccuggucgagcaggucuucagcccccaccccuacccggcgagccucaaggcccacaugaaguccaacccccuguacacggacaugcggcugaccgagcucgccgaggugaagcgcgggcagcccagcuggaccaucgaggaguacgcccggaacgccggcgacaagggcaagcugaccgcgcuggaccuccagacccaggagucccugaaccccaacaaccuggaguacuggauggaggacaucuacacgccgggguacgacagccuccugaagcgcaaggaggccgaguuccgccgggccaaggugugcaagaucgccgcccugaucgcggccgccgccugcaccgugauccucgugaucgucgugcccaucugcaccaugaaguccuga

SEQ ID NO: 31958 - RNA, 3522 nt, Artificial Sequence
  derived and/or modified sequence opt1 from KIAA1033__Homo_sapiens__NP_056090
auggccguggagacccugagccccgacugggaguucgaccgcgucgacgacggcucccagaagauccacgccgaggugcagcucaagaacuacgggaaguuccuggaggaguacaccagccagcugcggcgcaucgaggacgcgcucgacgacuccaucggcgacgugugggacuucaaccuggacccgaucgcccugaagcuccugcccuacgagcagagcucccugcucgagcugaucaagacggagaacaagguccugaacaaggugaucaccguguacgccgcccucugcugcgagaucaagaagcugaaguacgaggccgagaccaaguucuacaacgggcugcuguucuacggcgagggggcgaccgacgccagcauggucgagggcgacugccagauccagaugggccgguucaucuccuuccugcaggagcugagcugcuucgugacgcgcugcuacgagguggucaugaacguggugcaccagcucgccgcccuguacaucuccaacaagaucgcgcccaagaucaucgagaccaccgggguccacuuccagaccauguacgagcaccugggcgagcuccugacggugcugcucacccuggacgagaucaucgacaaccacaucacccugaaggaccacuggaccauguacaagcggcuccucaagagcgugcaccacaaccccuccaaguucgggauccaggaggagaagcugaagccguucgagaaguuccuccugaagcuggagggccagcuccuggacgggaugaucuuccaggccugcaucgagcagcaguucgacagccugaacggcggcgucuccgugagcaagaacuccacguucgccgaggaguucgcccacagcauccgcuccaucuucgccaacguggaggcgaagcucggggagcccagcgagaucgaccagcgggacaaguacgucggcaucugcgggcuguucgugcugcacuuccagaucuuccgcaccaucgacaagaaguucuacaagucccuccuggacaucugcaagaaggugcccgccaucacccugaccgccaacaucaucugguuccccgacaacuuccucauccagaagaucccggccgccgcgaagcugcuggaccgcaagagccuccaggccaucaagauccaccgggacacguuccugcagcagaaggcccagagccugaccaaggacguccaguccuacuacguguucgugagcuccuggaugaugaagauggagagcauccucuccaaggagcagcggauggacaaguucgccgaggaccugaccaaccgcugcaacgucuucauccagggcuuccuguacgccuacagcaucuccaccaucaucaagacgaccaugaaccuguacaugagcaugcagaagcccaugaccaagaccuccgugaaggcgcucugccggcuggucgagcugcucaaggccaucgagcacauguucuaccgccggagcauggugguggccgacuccgucagccacaucacgcagcaccuccagcaccaggcccugcacuccaucagcguggccaagaagcgcgugaucuccgacaagaaguacagcgagcagcggcuggacguccuguccgcgcuggugcucgccgagaacacccugaacggccccagcaccaagcagcgccggcugaucgugucccucgcccugagcgucgggacccagaugaagacguucaaggacgaggagcuguucccccuccagguggugaugaagaagcuggaccugaucagcgagcuccgcgagcggguccagacccagugcgacugcugcuuccuguacuggcaccgcgccguguucccgaucuaccuggacgacguguacgagaacgcggucgacgccgcccgccuccacuacauguucuccgcccugcgggacugcgugcccgccaugaugcacgcgcgccaccuggagagcuacgagauccuccuggacugcuacgacaaggagaucauggagauccugaacgagcaccuccuggacaagcugugcaaggagaucgagaaggaccuccggcuguccgugcacacccaccugaagcucgacgaccgcaaccccuucaaggucggcaugaaggaccuggcccuguucuucagccucaaccccauccgguucuucaaccgcuucaucgacauccgggccuacgugacccacuaccuggacaagacguucuacaaccugaccaccguggcccuccacgacugggccaccuacuccgagaugcgcaaccuggcgacgcagcgguacgggcuggucaugaccgaggcccaccucccgagccagacccuggagcagggccuggacgugcucgagaucaugcgcaacauccacaucuucgugucccgguaccuguacaaccugaacaaccagaucuucaucgagcgcaccagcaacaacaagcaccucaacaccaucaacauccggcacaucgccaacuccauccgcacgcacgggaccggcaucaugaacaccaccgucaacuucacguaccaguuccugaagaagaaguucuacaucuucagccaguucauguacgacgagcacaucaagucccggcugaucaaggacauccgcuucuuccgggagaucaaggaccagaacgaccacaaguaccccuucgaccgcgccgagaaguucaaccggggcauccgcaagcucggggugacccccgagggccagagcuaccuggaccaguuccgccagcugaucucccagaucgggaacgccaugggcuacgugcggaugauccgcagcgggggccuccacugcuccagcaacgcgauccgguucguccccgaccuggaggacaucgugaacuucgaggagcuggugaaggaggagggccucgccgaggagacccugaaggccgcccgccaccuggacuccguccucagcgaccacacccggaacagcgcggaggggacggaguacuucaagaugcugguggacguguucgccccggaguuccgccggcccaagaacauccaccuccgcaacuucuacaucaucgucccgccccugacccugaacuucguggagcacuccaucagcugcaaggagaagcugaacaagaagaacaagaucggcgccgccuucaccgacgacggguucgccaugggcguggcguacauccucaagcugcuggaccaguaccgggaguucgacucccuccacugguuccagagcguccgcgagaaguaccugaaggagauccgggccguggccaagcagcagaacgugcaguccgccagccaggacgagaagcugcuccagaccaugaaccugacgcagaagcgccuggacgucuaccuccaggaguucgagcugcuguacuucucccucagcuccgcccggaucuucuuccgcgcggacaagaccgccgccgaggagaaccaggagaagaaggagaaggaggaggagaccaagaccagcaacggggaccuguccgacagcacgguguccgccgaccccguggucaaguga

SEQ ID NO: 31959 - RNA, 15018 nt, Artificial Sequence
  derived and/or modified sequence opt1 from KIAA1109__Homo_sapiens__XP_005263344
auggaccagcggaagaacgagagcaucgugcccagcaucacccagcuggaggacuuccucaccgagcacaacagcaacgucguguggcugcugguggccacgauccucuccugcggcuggaucaucuaccugaccuacuacaacagccggaacgucgggcugauccucacccuggugcugaaccgccucuacaagcacggcuacauccacaucggguccuucagcuucuccgugcugagcggcaaggucauggugcgggagaucuacuacaucaccgaggacauguccauccgcauccaggacggguucaucaucuuccggugguggaagauguacaaccccaagcagaagcagcacgaccccaaggccgagacgcgccuguacaucaccgugaacgacuucgaguuccacgucuacaaccggagcgaccucuacggccgccugcaggagcuguucggccucgagcccaccaucaucccgcccaagaaggacgacgacaagacccgggagaucgggcgcacgcggacccaguccaagaucgagcgcgugaaggugaagaccgagagccaggaccccaccuccagcuggcggucccugauccccgucaucaaggugaacgugagcacgggccgccuggccuucgggaaccacuaccagccccagacccucugcaucaacuucgacgacgccuuccugaccuacaccacgaagccgcccuccagccaccuggaccaguucaugcacaucgucaagggcaagcucgagaacgugcgggugaugcugguccccagcccccgguacguggggcugcagaacgacgagccgccccggcucaugggcgagggcuucguggucaugcagagcaacgacguggacaucuacuacuacauggacgagcccgggcuggugcccgaggagaccgaggagaacaucgagggcgagaugagcuccgaggacugcaagcugcaggaccucccgcccugcugggggcuggacaucgucugcggcaagggcaccgacuucaacuacgggcccugggccgaccgccagcgggacugccuguggaaguucuucuucccgcccgacuaccaggugcucaaggucagcgagaucgcccagcccggccgcccccggcagauccuggccuucgagcugcgcaugaacaucaucgccgacgccaccaucgaccuccuguucacgaagaaccgcgagaccaacgccgugcacgugaacgucggggccggcuccuaccuggagaucaacauccccaugaccguggaggagaacggguacacccccgcgaucaagggccagcuccugcacguggacgccacgaccagcaugcaguaccggacccugcucgaggccgagaugcuggccuuccacaucaacgccuccuacccccgcaucuggaacaugccccagaccuggcagugcgagcuggaggucuacaaggcgacguaccacuucaucuucgcccagaagaacuucuucaccgaccucauccaggacuggagcuccgacuccccgcccgacaucuucuccuucgugcccuacaccuggaacuucaagaucauguuccaccaguucgagaugaucugggccgccaaccagcacaacuggaucgacugcagcaccaagcagcaggagaacguguaccuggccgcgugcggcgagacgcugaacaucgacuucucccuccccuucaccgacuucguccccgcgaccugcaacaccaaguucagccugcgcggcgaggacguggaccugcaccucuuccugcccgacugccaccccuccaaguacagccuguucaugcuggugaagaacugccaccccaacaagaugauccacgacacgggcauccccgccgagugccaguccgggcagaagaccgucaagcccaaguggcgcaacgugacccaggagaaguccggcuggguggagugcuggaccguccccuccgugaugcucaccaucgacuacacguggcaccccaucuacccccagaaggccgacgagcagcugaagcagagccuguccgagauggaggagaccaugcucagcgugcugcggcccagccagaagaccuccgaccgcgucgugagcucccccagcaccuccagccggccgcccaucgaccccuccgagcugccgcccgacaagcuccacguggagauggagcugagccccgacucccagaucacgcuguacgggccccuccugaacgccuuccugugcaucaaggagaacuacuucggcgaggacgacauguacauggacuucgaggaggucaucagcucccccgugcucagccuguccaccagcuccagcuccggcuggaccgcgguggggauggagaacgacaagaaggagaacgagggcagcgccaagagcauccacccccuggcccuccgccccugggacaucaccguccuggugaaccuguacaaggugcacgggcggcuccccguccacggcacgaccgacgggcccgagugccccaccgccuuccuggagcgccugugcuucgagaugaagaagggcuuccgggagaccaugcuccagcugauccuguccccgcucaacguguucgugagcgacaacuaccagcagcggccgcccgucgacgaggugcugcgggagggccacaucaaccuguccgggcuccagcugcgcgcccacgcgauguucagcgccgagggccugccgcucggguccgacagccuggaguacgccuggcugaucgacgugcaggccggcucccucacggcgaaggucaccgcgccccagcuggccugccugcucgaguggggccagaccuucguguuccacguggucugccgggaguacgagcuggagcgccccaagagcgugaucaucugccagcacgggaucgaccggcgcuucugcgaguccaagcugagcugcauccccggcccgugccccaccuccgacgaccucaaguacacgaugauccggcuggccguggacggggccgacaucuacaucgucgagcacggcugcgcgaccaacaucaagaugggggccauccgcguggccaacugcaaccugcacaaccagagcgugggcgagggcaucuccgccgccauccaggacuuccagguccgccaguacaucgagcagcucaacaacugccggaucgggcugcagcccgcggugcugcgccgggccuacuggcucgaggccggcagcgccaaccuggggcugaucaccguggacaucgcccucgcggccgaccaccacuccaagcacgaggcccagcgccacuuccuggagacccacgacgcccggacgaagcgccugugguuccucuggcccgacgacauccugaagaacaagcggugccgcaacaagugcggcugccucggcgggugccgguucuucggcgggaccgucaccgggcucgacuucuucaagcuggaggagcugaccccgagcuccagcuccgcguucagcagcacguccgccgagagcgacauguacuacgggcagucccuccugcagcccggcgaguggaucaucaccaaggagauccccaagaucaucgacgggaacgugaacggcaugaagcgcaaggagugggagaacaagagcgugggcaucgaggucgagcggaagacccagcaccugucccuccaggugccccugcgcagccacuccagcuccagcuccagcgaggagaacuccagcuccagcgccgcccagccgcugcucgccggggagaaggagucccccagcuccguggcggacgaccaccugguccagaaggaguuccugcacggcaccaagcgggacgacgggcaggccagcauccccacggagaucagcggcaacucccccgugagcccgaacacccaggacaaguccgucgggcagagcccccuccgcagcccccugaagcggcaggccagcgugugcuccacccgccugggcagcaccaagucccucacggccgccuucuacggcgacaagcagcccgugaccgucggggugcaguucagcuccgacgugagccgguccgacgagaacguccuggacagcccgaagcagcgccgguccuucggcagcuuccccuacacccccuccgcggacagcaacuccuuccaccaguaccgcagcauggacagcuccaugagcauggccgacuccgaggccuacuucagcgccgccgaggaguucgagcccaucuccagcgacgaggggccgggcaccuaccccggccggaagaagaagaagaagcagacgcagcagaucgacuacucccgcgggagcaucuaccacuccguggagggcccccugaccgggcacggcgagagcauccaggacucccgcacccuccccuucaagacccacccgagccaggcguccuucgugagcgcccucgggggcgaggacgacgucaucgagcaccuguacaucguggagggcgagaagaccguggaguccgagcagaucacgccccagcagcccgucaugaacugcuaccagaccuaccucacccaguuccaggugaucaacuggagcgugaagcacccgaccaacaagcggacguccaagagcucccugcaccgcccccuggaccucgacacccccaccagcgaggagagcuccagcuccuucgagcagcugagcguccccaccuucaaggugaucaagcaggggcugacggccaacucccuccuggaccggggcaugcagcugagcggguccaccagcaacaccccguacacgccccuggagaagaagcuggccgacaacacggacgacgagacccugaccgaggaguggacccucgaccagcccgugucccagacgcgcaccaccgcgaucgucgaggugaagggcaccguggacaucguccugacgccccugguggccgaggcccucgaccgguacaucgaggccauggugcacugcgccagcacccgccacccggcggccaucgucgacgaccugcacgccaaggugcugcgggaggccgugcagaacuccaagaccaccuucagcgagaaccucuccagcaagcaggacauccgcgggacgaagaccgagcaguccaccaucggcaccacgaaccagggccaggcccagaccaaccugaccaugaagcaggacaacgucaccaucaaggggcugcagacgaacgugagcauccccaaggugaaccugugccuccugcaggcguccgucgaggagagccccaccaccgcccccucccggagcgugacccacgugagccuggucgcccucugcuucgaccgcaucgccacccaggugcggaugaaccgcggcguggucgaggagaccuccaacaacgccgagcccgggcggaccagcaacuucgaccgcuacgugcacgcgaccaagaugcagccccaguccagcggcucccugcggagcaacgccggggccgagaagggcaaggagaucgccgccaagcugaacauccaccgcgugcacggccagcuccgggggcuggacaccacggacaucgggaccugcgcgaucaccgccauccccuucgagaaguccaagguccuguucacccucgaggagcuggacgaguucacguucguggacgagaccgaccagcaggccgugcccgacgucacccgcaucgggccgagccaggagaaguggggcuggaucauguucgagugcggccuggagaaccucaccaucaagggcggccggcaguccggggccgugcuguacaacagcuucggcaucauggggaaggcguccgacacggagcgcggcggcgugcugaccagcaacaacuccagcgacucccccaccgggagcggcuacaacaccgacgucuccgacgacaaccuccccugcgaccgcacgagccccagcuccgaccugaacgggaacagcguguccgacgagcaggacgagggcguggagagcgacgaccugaagaaggaccucccgcugaugccgccgccgcccgacuccugcagcaugaagcugaccaucaaggagaucugguucuccuucgccgcccccaccaacguccggagccacacccacgccuucucccgccagcucaaccugcugagcacggccacccccgcggugggggccuggcucgugcccaucgaccagcugaaguccagccugaacaagcucgagaccgagggcacccugcggaucugcgccgucaugggcugcaucaugacggaggcccuggagaacaaguccgugcacuucccccuccgcagcaaguacaaccggcugaccaaggucgcccgcuuccugcaggagaaccccuccugccuccugugcaacauccugcaccacuaccuccaccaggcgaacuacagcaucaucgacgacgccaccauguccgacgggcugcccgcccuggugacccucaagaagggccugguggcccuggcccggcaguggaugaaguucaucgucgugacgccggcguucaagggggugagccuccaccgccccgcccagccccugaagccccagaucgccauggaccacgagcacgaggacggccuggggcucgacaacggcggcgggcugcaguccgacaccagcgccgacggcgcggaguucgaguucgacgccgccaccgucagcgagcacaccaugcugcucgaggggacggccaaccggccgccgcccggcuccagcgggcccgugaccggcgccgagaucaugcgcaagcuguccaagacccacacccacagcgacuccgcgcugaagaucaagggcauccacccguaccacagccucuccuacacgagcggggacaccgccaccgacucccccgugcacgucggccgggccgggaugcccgugaaggacagcccccgcaaggagucccugcugagcuaccucaccggcuccuucccgagccugcacaaccugcucgagggcacgccccagcgguccagcgccgccgugaaguccagcucccugacccgcaccgggaacaccgucgcgacggacaugcugagcgagcacccccuccugagcgagcccuccagcguguccuucuacaacuggaugagcaacgccgugggcaaccggggguccguccugcaggagagcccggugaccaaguccggccacaacagccuccccaccgggguggcccccaaccugcccaccaucccguccgccagcgacuucaacaccguccuguccagcgaccagaacacgcucgacggcacccacucccagcacagcaccucccaggacgacguggccggcguggaggaggcgaaccagggguuccccgccguccagcuggccgacgcccaggugguguucaagccccugcucagccacaccggcauccagucccaggacacgaugcccuucugcuaccgcauguacuucggggagcaccugagcuucuccggcacccuggacugccuccgggcggacaucgucgacagcgacaccgccaaggagcgcaaggggaagcgggcccgccggcagggccacgugaaccugccgccccuggaguucaagcccgcccucaugcugggcaccuucagcaucuccgccguggucauggagaaguccgugugcacgccgcagaacuccaccagcgcgcuguccuuccacgaccucagcaagcgcuacuacaacaccuuccacugcaacuucaccaucuccugccagagcaucucccagcacguggacauggcccugguccgccugauccaccaguucagcacgaugaucgacgacaucaaggccacccagaccgacaucaagcucucccgguacaccgccgggagcgccucccccacgcccaccuucaagacccgcaagcaccgggacuuccgcagcuccgacuucagccgguccagccgcggcucccugaacgggggcaaccgggugaacaacgcgaagaacaagcgcaccaacaacgagaacaacaagaaggagagccggaacaagaacagccuggggcgcuccgagcggcgcacgagcaaggugucccggaagggcagcaaggacgucguggaccacaugaccauccacauggacgacuccgacagcaucaccguguccgagcagagcgagcccuccgccgagugcuggcagaacauguacaagcuccugaacuucuacagccugaucuccgacccgaccggcauccucgagaaguccuccgagacguucgggcccgccggcguccgcagccccaccgagccgaccugcaaggugguguucgagaacgagcaggacaacuccagccugaccaagacgcagcggaagcgcucccuggucaccagcgagccgcagcacgugacccucaucguguucgggaucggcauggucaaccggacccaccuggaggccgacaucgggggccugacgauggaguccgagcucaagcgcauccacggcagcuucacccugaaggagaagaugaaggacgugcugcaccagaagaugaccgagaccugcgccacggcgcacaucgggggcgugaacaucguccuccuggaggggaucacccccaacauccagcuggaggacuuccccaccagccccaccuccaccgccaagcaggaguuccucacgguggugaagugcagcaucgccaagucccaggcccuguacagcgcccagcggggccugaagaccaacaacgcggccgucuucaaggugggcgccaucuccaucaacaucccgcagcaccccgccacccugcacagcaugauggugcgcuccagccaccagcucuccaagcagaucagcgaccugauccgccagcccuccaccgcgccccagccggucaaggaggacaucgccacgccccugcccagcgagaagacccccaccuccgugaaccagaccccggucgagacgaacgaguucccccagcuccccgaggggcuggagaagaagcccaucgugcugaaguucagcgccaugcucgacggcaucgccaucggggccgcgcugcugccgucccucaaggccgaguacaagaugggccggaugcgcagccacgggaugaccggcgcccagacccgguucaccuucgagcugcccaaccaccgccugcgguucacguccaaggugagcgccaccgacaugagcaccaucccgcccuccgccagccucaaccugccgcccgucaccauguccggcaaguacaucauggaggagcacgacagcuacuccgaccagguguggagcaucgacgagcugcccuccaagcagggguacuaccuccagggcaacuaccugcgcugcguggcggaggucgggagcuucgagcacaaccugacgaccgaccuccugaaccaccugguguucgugcagaaggucuucaugaaggaggugaacgaggugauccagaaggucuccggcggggagcagccgaucccccucuggaacgagcacgacggcaccgccgacggcgacaagcccaagauccugcuguacagccucaaccugcaguucaaggggauccaggugaccgccacgacccccuccaugcgggccgugcgcuucgagaccggccugaucgagcucgagcugagcaaccggcugcagaccaaggccuccccggggagcuccagcuaccucaagcuguucggcaagugccaggucgaccugaaccucgcgcuggggcagaucgugaagcaccagguguacgaggaggccggcuccgacuuccaccaggucgccuacuucaagacgcgcaucggccugcggaacgcccuccgcgaggagaucagcggguccagcgaccgggaggcggugcugaucacccugaaccgccccaucguguacgcccagcccgucgccuucgaccgggccgugcuguucuggcugaacuacaaggccgcguacgacaacuggaacgagcagcgcauggcccugcacaaggacauccacauggccaccaaggagguggucgacaugcuccccggcauccagcagaccagcgcccaggccuucgggacgcuguuccugcagcucaccgugaacgaccugggcaucugccugccgaucaccaacaccgcgcaguccaaccacacgggcgaccucgacaccgggagcgcccuggugcugaccaucgaguccacccucaucacggccugcagcuccgagagccuggucuccaagggccacuucaagaacuucugcauccgguucgccgacggguucgagaccagcugggacgacuggaagcccgagauccacggcgaccuggugaugaacgccugcgugguccccgacgggaccuacgaggugugcucccgcaccaccggccaggcggccgccgagagcuccagcgccggcacguggacccucaacgugcuguggaagaugugcgggaucgacguccacauggaccccaacaucggcaagcggcugaacgcgcucgggaacacccugaccacgcugaccggcgaggaggacaucgacgacaucgccgaccucaacuccgugaacaucgccgaccugagcgacgaggacgagguggacaccauguccccgaccauccacacggaggccaccgacuaccgccggcaggccgcgagcgccucccagcccggggagcugcgcggccgcaagaucaugaagcggaucgucgacauccgcgagcucaacgagcaggccaaggugaucgacgaccugaagaagcugggcgccagcgaggggaccaucaaccaggagauccagcgguaccagcagcucgaguccguggccgucaacgacauccgccgggacgugcgcaagaagcugcggcgcagcagcaugcgggcggccucccugaaggacaaguggggccucagcuacaagcccuccuacagccgcuccaagagcaucuccgccagcgggcggcccccgcugaagcgcauggagcgggccuccagccgcgugggcgagaccgaggagcugcccgagauccgggucgacgccgcgucccccgggccccgcgugacguucaacauccaggacaccuucccggaggagaccgagcucgaccugcugagcgugaccaucgagggccccucccacuacagcuccaacagcgagggcuccugcagcgucuucuccagccccaagacgcccgggggcuucagcccggggauccccuuccagaccgaggagggccggcgcgacgacucccucagcuccaccagcgaggacuccgagaaggacgagaaggacgaggaccacgagcgggagcgcuucuacaucuaccgcaagcccagccacaccucccggaagaaggccacgggguucgccgccgugcaccagcuguucaccgagcgcuggcccaccaccccggugaaccggagccuguccggcacggccaccgagcgcaacaucgacuucgagcucgacauccgggucgagaucgacagcggcaagugcgugcugcaccccaccacccugcuccaggagcacgacgacaucucccugcgccggagcuacgaccgcuccagccggucccuggaccaggacagccccuccaagaagaagaaguuccagacgaacuacgcgagcaccacccaccucaugaccgggaagaaggugccguccagccugcagacgaagcccagcgaccuggagaccaccgucuucuacauccccggcguggacgucaagcuccacuacaacuccaagacccugaagacggagagccccaacgccucccgcgggagcucccugccgcggacccucagcaaggaguccaagcuguacggcaugaaggacagcgccaccagcccgcccagcccgccccugcccuccaccgugcagagcaagaccaacacgcuccugccgccccagcccccgcccauccccgccgcgaagggcaagggguccggcggggugaagaccgccaagcuguacgccugggucgcccuccagagccugccggaggagauggugaucucccccugccugcuggacuuccucgagaaggcccuggagaccauccccaucacccccguggagcgcaacuacacggcggucagcucccaggacgaggacaugggccacuucgagaucccggaccccauggaggagagcaccaccucccuggugagcagcuccaccagcgccuacuccagcuuccccguggacgucgugguguacguccgggugcagcccucccagaucaaguucagcugccucccggugucccgcgucgagugcaugcugaagcugcccagccucgaccugguguucuccagcaaccgcggggagcuggagacgcucggcaccaccuaccccgccgagacccugucccccggcgggaacgccacgcagagcggcaccaagaccuccgccagcaagaccgggaucccgggcuccagcgggcugggcagcccccugggccgcagccggcacagcuccagccaguccgaccugacgagcuccagcuccagcuccagcgggcuguccuucaccgcgugcaugagcgacuucucccucuacguguuccaccccuacggcgccgggaagcagaagaccgccgucagcggccugaccccgggguccggcggccuggggaacguggacgaggagcccacgagcgugaccggccgcaaggacucccucagcaucaaccuggaguucgucaaggugucccugagccggauccgccggagcgggggcgccuccuucuucgagagccaguccgugagcaaguccgccagcaagauggacaccacccucaucaacaucuccgcggucugcgacaucggcagcgccuccuucaaguacgacaugcgccgccugagcgagauccuggccuucccccgggccugguaccgccgguccaucgcgcgccgccucuuccugggggaccagacgaucaaccugcccaccagcggcccggggacccccgacuccaucgagggcgugagccagcaccucucccccgagagcucccgcaaggccuacugcaagaccugggagcagcccagccaguccgccagcuucacgcacaugccgcagagccccaacguguucaacgagcacaugaccaacuccaccaugagccccgggaccgucggccagucccucaagagccccgccuccauccggagccgcuccgugagcgacuccagcgugccgcggcgcgacucccugagcaagacguccacccccuucaacaagagcaacaaggccgcgucccagcagggcacccccugggagacccucgucguguucgccaucaaccugaagcagcugaacgugcagaugaacaugagcaacgucauggggaacacgaccuggaccaccuccggccucaagagccaggggcggcuguccgugggcagcaaccgcgaccgggagaucagcauguccguggggcugggccgcagccagcucgacuccaagggcggggucgugggcgggaccaucgacgugaacgcccuggagauggucgcccacaucagcgagcaccccaaccagcagccgucccacaagauccagaucacgaugggcagcaccgaggcccggguggacuacaugggguccagcauccugaugggcaucuucuccaacgcggaccucaagcugcaggacgaguggaaggugaaccuguacaacacccucgacagcuccaucaccgacaagagcgagaucuucguccacggcgaccugaagugggacaucuuccaggugaugaucucccgcagcacgacccccgaccugaucaagaucgggaugaagcuccaggaguucuucacccagcaguucgacaccuccaagcgggcccugagcacguggggccccgugcccuaccugccgcccaagaccaugaccuccaaccucgagaaguccucccaggagcagcugcuggacgccgcccaccaccgccacuggcccgggguccucaagguggugagcggcugccacaucagccuguuccagaucccccugccggaggacgggaugcaguucggcggcuccaugagccuccacgggaaccacaugacccuggccugcuuccacggccccaacuuccgguccaagagcugggcgcuguuccaccucgaggagcccaacaucgccuucuggacggaggcccagaagaucugggaggacggguccagcgaccacuccaccuacaucguccagacccuggacuuccaccugggccacaacaccauggugacgaagccgugcggcgcccucgagagccccauggccaccaucaccaagaucacccgccgccggcacgagaacccgccccacgggguggcguccgucaaggagugguucaacuacgugacggccacccgcaacgaggagcugaaccugcuccggaacgucgacgccaacaacaccgagaacagcaccacggugaagaacuccagccugcuguccggcuuccgcgggggcagcuccuacaaccacgagaccgagaccaucuucgcccucccccggaugcagcuggacuucaagagcauccacgugcaggagccccaggagcccucccugcaggacgcgagccucaagcccaaggucgagugcuccguggugaccgaguucacggaccacaucugcgucaccauggacgccgagcugaucauguuccugcacgaccucgugagcgccuaccugaaggagaaggagaaggccaucuucccgccccgcauccugagcacccggcccgggcagaagucccccaucaucauccacgacgacaacagcuccgacaaggaccgcgaggacagcaucaccuacacgaccguggacuggcgggacuucaugugcaacaccuggcaccucgagccgacccugcgccugaucuccuggacgggccggaagaucgaccccgucggcguggacuacauccuccagaagcugggguuccaccacgcccgcaccaccauccccaaguggcugcagcggggcgugauggacccccucgacaagguccugagcgugcugaucaagaagcucgggaccgcgcugcaggacgagaaggagaagaagggcaaggacaaggaggagcacuga

SEQ ID NO: 31960 - RNA, 1368 nt, Artificial Sequence
  derived and/or modified sequence opt1 from KIAA1147__Homo_sapiens__NP_001073861
augguggagcagggcgacgccgcgccccugcuccgcugggccgaggggccggccgucagccugccccaggcgccccagccccaggccggcggguggggccgcgggggcggcgggggcgcccggccggccgccgagccgccccggcgccgggagcccgaggagcccgccgcccccgaggugcugcuccagcccgggcgccuggagcugggcgacguggaggaggaccaggucguggcgguguucgucgugaccuucgacccccgguccgggaacaugguggaguggugccucccgcaggacaucgaccuggagggcgucgaguucaagagcauggccuccggcagccacaagauccaguccgacuucaucuacuuccgcaaggggcccuucuucggccuggccugcuucgccaacaugcccguggagagcgagcucgagcgcggggcccggaugaaguccgugggcauccugagccccuccuacacccugcucuaccgguacaugcacuuccuggagaaccagguccgccaccagcuggagaugccgggccacuacagccaccucgcggccuucuacgaggacaagaagggggugcugcacgccggccccgggcggggcuccagccugccgcccguguacuggcuccccuccauccaccgcuacauguaccccgagaugaagaucacgcaccccgccgggugcaugagccaguucaucaaguucuucggcgagcagauccugauccuguggaaguucgcccuccugcggaagcgcauccugaucuucagcccgccgcccgucggcguggugugcuaccgggucuacugcugcugcugccucgcgaacgugucccugcccgggaucggcgggaccauccccgaguccaagcccuucuucuacgugaacgucgccgacaucgagagccuggagguggagguguccuacgucgccugcaccaccgagaagaucuucgaggagaagcgcgagcucuacgacguguacgucgacaaccagaacgugaagacgcaccacgaccaccuccagccccugcugaagaucaacagcgccgaccgggagaaguaccgccggcugaacgagcagcgccagaugcugcucuacagccaggagguggaggaggacuacaaccccugcgaggaggaccuguucguccuguucuuccucgagcagaacaaccgcaucuuccagacccugcuggagguguccgccagccaggacaagacccucaccgcggagcacgcccggggcauggggcuggacccgcagggcgaccgcuccuuccugcucgaccugcuggaggccuacggcaucgacgugaugcucgucaucgacaaccccugcugccccuga

SEQ ID NO: 31961 - RNA, 2145 nt, Artificial Sequence
  derived and/or modified sequence opt1 from KIAA1161__Homo_sapiens__NP_065753
augcugcagaacccccaggagaagucccaggccuacccgcgccggcgccggcccggcugcuacgccuaccgccagaaccccgaggcgaucgccgccgccgccauguacaccuuccuccccgacaacuucagcccggcgaagcccaagcccagcaaggaccugaagccccugcucggguccgccgugcugggccugcuccugguccuggccgccgugguggcguggugcuacuacagcgucucccuccggaaggccgagcgccugcgggccgagcugcucgaccugaaggccgggggcuucagcauccgcaaccagaagggggagcaggucuuccggcuggccuuccgcuccggcgcgcucgaccuggacagcugcucccgggacggcgcccugcucgggugcagccugaccgccgacggccugccgcuccacuucuucauccagacggugcgccccaaggacaccgugaugugcuaccgggugcgcugggaggaggccgcccccgggcgggcgguggagcacgccauguuccugggcgacgccgccgcccacugguacgggggcgcggagaugcgcacccagcacuggcccauccggcuggacggccagcaggagccgcagcccuucgucaccuccgacguguacagcuccgacgccgccuucgggggcauccucgagcgcuacuggcugagcucccgggccgccgcgaucaaggugaacgacagcguccccuuccaccugggguggaacuccacggagcgcagccuccggcugcaggcccgcuaccacgacacccccuacaagccgcccgccggccgcgccgcggcccccgagcuguccuaccgggugugcgugggcagcgacgucaccagcauccacaaguacauggugcgccgguacuucaacaagcccucccgcgugccggcccccgaggccuuccgggaccccaucuggagcaccugggcccucuacgggcgcgcggucgaccaggacaaggugcugcgguucgcccagcagauccgccugcaccacuucaacuccagccaccucgagaucgacgacauguacacgcccgccuacggcgacuucgacuucgacgaggugaaguucccgaacgccuccgacauguuccggcgccugcgggacgccggguuccgcgucacccugugggugcaccccuucgugaacuacaacagcucccgguucggcgagggggucgagcgcgagcuguucgugcgggagcccaccggccgccugcccgcgcugguccggugguggaacggcaucggggccgugcucgacuucacccacccgaaggcccgcgacugguuccagggccaccuccggcgccugcgcagccgguacuccguggccagcuucaaguucgacgccggggaggucuccuaccucccccgcgacuucagcacguaccggccccugccggaccccuccguguggagccgccgguacaccgagauggcgcugcccuucuucucccucgccgaggugcgcgucggcuaccagagccagaacaucuccugcuucuuccggcugguggaccgcgacagcguguggggguacgaccugggccuccggucccugauccccgccguccugaccgugagcaugcugggcuacccguucauccuccccgacauggucgggggcaacgccgugccccagcgcaccgccgggggcgacgugcccgagcgggagcuguacauccgcuggcuggagguggcggccuucaugccggccaugcaguucagcaucccgcccuggcgguacgacgccgaggucguggcgaucgcccagaaguucgccgcccuccgcgccucccugguggcgccccugcuccuggagcuggccggggaggucacggacaccggcgaccccaucgugcggccccucugguggaucgcccccggcgacgagaccgcccaccgcaucgacagccaguuccugaucggggacacccugcucguggcccccguccuggagccgggcaagcaggagcgggacguguaccugcccgcggggaaguggcgcuccuacaagggcgagcuguucgacaagacgcccgugcuccugaccgacuaccccgucgaccucgacgagaucgccuacuucaccugggccagcuga

SEQ ID NO: 31962 - RNA, 3702 nt, Artificial Sequence
  derived and/or modified sequence opt1 from KIAA1211__Homo_sapiens__NP_065773
augggcacccgcgccuucagccacgacuccaucuucauccccgacgggggcgccgagagcgagcagaccgugcaggcgaugucccaggacaacauccuggggaaggucaagacgcuccagcagcagcugggcaagaacaucaaguucgggcagcggagcccgaacgccauccccaugaacaaggccaacuccggcgaggccagccuggaggaggaccucuuccugaccucccccauggagaucgugacccagcaggacaucgugcugagcgacgccgagaacaaguccagcgacacccccuccagccucuccccgcugaaccugcccggcgcggggagcgagauggaggagaaggucgcccccgugaagcccucccgcccgaagcggcacuucagcuccgccggcacgaucgagagcgugaaccucgacgccaucccccuggcgaucgcccgccuggacaacuccgccgccaagcacaagcucgccgucaagcccaagaagcagcgggugagcaagaagcaccgccggcuggcgcaggacccccagcacgagcaggggggccuggagagccgcccgugccucgaccagaacgggcaccccggcgaggacaagcccaccuggcacgaggaggagcccaacccgcuggacuccgaggaggagcggcgccggcaggaggacuacuggcgcgagcuggaggccaagugcaagcggcagaaggccgaggccgccgagaagcgccggcucgaggagcagcgccugcaggcgcuggagcggcgccucugggaggagaaccggcgccaggagcugcuggaggaggagggcgaggggcaggagcccccccucgaggccgagcgggccccccgcgaggagcagcagcgcagccuggaggccccgggcugggaggacgccgagcggcgcgagcgggaggagcgcgagcggcuggaggcggaggaggagcgccggcgccuccaggcccaggcccaggccgaggagcggcgccggcuggaggaggacgcccgccuggaggagcggcgccggcaggaggaggaggaggggcgcugcgcggaggagcucaagcggcaggaggaggaggaggccgagggcugggaggagcuggagcagcaggaggccgaggugcagggcccccccgaggcccuggaggagaccggggagggccgccggggggcggaggaggaggaccucggcgaggaggaggaggaggggcaggcccaccuggaggacuggcgcggccagcuguccgagcuccugaacgacuucgaggagcgccuggaggaccaggagcggcucaagcccgagggccagcgcgagcacagcgaggagccggggaucugcgaggagcagaaccccgaggccgagcggcgccgggagcagcagggccgcuccggggacuuccagggcgccgaccggcccgggcccgaggagaagcgcgaggagggcgacaccgagccgcugcugaagcaggagggccccgucgaggccgcgcagcccccgguggagcggaaggaggccgccgcccucgagcaggggcgcaagguggaggagcugcgguggcaggaggucgacgagcgccagacgaugccccggcccuacaccuuccaggugagcuccggcgggaagcagauccuguuccccaaggugaaccucagcccggucacccccgccaaggacaccggccugacggcggccccccaggagcccaaggccccgaaggccucccccgugcagcacgcccugcccagcucccucagcgugccccacaccgcgauccuggucaccggggcccagcugugcggcccggccgugaaccugucccagaucaaggacaccgccugcaagagccuccugggccuggaggagaagaagcacgcggaggcccccgccggggagaaccccccccgcggcccgggggacgcccgggccggcuccggcaaggcgaagccccgccaggagagccccuccagcgccuccgcccucgccgagugggccagcauccggagccgcauccugaagaacgcggaguccgacccccggagcuccgagcgcgaccagcugcggccgggggacgagagcacgccccgcggccgcugcgacucccgggggaaccagcgcaagaccccccccgugaacgccaaguucagcaucaugccggccuggcagaaguucuccgacggcgggaccgagaccagcaagcaguccacggaggccgagagcauccggaagcgccccaugcucggccccuccgaggagaccgccccgcagcccccccccgcgggcguccgggagcuggggaagggcccggagaagagcgagaugcaccgcgagcccgccgacaccaccgaggggugcaaguucgccaaggaccugcccuccuuccucgugcccagccugccguaccccccccagaagguggucgcccacacggaguucaccaccuccagcgacuccgagaccgcgaacggcaucgccaagcccgacccggugaugcccgggggcgaggagaaggccagccccuucggcaucaagcugcggcgcacgaacuacagccuccgguucaacugcgaccagcaggccgagcagaagaagaagaagcgccacuccagcaccggggacuccgccgacgcgggccccccggccgccgggagcgcccggggcgagaaggagauggagggggucgcccugaagcacggccccucccugccccaggagcgcaagcaggcgcccagcacccggcgcgacuccgccgagccgagcuccagccgguccgugcccguggcccaccccggccccccgcccgccagcucccagacccccgcccccgagcacgacaaggcggccaacaagaugccgcucgcccagaagcccgcccuggcccccaagccgacgagccagaccccccccgcguccccccugagcaagcucucccgcccguaccuggucgagcugcucagccggcgcgccgggcggcccgaccccgagcccuccgagccgagcaaggaggaccaggagagcuccgaccgccgcccccccagccccccgggccccgaggagcggaaggggcagaagcgcgacgaggaggaggaggccaccgagcggaagcccgccucccccccgcugcccgcgacccagcaggagaagcccagccagacgcccgaggccggccgcaaggagaagccgaugcugcagucccggcacagccucgacggguccaagcugaccgagaagguggagaccgcccagccccuguggaucacccucgcccugcagaagcagaagggcuuccgcgagcagcaggccacccgggaggagcgcaagcaggcgcgggaggccaagcaggccgagaagcugagcaaggagaacguguccgucagcgugcagcccggcuccagcuccgugagccgcgccgggucccuccacaagagcacggcccugcccgaggagaagcggccggagaccgcggucucccgccuggagcggcgcgagcagcucaagaaggccaacacccugcccaccagcgugacgguggagaucuccgacagcgccccccccgccccgcuggucaaggaggugaccaagcgguucagcacccccgacgccgcgcccguguccaccgagccggccuggcucgcccuggccaagcgcaaggcgaaggccuggagcgacugcccccagaucaucaaguga

SEQ ID NO: 31963 - RNA, 2973 nt, Artificial Sequence
  derived and/or modified sequence opt1 from KIAA1211L__Homo_sapiens__XP_005263981
augcgcgagcucgaggcccacagcacccuccgccgcauggccgccuucuaccagugcauccggcccgaccccagcgagcucgacaugaucagcacccgcgugauggacaucaagcugcgggaggccgccgagggccucggggaggacuccacgggcaagaagaaguccaaguucaagaccuucaagaaguucuucgggaagaagaagcgcaaggagucccccagcuccaccggcagcuccaccuggaagcagagccagacccggaacgaggucaucgccaucgaguccgggcccgugggcuacgacagcgaggacgagcuggaggagucccgcggcacccuggggagccgggcccucucccacgacagcaucuucauccccgaguccggccaggacgccacccgcccggugcgggucuucagccaggagaacgugugcgaccgcaucaaggcccugcagcugaagauccagugcaacgugaagauggggcccccgccgccgcccggcgggcuccccgccaagcggggcgaggacgccggcauguccagcgaggacgacgggcugccccgcagcccgcccgagaugucccugcuccacgacgucggccccgggaccaccaucaaggugagcguggucucccccgaccacgugagcgacuccaccgugagcgcccggaucuccgacaacagccuggcccccgucgccgacuucuccuaccccgccgagagcuccagcugccuggacaacuccgccgcgaagcacaagcuccaggugaagccccgcaaccagcggagcuccaagaugcgccggcugagcucccgcgcccagagcgagucccugagcgaccugaccugcacccccgaggaggaggagaacgaggagaagccccugcuggaggugagccccgaggagcggcccuccagcggccagcaggacgucgcccccgaccgcggcccggagcccgggccgcccgccccgcugccgccgcccggcggggcccgcgcgcggcgcgcccggcugcagcacagcagcgcccugacggccuccguggaggagggcggggugcccggcgaggaccccagcucccgccccgccacccccgagcucgcggagcccgagagcgcccccacccugcgggucgagcccccgagcccgcccgagggcccgcccaaccccgggcccgacggcgggaagcaggacggcgaggcgccgcccgccgggcccugcgcccccgcgaccgacaaggccgaggagguggugugcgcccccgaggacgucgccagccccuuccccacggcgauccccgagggcgacaccacgccgcccgagaccgaccccgccgccacguccgaggcccccagcgcccgcgacggccccgagcgguccgugcccaaggaggcggagcccacgccgcccgugcugcccgacgaggagaaggggccgcccggccccgcccccgagcccgagcgcgaggccgagaccgagcccgagcgcggggccggcaccgagcccgagcggaucgggacggagcccagcaccgcccccgcgcccuccccgcccgcccccaagagcugccucaagcaccggcccgccgccgccuccgagggcccggcggccuccccgccccucgccgccgcggaguccccgcccgucgagcccggccccgggucccuggacgccgaggccgccgcccccgagcgccccaaggcggagcgggccgaggcgccgcccgccggcgccgagcgcgcggccccggagcggaaggccgagcgcgggggcgccgagcuccggggcgccaagaaguucagcguguccagcugccgcgcgcggccccgccccggggucucccgcccccuggagcgggccagcggccgccugccgcucgcccgguccgggcccguguggcgcagcgaggccgcgcuggacgaccugcagggccuccccgagccccagcacgccaagccggggccccggaagcuggccgagcgcggcccccaggacuccggcgaccgggccgccagccccgcggggccgcgcaagagcccccaggaggccgccgccgcccccggcacccgggagcccugcccggcggcccaggagcccgcccccagcgaggaccgcaaccccuucccggugaagcugcgguccaccagccucucccugaaguaccgcgacggggccagccaggaggucaagggcgugaagcgguacuccgccgaggugcgccuggagcggagccucacgguccugcccaaggaggagaagugcccccuggggaccgcgcccgcccuccgcggcacccgggccccguccgaccagggcaaggggaaggcccggccgcccgagccccugagcagcaagccgccccugccccggaagccgcuccugcaguccuucacccugccccaccagcccgcgccgcccgacgcgggccccggggagcgcgagccccggaaggagccccgcacggccgagaagcgcccccugcggcgcggcgccgagaagucccugccgcccgccgcgaccgggcccggcgccgacggccagccggccccgcccuggaucaccgugacccggcagaagcgccgggggacgcuggaccagccgcccaaccaggaggacaagcccggcgcccgcacccugaaguccgagcccgggaagcaggccaaggugcccgagcggggccaggagcccgucaagcaggcggacuucgugcgcagcaaguccuuccucaucacccccgugaagcccgccgucgaccggaagcagggggccaagcugaacuucaaggagggccugcagcgcggcaucagccucucccaccagaaccuggcccagagcgccgugaugauggagaaggagcugcaccagcucaagcgggcguccuacgccagcaccgaccagcccuccuggauggagcuggcccgcaagaagucccaggccuggagcgacaugccgcagaucaucaaguga

SEQ ID NO: 31964 - RNA, 3795 nt, Artificial Sequence
  derived and/or modified sequence opt1 from KIAA1217__Homo_sapiens__NP_001091970
augcagaccuccgagauggaccgcaagcgggaggccuuccuggagcaccucaagcagaaguacccccaccacgccuccgccaucaugggccaccaggagcgccugcgggaccagacccgcucccccaagcugucccacagcccccagccgcccucccucggcgaccccguggagcaccuguccgagacguccgccgacagccuggaggccauguccgagggcgacgcccccacccccuucagccgggggucccgcacccgggccagccuccccgucgugcgcuccaccaaccagaccaaggagcggagccugggcgugcuguaccuccaguacggggacgagaccaagcagcugcgcaugcccaacgagaucaccuccgccgacaccauccgggcccuguucgucagcgccuucccccagcagcucacgaugaagaugcuggagucccccagcguggccaucuacaucaaggacgagucccgcaacguguacuacgagcugaacgacguccggaacauccaggaccgcagccuccugaagguguacaacaaggaccccgcccacgccuucaaccacacccccaagaccaugaacggcgacaugcggaugcagcgcgagcugguguacgcccggggcgacgggcccggcgcgccccgccccgggagcaccgcccacccgccccacgcgauccccaacagcccgcccagcacgcccgucccccacuccaugcccccgagccccucccggauccccuacggcgggacccgcagcaugguggugcccggcaacgccaccaucccgcgggaccgcaucuccagccuccccgucucccgccccaucagcccgucccccagcgccauccuggagcggcgcgacgugaagcccgacgaggacauguccggcaagaacaucgccauguaccggaacgagggguucuacgccgaccccuaccuguaccacgagggccgcaugagcaucgcguccagccacgggggccacccgcucgacgugcccgaccacaucaucgccuaccaccggaccgccauccgcuccgccagcgccuacugcaaccccuccaugcaggcggagaugcacauggagcagagccuguaccggcagaagucccgcaaguaccccgacucccaccuccccacgcucggcagcaagacgccgcccgccagcccccaccgggucagcgaccugcgcaugaucgacaugcacgcccacuacaacgcccacgggccgccccacaccaugcagcccgaccgggccucccccagccgccaggcguucaagaaggagccgggcacccugguguacaucgagaagccccgguccgccgccgggcugagcucccugguggaccuggggccgccccucauggagaagcaggucuucgccuacagcacggcgaccaucccgaaggaccgcgagacccgggagcgcaugcaggccauggagaagcagaucgccucccugaccgggcuggugcagagcgcccucuucaagggccccaucacguccuacagcaaggacgccuccagcgagaagaugaugaagaccaccgcgaaccggaaccacaccgacuccgccggcacgccccacgugagcgggggcaagaugcugagcgcccuggaguccaccgucccgcccagccagcccccgcccguggggaccuccgccauccacaugagccuccuggagaugcgccgguccguggccgagcugcgccuccagcugcagcagaugcgccagcugcagcuccagaaccaggagcugcugcgggcgaugaugaagaaggccgagcucgagaucagcggcaaggucauggagaccaugaagcgccuggaggaccccgugcagcggcagcgcguccugguggagcaggagcggcagaaguaccuccacgaggaggagaagaucgugaagaagcugugcgagcuggaggacuucgucgaggaccugaagaaggacuccacggccgccagccgccucgugacccugaaggacguggaggacggggccuuccugcuccggcaggucggcgaggcgguggccacccugaagggcgaguuccccacccugcagaacaagaugcgcgccauccuccggaucgagguggaggccguccgcuuccugaaggaggagccccacaagcuggacucccuccugaagcgggugcgcagcaugacggacgugcugaccaugcuccggcgccacgucaccgacgggcugcugaagggcaccgacgcggcccaggccgcccaguacauggccauggagaaggcgaccgccgccgaggugcucaagucccaggaggaggccgcccacacgagcgggcagcccuuccacuccaccggcgcgcccggggacgccaagagcgagguggucccccuguccggcaugauggugcggcacgcccagagcucccccguggucauccagccgagccagcacuccguggcccugcucaaccccgcccagaaccugccccacguggcgagcagccccgccgucccgcaggaggccaccuccacccugcagaugagccaggcgccccagagcccccagauccccaugaacggcagcgcgaugcagucccucuucaucgaggagauccacagcguguccgccaagaaccgcgccgugagcaucgagaaggccgagaagaagugggaggagaagcggcagaaccuggaccacuacaacgggaaggaguucgagaagcugcucgaggaggcccaggcgaacaucaugaaguccaucccgaaccuggagaugccgcccgccacgggcccccugccgcgcggggacgcccccgucgacaagguggagcucagcgaggacucccccaacagcgagcaggaccuggagaagcugggcggcaaguccccgccgcccccgccgccgccgccccggcgcagcuaccuccccgggagcggccugaccaccacccggagcggggacguggucuacacgggccgcaaggagaacaucaccgccaaggccuccagcgaggacgcggggcccagcccccagacccgcgccaccaaguaccccgccgaggagcccgccagcgccuggacgcccuccccgccgcccgugaccaccuccagcuccaaggacgaggaggaggaggaggaggagggcgacaagaucauggcggagcugcagggcagcuccggggcgccccagaccagccggaugcccgugcccauguccgccaagaaccgccccggcacgcucgacaagcccgggaagcagagcaagcugcaggacccccggcaguaccgccaggccaacggcuccgccaagaaguccgggggcgacuucaagcccaccucccccagccugcccgcguccaagauccccgcccucagccccuccagcggcaaguccagcucccugccgagcagcuccggggacagcuccaaccugcccaacccgcccgccaccaagcccagcaucgccuccaacccccucagcccccagaccgggcccccggcgcacuccgccagccugauccccuccgucagcaacggcucccugaaguuccagagccucacgcacaccggcaaggggcaccaccuguccuucagcccccagucccagaacggccgggccccgccgccccugagcuucuccagcagcccgcccagccccgccagcuccgugagccucaaccagggcgccaaggggacccgcaccauccacacgcccucccugaccagcuacaaggcgcagaacggcuccagcuccaaggccacccccagcaccgccaaggagacguccuga

SEQ ID NO: 31965 - RNA, 1866 nt, Artificial Sequence
  derived and/or modified sequence opt1 from KIAA1279__Homo_sapiens__NP_056449
auggccaacgugcccugggccgaggucugcgagaaguuccaggcggcccuggcccucagccgcguggagcugcacaagaacccggagaaggagcccuacaaguccaaguacagcgcccgggcccugcucgaggaggugaaggcgcugcugggccccgcccccgaggacgaggacgagcgcccggaggccgaggacgggcccggcgccggggaccacgcgcucggccugcccgccgaggucguggagcccgaggggccgguggcccagcgggccguccgccuggccgugaucgaguuccaccucggcgugaaccacaucgacaccgaggagcuguccgcgggcgaggagcaccuggucaagugccuccggcugcugcgccgguaccgccucagccacgacugcaucucccugugcauccaggcccagaacaaccuggggauccucuggagcgagcgggaggagaucgagaccgcccaggccuaccuggaguccagcgaggcccuguacaaccaguacaugaaggaggugggcuccccgccccucgaccccacggagcgcuuccugcccgaggaggagaagcugaccgagcaggagcggagcaagcgcuucgagaagguguacacccacaaccucuacuaccuggcgcaggucuaccagcaccuggagauguucgagaaggccgcccacuacugccacuccacccucaagcggcagcuggagcacaacgccuaccaccccaucgagugggccaucaacgcggccacgcugagccaguucuacaucaacaagcucugcuucauggaggcccgccacugccuguccgccgccaacgugaucuucgggcagaccggcaagaucagcgcgaccgaggacacccccgaggccgagggggaggugcccgagcuguaccaccagcggaagggcgagaucgcccgcugcuggaucaaguacugccucacgcugaugcagaacgcccagcuguccaugcaggacaacaucggcgagcucgaccuggacaagcagagcgagcugcgggcgcuccgcaagaaggagcuggacgaggaggaguccauccggaagaaggccguccaguucgggaccggcgagcugugcgacgccaucagcgccguggaggagaagguguccuaccuccgcccgcuggacuucgaggaggcccgggagcuguuccuccuggggcagcacuacgucuucgaggcgaaggaguucuuccagaucgacggcuacgugaccgaccacaucgaggugguccaggaccacagcgcccuguucaaggugcucgccuucuucgagaccgacauggagcgccgcugcaagaugcacaagcggcgcaucgccaugcuggagccccugacgguggaccugaacccccaguacuaccuccuggucaaccggcagauccaguucgagaucgcccacgcguacuacgacaugauggaccugaagguggccaucgccgaccgccuccgggaccccgacagccacaucgucaagaagaucaacaaccugaacaaguccgcccugaaguacuaccagcuguuccucgacagccugcgcgacccgaacaagguguuccccgagcacaucggcgaggacgugcuccggcccgccaugcuggcgaaguuccgcgucgcccggcuguacgggaagaucaucaccgccgaccccaagaaggagcucgagaaccuggccaccucccuggagcacuacaaguucaucguggacuacugcgagaagcacccggaggcggcccaggagaucgagguggagcucgagcugagcaaggagauggucucccugcuccccaccaagauggagcgcuuccggacgaagauggcccugaccuga

SEQ ID NO: 31966 - RNA, 3015 nt, Artificial Sequence
  derived and/or modified sequence opt1 from KIAA1324__Homo_sapiens__XP_011540127
auggccgagcccggccacagccaccaccuguccgcccgcgugcgggggcgcaccgagcggcgcaucccgcggcucuggcgccugcugcucugggcgggcaccgccuuccaggucacgcaggggaccggccccgagcugcacgccugcaaggagagcgaguaccacuacgaguacaccgccugcgacuccaccgggagccgguggcgcguggccgugccccacacgcccggccugugcaccucccucccggaccccaucaagggcaccgagugcagcuucuccugcaacgcgggggaguuccuggacaugaaggaccagagcugcaagcccugcgccgagggccgguacucccuggggaccggcauccgcuucgacgagugggacgagcucccccacggguucgccagccuguccgccaacauggagcuggacgacagcgcggccgaguccacgggcaacugcaccagcuccaagugggucccgcggggcgacuacaucgccagcaacaccgacgagugcaccgccacgcucauguacgccgugaaccugaagcaguccgggaccgugaacuucgaguacuacuaccccgacagcuccaucaucuucgaguucuucguccagaacgaccagugccagcccaacgcggacgacagccgcuggaugaagaccaccgagaagggcugggaguuccacagcguggagcugaaccgggggaacaacgugcucuacuggcgcacgaccgccuucuccgucuggaccaaggugcccaagccggugcugguccggaacaucgccaucaccggcguggccuacacgagcgagugcuuccccugcaagcccggcaccuacgccgacaagcagggguccagcuucugcaagcugugccccgcgaacuccuacagcaacaagggcgagaccuccugccaccagugcgacccggacaaguacagcgagaagggguccagcuccugcaacgugcgccccgccugcaccgacaaggacuacuucuacacgcacaccgccugcgacgccaacggcgagacccagcucauguacaagugggccaagcccaagaucugcagcgaggaccuggagggggcggucaagcugcccgccuccggcgugaagacccacugcccgcccugcaaccccggcuucuucaagacgaacaacagcacgugccagcccugcccguacggguccuacagcaacggcuccgacugcacccggugccccgccgggaccgagcccgccgugggcuucgaguacaagugguggaacacccuccccaccaacauggagaccaccguccugagcgggaucaacuucgaguacaagggcaugacgggcugggagguggccggggaccacaucuacaccgcggccggcgccuccgacaacgacuucaugauccugacccucguggucccgggguuccgcccgccccagagcgugauggccgacaccgagaacaaggagguggcgcggaucaccuucgucuucgagacgcugugcagcgugaacugcgagcuguacuucauggucggcgugaacucccgcaccaacacccccguggagaccuggaaggggagcaagggcaagcaguccuacacguacaucaucgaggagaacaccaccaccagcuucacgugggccuuccagcggaccaccuuccacgaggccucccgcaaguacaccaacgacgucgccaagaucuacagcaucaacgugacgaacgugaugaacggcgucgccuccuacugccgccccugcgcgcucgaggccagcgacgugggguccagcugcaccuccugccccgccggcuacuacaucgaccgggacagcgggaccugccacuccugccccaccaacacgauccugaaggcccaccagccguacggcgugcaggccugcguccccugcggccccgggaccaagaacaacaagauccacagccugugcuacaacgacugcaccuucucccgcaacacccccacgcggaccuucaacuacaacuucagcgcgcucgccaacaccgugacccuggccggcgggccguccuucacgagcaagggccugaaguacuuccaccacuucacccucagccugugcgggaaccagggccgcaagauguccgugugcaccgacaacgucaccgaccugcggauccccgagggcgagagcggguucuccaagagcaucacggccuacgugugccaggccgugaucaucccgcccgaggucaccggcuacaaggcggggguguccagccagcccgugucccucgccgaccgccugaucggcgucaccaccgacaugacgcuggacgggaucaccagccccgccgagcuguuccaccucgagucccugggcauccccgacgugaucuucuucuaccggagcaacgacgugacccaguccugcagcuccggccgcagcaccacgauccggguccgcugcagcccccagaagaccgugccggggucccuccugcugcccggcacgugcuccgacgggaccugcgacggcugcaacuuccacuuccucugggagagcgccgcggccugcccccugugcuccguggccgacuaccacgccaucgucagcagcugcguggccgggauccagaagaccaccuacguguggcgggagcccaagcugugcuccggcggcaucagccucccggagcagcgcgucaccaucugcaagaccaucgacuucuggcugaagguggggaucuccgcggggaccugcacggccauccugcugaccgugcugaccugcuacuucuggaagaagaaccagaagcucgaguacaaguacagcaagcuggucaugaacgccacccucaaggacugcgaccugcccgccgccgacuccugcgcgaucauggagggcgaggacguggaggacgaccugaucuucacgagcaagaagucccucuucggcaagaucaagagcuucaccuccaagcagcccgcccccgugaccaucagccuguccgaggacagcuga

SEQ ID NO: 31967 - RNA, 3090 nt, Artificial Sequence
  derived and/or modified sequence opt1 from KIAA1324L__Homo_sapiens__NP_001136221
augcuguuccgcgcccggggccccgugcgcgggcggggcugggggcgcccggccgaggcgccccggcgcggccggagcccgcccuggucccccgccuggaucugcugcugggcccucgccgggugccaggccgcgugggccggcgaccugcccagcuccagcucccgcccccugcccccgugccaggagaaggacuaccacuucgaguacaccgagugcgacagcuccggcagccgguggcgcgucgccauccccaacuccgccguggacugcagcgggcuccccgaccccgugcggggcaaggagugcaccuucuccugcgcgagcggggaguaccuggagaugaagaaccaggucugcuccaagugcggcgaggggacguacagccugggcuccggcaucaaguucgacgagugggacgagcucccggccggguucagcaacaucgccaccuucauggacaccguggugggccccuccgacagccgccccgacgggugcaacaacuccagcuggaucccccggggcaacuacaucgagagcaaccgcgacgacugcaccgucucccugaucuacgccgugcaccugaagaaguccggcuacguguucuucgaguaccaguacgucgacaacaacaucuucuucgaguucuucauccagaacgaccagugccaggagauggacacgaccaccgacaagugggugaagcucaccgacaacggggaguggggcagccacagcgugaugcugaaguccgggacgaacauccuguacuggcggaccaccggcauccucauggggagcaaggccgucaagccggugcuggugaagaacaucaccaucgagggcgucgcguacacguccgagugcuuccccugcaagcccggcaccuucagcaacaagcccggguccuucaacugccaggugugcccgcgcaacaccuacagcgagaagggcgccaaggagugcauccggugcaaggacgacucccaguucagcgaggagggguccagcgagugcaccgagcgcccgcccugcacgaccaaggacuacuuccagauccacacccccugcgacgaggagggcaagacccagaucauguacaaguggaucgagcccaagaucugccgggaggaccugacggacgccauccgccucccgcccuccggggagaagaaggacugcccgcccugcaaccccggcuucuacaacaacggcagcuccagcugccaccccugcccgcccgggaccuucuccgacggcaccaaggagugccggcccugccccgccgggaccgagcccgcccugggcuucgaguacaagugguggaacgugcugcccgggaacaugaagacgagcugcuucaacgucggcaacagcaagugcgacggcaugaacgggugggagguggcgggcgaccacauccaguccggggccggcggcagcgacaacgacuaccucauccugaaccugcacauccccggguucaagcccccgaccuccaugaccggcgccaccgggagcgagcucggccgcaucacguucguguucgagacccugugcuccgccgacugcguccuguacuucaugguggacaucaaccgcaagagcaccaacguggucgaguccuggggcggcaccaaggagaagcaggccuacacgcacaucaucuucaagaacgcgaccuucaccuucaccugggccuuccagcggacgaaccagggccaggacaaccgccgguucaucaacgacauggugaagaucuacagcaucaccgccaccaacgccgucgacgggguggccuccagcugccgcgcgugcgcccucggcuccgagcagagcggguccagcugcgugcccugcccgcccggccacuacaucgagaaggagaccaaccagugcaaggagugcccgcccgacaccuaccuguccauccaccaggucuacgggaaggaggccugcauccccugcggccccggcagcaagaacaaccaggaccacuccgugugcuacagcgacugcuucuucuaccacgagaaggagaaccagagccugcacuacgacuucuccaaccucagcuccguggggagccugaugaacggccccuccuucacgagcaaggggaccaaguacuuccacuucuucaacaucucccugugcggccacgaggggaagaagauggcccucugcaccaacaacaucaccgacuucacggucaaggagaucguggcgggcagcgacgacuacaccaaccuggugggcgccuucgucugccaguccaccaucauccccagcgaguccaagggguuccgggccgcccugagcucccagagcaucauccucgccgacaccuucaucggcgugacgguggagaccacccugaagaacaucaacaucaaggaggacauguuccccguccccaccucccagaucccggacgugcacuucuucuacaagagcuccacggcgaccaccagcugcaucaacgggcgcuccaccgccgugaagaugcggugcaaccccaccaagagcggcgccggggucaucagcgugcccuccaagugccccgccgggacgugcgacggcugcaccuucuacuuccugugggagagcgccgaggcgugcccgcucugcaccgagcacgacuuccacgagaucgagggggccugcaagcgcggcuuccaggagacgcuguacguguggaacgagcccaaguggugcaucaaggggaucucccugcccgagaagaagcucgcgaccugcgagaccgucgacuucuggcugaaggugggcgccggcgugggggccuucaccgccguccugcucguggcccugacgugcuacuucuggaagaagaaccagaagcuggaguacaaguacagcaagcucgugaugaccaccaacuccaaggagugcgagcugccggccgccgacagcugcgcgaucauggagggcgaggacaacgaggaggaggucguguacuccaacaagcagagccugcucgggaagcugaagucccuggccaccaaggagaaggaggaccacuucgagagcgugcagcugaagacgucccggagccccaacaucuga

SEQ ID NO: 31968 - RNA, 3354 nt, Artificial Sequence
  derived and/or modified sequence opt1 from KIAA1377__Homo_sapiens__NP_065853
augcuggccggccgccccgggacccggagcgccgugggcgagcucgggaccgaguccagcgacaaccuggaccgcgcgccgcugggcccccgggaguccgggggccaccaccgccccggcagcuaccucgacaugaagauccaccuggagaagaaccuggaggaggagcggcagauccuccugcagcagcagaagaucugccgcaaccgggcccgcaaguacuucgucgaguccaaccggcgcaagaaggccuucgaggagaagcggaaggagcaggaggagaaggagcaccagauccgcgagcagauccugcagcagcggaagcagaaguucgaggaggugacggagaaguuccagcgcgcccacgugccccucagccagcggcgcaaggccgucucccggaagccggugccgccccuggaggaggcgcugaagcagauccaggagagcaaccucaaguccgaggugaaccugcccuucagccgccggcccaccaucaacuggcgcgccaucgacuccgcccugcccagcgcccucuccaagaacgaccacaagcaccagaagcagcugcugagcaagaucaacugcgagaaggagaugaacgagaacaugcgggcgacccucgccaccuccaagaacgucuuccagcugaagcuggaggagacgcagaagcuccuggaggaccagcaccugagcaaccuccagaaguucugcgacgaggugaaccagaucaccaacuccgagacccugagcuccaucgacagccuggaggccaccgagcacgaggagaucuaccucacgcugaacaaggagcacagcaccuccauccagcgcaacaccaucagccugaagcccgccaacaugcaguccaccaaccucagcugcuucgacgaggacaagcuggccuucuccaagacgcagcacaucaacaacuggcugaccaaccucgacgcgagcaacacccagaacgugaccgccuucuccgacauccugagcaaguccaacguccugcccagcugggaguacuucaacuccaaggagcagaacccgagcccccucaacgggacgguggagcgcgccaccaacaccgccaacaacuccgugcccuucgucagcagcccgcccauguucgugcuggacaagaagugcgagaagaccagcgagacguccaccaugcggaccaccgacagcacguccggcgccuucaagcgcgagcggccccuggugaccgagagccccaccuucaaguucagcaagucccagagcaccuccgacagccucacgcaggaggucgcgaccuuccccgaccaggagaaguacuccgagcugaaccaggagaacgggaccaccagcaucccgacguccugcgugcccguggccacgccccugguccuccccagcaacauccaguccgcccgcccgagcgccaagaacuccauccacaucaaggagaucgacgccgugcagugcagcgacaagcuggacgagcugaaggacggcaaggaggaggagaucaaguacuucaacugcaacaaggaggagcucccccuguucuccgacagcuuccaggacgcguacaucccccacaaccccgacuccaaggacgagaagcagaagcuggccgagaccagcucccucagcaacgugaccagcaacuacgacuucgucgggcagcacaagaagaugaaguacaacauccacgagcggaacggcgugcgcuuccugaaguccauccugaagaaggagagcaaguacgagcacggcuaccugaaggcccucaucaucaaccaguccuucaaguucgggaaccagaaggccgccgcgauccgggacagcaucgagcugaccaaggagaagggcgccgagaucccgaagaccaucaagaagcugcgcugguucgacgagaccuccaacaucgagaacaacgccgagaacagccacucccucaagaacaagaccgggaccacgcagcagcacagccagcaguuccacauccaguccggcgccggcagcaacaucaucuccgugagcacgugcgcggucaacuccgccgacaccaagaagucccgggaggacuccaucagcgagaacgugaccacccucgggggcuccggggccgaccacaugccccugaacugcuucauccccagcggcuacaacuucgccaagcacgccuggccggcguccaagaaggaggagagcaagauccccguccacgacgacagcaagaccaagcaggggaagccccagcgcggccgggccaagaucauccgcaagcccggcuccgccaaggugcagagcggguucaucugcaccaaccggaagggcgccgugauccagccgcaguccgccagcaaggucaacaucuucacccaggcgcaggggaagcugaucauccccugcccgccgccccaguccacgagcaacauccgcuccggcaagaacauccaggugagccagugccagcccgugacccccgagaacccccagaacaucaucacccacaacuccuucaacagcaagcacguccugcccaccgagcacucccugaaccaguggaaccaggagagcuccagcccccucuccaacgccugcagcgaccuggugacggugauccccucccugcccagcuacugcuccagcgagugccagaccuucgccaagaucaaccacagcaacgggacccaggccgucgcccggcaggacgcgacccucuacugcacgcagcgcuccccggugugcgaggagagcuaccccuccgugacccugcggaccgccgaggaggagagcgucccccuguggaagcgcggccccaacgugcuccaccagaacaagcgggccaccggcuccacggugaugcgccgcaagcggaucgccgagaccaagcgccggaacauccuggagcagaagcgccagaacccggggagcgucggccagaaguacuccgagcagaucaacaacuucgggcagagcgugcugcucuccagcuccgagcccaagcagaccacccggggcacgagcuacaucgaggagguguccgacagcaccuccgaguuccugauggcggagaaccuggucaaggccagcgugcccgaggacgagauccucaccgugcugaacuccaagcagauccagaaguccaaccugccccucaacaagacccagcaguucaacaucugcacgcugagcgccgaggagcagaagauccuggagagccucaacgaccugagcgagcgccugcacuacauccaggaguccaucugcaagaacccgagcaucaagaacacccuccagaucaucccccugcuggagaagcgggaggaccgcaccuccagcugccgggacaagcgcuga

SEQ ID NO: 31969 - RNA, 1572 nt, Artificial Sequence
  derived and/or modified sequence opt1 from KIAA1456__Homo_sapiens__XP_005273641
augaagauccaguucaagaaggagugccagaaccgcaagggccugugcuuccuccagcggcugacccaggagguguaccacgagaaggaccgcaccaucagcuuccacuccuacaaguucagcuucacgcugcacaucgagaaggucaugcgguccaacugccacagccucgagguggagaccgccgugauccacaaggacaagcgcauggaccacgaggccgcgcagcuggagaagcagcacguccacaacguguacgaguccaccgcccccuacuucagcgaccugcaguccaaggccuggccgcgggugcgccaguuccuccaggagcagaagcccgggagccugaucgccgacaucggcugcgggaccggcaaguaccugaaggucaacucccaggugcacacgguggggugcgacuacugcggcccccucgucgagaucgcccggaaccgcggcugcgaggcgauggugugcgacaaccugaaccugcccuuccgggacgagggguucgacgccaucaucagcaucggcgugauccaccacuucuccaccaagcagcgccggauccgcgccaucaaggagauggcccggguccucgugcccgggggccagcugaugaucuacgugugggcgauggagcagaagaaccgccacuucgagaagcaggacguccuggugccguggaaccgggcccucugcagccagcuguucuccgagagcucccagagcgggcgcaagcggcagugcggcuaccccgagcgcggccaccccuaccacccgcccugcuccgagugcagcugcuccgugugcuucaaggagcagugcgggagcaagcggagccacuccgucggcuacgagcccgccauggcccggaccugcuucgccaacaucagcaaggagggggaggaggaguacggcuucuacuccacccugggcaagagcuuccgcuccugguucuucagccgcucccucgacgagagcacgcugcgcaagcagaucgagcgggugcgcccccugaagaacaccgaggugugggcguccagcaccgucaccgugcagccgucccggcacagcucccucgacuucgaccaccaggagcccuucagcacgaaggggcagucccuggacgaggagguguucgucgagagcuccagcggcaagcaccuggaguggcuccgcgcccccgggacccugaagcaccugaacggcgaccaccagggggagaugcggcgcaacggcggcgggaacuuccucgacuccaccaacaccggcgugaacugcgucgacgccgggaacaucgaggacgacaaccccagcgccagcaagauccugcggcgcaucuccgccguggacagcacggacuucaacccggacgacaccauguccguggaggacccccagaccgacguccuggacagcaccgcguucaugcgguacuaccacguguuccgcgagggcgagcucugcucccugcugaaggagaacgugagcgagcuccggauccuguccagcgggaacgaccacggcaacuggugcaucaucgccgagaagaagcgcggcugcgacuga

SEQ ID NO: 31970 - RNA, 4080 nt, Artificial Sequence
  derived and/or modified sequence opt1 from KIAA1462__Homo_sapiens__XP_011517910
auguacagcguggaggaccugcucaucucccacggcuacaagcugagccgcgaccccccggccucccgggaggacaaccccaaggggcgccaggccgcgcggaccggcacccgcgccgggcagggccugcagaacgggcacgaggacggccccgccgcccucgcccaccggaagacgagcgcgggcaaggggcacgucuccgacagcgagucccgccggagcaccccccgcggccacggggagccgcaguccaccagcgccucccggaccagcgaggccggcuucugcaaccagccccccuccgccuggagcucccaccccccgacggggaacgaccaggcguaccgccggcgcggccggcaggaggcccgcagccagaagccccgggagcacgagaaccuggaggcccgcggcauggcccaggcccacucccugcccgugcacgugcgggaggggcccugggaggucggcgggcgcagcgagcacgugaugaagaagccggugugggaggaggagcuccggauguccggccccgcgaaguggcagaacgucagccuggagagcuggaaccagccccgcaagcugggccggcagauguccgacggggacggcgagcgccucuuccaggaccuguaccccuucauccagggggagcacgugcugaacagccagaacaagggcaagucccgcagccucccgcgggugcugucccccgagagccuguccugcaccgagauccccaucccccucaacgagcgccacagcccgaagaugccccccuaccccccgaccugcgcccccaaccuggacuccacccggaacagcgagaaguccgggugcagcgcccccuucccccgcccgaaguucggccggccccugaagcccccguccuacagcucccaccagcagagccgcggcggggccgacuccagcgacucccaggacagccagcagauggacgccuacgucccccggcacgagcucugccugagcgaccccggccuggagcccccgguguacgugcccccccccuccuaccgcagcccgccccagaacauccccaaccccuaccucgaggacacggucccgaucaacgugugcgggggccacucccagcagcagagccccaccgagaaggcgggggccuccggccagccccccagcggcccgcccgggaccggcaacgaguacgggguguccccccggcugccccagggccugccggcccacccccgccccgucaccgccuacgacggguucgugcaguacauccccuucgacgacccgcggcuccgccacuucaagcuggcccagccccagggcuucugcgaggacaucaagcuggacgacaagagcuacaacuccagccccgugacggcgcaggagccggcccacggcgggaugcagcccgacggcgccaucuggaacccccagucccucauccccccgagcggggacgagcggggccugguccuggccgacuccagcccccgcuggcucuggggccagccccccggggacggcgagaacuccgggcugccgaaccagcgggaccgcugcguggcccggggccaguggcccgacgugcgcgggagccagcacggccacaccggccggcaggucuccagccccuacagccagggggaguccaccugcgagacccagacgaagcugaagaaguuccagaccggcacccgcaccaagaagagcuccaagaagaagaugaacgagacgaucuucugccucgugagcauccccgugaaguccgagagccaccugccggaccgcgacauggacaacaacgaccugaagcccuccgcggaccagaagaacgggagcgacaagucccccgcccuccaggagcagagccugcuguccaugagcuccaccgaccucgagcugcaggcccugaccggcagcauggggggccggaccgaguuccagaagcaggaccucggcgagcccgaggaggaccgccagacgaacgaccuguccuucauccaccugaccaagcaccgggagcucaagcacagcggguccuggccgggccaccgcuaccgggaccagcagacccagaccagcuucuccgaggagccccagagcagccagcugcugcccggggccaagcucggcgggcccucccgcgcggcccugagcccgaagugcuccgaccccgccgccagcgaggcccagacgcacaccgcguuccccaccggcgaccacaagcagcggcccuccgcccgcaaccugaagggccaccggagccuguccccgagcuccaacagcgccuucucccgcaccagccucuccgucgaccaggcccccacgcccaaggccgggcggagccagcccugcguggacguccacggccugggggcgcacccgggccccaagcgcgagguggugaagggggagcccaccggcccgugcaacuccaagcagcuguucggccaguuccuccugaagcccgucagccggcgccccugggaccugaucucccagcucgagagcuucaacaaggagcugcaggaggaggaggaguccagcagcuccagcuccagcuccagcuccagcuccgaggagagcgaggccgagccccagcaggagaaccgggcccacugccgccaggaggacgugggguuccggggcaacuccccggagaugcgcguggagccccagccccggauguggguccccgagagcccggugugccgcuccgggcggggcgagagcaaguccgagagcugguccgaggagcugcagcccggccacccccgcgccuggcccccgagccccgggcgcuuccggguggaggagggcgggggcgcccccuucugcuccgcggacgggagcaccagcgccgagaagcgccaccucgaggucuccaacggcauggacgagcuggccggcagccccuucccggugacccggauguccagccgcuccagcgacgccaagccccugcccgcguccuaccccgccgagccgcgggagccccaggagagccccaagaucacguccgccuucagcuccgugaagcccagcgaggccgucccgcgcaaguucgacuccgggggcgagcggggggccggccucccccugagccuguccaacaagaaccgcgggcucagcgcgcccgaccugcgguccgugggccugacccccggccaggagcagggggccagcgagcucgagggcucccugggggaggccagcaccaucgagaucccgcccggcgagagccugcaggcccgcgccgcgcggauccucgggaucgagguggccgucgagucccugcugcccggcauccgccgggccggccagaaccagccggccgagcccgacgccagcgcgugcacccccgaguccccccaggaggagcuccugagccgcccggcccccgccgacgugccccggguguccaccgacgccuucuacgggcgccggaagugcggcuggacgaagagcccccuguucgucggggaccgcgacuccgcgcggcgcgccccgcaggccuucgagcacagcgacguggacggcguggucaccuccaccgaccccgugcccgagcccgagccgagcccccucgaguccaaguucuucgagcagaaggacguggagaccaagccccccuuccgcagcacgcuguuccacuucgucgagcggaccccguccguggccggcagcgagaagcgccugcggucccccagcaaggugaucgagucccuccaggagaagcuggccagccccccccgccgggcggacccggaccgccugaugcggaugaaggaggucuccagcgugagccgcaugcgggugcucuccuuccgcaacgccgacagccaggaggacgccgaggagcugaaggccaccacccgggggcaggccggccugcccgggggccucgucucccccgggagcggcgaccgcgcgcagcggcugggccacucccugagcguguccaaggacagcaucucccgcgaggagaaggagcaccccgccgcccagaaggagaagagcauggaccaggacuucuggugcccggacuccuacgaccccagccggguggagcgcgucuga

SEQ ID NO: 31971 - RNA, 3651 nt, Artificial Sequence
  derived and/or modified sequence opt1 from KIAA1468__Homo_sapiens__NP_065905
auggccgccauggcgcccggcgggagcggcuccgggggcggggugaacccguuccugagcgacuccgacgaggacgacgacgaggucgccgccaccgaggagcgccgggccgugcuccgccugggcgccggcagcgggcuggaccccggcuccgcggggagccucagcccccaggaccccguggcccugggcagcuccgcccggccggggcugcccggcgaggccagcgcggccgccgucgcccucggcgggaccggcgagacgcccgcccgccuguccaucgacgcgaucgccgcccagcugcuccgggaccaguaccugcugaccgcccucgagcugcacaccgagcugcucgagagcgggcgcgagcugccccggcugcgcgacuacuucuccaacccgggcaacuucgagcggcagagcggcaccccgcccgggaugggcgcccccggggugcccggcgcggccggggugggcggcgccgggggccgcgagcccuccacggccagcgggggcgggcagcucaaccgggccggcuccaucagcacccuggacucccuggacuucgcgcgcuacagcgacgacggcaaccgggagaccgacgagaaggucgccgugcucgaguucgagcugcgcaaggccaaggagaccauccaggcccugcgggccaaccucacgaaggcggccgagcacgaggugccccugcaggagcgcaagaacuacaagagcucccccgagauccaggagccgaucaagccccuggagaagcgggcccucaacuuccuggucaacgaguuccugcucaagaacaacuacaagcugaccagcaucaccuucuccgacgagaacgacgaccaggacuucgagcugugggacgacguggggcucaacauccccaagcccccggaccugcugcagcucuaccgcgacuucggcaaccaccaggugaccgggaaggaccuggucgacguggccagcggcguggaggaggacgagcuggaggcgcucacgcccaucaucuccaaccugccgcccacccuggagacgccccagcccgccgagaacagcaugcucguccagaagcuggaggacaagaucucccugcucaacagcgagaaguggucccugauggagcagauccggcgccucaagagcgagauggacuuccugaagaacgagcacuucgccauccccgccgugugcgacuccgugcagcccccgcuggaccagcugccccacaaggacagcgaggacuccgggcagcaccccgacgucaacagcuccgacaagggcaagaacaccgacauccaccugagcaucuccgacgaggccgacagcaccaucccgaaggagaacucccccaacagcuucccccggcgcgagcgcgagggcaugcccccgagcucccucagcuccaagaagaccgugcacuucgacaagcccaaccggaagcugagccccgcguuccaccaggcccugcucuccuucugccgcaugagcgccgacucccggcugggguacgaggugagccgcaucgccgacuccgagaaguccgucaugcugaugcucggccggugccugccccacaucgugccgaacgugcugcucgccaagcgcgaggagcugaucccccugauccucugcaccgcgugccugcaccccgagcccaaggagcgggaccagcugcuccacauccuguucaaccugaucaagcgcccggacgacgagcagcggcagaugauccucaccgggugcgucgccuucgcccgccacgugggccccacgcgggucgaggccgagcugcugccccagugcugggagcagaucaaccacaaguaccccgagcgccggcuccugguggccgaguccugcggcgcgcuggccccguaccuccccaaggagauccgcagcucccuggugcugagcaugcuccagcagaugcugauggaggacaaggccgaccugguccgggaggccgugaucaagucccucgggaucaucaugggcuacaucgacgaccccgacaaguaccaccagggguucgagcugcugcucagcgcgcugggcgaccccuccgagcgcguggucagcgccacccaccagguguuccugccggccuacgccgccuggaccaccgagcucgggaaccugcagagccaccugauccucacgcugcugaacaagaucgagaagcuccugcgggagggcgagcacggccuggacgagcacaagcuccacauguaccuguccgcgcugcagagccucauccccucccuguucgcccuggugcuccagaacgcccccuucagcuccaaggccaagcugcacggggaggucccccagaucgaggugacccgcuucccgcggcccaugagcccccugcaggacguguccaccaucaucggcagccgcgagcagcucgccguccugcugcagcucuacgacuaccagcuggagcaggaggggaccacgggcugggagucccugcucuggguggugaaccagcugcugccgcagcucaucgagaucgucgggaagaucaacgugaccagcaccgcgugcgugcacgaguucucccgcuucuucuggcggcugugccgcaccuucggcaagaucuucacgaacaccaaggucaagccccaguuccaggagauccugcggcucagcgaggagaacaucgacuccagcgccggcaacggggugcugaccaaggccaccgugcccaucuacgccacgggcguccugaccugcuacauccaggaggaggaccgcaagcuccuggugggguuccuggaggacgugaugacccuccugucccugagccacgcgccccucgacucccugaaggccagcuucgucgagcugggcgccaacccggccuaccacgagcuccugcugaccgugcucugguacggggugguccacaccuccgcccuggugcggugcacggcggcccgcauguucgagcugacccuccggggcaugagcgaggcccugguggacaagcgcgucgcccccgcccuggugacccucagcuccgaccccgaguucagcgugcggaucgcgaccauccccgccuucggcacgaucauggagaccgucauccagcgcgagcugcuggagcgggugaagaugcagcucgccuccuuccuggaggacccgcaguaccaggaccagcacagccugcacaccgagaucaucaagaccuucgggcgcgugggccccaacgccgagccccgguuccgcgacgaguucgucaucccccaccuccacaagcuggcccuggugaacaaccugcagaucguggacuccaagcggcucgacaucgcgacgcaccuguucgaggccuacagcgcccuguccugcugcuucaucagcgaggaccucauggucaaccacuuccugccggggcugcgcugccuccggaccgacauggagcaccugucccccgagcacgaggugauccugagcuccaugaucaaggagugcgagcagaagguggagaacaagaccguccaggagccccagggcagcauguccaucgccgccagccucguguccgaggacaccaagacgaaguuccugaacaagauggggcagcugaccaccagcggcgcgaugcucgccaacguguuccagcgcaagaaguga

SEQ ID NO: 31972 - RNA, 2718 nt, Artificial Sequence
  derived and/or modified sequence opt1 from KIAA1524__Homo_sapiens__NP_065941
auggacagcaccgccugccugaagucccuccugcugaccgugagccaguacaaggccgucaaguccgaggcgaacgccacgcagcuccugcgccaccuggaggugaucagcggccagaagcucacccggcuguucaccuccaaccagauccugaccagcgagugccucuccugccugguggagcugcucgaggaccccaacaucagcgccucccugauccugagcaucaucgggcuccugucccagcuggccgucgacaucgagacgcgcgacugccuccagaacaccuacaaccugaacagcgugcuggccggcguggucugccgguccagccacaccgacuccguguuccuccagugcauccagcugcugcagaagcucaccuacaacgugaagaucuucuacagcggggcgaacaucgacgagcugaucacguuccugaucgaccacauccaguccagcgaggacgagcucaagaugccgugccugggccugcucgccaaccugugccgccacaaccuguccguccagacccacaucaagacccucagcaacgucaagagcuucuaccggacccugaucacgcugcucgcccacuccagccugaccguggugguguucgcccuguccauccucagcucccugacccugaacgaggaggugggggagaagcuguuccacgcgcgcaacauccaccagaccuuccagcucaucuucaacauccugaucaacggcgacggcacgcucacccggaaguacagcgucgaccugcugauggaccuccugaagaaccccaagaucgccgacuaccugacccgcuacgagcacuucuccagcugccugcaccaggugcucgggcugcugaacggcaaggaccccgacuccagcuccaaggugcucgagcugcugcucgccuucugcagcgucacccagcugcggcacaugcugacgcagaugauguucgagcagagcccgcccgggagcgccacccucggcucccacaccaagugccuggagcccaccguggcccugcuccgcuggcugagccagccccuggacggguccgagaacugcagcgugcucgcgcuggagcuguucaaggagaucuucgaggacgucaucgacgccgccaacugcuccagcgccgaccgguucgugacgcuccugcugcccaccauccucgaccagcugcaguucaccgagcagaaccuggacgaggcccucacccgcaagaagugcgagcggaucgcgaaggccaucgaggugcugcugacgcucugcggcgacgacacccugaagaugcacaucgccaagauccugaccaccgucaagugcacgacccucaucgagcagcaguucaccuacggcaagaucgaccugggguucggcaccaagguggccgacagcgagcugugcaagcucgccgcggacgucauccugaagacgcuggaccucaucaacaagcugaagccgcuggugcccgggauggagguguccuucuacaagauccuccaggacccccgccugaucacgccccuggccuucgcccucaccagcgacaaccgggagcagguccaguccggccugcgcauccugcucgaggccgccccgcugcccgacuuccccgcgcuggugcucggcgagagcaucgccgccaacaacgccuaccggcagcaggagaccgagcacaucccccgcaagaugccguggcaguccagcaaccacuccuuccccaccagcaucaagugccugacgccccaccugaaggacggggugcccggccucaacaucgaggagcugaucgagaagcugcaguccgggauggucgugaaggaccagaucugcgacgugcggaucagcgacaucauggacgucuacgagaugaagcucuccacccuggcgagcaaggagucccgccugcaggaccuccuggagaccaaggcccuggcccucgcccaggccgaccggcugaucgcgcagcaccgcugccagcgcacccaggccgagaccgaggcccggacccuggccagcaugcuccgcgagguggagcggaagaacgaggagcuguccgugcugcucaaggcccagcaggucgagagcgagcgcgcgcaguccgacaucgagcaccuguuccagcacaaccggaagcuggagagcguggccgaggagcacgagauccucaccaagagcuacauggagcugcugcagcgcaacgaguccaccgagaagaagaacaaggaccuccagaucacgugcgacagccugaacaagcagaucgagaccgugaagaagcugaacgagucccucaaggagcagaacgagaaguccaucgcccagcugaucgagaaggaggagcagcggaaggagguccagaaccagcugguggaccgcgagcacaagcucgccaaccugcaccagaagaccaaggugcaggaggagaagaucaagacccugcagaaggagcgggaggacaaggaggagacgaucgacauccuccgcaaggagcugucccggaccgagcagauccgcaaggagcugagcaucaaggccuccagccucgagguccagaaggcgcagcuggagggccggcuggaggagaaggagucccucgugaagcugcagcaggaggagcugaacaagcacagccacaugaucgccaugauccacucccucagcgggggcaagaucaacccggagaccgugaaccuguccaucuga

SEQ ID NO: 31973 - RNA, 5853 nt, Artificial Sequence
  derived and/or modified sequence opt1 from KIAA1549__Homo_sapiens__NP_001158137
augcccggcgcccgccggcgccggcgcggggccgccauggagggcaagccccgggccgggguggcccuggcccccggccccuccgggcgccggcccuccgcccgcugcgcccggcgccggcgccccggccuccugcugcccggccucuggcugcugcuccuggcccggcccgccagcugcgcccccgacgagcugucccccgagcagcacaaccucagccuguacuccauggagcuggugcucaagaaguccaccgggcacuccgcggcccagguggcccugaccgagaccgcccccggcagccagcacuccagcccccugcacgugaccgcgccgcccuccgcgaccaccuucgacaccgccuucuucaaccaggggaagcagaccaagagcaccgccgaccccuccaucuucgucgccaccuacgugagcgugacguccaaggaggucgccgugaacgacgacgagauggacaacuuccuccccgacacccacuggaccacgccccgcauggugagccccauccaguacaucaccgucagcccgcccggccugccccgggaggcgcuggagccgaugcucacccccagccugcccauggugucccugcaggacgaggaggugaccagcggguggcagaacaccacgcgccagcccgccgccuacgccgagagcgccucccacuuccacaccuuccggagcgcguuccgcaccuccgagggcaucgucccgacccccggccggaaccucgugcuguaccccacggacgccuacagccaccuguccagccgcacccuccccgagaucguggccucccugaccgagggggucgagaccacgcuguuccucagcucccggagccugaugccccagccccugggcgacgggaucaccaucccccucccgucccugggcgaggugagccagccgcccgaggaggugugggccaccuccgccgaccgcuacaccgacgucacgaccgugcugagccagucccucgaggagaccaucagcccccgcaccuacccgacggugaccgcgucccacgccgcccuggccuucagccggacccacagcccccugcucagcacgccccuggcguucgccagcuccgccagccccacggacgucuccagcaacccguuccugcccuccgacagcuccaagaccagcgagcuccacuccaacagcgcccugcccggccccguggacaacacccacauccuguccccggugagcuccuuccgccccuacaccuggugcgccgcgugcaccguccccagcccccagcagguccucgccacgucccugauggagaaggacgucgggagcggcgacggggccgagacccugugcaugaccgugcucgaggaguccagcaucagccugauguccagcguggucgccgacuucuccgaguucgaggaggacccccagguguucaacacccuguuccccagccggcccaucgugccccucuccagccgcuccauggagaucagcgagacguccgucggcaucagcgccgagguggacauguccagcgugaccaccacccaggucccgcccgcgcacgggcggcuguccgugcccgccagccuggaccccacggccggcucccugagcguggccgagacccaggucaccccguccagcgugaccacggccuucuucuccgugaucaccagcauccuccuggacagcuccuucagcgucaucgcgaacaagaacacccccucccuggccgugcgcgaccccagcguguucaccccguacucccucguccccagcguggaguccagccuguucuccgaccaggagcggagcuccuucagcgagcacaagccccgcggcgcccuggacuucgccuccagcuucuucuccacgcccccgcucgagcugagcggguccaucagcucccccagcgaggcgcccgccagccugucccucaugcccagcgaccugucccccuucaccagccaguccuucagcccccugguggagaccuucacccucuucgacuccagcgaccugcaguccagccagcugucccuccccagcuccacgaaccuggaguucagccagcugcagcccuccagcgagcucccgcugaacaccaucaugcugcuccccucccggagcgaggucucccccuggagcagcuuccccuccgacagccuggaguucguggaggccuccaccgugagccugaccgacuccgaggcccacuucacgagcgccuucaucgagaccaccuccuaccucgagagcucccugaucagccacgaguccgcggucaccgcccuggugccgcccggcagcgaguccuucgacauccucacggccgggauccaggccaccagcccccugaccaccgugcacacgacccccauccugaccgaguccagccucuucuccacccugacgccgcccgacgaccagaucagcgcccuggacggccacgucuccgugcucgcgagcuucagcaaggccauccccaccgggaccgugcugaucaccgacgccuaccugcccuccggcagcuccuucgucagcgaggccaccccguucccccuccccacggagcugaccguggugggccccucccugaccccgaccgaggucccccucaacacgagcaccgagguguccaccaccagcacgggggccgcgaccggcgggccccuggacuccacccugaugggcgacgccgccagccaguccccgcccgagagcuccgccgcgccgccccucccgagccugcgccccgugaccgccuucacgcuggaggccaccgucgacacccccacccucgccacggccaagcccccguacgugugcgacaucaccgugcccgacgcguaccugaucaccaccguccuggcccggcgcgccgugcaggaguacaucaucacggccaucaaggaggugcuccggauccacuucaaccgcgccgucgagcugaagguguacgagcuguucaccgacuucaccuuccucgugaccuccgggcccuucgucuacacggcgaucagcgugaucaacgugcugaucaacuccaagcugguccgggaccagacgccccucauccugagcgugaagccguccuuccuggugcccgagagccgcuuccagguccagaccgugcuccaguucgugccgcccagcguggacaccggcuucugcaacuucacgcagcggaucgagaagggccugaugaccgcccuguucgaggugcgcaagcaccaccaggggaccuacaaccucaccguccagauccugaacaucacgaucuccagcucccgggugaccccgcgccgcggccccgugaacaucaucuucgccgucaagagcacccagggguuccugaacggcuccgaggugagcgagcuccugcggaaccuguccguggucgaguucagcuucuaccucggcuaccccgugcugcagaucgccgagcccuuccaguacccgcagcugaaccucucccagcugcugaaguccuccugggugcgcaccguccuccugggggugauggagaagcagcugcagaacgagguguuccaggccgagauggagcggaagcucgcgcagcugcugagcgaggucuccacgcgccggcgcauguggcggcgcgccaccguggccgccggcaacagcgugguccagguggugaacgucucccggcucgagggggacgacaaccccgugcagcugaucuacuucguggaggaccaggacggcgagcgccugagcgccgucaaguccagcgaccucaucaacaagauggaccugcagcgggcggccaucauccugggguaccgcauccagggcgugaucgcccagcccguggaccgggucaagcgccccagcccggagucccagagcaacaaccucugggugaucgugggcgucgugauccccgugcuggucgugauggugaucgucgugauccuguacuggaagcucugccggaccgacaagcuggacuuccagcccgacaccguggccaacauccagcagcgccagaagcugcagauccccuccgucaagggguucgacuucgcgaagcagcaccucggccagcacaacaaggacgacauccugaucauccacgagccggcgccccugcccgggccgcucaaggaccacaccacgcccagcgagaacggcgacgugcccucccccaagagcaagaucccguccaagaacgugcggcaccgcgggcgggucagccccuccgacgccgacagcaccguguccgaggagagcuccgagcgcgacgccggcgacaagacccccggcgccgugaacgacgggcggagccaccgcgcgccccaguccggcccgccccugcccagcuccgggaacgagcagcacagcuccgccagcaucuucgagcacgucgaccgcaucagccggcccccggaggccucccgccgggugcccagcaagauccagcugaucgccaugcagcccauccccgccccgcccgugcagcgccccucccccgcggaccgggucgccgagagcaacaagaucaacaaggagauccagaccgcccugcgccacaaguccgagaucgagcaccaccggaacaagauccgccuccgggccaagcgccggggccacuacgaguucccggugguggacgaccugagcuccggggacacgaaggagcgccaccgggucuaccgccgggcccagaugcagaucgacaagauccuggaccccaccgcgagcgugcccuccgucuucaucgagccccgcaagagcucccggaucaagcgcagcccgaagccccggcgcaagcaccaggugaacggcugccccgccgacgccgagaaggaccgccucaucaccaccgacuccgacggcacguaccggcgcccgcccggggugcacaacagcgccuacaucggcugccccuccgaccccgaccugccggcggacguccagacccccagcuccguggagcuggggcgguaccccgcccuccccuucccggccagccaguacaucccgccccagcccuccaucgaggaggcccgccagaccaugcacagccugcuggacgacgccuucgcgcucguggccccgagcucccagcccgccagcaccgccggcgucgggcccggcgugcccccgggccugcccgccaacuccacgcccagccaggaggagcggcgcgcgacccaguggggguccuucuacagccccgcccagaccgccaacaacccgugcucccgguacgaggacuacggcaugacgccgcccacggggccccugccgcgccccggcuucggccccgggcuccugcagagcaccgagcuggugcccccggacccccagcagccccaggccuccgccgaggcgccguucgccgcccggggcaucuacagcgaggagaugcccuccgucgcccgcccccggcccgucgggggcaccaccgggagccagauccagcaccucacccaggugggcaucgcgucccgcaucggcgcccagccggucgagaucccgcccagccgggggucccaguacggcgggcccggcuggccgagcuacggggaggacgaggccggccgccgggaggccacccacaugcugggccaccaggaguacuccagcagcccccuguuccaggugccccgcaccagcgggcgggagcccagcgccccguccggcaaccucccccaccgcgggcugcagggccccgggcugggcuaccccaccagcuccacggaggaccuccagccgggccacagcuccgcgagccugaucaaggccauccgggaggagcugcuccgccugucccagaagcagagcaccgugcagaacuuccacuccuga

SEQ ID NO: 31974 - RNA, 5244 nt, Artificial Sequence
  derived and/or modified sequence opt1 from KIAA1551__Homo_sapiens__XP_005253462
augaacuggaacgagaagcccaagagcgccacccugccgccccucuaccccaagucccagcccccguuccugcaccagagccugaucaaccagaucaccaccaccucccagagcuccuucagcuaccccggcuccaaccaggaggccugcauguaccccgggaacagcaaccccaucucccagccgcuccugaacauccagaacuacccccagcagaucagcguguccgacaugcacaacggcaccgugguggccagccacaccuccguggagcgcaucacguacgccaacgugaacgggcccaagcagcugacccacaaccuccagaugagcuccggcgugacccagaacguguggcugaacagccccaugcgcaacccggugcacucccacaucggggccaccgugagccaccagacggacuucggcgccaacgugcccaacaugcccgcccugcagucccagcucaucaccagcgacaccuacagcaugcagaugcagaugauccccuccaacagcacccgccugccggucgcguaccagggcaaccaggggcugaaccaguccuucagcgagcagcaggucgacuggacgcagcagugcaucuccaagggccucaccuaccccgacuaccggccgccgcccaagcuguaccgcuacagcccccaguccuuccugcccgacagcaccauccagaagcagaacuucaucccccacaccucccuccaggugaagaacagccagcugcugaacuccguccucacgcugcccagccggcagaccuccgccgugcccagccagcaguacgccacccagaccgacaagcggccgccgccgccgcccuacaacugccgguacgggucccagccccugcagagcacgcagcacaucaccaagcaccucuccauggaggugccccagagccgcgagaugcuguccagcgagauccggaccagcuuccagcagcaguggcagaaccccaacgagaacgucuccaccaucggcaacuucacgaaccugaaggugaacaccaacagcaagcagcccuucaacucccccauccgcagcuccguggacgggguccagacccucgcccagaccaacgaggagaagaucauggacagcugcaaccccacguccaaccaggugcuggacaccagcguggcgaaggagaagcugguccgggacaucaagacccucguggagaucaagcagaaguucuccgagcuggcccgcaagaucaagaucaacaaggaccugcucauggccgccggcugcaucaagaugaccaacacgagcuacuccgagcccgcccagaacagcaagcugucccugaagcagaccgcgaagauccagagcggcccccagaucaccccggugaugcccgagaacgccgagcggcagacccccacggucguggaguccgccgagaccaacaagacccagugcaugcucaacagcgacauccaggaggucaacugccgccgguucaaccagguggacuccgugcugcccaacccggucuacagcgagaagcgccccaugcccgacagcucccacgacgugaaggugcugaccagcaagaccuccgccgucgagaugacgcaggccgugcucaacacccagcugagcuccgagaacgugaccaaggucgagcagaacagccccgcggugugcgagaccaucuccgugcccaaguccauguccacggaggaguacaagagcaagauccagaacgagaacaugcugcuccuggcccugcucucccaggcccggaagacccagaagaccguccugaaggacgccaaccagaccauccaggacagcaagcccgacuccugcgagaugaaccccaacacgcagaugaccgggaaccagcugaaccucaagaacauggagacccccagcaccuccaacgugagcggccgcgugcuggacaacuccuucugcagcgggcaggaguccagcacgaagggcaugccggccaagagcgacuccagcugcuccauggagguccuggcgaccugccucagccuguggaagaagcagcccuccgacaccgccaaggagaaggagugcgacaagcugcggaccaacacgaccgccgugggcaucagcaagcccgccaacauccacgugaagucccccugcagcgucguggggaacuccaacagccagaacaagaucuccaacccgagccagcagaccgcccuguccauggugaugcacaacuacgagagcuccggcaucaacaucaccaaggggacggagcuccagaucgcggucgugagcccccuggugcuguccgaggucaagacccucagcgugaagggcaucacccccgccgugcugccggagaccgucuaccccgugaucaaggagggguccgugugcagccugcagaaccagcucgccgagaacgccaaggcgacggccgcccugaaggucgacgugagcggccccguggccuccaccgccaccagcaccaagaucuucccccugacgcagaaggagaagcagaacgaguccaccaacggcaacagcgaggucaccccgaacgugaaccaggggaagcacaacaagcucgaguccgcgauccacagccccaugaacgaccagcagaucucccaggagagccgcaacuccaccguggucagcuccgacacgcugcagaucgacaacaucugcagccugguggagggcgacaccuccuacaacagccagaucgccaagaucuucuccagccucccccugaagaugguggagccccagaagccgucccugcccaaccagcaggggaucggcagccgggagcccgagaagcagcucgacaacaccaccgagaacaaggacuucggguuccagaaggacaagcccguccagugcacggacgugucccacaagaucugcgaccagagcaagagcgagccgccccuggaguccagcuucaacaaccuggagaccaaccgcgugauccucgagaaguccagccuggagcacgccaccgagaaguccaccgccaacgacacgugcagcuccgccgcgauccaggaggacaucuacccccaggagaucgacgccagcuccaacuacacgccccaggacccggcccgcaacgagauccacagcgacaaggcccccguccuguaccuccacgaccagcuguccgagcugcucaaggaguuccccuacggcaucgaggccgugaacacccgggagggcagcguggggcagcagaccaccuaccagacguccgaggaccagaccgcggacaagaccagcuccgacagcaaggaccccgccgaccagauccagaucaccauccuguccagcgagcagaugaaggagaucuucccggagcaggacgaccagcccuacgucguggacaagcuggccgagccccagaaggaggagcccaucacggagguggucucccagugcgaccuccaggccccggcggccggccagagccgcgacagcgugauccuggacuccgagaaggacgacauccacugcugcgcccugggguggcucagcaugguguacgagggcgucccccagugccagugcaacuccaucaagaacagcuccagcgaggaggagaagcagaaggagcagugcagcccccuggacaccaacagcugcaagcagggggagcggaccuccgaccgcgacgugaccgucgugcaguucaagagccuggugaacaaccccaagacgccgcccgacggcaagucccacuuccccgagcuccaggacgacagccggaaggacaccccgaagaccaagcacaagucccugccccgcaccgagcaggagcuggucgccggccaguucagcuccaagugcgacaagcucaacccccugcagaaccacaagcggaagaagcugcgcuuccacgaggugacguuccacagcuccaacaagaugaccgccagcuacgagcaggcgucccaggagacccggcagaagaagcacgugacccagaacagccgcccccucaagacgaagaccgccuuccugccgaacaaggacgucuacaagaagcacagcucccuggggcagagccucucccccgagaagaucaagcugaagcucaagagcguguccuucaagcagaagcggaagcucgaccagggcaacgugcuggacauggaggucaagaagaagaagcacgacaagcaggagcagaaggggagcgugggcgccaccuucaagcugggcgacucccucagcaaccccaacgagcgcgccaucgugaaggagaagauggucuccaacaccaagagcguggacacgaaggccuccagcuccaaguucagccggauccugacccccaaggaguaccugcagcgccagaagcacaaggaggcgcucuccaacaaggccagcaagaagaucugcgugaagaacgucccgugcgacuccgagcacaugcggcccagcaagcuggccguccagguggagagcugcgggaaguccaacgagaagcacagcuccggcguccagaccagcaaggagucccugaacgggcucaccagccacggcaagaaccugaagauccaccacucccaggagagcaagacguacaacauccugcgcaacgugaaggagaaggucgggggcaagcagcccgacaagaucuggaucgacaagaccaagcucgacaagcugaccaacaucuccaacgaggcccaguucagccagaugcccccgcaggucaaggaccagaagaagcuguaccucaaccgggugggcuucaagugcaccgagcgcgaguccaucagccugacgaagcuggaguccagcccccggaagcuccacaaggacaagcgccaggagaacaagcacaagaccuuccugcccgugaaggggaacaccgagaaguccaacaugcuggaguucaagcucugccccgacauccugcugaagaacaccaacagcgucgaggagcgcaaggacgugaagccgcacccccggaaggagcaggcgccccuccagguguccggcaucaagagcacgaaggaggacuggcugaaguucgucgcgaccaagaagcgcacccagaaggacucccaggagcgggacaacgugaacagccgccugagcaagcgguccuucagcgccgacggguucgagaugcugcagaaccccgugaaggacuccaaggagauguuccagaccuacaagcagauguaccuggagaagcgcagccggucccugggcagcuccccggucaaguga

SEQ ID NO: 31975 - RNA, 1896 nt, Artificial Sequence
  derived and/or modified sequence opt1 from KIAA1598__Homo_sapiens__NP_001120683
augaacagcuccgacgaggagaagcagcugcagcucaucaccagccugaaggagcaggccaucggcgaguacgaggaccugcgcgccgagaaccagaagaccaaggagaagugcgacaagauccggcaggagcgcgacgaggcggugaagaagcucgaggaguuccagaagaucucccacauggucaucgaggaggugaacuucaugcagaaccaccuggagaucgagaagacgugccgggagagcgccgaggcccuggccaccaagcucaacaaggagaacaagacccugaagcgcaucuccaugcuguacauggccaagcucgggcccgacgugaucaccgaggagaucaacaucgacgacgaggacagcacgaccgacaccgacggcgcggccgagaccugcgucuccgugcagugccagaagcagaucaaggagcugcgggaccagaucgugagcguccaggaggagaagaagauccuggccaucgagcucgagaaccugaaguccaagcugguggaggugaucgaggaggucaacaaggugaagcaggagaagacggugcucaacagcgagguccuggagcagcgcaaggugcuggagaagugcaaccggguguccaugcucgccgucgaggaguacgaggagaugcaggucaaccuggagcuggagaaggaccuccgcaagaaggcggagagcuucgcccaggagauguucaucgagcagaacaagcugaagcggcagucccaccuccugcugcagagcuccauccccgaccagcagcugcucaaggcccuggacgagaacgccaagcugacccagcagcucgaggaggagcgcauccagcaccagcagaaggugaaggagcuggaggagcagcuggagaacgagacccuccacaaggagauccacaaccugaagcagcagcuggagcuccuggaggaggacaagaaggagcuggagcucaaguaccagaacagcgaggagaaggcccggaaccugaagcacuccguggacgagcugcagaagcgcgugaaccagagcgagaacuccgugcccccgccgcccccgccgccgccgccccugcccccgcccccgcccaaccccauccggagccucaugagcaugauccgcaagcggucccaccccagcggguccggcgcgaagaaggagaaggccacccagcccgagacgaccgaggaggucaccgaccugaagcgccaggccguggaggagaugauggaccggaucaagaagggggugcaccuccgccccgucaaccagaccgcccggcccaagacgaagcccgagagcuccaagggcugcgagagcgccguggacgagcugaagggcauccuggggacccucaacaaguccaccagcucccgcagccugaagucccuggaccccgagaacagcgagaccgagcuggagcggauccuccgccgccggaaggucacggcggaggccgacuccagcucccccaccggcauccuggccaccagcgaguccaagagcaugcccgugcugggguccgugagcagcgucaccaagacggcccucaacaagaagacccuggaggccgaguucaacucccccagcccgcccacccccgagcccggcgaggggccccgcaagcuggagggcugcaccuccagcaaggugacguuccagccgcccuccagcaucggcugccggaagaaguacaucgacggggagaagcaggcggagcccguggucgugcucgaccccguguccacccacgagccccagaccaaggaccaggucgccgagaaggaccccacccagcacaaggaggacgagggcgagauccagcccgagaacaaggaggacagcaucgagaacgugcgcgagacggacuccagcaacugcuga

SEQ ID NO: 31976 - RNA, 1485 nt, Artificial Sequence
  derived and/or modified sequence opt1 from KIAA1715__Homo_sapiens__NP_001291937
augggccgcagcuggcccgggcugucccucugccaguggcggcugcugccggcccucgaggccggcugggcgguggccgccgagaccgggggcgggggccgccccggccgggccgcccccgcgagcugcuccugcgaguuccuguggaccaucgacgacaucuaccacugcgcccaguuccugcagaucaaggacggguggaucaucuucagcauggagggcaagacgaagcccuccaccgucgaggugcucgagagcaucgacaaggagauccaggcccuggaggaguuccgcgagaagaaccagcggcugcagaagcucuggguggggcgccugauccuguacuccagcguccucuaccuguucacgugccugaucguguaccucugguaccugccggacgaguucaccgcccggcuggcgaugacccuccccuucuucgccuucccccugaucaucugguccauccgcaccgugaucaucuucuucuucagcaagcggaccgagcgcaacaacgaggcccuggacgaccucaagucccagcggaagaagauccuggaggaggucauggagaaggagaccuacaagacggccaagcugauccucgagcgcuucgaccccgacagcaagaaggccaaggagugcgagccgcccuccgcgggcgccgccgugaccgcccggcccgggcaggagauccgccagcggaccgccgcgcagcgcaaccugagccccaccccggccucccccaaccaggggcccccgccccaggugcccgucagccccgggcccccgaaggacuccagcgcccccggcggcccgcccgagcggacggugacccccgcccuguccagcaacgugcucccccgccaccugggcagccccgccaccuccguccccggcaugggccugcacccgcccgggcccccgcucgcgcggcccauccugccccgcgagcggggcgcccuggaccgcaucguggaguaccucgugggggacggcccccagaaccgcuacgcccugaucugccagcagugcuucagccacaacgggauggcccugaaggaggaguucgaguacaucgccuuccggugcgcguacugcuucuuccucaacccggcccgcaagacccggccccaggcgccccgccugcccgaguucuccuucgagaagcggcaggucguggagggcagcuccagcgugggcccgcugcccuccgggagcguccucuccagcgacaaccaguucaacgaggagucccuggagcacgacgugcuggacgacaacacggagcagaccgacgacaagauccccgccaccgagcagaccaaccaggugaucgagaaggccagcgacuccgaggagcccgaggagaagcaggagacggagaacgaggaggccagcgucaucgagaccaacuccaccgugccgggcgccgacagcauccccgaccccgagcucuccggggagagccugaccgccgaguga

SEQ ID NO: 31977 - RNA, 3111 nt, Artificial Sequence
  derived and/or modified sequence opt1 from KIAA1804__Homo_sapiens__NP_115811
auggcccugcgcggcgccgcgggggccaccgacacccccgugagcuccgccggcggggccccgggcgggagcgccuccagcuccagcacguccagcggcggcuccgcgagcgccggggccggccucugggccgcgcuguacgacuacgaggcccgcggggaggacgagcugucccuccggcggggccagcuggucgaggugcugagccaggacgccgccguguccggggacgagggcuggugggccggccagguccagcgccggcucgggaucuuccccgcgaacuacguggcccccugccgccccgccgccagcccggccccgccgcccucccggcccagcucccccgugcacgucgcguucgagcgccuggagcugaaggagcucaucggcgccgggggcuucggccagguguaccgggccaccuggcaggggcaggagguggccgucaaggccgcgcgccaggaccccgagcaggacgccgccgccgccgcggagagcgugcggcgcgaggcccggcuguucgccaugcugcgccaccccaacaucaucgagcuccggggcgugugccugcagcagccccaccugugccucguccuggaguucgcccgcgggggcgcgcugaaccgggcccucgccgccgccaacgcggcccccgacccccgcgcccccgggccgcggcgcgcccggcgcaucccgccccacgugcuggugaacugggccguccagaucgcgcgcggcaugcuguaccuccacgaggaggccuucgugcccauccugcaccgggaccugaaguccagcaacauccuccugcuggagaagaucgagcacgacgacaucugcaacaagacccucaagaucaccgacuucggccuggcccgcgaguggcaccggacgaccaagaugagcaccgccgggaccuacgccuggauggcgcccgaggugaucaaguccagccuguucuccaagggcagcgacaucugguccuacgggguccuccugugggagcugcucacgggcgaggugcccuaccgcgggaucgacggccuggccguggccuacggcgucgccgugaacaagcugacccuccccauccccagcacgugcccggagcccuucgcgaagcugaugaaggagugcuggcagcaggacccccacauccggcccuccuucgcccugauccucgagcagcugaccgccaucgagggggccgugaugaccgagaugccgcaggagagcuuccacuccaugcaggacgacuggaagcuggagauccagcagauguucgacgagcuccgcaccaaggagaaggagcugcggagccgcgaggaggagcugacccgggccgcgcuccagcagaagucccaggaggagcugcugaagcgccgggagcagcagcucgccgagcgcgagaucgacguccuggagcgggagcugaacauccugaucuuccagcucaaccaggagaagcccaaggugaagaagcgcaagggcaaguucaagcggagccgccugaagcugaaggacgggcaccggaucucccuccccagcgacuuccagcacaagaucaccguccaggccuccccgaaccuggacaagcgccggagccugaacuccagcuccagcagcccgcccuccagccccacgaugaugccccgccuccgcgccauccagcugaccuccgacgagagcaacaagaccuggggccggaacaccguguuccgccaggaggaguucgaggacgugaagcggaacuucaagaagaaggggugcacguggggccccaacuccauccagaugaaggaccgcaccgacugcaaggagcggauccgcccccugagcgacggcaacucccccuggagcaccauccucaucaagaaccagaagaccaugccgcuggccucccuguucgucgaccagcccgggagcugcgaggagcccaagcucucccccgacggccuggagcaccggaagccgaagcagaucaagcugcccagccaggcguacaucgaccucccccuggggaaggacgcccagcgcgagaaccccgccgaggccgaguccugggaggaggccgcgagcgccaacgccgccacgguguccaucgagaugaccccgaccaacagccugucccggagcccccagcgcaagaagaccgagagcgcgcucuacggcugcacggugcugcuggccuccgucgcccucggccuggaccugcgggagcuccacaaggcccaggccgcggaggagccccugcccaaggaggagaagaagaagcgcgaggggaucuuccagcgggccagcaagucccgccggagcgccuccccgcccaccagccugcccuccacgugcggcgaggccagcagcccgcccucccucccccuguccagcgcccuggggauccucuccacccccagcuucuccaccaagugccugcugcagauggacagcgaggacccgcucguggacuccgcgcccgugaccugcgacagcgagaugcugacccccgacuucugccccaccgccccgggcuccgggcgcgagcccgcccugaugccccggcucgacacggacugcagcgucagccgcaaccugcccuccagcuuccugcagcagaccugcggcaacgugccguacugcgccuccagcaagcaccggcccucccaccaccgccggaccaugagcgacggcaaccccacccccaccggggccacgaucaucuccgcgaccggcgccagcgcccucccgcugugccccucccccgcgccccacagccaccucccgcgcgaggugucccccaagaagcacagcaccguccacaucgugccccagcgccggcccgccucccugcgcagccgguccgaccugccgcaggccuacccccagaccgccgugagccagcuggcccagacggccugcgucguggggcgccccggcccccacccgacccaguuccucgcggccaaggagcggaccaagucccacgugcccagccugcuggacgccgacgucgaggggcagucccgcgacuacaccgugccccucugccggaugcgcagcaagacgagccggcccuccaucuacgagcuggagaaggaguuccugagcuga

SEQ ID NO: 31978 - RNA, 2124 nt, Artificial Sequence
  derived and/or modified sequence opt1 from KIAA1841__Homo_sapiens__XP_005264663
augagccgcggcuacuccgagaacaacaacuuccugaacaacaacaaccagauggugcucgacaugauccuguacccccugaucgggaucccgcagaccaucaacugggagaccaucgcccggcucguccccggccugacgcccaaggagugcgccaagcgcuucgacgagcucaagagcuccgggagcucccccguggacaaccaguacaacagccucauggcggccggcgaguccccgguggagacccuggccaccuacaucaagagcucccugcucgacauccacggggaguuccaggagacccccgucggccacgacgccgugagcaagacgggccggcacuccaucgccagcacccgcaacugcuccagcgaguccgagaacugcaccacccacaacgggggcgagaugacggaggagagcgaggggcccaacauggugauccacgucugcgacgaggcgaagaaccugaaggaggacuucacgugcccccgggaccugcucaucuccgagaugaaguacuucgccgaguaccugagcauggacgcccagcgcugggaggagguggacaucuccgugcacugcgacguccacaucuucaacuggcugaucaaguacaucaagcggaacaccaaggagaacaaggacugcgagaugccgacccucgagcccggcaacgugaucagcauccugaucagcuccgaguuccugaagauggacagccucguggagcagugcauccaguacugccacaagaacaugaacgccaucgucgcgacccccugcaacaugaacugcaucaacgccaaccugcugacccgcaucgccgaccucuucucccacaacgagguggacgaccugaaggacaagaaggacaaguucaagagcaagcuguucugcaagaagaucgagcggcuguucgaccccgaguaccugaacccggacucccgcagcaacgccgccacccuguaccggugcugccucugcaagaagcugcugaccaaggagacggagcgccggauccccugcauccccgggaagaucaacguggaccgccggggcaacaucgucuacauccacauccgcgacaagaccugggacgugcacgaguaccucaacucccuguucgaggagcucaagagcuggcgggacguguacuggcgccuguggggcaccaucaacuggcugaccugcucccggugcuaccaggcguuccugugcaucgaguucagccacugccaguaccacuccgagacggucguguaccccaccgccgccagcucccucaacaccguggggaccggcaucuacccgugcugcaaccagaagguccugcgcuucgaccccacgcagcugaccaaggggugcaaggugcgggaccacauggugacccuccgcgaccagggcgagggcggggaccugcccagcugccccaccgcccgcaugcuggacgaccuccacaaguaccgggacgucaucguggucccguucuccaaggacacggugagcgacgugggcgucgggcugugcgacgagaagggcaucgagugcgacgugcugcucgagcccaacacccccugggggcccaagaccggcgagcugaacgccuuccugucccucaagaacuggacccugcagcugaagcagcagagccuguucuccgaggaggaggaguacacgaccggcagcgaggugaccgaggacgaggucggggacgaggaggaggugagcaagaagcagcgcaagaaggagaagccgaagaaguucacccggcagcccaagaagcaggucuccagccccugcgcgcagcgcaaggagaaggcccucgagaaguccgccagccgggacgugucccccuucgugaugagcaugcagaagaacaagugggacgccacgcgcucccugcgguucaaccaggacgcccagcgcgaggacgaccagcggcgcaugaccgagaucaccggccaccugaucaagaugcggcucggggaccuggaccgcgucaagagcaaggaggcgaaggagaccgacaagcugcggccgcgcgacggcaccguguccaagagcaaccggaaguccgggcucagcuccgugcugcugaugacggugcuccugugcuga

SEQ ID NO: 31979 - RNA, 1557 nt, Artificial Sequence
  derived and/or modified sequence opt1 from KIAA1919__Homo_sapiens__NP_699200
augcugugcgccagcuuccugggccuggggcuguccguggccaucgucggccccaccuuccaggaccucgcgaccaacgugaaccgcaacaucagcucccugagcuucaucuucguggggcgggcccugggcuaccucuccgggagcgucaucggcggcuuccugguggacgugaugaacuacuuccugcuccuggggaucuccaugagcgccacgaccgucggccuguaccucgugccguucugcaagaccgccauccugcugaccgugaugauguccaucuucggggucagcaucggcauccucgacaccgggggcaacgugcugauccuggccaucuggggcgacaagggggcgccccacaugcaggcccuccacuucuccuucgcccugggcgccuuccuggcgccccuccuggccaagcuggcccucgggcccaccgccagcgccgagaaccacaccgaguccgacuuccacccggcgcugaaccagagcuccgacgccgacagcgaggcccuguucggcgugcccaacgacaagaaccuccugugggccuacgccgucaucggcaccuacauguuccugguguccgugaucuucuucugccucuuccugaagaacagcuccaagcaggagaaggcgcgcgccagcgccgagacguuccggcgcgccaaguaccacaacgcccugcucugccugcuguuccucuucuucuucuucuacgucggggcggaggugaccuacggcagcuacguguucuccuucgccaccacccacgccgggaugaaggagagcgaggccgccggccugaacuccaucuucugggggacguucgcggccugccggggccuggccaucuucuucgccacgugccuccagcccggcaccaugaucguccugagcaacaucgggucccugaccagcucccucuuccuggugcuguucgacaagaaccccaucugccucuggaucgcgacgagcguguacggcgccuccauggccaccaccuucccgagcggggucuccuggaucgagcaguacaccacgauccacggcaagagcgccgccuucuucgugaucggggcgucccugggcgagauggccauccccgccgugaucggcauccugcaggggaaguaccccgaccuccccgucgugcuguacaccagccugggcgccuccaucgccaccgggauccuguucccgguccucuacaagcuggcgaccagcccccuggaccgccagcggaaggaggaccgcaaguccgaggaccagaaggcccuccugagcuccagcggccugaacgaguacgaggaggagaacgaggaggaggacgccgagaaguggaacgagauggacuucgagaugaucgagacgaacgacaccaugcggcacagcaucaucgagaccucccgcagcucccucaccgagcccacggccgagguguacaaccaguaccccagcaacgcccugguguucgaguccagcccguucaacaccggguccgcgcacgucaagcaccuccccgagacccggaccaagggcacgaacguguga

SEQ ID NO: 31980 - RNA, 4551 nt, Artificial Sequence
  derived and/or modified sequence opt1 from KIAA2022__Homo_sapiens__NP_001008537
auggacaaccagcaggacaaggccaucguggccagcgcgaacggcgagaacacccugaucaacggggucaaggagaacgacuccgaggaccaggacguggccaugaagagcuucgccgcccucgaggccgcggcccccauccagccgacccccguggcccagaaggagacgcugauguacccccgcggccugcucccccugccguccaagaagcccugcaugcagagcccccccuccccgcuggggcucaucgaggcccccgagcacgcggccaacagcgccuccgucaacgccaucagccugaccuccggcaucgccaaggggcugaacaccuggagccuccccaacgagugcgagaaggcgcccuucgccaucauggagccggccggcauguccgcccugaacggcgacugccugaugcagcccagccggaccugccucgggugcuucauggaguccaaggacgccguggaccccgagcccggcaucagccugaaggugggggaccugaaccgcgacuacgagacgugcgcggucuccgacaucggcauccagugcaucaacgccggggagaacaugaaguacggcgagcagcuccugagcgaccagcugcucggcuucccgcugcacaagucccgggccggggaccgccgggagaccgagaagcccgacaucgaccuggaggaccccgcccagaagagcuacuacgaggcccuccugcuggacaagugcaacaccgaggaggcgcuccuggccaacuccaaccaggacuggggcuacuucgagaccuucaucagcgagagcaagaucgagcugcucgaccugugcuccaagaacgagcugagcgugaaccucuucuccgaggaggacguggacaacuacauguucgacgacgacgagagcacgcugggguccgacgucugcagccugaagauccgcuacgaguccuuccaggacaacgugcgggacaagaccacccuccugaugcaggaggacgcccaguucaacuucuuccccagcguguucaccacgugcccgaagcgcgaguccaagagcggcgcccugaagcaguccagcgacuucucccaguucaagguccccgacgugagcaucaucuggggcgaggaggacaagaaccucgacaagaagaaggggaaggaggagggccaggaggacaaggggguggagaagaaggacggcaaggacaacggggagaagcccgcccugaacaagcccugcuccggcaccgaggucgagcagcugaagaacccgaagcagggccaccucgcgaacagccuggagaccuccgggagcuucuccgacgacagcagcuucaucgagaucuccuacgacgccaugggcgagaucaaggacugcagccgguacauggcccgcgacaccaacuccgggagcuccagcucccagcagaacuacggccugcgggccaagcgcaaggugcgguacagcgaggacuaccucuacgacguggacucccuggagggggagaaggucaacgagcgcaaggaguggcugcccgugggcagcaaggaggaggacgacgacgaguggugccccaagaagcggcgcaaggugacgcggaaggagcccccggucaucaucaaguacaucaucaucaaccgcuucaagggcgagaagaacaugcucgugaagcuggggaagguggacgcguccgagaccaccgucaaccugagcgagaaccagcucaacaaguacgccaagcuggccccccugaagggcuucuggcagaagaagaagaagcagcggaacaccaacacggacuccaucaagacccccuucagccagaagcaguccuucgagccggggagcuucgagguguccuuccugccccccgcccgcaagcggaagagcaagcucggcaaccgccaccgcauccagcggauccccagcaucgagaucuccgccagcuccaagcagaucagccugugcaacgaccagcgccacgcguccaaccacaaggaggacgggggccugaagggcacccucaagagcgccccgcugggggcccccuccugcgccaacggcagccaccugaacgacaucaccgggcccgacuccgucaaggugaaggcccaggacacggaguucaagggccccgagcggaaggugcucaacaagaucaaguucaagagcgaggcgcgccugaaguccaagaaggucaaggccgccggccaggagagcaagccgaucgugcagauguccccccugcucgagaaccagagcuccaaggccaaccugaagaacgaggugauccccgggaccagcaacuccagccggcuguccgaguuccacgaggccaaggcggccaagagcagcaccuuccuccccaccacgugcuccagcgagaugccgcuguccagcgccaacgucaccaccaacauccccgugauccccggcggguaccugcagacccuccuggacgccuccgaccugagcaacaacacguccaucagcuacuucucccaccacagccccgagcagaacgagggcucccucacccagaccgagaagagcuucgugccgcugcagcccacccaggacugcguccugacguccagcuccgacagcgagcuccagcaguccagccacaacuucaagauggaguccagcaacuaccgcaacguguggcccaacaaggcgaccagcgggacccaggaguucauggccgaggugucccgggagaucgcccccacccagagcuccgaguucggcgccagccaggucguguccauggagaacaaccugaccccgacgaccuacaaccccaucugccugaacagcggcggguccaacugcaacaaggugcucuacgacagcaugcaggacacccagcugcccuccgacgacagcuaccagcugugccacuucaacaacggcgagaucugcuuccccuuccagcaggggccggucaacauggacgacggccgccucuucuccuucgacagcauggccccccuguccgugagcuccagcaacuacugcucccugagccucaaguccugcgagaaggacggggacgacgacaucaccgacgacuuccuggcgcacugcagccccaagcuggugauccagcagagcaucgacgagaucgccccgcucaaggaguccacggaccugcuggacaucagcaacuucacccccgacaaguuccggcacuccagccucuccgagaugagcccccccgacaccccgucccugagcccccagaucacccgcugcgaguccaugaagacgcugggcacccucaagggcuuccaggaggggguccccggcccccuggacagcguggagaagaucaagugggacugcuccacccugagccggcaggugcagauggaggacggguucacccucaacaaccaccaguuccaguuccacauguucaacgacgaggacuccgucagccugcugcagaagaacccgugccucuccacguucaacgaccccagcggccagaucuccaccaacaacaaggugagcaagucccgcaagaagagcagccccuccaagagcggggccaugaaccaguccagcucccagaagaacacccggaagaagagccugaagggcaacaacaagggcaucgagaagcccccggggaagaacucccgccaggugcccaagagcaccaagaagggcaaguacauggccgccaucaacggggagaagaugcagaucggcaucgggcggggcggcucccagacgaacaccaucagcuccaccgggaagacccuggcggagugcauccagcacggcgggcccauggccagcaugaagaugcccucccagaagggccucagcggcgacugggcccuggggaaggaguccagcccgggcugguccgacaugagcauggggacgaacaccaacucccugcucgacgacgaccagcgcgaguuccaggagcccagcuacauccugagcaacaucgccuccggcauggccgacguccagcgguucaugauggcgagcaucgagccccugugggagcccauggagcaccacggggacccgaacaucuucuacucccccgagagcaacucccucaagcugaagacccugaagauccucgccggcaccccccaggagagcaagaagaagaucaacuccggcagccagggggccacgaagaaccaccgcuccaucaagggcgugagcaaguccaacgggaagaccgccaucggcgaccccgggcgggcgaacaugccgggcuacaacgaggacagccgcuccaccuucuucgacaagaaguacagcaacauguccacccugggcaacaacgggcccacgcacaagaagcuguaccgccacaagagcuccagcaaggcccuccgggacgagaagugcaagggcaagcacauggagcgcgagcaggugcacaaggacgagagcgggaccgccuccuucgagaagcugcgggacagcgacuacaaccugcucaaggccgagaccaccuucuggguccugcccguguucgaggaggagacgcgcaucuuccagaaggacaucuga

SEQ ID NO: 31981 - RNA, 5316 nt, Artificial Sequence
  derived and/or modified sequence opt1 from KIDINS220__Homo_sapiens__NP_065789
augagcgugcugaucagccagagcgugaucaacuacguggaggaggagaacauccccgcccucaaggcccugcuggagaagugcaaggacguggacgagcggaacgagugcggccagaccccgcucaugaucgccgccgagcaggggaaccuggagaucgucaaggagcugaucaagaacggcgccaacugcaaccucgaggaccuggacaacuggaccgcccugaucagcgccagcaaggaggggcacgugcacaucguggaggagcuccugaagugcggcgucaaccuggagcaccgggacaugggcggguggaccgcccucaugugggccugcuacaagggccgcaccgacgugguggagcugcugcucucccacggggccaaccccagcgucaccggccuguacuccguguaccccaucaucugggccgcggggcggggccacgccgacaucgugcaccuccugcugcagaacggggccaaggucaacugcagcgacaaguacggcaccacgccccuggugugggccgcccgcaagggccaccuggagugcgugaagcaccuccuggcgaugggggccgacgucgaccaggagggcgccaacuccaugaccgcccucaucguggccgugaagggcggguacacccagagcgucaaggagauccugaagcggaaccccaacgugaaccugaccgacaaggacggcaacacggcgcucaugaucgccuccaaggaggggcacaccgagaucgugcaggaccugcuggacgccggcaccuacgucaacauccccgaccgcagcggggacaccgugcucaucggcgccgugcgcgggggccacgucgagaucgugcgcgcccugcugcagaaguacgcggacaucgacauccggggccaggacaacaagacggcccucuacugggccgucgagaaggggaacgccaccauggugcgcgacauccugcagugcaaccccgacaccgagaucugcaccaaggacggcgagacgccccugaucaaggccaccaagaugcggaacaucgagguggucgagcuccugcuggacaagggggcgaagguguccgccguggacaagaagggcgacacgccccuccacaucgccauccgcgggcggagccgcaagcuggccgagcugcuccugcggaaccccaaggacggccgccugcucuaccggcccaacaaggcgggcgagacccccuacaacaucgacugcucccaccagaaguccauccugacccagaucuucggggcccgccaccugucccccaccgagaccgacggcgacaugcucggguacgaccuguacagcuccgcccuggccgacauccugagcgagcccaccaugcagccgcccaucugcgucggccucuacgcccagugggggagcggcaaguccuuccugcugaagaagcucgaggacgagaugaagacguucgcgggccagcagaucgagccccuguuccaguucagcuggcugaucguguuccucacccugcugcucugcgggggccuggggcuccuguucgccuucaccgugcaccccaaccugggcaucgccgucucccugagcuuccucgcccugcuguacaucuucuucaucgugaucuacuucggcgggcggcgcgagggcgaguccuggaacugggccugggugcucagcacccggcuggcgcgccacaucggguaccuggagcuccugcugaagcucauguucgucaacccgcccgagcugccggagcagacgaccaaggcccugcccgugcgcuuccucuucaccgacuacaaccggcuguccagcgugggcggggagaccucccuggccgagaugaucgccacgcucagcgacgccugcgagcgcgaguucggcuuccuggcgacccggcuguuccgcgucuucaagaccgaggacacccagggcaagaagaaguggaagaagacgugcugccuccccuccuucgugaucuuccuguucaucaucgggugcaucaucagcggcaucacccugcucgccaucuuccggguggaccccaagcaccugaccgucaacgccgugcugaucuccaucgccagcguggucgggcucgcguucgugcugaacugccgcaccugguggcagguccuggacucccuccugaacagccagcggaagcgccugcacaacgccgccuccaagcuccacaagcucaagagcgagggcuucaugaagguccugaagugcgagguggagcucauggcccggauggccaagaccaucgacuccuucacgcagaaccagacccgccugguggucaucaucgacgggcuggacgcgugcgagcaggacaaggugcuccagaugcuggacaccgugcggguccuguucagcaagggcccguucaucgccaucuucgccagcgacccccacaucaucaucaaggccaucaaccagaaccucaacuccgugcugcgcgacagcaacaucaacggccacgacuacaugcggaacaucgugcaccucccggucuuccugaacucccgcgggcugagcaacgcccggaaguuccuggugaccuccgcgacgaacggcgacgugcccugcagcgacaccaccgggauccaggaggacgccgaccgccgggucucccagaacagccucggcgagaugaccaagcugggguccaagacggcccugaaccgccgggacaccuaccgccgccggcagaugcagcgcaccaucacccggcagaugagcuucgaccucacgaagcugcuggugaccgaggacugguucuccgacaucagcccgcagaccaugcgccggcuccugaacaucguguccgucaccggccgccugcuccgggccaaccagaucagcuucaacugggaccgccuggccuccuggaucaaccugacggagcaguggcccuaccggaccagcuggcucauccuguaccuggaggagaccgagggcauccccgaccagaugacccucaagacgaucuacgagcgcaucuccaagaacaucccgaccaccaaggacguggagccccugcuggagaucgacggggacauccggaacuucgagguguuccucagcagccgcacccccguccugguggcgcgggacgugaaggucuuccugcccugcacggugaaccucgacccgaagcugcgcgagaucaucgccgacgugcgggccgcccgcgagcagaucuccaucggcgggcuggcguacccgccccugccccugcacgagggcccgccccgggcccccagcggguacucccagcccccgagcgucugcuccagcaccuccuucaacggccccuucgccggcgggguggugagcccccagccccacuccagcuacuacuccggcaugaccgggccgcagcaccccuucuacaaccgccccuucuucgcccccuaccuguacaccccgcgguacuaccccggcggcagccagcaccucaucucccgccccagcgucaagacgucccugccccgggaccagaacaacgggcuggaggugaucaaggaggacgccgcggagggccucagcuccccgaccgacagcucccgcgggagcggccccgcccccgggccggucgugcugcugaacagccucaacguggacgccgucugcgagaagcugaagcagaucgagggccuggaccaguccaugcugccccaguacugcaccaccaucaagaaggccaacaucaacggccgcgugcucgcccagugcaacaucgacgagcugaagaaggagaugaacaugaacuucggggacuggcaccuguuccggagcacggugcucgagaugcgcaacgcggagucccacgucgugcccgaggacccccgguuccugagcgaguccagcuccggcccggcgccccacggggagcccgcccgccgggccagccacaacgagcugccccacaccgagcucuccagccagaccccguacacccugaacuucuccuucgaggagcugaacacgcucggccuggacgagggggcgccccggcacagcaaccuguccuggcagagccagacccggcgcacccccucccucagcucccugaacagccaggacuccagcaucgagaucagcaagcugaccgacaaggugcaggcggaguaccgggacgccuaccgcgaguacaucgcccagaugucccagcucgagggcggccccgggagcaccacgaucuccggccggagcuccccgcacagcaccuacuacauggggcaguccagcuccggcgggagcauccacuccaaccuggagcaggagaagggcaaggacagcgagcccaagcccgacgacggccgcaaguccuuccugaugaagcgcggggacgucaucgacuacagcuccagcggcguguccaccaacgacgccagcccccucgacccgaucaccgaggaggacgagaaguccgaccagagcgggagcaagcugcugcccggcaagaaguccagcgagcgcuccagccucuuccagacggaccugaagcugaagggcuccgggcuccgguaccagaagcugcccagcgacgaggacgaguccggcaccgaggagagcgacaacacgccccugcucaaggacgacaaggaccgcaaggccgaggggaagguggagcgggucccgaagucccccgagcacagcgcggagcccauccgcaccuucaucaaggccaaggaguaccuguccgacgcccugcucgacaagaaggacagcuccgacagcggcgugcgguccagcgaguccagccccaaccacucccugcacaacgagguggccgacgacagccagcuggagaaggcgaaccucaucgagcuggaggacgacagccacuccgggaagcgcggcaucccgcacagccuguccggccuccaggaccccaucaucgcccgcaugagcaucugcuccgaggacaagaagucccccuccgagugcagccugaucgccuccagccccgaggagaacuggccggccugccagaaggccuacaaccugaaccggacgcccuccaccgucacccucaacaacaacagcgcgcccgccaaccgcgccaaccagaacuucgacgagauggaggggauccgggagaccucccaggugauccugcgcccgagcuccagccccaaccccacgaccauccagaacgagaaccugaaguccaugacccacaagcggagccagcgcuccagcuacacccggcucagcaaggacccgcccgagcugcacgccgccgcguccagcgaguccacgggcuucggggaggagcgcgagagcauccuguga

SEQ ID NO: 31982 - RNA, 3171 nt, Artificial Sequence
  derived and/or modified sequence opt1 from KIF11__Homo_sapiens__NP_004514
auggccagccagcccaacuccagcgccaagaagaaggaggagaagggcaagaacauccagguggucgugcgcugccggccguucaaccuggcggagcgcaaggccuccgcccacagcaucguggagugcgaccccguccggaaggagguguccgugcgcaccgggggccucgccgacaagagcucccggaagaccuacacguucgacauggucuucggggccagcaccaagcagaucgacguguaccgcuccguggucugccccauccuggacgaggugaucaugggcuacaacugcaccaucuucgcguacgggcagaccggcacgggcaagaccuucaccauggagggggagcggagccccaacgaggaguacaccugggaggaggacccgcuggccggcaucaucccccgcacgcuccaccagaucuucgagaagcugaccgacaacgggaccgaguucuccgugaaggucagccugcucgagaucuacaacgaggagcuguucgaccugcucaaccccuccagcgacguguccgagcggcugcagauguucgacgacccccgcaacaagcggggcgugaucaucaaggggcuggaggagaucaccguccacaacaaggacgagguguaccagauccucgagaagggcgccgccaagcgcacgaccgcggccacccugaugaacgccuacagcucccggagccacuccguguucagcgucaccauccacaugaaggagacgaccaucgacggcgaggagcuggugaagaucgggaagcucaaccugguggaccuggccggcagcgagaacaucgggcgcuccggcgccgucgacaagcgggcgcgcgaggccggcaacaucaaccagagccuccugacccuggggcgggugaucaccgcccucguggagcgcacgccgcacguccccuaccgggaguccaagcugacccgcauccugcaggacagccucggcgggcggacccgcaccuccaucaucgccacgaucagccccgccucccugaaccuggaggagacccucagcacccuggaguacgcgcaccgcgccaagaacauccugaacaagcccgaggugaaccagaagcucaccaagaaggcccugaucaaggaguacacggaggagaucgagcggcugaagcgcgaccucgccgccgcgcgggagaagaacggcgucuacaucuccgaggagaacuuccgcgugaugagcgggaagcugaccgugcaggaggagcagaucgucgagcugaucgagaagaucggcgccguggaggaggagcucaaccgggugaccgagcuguucauggacaacaagaacgagcuggaccagugcaaguccgaccuccagaacaagacccaggagcuggagacgacccagaagcaccuccaggagaccaagcugcagcuggucaaggaggaguacaucaccagcgcccuggaguccacggaggagaagcuccacgacgccgccagcaagcugcugaacaccguggaggagaccaccaaggacguguccggccuccacagcaagcuggaccgcaagaaggcggucgaccagcacaacgccgaggcccaggacaucuucgggaagaaccugaacucccuguucaacaacauggaggagcucaucaaggacggcagcuccaagcagaaggccaugcuggaggugcacaagacccuguucgggaaccuccugagcagcuccgugagcgcgcuggacacgaucaccaccgucgcccucggcucccugaccagcaucccggagaacguguccacgcacgugagccagaucuucaacaugauccugaaggagcagucccucgccgccgagagcaagaccguccugcaggagcugaucaacgugcucaagaccgaccugcuguccagccucgagaugauccugucccccaccguggucagcauccugaagaucaacucccagcucaagcacaucuucaagacgagccugaccguggccgacaagaucgaggaccagaagaaggagcuggacggguuccucuccauccugugcaacaaccugcacgagcuccaggagaacaccaucugcagccugguggagucccagaagcagugcggcaaccugaccgaggaccucaagacgaucaagcagacccacagccaggagcugugcaagcugaugaaccucuggaccgagcgguucugcgcgcuggaggagaagugcgagaacauccagaagccccugagcuccguccaggagaacauccagcagaaguccaaggacaucgugaacaagaugaccuuccacagccagaaguucugcgccgacagcgacggcuucucccaggagcuccgcaacuucaaccaggaggggacgaagcugguggaggagagcgucaagcacuccgacaagcugaacggcaaccucgagaagaucagccaggagaccgagcagcggugcgagucccugaacacccgcaccguguacuucagcgagcaguggguguccagccugaacgagcgggagcaggagcuccacaaccugcuggaggucgugucccagugcugcgaggccagcuccagcgacaucacggagaaguccgacgggcgcaaggccgcccacgagaagcagcacaacaucuuccucgaccagaugaccaucgacgaggacaagcugaucgcgcagaaccuggagcucaacgagaccaucaagaucggccugaccaagcugaacugcuuccucgagcaggaccugaagcuggacauccccacggggaccaccccgcagcgcaagagcuaccucuaccccuccacccuggugcggacggagccccgggagcaccuccuggaccagcugaagcgcaagcagcccgagcugcucaugaugcugaacugcagcgagaacaacaaggaggagaccaucccggacgucgacguggaggaggccgugcugggccaguacaccgaggagccccucagccaggagcccuccgucgacgccggcguggacugcagcuccaucgggggcgugcccuucuuccagcacaagaagucccacgggaaggacaaggagaaccggggcaucaacacccuggagcgcagcaaggucgaggagacgaccgagcaccuggugaccaagagccggcucccgcugcgcgcccagaucaaccuguga

SEQ ID NO: 31983 - RNA, 5313 nt, Artificial Sequence
  derived and/or modified sequence opt1 from KIF13A__Homo_sapiens__NP_001099036
auguccgacacgaaggugaagguggccgugcgggugcggcccaugaaccggcgggagcuggagcucaacacgaagugcgucguggagauggagggcaaccagacggugcugcacccgccgcccuccaacaccaagcagggggagcgcaagccgcccaaggucuucgccuucgacuacugcuucuggagcauggacgaguccaacaccaccaaguacgcgggccaggaggugguguucaagugccugggggagggcauccucgagaaggccuuccagggguacaacgccugcaucuucgccuacggccagacgggcagcgggaaguccuucagcaugaugggccacgccgagcagcuggggcugaucccccggcucugcugcgcgcuguucaagcgcaucucccuggagcagaacgagagccagaccuucaaggucgagguguccuacauggagaucuacaacgagaaggugcgggaccuccuggaccccaagggcagccgccagucccugaagguccgggagcacaaggugcucgggcccuacguggacggccugagccagcuggccgucaccuccuucgaggacaucgagagccucauguccgagggcaacaagagccgcaccguggccgccacgaacaugaacgaggaguccagccggucccacgcgguguucaacaucaucaucacccagacccuguacgaccugcagagcgggaacagcggcgagaaggucuccaaggugagccucguggaccuggccggguccgagcgcgucagcaagaccggcgccgccggcgagcggcugaaggagggguccaacaucaacaagagccucacgacccugggccuggugaucuccagccucgccgaccaggcggccgggaagggcaaguccaaguucgugcccuaccgcgacagcguccugaccuggcugcucaaggacaaccucgggggcaacucccagaccagcaugaucgccacgaucucccccgccgccgacaacuacgaggagacccugagcacccuccgguacgcggaccgcgccaagcggaucgugaaccacgccgucgugaacgaggaccccaacgccaaggugauccgcgagcugcgggaggaggucgagaagcugcgcgagcagcucucccaggccgaggcgaugaaggcccccgagcugaaggagaagcuggaggagagcgagaagcucaucaaggagcugaccgugacgugggaggagaagcugcggaagaccgaggagaucgcccaggagcgccagcgccagcucgaguccaugggcaucagccuggagauguccgggaucaaggugggcgacgacaagugcuaccuggucaaccucaacgccgaccccgcccugaacgagcugcucguguacuaccugaaggaccacacccgggugggggcggacaccagccaggacauccagcuguucggcaucgggauccagccccagcacugcgagaucgacaucgccagcgacggcgacgucacgcucacccccaaggagaacgcccgcuccugcgugaacggcacccuggugugcagcaccacgcagcuguggcacggggaccggauccuguggggcaacaaccacuucuuccgcaucaaccuccccaagcggaagcgccgggacuggcugaaggacuucgagaaggagaccgggccgcccgagcacgaccuggacgccgcguccgaggccagcuccgagcccgacuacaacuacgaguucgcccagauggaggucaucaugaagacccucaacagcaacgaccccgugcagaacgugguccaggugcuggagaagcaguaccuggaggagaagcgcuccgcccucgaggagcagcggcugauguacgagcgcgagcuggagcagcuccggcagcagcugagccccgaccgccagccccaguccagcggccccgaccggcuggccuacuccagccagaccgcgcagcagaaggugacgcagugggccgaggagcgcgacgagcuguuccggcagucccuggccaagcugcgcgagcagcucgucaaggccaacacccuggugcgggaggccaacuuccuggcggaggagaugagcaagcucaccgacuaccaggugacccugcagauccccgccgccaaccuguccgccaaccgcaagcgcggggccaucgucagcgagccggcgauccaggugcgccgcaagggcaaguccacccagguguggaccaucgagaagcucgagaacaagcugaucgacaugcgggaccuguaccaggaguggaaggagaagguccccgaggccaagcgccucuacggcaagcgcggggaccccuucuacgaggcccaggagaaccacaaccugaucggcguggccaacguguuccuggagugccucuucugcgacgucaagcugcaguacgcggugcccaucaucagccagcagggggagguggccggccgccugcacgucgaggugaugcgggugaccggcgccgucccggagcgcgugguggaggacgacagcuccgagaacagcuccgagagcgggucccucgaggucguggacagcuccggcgagaucauccaccgggugaagaagcugaccugccgcgucaagaucaaggaggccaccgggcugccccucaaccugagcaacuucguguucugccaguacacguucugggaccagugcgaguccaccguggccgcgcccgucguggacccggaggugcccagcccccaguccaaggacgcccaguacaccgucaccuucagccacugcaaggacuacguggugaacgucacggaggaguuccuggaguucaucuccgacggcgcccucgccaucgaggugugggggcaccggugcgccggcaacggcagcuccaucugggagguggacagccugcacgcgaagacccgcacccugcacgaccgguggaacgaggucacccgccggaucgagauguggaucuccauccucgagcugaacgagcugggggaguacgccgccguggagcuccaccaggccaaggacgucaacacgggcgggaucuuccagcugcgccagggccacagccggcgcguccaggugaccgucaagcccgugcagcacuccgggacccugccgcucaugguggaggccauccugagcgucagcaucggcugcgugaccgcgcgguccacgaagcugcagcgcggccucgacagcuaccagcgggacgacgaggacggggacgacauggacuccuaccaggaggaggaccugaacugcgugcgcgagcgguggagcgacgcccugaucaagcgccgcgaguaccucgacgagcagaucaagaaggucuccaacaagaccgagaagaccgaggacgacguggagcgggaggcccagcugguggagcagugggucggccugaccgaggagcgcaacgccgugcucgugcccgcgcccgggagcggcauccccggggccccggccgacuggaucccgccgcccggcauggagacgcacaucccgguccuguuccuggaccucaacgccgacgaccuguccgccaacgagcagcuggugggcccccacgcgagcggggugaacuccauccuccccaaggagcacggcagccaguucuucuaccugcccaucaucaagcacuccgacgacgaggucagcgccaccgccuccugggacagcuccgugcacgacagcgugcaccugaaccgggucaccccgcagaacgagcgcaucuaccucaucgugaagaccacggugcagcugucccaccccgccgccauggagcugguccuccggaagcgcaucgcggccaacaucuacaacaagcagagcuucacccagucccugaagcggcgcaucagccugaagaacaucuucuacagcugcggggugaccuacgagaucguguccaacauccccaaggccaccgaggagaucgaggaccgggagacgcucgcccugcuggccgcgcgcagcgagaacgagggcaccuccgacggggagaccuacaucgagaaguacacccggggcguccuccagguggagaacauccugagccuggagcgccuccggcaggccgugacggucaaggaggcccuguccaccaaggcccgccacauccggcgcagccuguccacccccaacgugcacaacgugagcuccagccggccggaccucuccggcuucgacgaggacgacaagggguggcccgagaaccagcuggacaugagcgacuacuccagcuccuaccaggacgucgccugcuacggcacccugccccgcgacagcccccggcgcaacaaggaggggugcacguccgagaccccgcacgcgcucaccgugagccccuucaaggccuucagcccccagccgcccaaguucuucaagccccugaugcccgugaaggaggagcacaagaagcgcaucgcccuggaggcccggccgcuccugagccaggaggacagcgaggaggaggagaacgagcuggaggcgaucaaccgcaagcucaucuccagccagcccuacguccccguggaguucgccgacuucuccguguacaacgccagccuggagaaccgggagugguucuccagcaaggucgaccuguccaacagccgcgugcucgagaaggaggugucccggagccccaccacguccagcaucaccuccggcuacuucagccacuccgccagcaacgccacccuguccgacauggucgugccgagcuccgacagcagcgaccagcuggcgauccagaccaaggacgccgacuccaccgagcacagcacgcccucccucgugcacgacuuccgccccagcuccaacaaggagcugaccgaggucgagaagggccuggugaaggacaagaucaucguggucccccugaaggagaacagcgcccucgccaagggguccccgagcucccagagcauccccgagaagaacuccaagagccugugccggaccggcuccugcagcgagcuggacgccugccccuccaagaucagccagcccgcgcgcggguucugcccgcgggaggugaccguggagcacacgaccaacauccucgaggaccacuccuucaccgaguucaugggcgucagcgaggggaaggacuucgacggccugaccgacuccagcgccggcgagcugagcucccgccggagccuccccaacaagaccgggggcaagaccguguccgacgggcugcaccaccccagccagcugcacuccaagcucgagaacgaccaggucaucauccccgaggccgccuucugggugcugugcugccaguga

SEQ ID NO: 31984 - RNA, 4947 nt, Artificial Sequence
  derived and/or modified sequence opt1 from KIF14__Homo_sapiens__NP_055690
augagccugcacuccacccacaaccgcaacaacagcggcgacauccucgacauccccuccagccagaacuccagcucccugaacgcccugacccacagcucccggcucaagcugcaccucaagagcgacauguccgagugcgagaacgacgacccgcugcugcgcagcgccgggaaggugcgggacaucaaccgcacguacgucaucuccgcgagccggaagaccgccgacaugccccugacccccaaccccgugggccgccucgcccugcagcggcgcaccacgcggaacaaggaguccagccugcucguguccgagcuggaggacaccaccgagaagaccgccgagacgcgccugacccuccagcggcgcgccaagaccgacagcgcggagaaguggaagaccgccgagaucgacuccgucaagaugacgcugaacgucgggggcgagaccgagaacaacggggugagcaaggagagccggaccaacgugcgcaucgugaacaacgccaagaacuccuucguggccagcuccgucccgcuggacgaggacccccaggugaucgagaugauggcggacaagaaguacaaggagaccuucagcgcccccucccgggccaacgagaacguggcccucaaguacagcuccaaccggcccccgaucgccagccugucccagacggaggucgugcggagcggccaccugaccaccaagcccacccaguccaagcucgacaucaaggugcugggcacggggaaccuguaccaccgcagcaucggcaaggagaucgcgaagaccuccaacaaguucgggagccucgagaagcggacccccaccaagugcacgaccgagcacaagcugaccaccaagugcucccugccccagcucaagagcccggcccccuccauccugaagaaccgcaugagcaaccugcaggucaagcagcggcccaaguccagcuuccucgccaacaagcaggagcgcagcgccgagaacacgauccugcccgaggaggagaccguggugcagaacaccuccgccggcaaggacccgcugaaggucgagaacagccaggugaccguggcgguccgcgugcggcccuucacgaagcgcgagaagaucgagaaggccucccagguggucuucaugagcgggaaggagaucaccguggagcaccccgacaccaagcaggucuacaacuucaucuacgacguguccuucuggagcuucgacgagugccacccccacuacgccucccagaccacgguguacgagaagcucgccgccccgcugcuggagcgggcguucgagggcuucaacacgugccucuucgccuacggccagaccgggagcggcaaguccuacaccaugaugggguucagcgaggagcccggcaucaucccccgcuucugcgaggaccuguucucccaggucgcccggaagcagacccaggaggugagcuaccacaucgagauguccuucuucgagguguacaacgagaagauccacgaccugcucgucugcaaggacgagaacggccagcgcaagcagccccugcgggugcgcgagcacccgguguacgggcccuacgucgaggcccugagcaugaacaucguguccagcuacgccgacauccaguccuggcucgagcugggcaacaagcagcgggcgaccgccgccaccgggaugaacgacaagagcagccgcucccacagcguguucacccuggucaugacccagacgaagaccgaguucguggagggcgaggagcacgaccaccggaucaccucccgcaucaaccucaucgaccuggccgggagcgagcggugcuccaccgcgcacacgaacggcgaccgccugaaggagggcgugagcaucaacaagucccuccugacccuggggaaggucaucagcgcccuguccgagcaggccaaccagcggagcguguucauccccuaccgcgaguccgugcucaccuggcugcugaaggagagccucggcgggaacuccaagaccgccaugaucgccacgaucagccccgcggccuccaacaucgaggagacccugagcacccugcgguacgccaaccaggcccgccucaucgucaacaucgccaaggugaacgaggacaugaacgcgaagcugauccgggagcugaaggccgagaucgccaagcucaaggccgcccagcgcaacucccgcaacaucgacccggagcgguaccgccugugccggcaggagaucaccagccugcgcaugaagcuccaccagcaggagcgggacauggcggagaugcagcgcguguggaaggagaaguucgagcaggccgagaagcggaagcugcaggagacgaaggagcugcagaaggccggcaucauguuccagauggacaaccaccuccccaaccuggucaaccugaacgaggacccccagcucuccgagaugcugcuguacaugaucaaggaggggaccaccaccgugggcaaguacaagccgaacagcagccacgacauccagcucuccggcgugcugaucgccgacgaccacugcacgaucaagaacuucgggggcaccgucagcaucauccccgugggggaggcgaagaccuacgugaacggcaagcacauccuggagaucaccguccuccgccacggggaccgggugauccugggcggcgaccacuacuuccgcuucaaccaccccguggagguccagaaggggaagcggcccuccggccgcgacacgccgaucagcgaggggcccaaggacuucgaguucgccaagaacgagcugcucauggcccagcggucccagcuggaggccgagaucaaggaggcccagcugaaggcgaaggaggagaugaugcagggcauccagaucgccaaggagauggcccagcaggagcucagcucccagaaggccgccuacgagagcaagaucaaggcgcuggaggccgagcugcgcgaggagucccagcggaagaagaugcaggagaucaacaaccagaaggccaaccacaagaucgaggagcucgagaaggccaagcagcaccuggagcaggagaucuacgugaacaagaagcgccuggagauggagacccucgccaccaagcaggcgcuggaggaccacagcauccggcacgcccgcauccuggaggcccucgagaccgagaagcagaagaucgccaaggaggugcagauccugcagcagaaccggaacaaccgcgacaagacguucaccguccagaccaccugguccagcaugaagcuguccaugaugauccaggaggcgaacgccaucagcuccaagcucaagacguacuacguguucggccggcacgacaucagcgacaaguccagcuccgacaccagcauccgcgugcgcaaccugaagcuggggaucagcaccuucuggucccucgagaaguucgagagcaagcuggccgccaugaaggagcuguacgaguccaacggcagcaaccgcggggaggacgccuucugcgaccccgaggacgagugggagcccgacaucaccgacgcgccggucuccagccucucccgccggcgcagccggucccugaugaagaaccgccggaucagcggcugccugcacgacauccaggugcaccccaucaagaaccuccacuccagccacuccagcgggcugauggacaaguccagcacgaucuacuccaacagcgccgaguccuuccugcccggcaucugcaaggagcucaucggcagcagccuggacuucuucgggcaguccuacgacgaggagcgcaccaucgccgacagccugaucaacuccuuccucaagaucuacaacggccuguucgccaucagcaaggcccacgaggagcaggacgaggagucccaggacaaccuguucagcuccgaccgggcgauccagagccucaccauccagaccgccugcgccuucgagcagcuggugguccugaugaagcacuggcucuccgaccugcugcccugcaccaacaucgcccgccucgaggacgagcugcggcaggaggugaagaagcucgggggcuaccugcagcuguuccugcaggggugcugccucgacaucagcuccaugaucaaggaggcccagaagaacgcgauccagaucgugcagcaggccgucaaguacgugggccagcuggccgugcugaagggcagcaagcuccacuuccuggagaacgggaacaacaaggccgccuccguccaggaggaguucauggacgcggugugcgacggcguggggcugggcaugaagauccuccuggacagcgggcuggagaaggccaaggagcuccagcacgagcuguuccgccagugcacgaagaacgaggucaccaaggagaugaagaccaacgccaugggccugauccggucccucgagaacaucuucgccgagagcaagaucaaguccuuccgccgccaggugcaggaggagaacuucgaguaccaggacuucaagcggauggugaaccgggcgccggaguuccugaagcugaagcacugccucgagaaggccaucgagaucaucaucagcgcccugaagggcugccacuccgacaucaaccugcuccagaccugcgucgagagcauccgcaaccuggccagcgacuucuacuccgacuucagcgugcccuccacgagcgucggguccuacgagagccgggugacccacaucgugcaccaggagcuggagucccucgccaagagccugcuguucugcuucgaguccgaggagagccccgaccugcucaagcccugggagaccuacaaccagaacaccaaggaggagcaccagcaguccaagagcuccggcaucgacgggagcaagaacaagggcgucccgaagcgcguguacgagcugcacggguccagccccgcgguguccagcgaggagugcacgcccucccgcauccagugggucuga

SEQ ID NO: 31985 - RNA, 4167 nt, Artificial Sequence
  derived and/or modified sequence opt1 from KIF15__Homo_sapiens__NP_064627
auggcccccggcugcaagaccgagcugcgcagcgugaccaacgggcaguccaaccagccgagcaacgagggcgacgccaucaaggucuucgugcggauccgcccgcccgcggagcgguccgggagcgccgacggcgagcagaaccucugccuguccgugcugagcuccacgagccuccgccugcacuccaaccccgagcccaagaccuucaccuucgaccacgucgccgacguggacaccacgcaggagagcguguucgccaccgucgccaaguccaucguggagagcugcauguccggguacaacggcaccaucuucgcguacggccagaccgggagcggcaagacguucaccaugauggggcccuccgagagcgacaacuucucccacaaccugcggggcgugaucccccgcagcuucgaguaccucuucucccugaucgaccgggagaaggagaaggccggggccggcaagagcuuccugugcaagugcagcuucaucgagaucuacaacgagcagaucuacgaccuccuggacuccgccagcgcgggccuguaccuccgcgagcacaucaagaagggggucuucguggugggcgccgucgagcaggucgugaccuccgccgccgaggccuaccaggugcugagcgggggcuggcggaaccgccggguggcguccaccagcaugaaccgcgaguccagccggucccacgccguguucacgaucaccaucgagagcauggagaaguccaacgagaucgucaacauccgcaccagccugcucaaccugguggaccuggccggcuccgagcggcagaaggacacccacgccgaggggaugcgccucaaggaggccggcaacaucaaccggagccuguccugccugggccaggugaucacggcgcucgucgacguggggaacgggaagcagcgccacgugugcuaccgggacagcaagcugaccuuccugcuccgcgacucccugggcggcaacgccaagaccgccaucaucgccaacguccaccccgggagccggugcuucggcgagacccuguccacgcucaacuucgcccagcgcgcgaagcugaucaagaacaaggccguggucaacgaggacacccaggggaacgugagccagcugcaggccgaggugaagcgccucaaggagcagcuggccgagcuggccagcggccagaccccgcccgaguccuuccucacccgggacaagaagaagacgaacuacauggaguacuuccaggaggcgaugcuguucuucaagaaguccgagcaggagaagaagucccugaucgagaaggucacccagcucgaggaccugacccugaagaaggagaaguucauccagagcaacaagaugaucgugaaguuccgcgaggaccagaucauccggcucgagaagcugcacaaggagagccgcgggggcuuccugcccgaggagcaggaccggcuccugagcgagcugcgcaacgagauccagacccuccgggagcagaucgagcaccacccccgcguggccaaguacgccauggagaaccacucccugcgggaggagaaccgccggcugcgccuccuggagccggucaagcgggcccaggagauggacgcgcagacgaucgccaagcuggagaaggccuucagcgagaucuccggcauggagaaguccgacaagaaccagcagggguucagccccaaggcccagaaggagcccugccuguucgccaacaccgagaagcucaaggcgcagcugcugcagauccagaccgagcucaacaacagcaagcaggaguacgaggaguucaaggagcugacccgcaagcggcagcuggagcucgaguccgagcugcagagccugcagaaggccaaccucaaccuggagaaccugcucgaggccacgaaggccugcaagcgccaggaggugucccagcugaacaagauccacgccgagacccugaagaucaucaccacccccacgaaggcguaccagcuccacagccggccggugcccaagcugucccccgagaugggcagcuucgggagccuguacacccagaacuccagcauccucgacaacgacauccugaacgagcccgucccgcccgagaugaacgagcaggccuucgaggccaucuccgaggagcugcgcaccgugcaggagcagaugagcgcccuccaggccaagcuggacgaggaggagcacaagaaccugaagcuccagcagcacguggacaagcuggagcaccacuccacccagaugcaggagcuguucagcuccgagcggaucgacuggaccaagcagcaggaggagcuccugagccagcugaacguccucgagaagcagcugcaggagacgcagaccaagaacgacuuccugaaguccgaggugcacgaccuccgcgugguccugcacagcgcggacaaggagcuguccagcgugaagcucgaguacuccagcuucaagaccaaccaggagaaggaguucaacaagcuguccgagcgccacaugcacgugcagcugcagcucgacaaccugcggcuggagaacgagaagcuccuggagagcaaggccugccugcaggacuccuacgacaaccuccaggagaucaugaaguucgagaucgaccagcugagccgcaaccugcagaacuucaagaaggagaacgagacccucaaguccgaccugaacaaccugauggagcuccuggaggccgagaaggagcggaacaacaagcugagccuccaguucgaggaggacaaggagaacagcuccaaggagauccugaagguccuggaggccgugcgccaggagaagcagaaggagacggcgaagugcgagcagcagauggccaaggugcagaagcucgaggagagccugcuggccaccgagaaggucaucuccagccucgagaagucccgggacagcgacaagaaggugguggccgaccugaugaaccagauccaggagcugcgcaccuccgucugcgagaagaccgagacgaucgacacccucaagcaggagcugaaggacaucaacugcaaguacaacagcgcccugguggaccgggaggagucccgcgugcucaucaagaagcaggaggucgacauccuggaccugaaggagacccuccggcugcgcauccugagcgaggacaucgagcgggacaugcucugcgaggaccuggcgcacgccaccgagcagcugaacaugcucacggaggccuccaagaagcacagcggccugcugcaguccgcccaggaggagcucaccaagaaggaggcccugauccaggagcugcagcacaagcucaaccagaagaaggaggagguggagcagaagaagaacgaguacaacuucaagaugcgccagcuggagcacgugauggacagcgcggccgaggacccccagucccccaagaccccgccccacuuccagacccaccuggccaagcuccuggagacgcaggagcaggagaucgaggacgggcgggccagcaagaccucccuggagcaccucgucaccaagcugaacgaggaccgcgaggugaagaacgccgagauccugcggaugaaggagcagcuccgcgagauggagaaccugcggcuggagagccagcagcucaucgagaagaacuggcugcugcagggccagcuggacgacaucaagcgccagaaggagaacuccgaccagaaccaccccgacaaccagcagcucaagaacgagcaggaggagagcaucaaggagcggcuggccaagagcaagaucguggaggagaugcugaagaugaaggcggaccucgaggagguccaguccgcccuguacaacaaggagauggagugccugcgcaugaccgacgagguggagcggacgcagacccucgagagcaaggccuuccaggagaaggagcagcugcgcuccaagcuggaggagauguacgaggagcgcgagcggaccagccaggagauggagaugcuccgcaagcaggucgagugccuggcggaggagaacggcaagcugguggggcaccagaaccuccaccagaagauccaguacguggugcggcugaagaaggagaacguccgccuggccgaggagaccgagaagcuccgggccgagaacguguuccugaaggagaagaagcgcuccgagagcuga

SEQ ID NO: 31986 - RNA, 4179 nt, Artificial Sequence
  derived and/or modified sequence opt1 from KIF16B__Homo_sapiens__NP_001186795
auggccagcgugaaggucgccgugcgcgugcggcccaugaaccgccgggagaaggaccuggaggcgaaguucaucauccagauggagaaguccaagaccaccaucaccaaccucaagaucccggagggcgggaccggcgacagcgggcgcgagcggaccaagaccuucacguacgacuucuccuucuacagcgccgacaccaagucccccgacuacgucagccaggagaugguguucaagacccugggcaccgacguggucaaguccgccuucgagggguacaacgccugcguguucgccuacggccagacgggcagcgggaaguccuacaccaugaugggcaacagcggggacuccggccugaucccccgcaucugcgagggccucuucagccggaucaacgagaccacccgcugggacgaggcguccuuccggacggaggugagcuaccuggagaucuacaacgagcgcguccgggaccugcuccgccggaaguccagcaagaccuucaaccugcgcgugcgggagcaccccaaggaggggccguacguggaggaccuguccaagcaccucguccagaacuacggcgacguggaggagcugauggacgccgggaacaucaaccgcaccaccgccgccacgggcaugaacgacgugagcucccggagccacgcgaucuucaccaucaaguucacccaggccaaguucgacagcgagaugcccugcgagaccgucuccaagauccaccugguggaccucgccgggagcgagcgcgccgacgccacgggcgcgaccggcgugcggcugaaggagggcgggaacaucaacaagucccuggucacccucgggaacgugaucagcgcccuggccgaccugucccaggacgccgccaacacccucgcgaagaagaagcaggucuucgugcccuaccgcgacagcgugcugacguggcugcucaaggacucccugggcgggaacagcaagaccaucaugaucgccaccaucucccccgccgacgugaacuacggcgagacccugagcacgcuccgguacgccaaccgcgccaagaacaucaucaacaagccgaccaucaacgaggacgcgaacgucaagcugauccgcgagcugcgggccgagaucgcccgccucaagacccugcuggcccagggcaaccagaucgcccuccuggacucccccaccgcgcugagcauggaggagaagcuccagcagaacgaggcccgggugcaggagcugacgaaggaguggaccaacaaguggaacgagacccagaacauccugaaggagcagacccucgcccugcgcaaggaggggaucggcgucgugcuggacuccgagcucccccaccugaucgggaucgacgacgaccugcucagcacgggcaucauccuguaccaccugaaggaggggcagaccuacgugggccgggacgacgccuccaccgagcaggacaucguccuccacggccuggaccuggagagcgagcacugcaucuucgagaacaucgggggcaccgugacccucaucccccuguccgggagccagugcuccgugaacggcguccagaucguggaggcgacgcaccugaaccagggggccgugauccugcucggccgcaccaacauguuccgguucaaccacccgaaggaggccgccaagcugcgcgagaagcgcaagagcggccugcucagcuccuucagccuguccaugaccgaccugagcaagucccgggagaaccucagcgccgucaugcuguacaaccccgggcuggaguucgagcggcagcagcgcgaggagcucgagaagcuggaguccaagcggaagcugaucgaggagauggaggagaagcagaaguccgacaaggcggagcucgagcgcaugcagcaggagguggagacccagcggaaggagacggagaucgugcagcugcagauccgcaagcaggaggagagccugaagcggcgcagcuuccacaucgagaacaagcucaaggaccugcuggccgagaaggagaaguucgaggaggagcggcuccgcgagcagcaggagaucgagcugcagaagaagcgccaggaggaggagaccuuccugcggguccaggaggagcuccagcgccugaaggagcugaacaacaacgagaaggccgagaaguuccagaucuuccaggagcucgaccagcugcagaaggagaaggacgagcaguacgccaagcuggagcucgagaagaagcggcuggaggagcaggagaaggagcaggucaugcugguggcccaccucgaggagcagcugcgcgagaagcaggagaugauccagcugcuccggcgcggcgaggugcaguggguggaggaggagaagcgggaccuggaggggauccgcgagucccugcuccgggugaaggaggcgcgcgccggcggcgacgaggacggggaggagcuggagaaggcccagcugcgguucuucgaguucaagcgccggcagcucgucaagcuggugaaccuggagaaggaccucgugcagcagaaggacauccugaagaaggagguccaggaggagcaggagauccuggagugccucaagugcgagcacgacaaggagagccgccugcuggagaagcacgacgaguccgugaccgacgugaccgaggucccccaggacuucgagaagaucaagcccguggaguaccggcuccaguacaaggagcgccagcugcaguaccugcuccagaaccaccucccgacgcugcucgaggagaagcagcgggccuucgagauccuggaccgcggcccccugagccucgacaacacccuguaccagguggagaaggagauggaggagaaggaggagcagcuggcccaguaccaggcgaacgccaaccagcuccagaagcugcaggccaccuucgaguucaccgccaacaucgcgcggcaggaggagaagguccgcaagaaggagaaggagauccuggagucccgggagaagcagcagcgcgaggcccucgagcgcgcccuggcccggcuggagcgccggcacagcgcccuccagcgccacuccacgcuggggauggagaucgaggagcagcggcagaagcuggcgagccucaacagcggcucccgcgagcagagcgggcugcaggccucccuggaggccgagcaggaggcccucgagaaggaccaggagcggcuggaguacgagauccagcagcugaagcagaagaucuacgagguggacggcgugcagaaggaccaccacggcacccucgaggggaaggucgccagcuccagccugcccguguccgcggagaagucccaccuggugccccucauggacgcccgcaucaacgccuacaucgaggaggagguccagcggcgccugcaggaccugcaccgggugaucagcgagggcugcagcaccuccgccgacaccaugaaggacaacgagaagcuccacaacgggacgauccagcgcaagcugaaguacgagcugugccgggaccuccugugcgugcugaugccggagcccgacgccgcggccugcgccaaccacccccuccugcagcaggaccugguccagcucagccuggacuggaagaccgagauccccgaccuggugcucccgaacggcgugcaggucuccagcaaguuccagaccacccugguggacaugaucuacuuccugcacgggaacauggaggugaacguccccucccuggccgaggugcagcuccugcuguacacgaccgugaaggucaugggcgacagcggccacgaccagugccagucccucgugcugcugaacacccacaucgcgcucgugaaggaggacugcgucuucuacccccgcauccggagccgcaacaucccgccgcccggggcccaguucgacgugaucaagugccacgcccuguccgaguuccggugcguggucgugcccgagaagaagaacgucagcaccguggagcugguguuccuccagaagcugaagcccagcgucggcucccgcaacagcccgcccgagcaccuccaggaggcccccaacgugcagcuguucacgacgccccuguaccugcaggggucccagaacguggcccccgaggucuggaagcugaccuucaacagccaggacgaggcgcuguggcugaucucccaccucacccggcuguga

SEQ ID NO: 31987 - RNA, 3117 nt, Artificial Sequence
  derived and/or modified sequence opt1 from KIF17__Homo_sapiens__XP_011540143
auggccagcgaggccgugaaggucguggugcgcugccggcccaugaaccagcgcgagcgggagcugcgcugccagccggucgugaccguggacugcgcgcgggcccagugcugcauccagaaccccggcgccgccgacgagccgcccaagcaguucaccuucgacggggccuaccacgucgaccacgugacggagcagaucuacaacgagaucgcguacccccucguggagggcgucaccgagggguacaacggcaccaucuucgccuacgggcagaccggcuccggcaagagcuucacgaugcaggggcugcccgacccgcccucccagcgcggcaucaucccccgggccuucgagcacguguucgagagcgugcagugcgccgagaacaccaaguuccugguccgcgcguccuaccucgagaucuacaacgaggacgugcgggaccugcugggggccgacaccaagcagaagcucgagcugaaggagcaccccgagaagggcguguacgucaaggggcugagcaugcacaccgugcacuccguggcccagugcgagcacaucauggagacgggcuggaagaaccgcagcgucggcuacacccucaugaacaaggacuccagccggucccacagcaucuucaccaucuccaucgagaugagcgccguggacgagcgcgggaaggaccaccuccgggccggcaagcugaaccucguggaccuggcgggguccgagcgccagagcaagaccggcgccacgggcgagcggcugaaggaggccaccaagaucaaccucucccugagcgcccuggggaacgucaucuccgcccucguggacggccgcugcaagcacgugcccuaccgggacagcaagcugacccgccugcuccaggacagccucgggggcaacaccaagacgcugauggucgcgugccugucccccgccgacaacaacuacgacgagacccugagcacccugcgguacgccaaccgcgccaagaacauccggaacaagccgcgcaucaacgaggaccccaaggacgcccugcugcgcgaguaccaggaggagaucaagaagcugaaggcgauccucacccagcagaugucccccagcucccugagcgcccugcucucccgccaggugcccccggaccccguccagguggaggagaagcugcugccccagcccgugauccagcacgacgucgaggccgagaagcagcucauccgggaggaguacgaggagcggcuggcccgccugaaggccgacuacaaggcggagcaggagagccgggcccgccucgaggaggacaucacggccaugcggaacuccuacgacgugcgccugagcacccuggaggagaaccuccggaaggagaccgaggccgugcugcaggucggggugcuguacaaggcggaggugaugucccgcgccgaguucgccagcuccgccgaguacccgcccgccuuccaguacgagaccgucgugaagcccaagguguucagcacgaccgacacccuccccuccgacgacgucagcaagacccagguguccagccgguucgcggagcugccgaagguggagcccuccaagagcgagaucagccugggcuccagcgaguccagcucccucgaggagacgagcgucuccgaggccuuccccggccccgaggagccgagcaacguggagguguccaugcccaccgaggagagccgcucccgguacuuccuggacgagugccuggggcaggaggccgccggccaccuccugggggagcagaacuaccugccccaggaggagccgcaggaggucccccugcagggccuccuggggcugcaggaccccuucgccgagguggaggcgaagcucgcccgccugagcuccaccguggcccggaccgacgcgccccaggccgacgucccgaaggugcccgugcagguccccgcccccacggaccugcucgagccgagcgacgcccgccccgaggccgaggccgcggacgacuucccgccccggcccgagguggaccuggccuccgagguggcccuggaggucgugcgcaccgccgagcccggcguguggcucgaggcccaggcgcccgucgcccugguggcccagcccgagccgcugcccgccaccgccggcgugaagcgggagagcgucgggauggagguggcggugcucaccgacgacccccugcccgucguggaccagcagcagguccuggcccgccuccagcugcuggagcagcaggucgugggcggggagcaggccaagaacaaggaccucaaggagaagcacaagcgccggaagcgcuacgccgacgagcggcgcaagcagcugguggccgcgcugcagaacuccgacgaggacagcggcgacugggugcuccugaacguguacgacagcauccaggaggaggugcgggccaaguccaagcugcucgagaagaugcagcgcaagcugcgggccgccgaggucgagaucaaggaccugcagagcgaguuccagcucgagaagaucgacuaccuggcgacgauccgccggcaggagcgcgacuccaugcugcuccagcagcugcuggagcagguccagccgcucauccggcgcgacugcaacuacagcaaccuggagaagauccugcgggaguccugcugggacgaggacaacggguucuggaagaucccccaccccgugaucaccaagaccagccucccccaguuccagcugggccaccgcaccaaccagccggccaagccccugcagcagaccauggccucccggacguggcgcaccaccgccaccggcagcugcuccgugggggccacggugaagacccuccccgcgaccaccagcgaccuguccggcccggcccggagcuccgcccagacgcccgggcgcgccagccacaucaccacccggcaccaggccuccgcggcccacagcgccaccacgcugcccucccacccgccccgcccccucaagugccccagccccggcccguccgccagcagccccuccaccagccugagcccccggcccucccugccgagcccccucgccuccggccuguggcuggggccccgcggccgcuggaaguccugcugccucugguga

SEQ ID NO: 31988 - RNA, 2697 nt, Artificial Sequence
  derived and/or modified sequence opt1 from KIF18A__Homo_sapiens__NP_112494
augagcgugaccgaggaggaccugugccaccacaugaaggucguggugcgcguccggcccgagaacaccaaggagaaggccgccggcuuccacaagguggugcacgucguggacaagcacauccucguguucgacccgaagcaggaggaggucuccuucuuccacgggaagaagacgaccaaccagaacgugaucaagaagcagaacaaggaccugaaguucguguucgacgcggucuucgacgagaccagcacccaguccgagguguucgagcacacgaccaagcccauccugcgcagcuuccucaacggcuacaacugcaccgugcuggccuacggggccaccggcgccgggaagacgcacaccaugcugggcuccgccgacgagcccggcgucauguaccucaccaugcugcaccuguacaagugcauggacgagaucaaggaggagaagaucugcagcaccgcgguguccuaccucgagguguacaacgagcagauccgggaccugcuggucaacagcgggccccucgccgugcgcgaggacacgcagaagggcguggucgugcacgggcugacccugcaccagccgaaguccagcgaggagauccuccaccuccuggacaacggcaacaagaaccggacccagcaccccaccgacaugaacgccacguccagccgcucccacgccguguuccagaucuaccugcggcagcaggacaagaccgcgagcaucaaccagaacguccgcaucgccaagaugucccugaucgaccuggccgggagcgagcgggccuccaccagcggcgccaagggcacccgcuucguggaggggacgaacaucaaccggucccuccuggcgcugggcaacgucaucaacgcccucgccgacagcaagcgcaagaaccagcacauccccuaccggaacagcaagcugacccgccugcucaaggacucccucgggggcaacugccagaccaucaugaucgccgccgugagccccuccagcguguucuacgacgacaccuacaacacgcugaaguacgcgaaccgggccaaggacaucaaguccagccugaaguccaacguccugaacgugaacaaccacaucacccaguacgugaagaucugcaacgagcagaaggccgagauccugcuccugaaggagaagcugaaggccuacgaggagcagaaggccuucaccaacgagaacgaccaggcgaagcucaugaucagcaacccgcaggagaaggagaucgagcgcuuccaggagauccugaacugccuguuccagaaccgggaggagauccgccaggaguaccucaagcuggagaugcugcucaaggagaacgagcugaaguccuucuaccagcagcagugccacaagcagaucgagaugaugugcagcgaggacaaggucgagaaggccaccggcaagcgggaccaccgccuggccaugcucaagacgcggcgcuccuaccuggagaagcgccgggaggaggagcugaagcaguucgacgagaacaccaacuggcuccaccgcguggagaaggagauggggcugcugagccagaacggccacauccccaaggagcugaagaaggaccuccacugccaccaccuccaccuccagaacaaggaccugaaggcccagauccggcacaugauggaccuggccugccugcaggagcagcagcaccgccagaccgaggcggugcugaacgcccugcugcccacccuccggaagcaguacugcacgcugaaggaggccgggcuguccaacgccgcguucgagagcgacuucaaggagaucgagcaccucgucgagcgcaagaaggugguggucugggccgaccagaccgccgagcagcccaagcagaacgaccugccgggcaucuccgugcugaugaccuucccccagcucgggcccgugcagcccaucccgugcugcagcuccagcggcggcaccaaccuggucaagauccccacggagaagcggacccgccggaagcugaugcccagcccccucaaggggcagcacacccugaaguccccgcccagccaguccgugcagcugaacgacagccucuccaaggagcugcagcccaucguguacacccccgaggacugccgcaaggccuuccagaacccgagcaccgucacgcugaugaagcccuccagcuucaccaccuccuuccaggccaucagcuccaacaucaacagcgacaacugccucaagaugcugugcgagguggcgaucccccacaaccggcgcaaggagugcggccaggaggaccuggacuccaccuucacgaucugcgaggacaucaagagcuccaagugcaagcuccccgagcaggagagccugccgaacgacaacaaggacauccugcagcggcucgaccccuccagcuucuccaccaagcacagcaugcccgugccgagcaugguccccuccuacauggccaugaccaccgccgccaagcgcaagcggaagcugacgagcuccaccagcaacuccagccugaccgccgacgugaacuccggguucgcgaagcgcgugcggcaggacaacagcuccgagaagcaccuccaggagaacaagcccaccauggagcacaagcgcaacaucugcaagaucaaccccagcaugguccggaaguucggccgcaacaucuccaaggggaaccugcgcuga

SEQ ID NO: 31989 - RNA, 5376 nt, Artificial Sequence
  derived and/or modified sequence opt1 from KIF1A__Homo_sapiens__NP_001230937
auggccggcgccagcgugaaggucgcggugcgcgugcggcccuucaacucccgcgagaugagccgggacuccaagugcaucauccagaugagcggguccaccaccacgaucgucaacccgaagcagcccaaggagacccccaagagcuucuccuucgacuacagcuacuggucccacaccagccccgaggacaucaacuacgccucccagaagcagguguaccgcgacaucggcgaggagaugcugcagcacgccuucgagggguacaacgugugcaucuucgccuacggccagaccggggccggcaagagcuacacgaugaugggcaagcaggagaaggaccagcaggggaucaucccgcagcucugcgaggaccuguucucccggaucaacgacaccaccaacgacaacaugagcuacuccgucgaggugagcuacauggagaucuacugcgagcgcgugcgggaccugcucaaccccaagaacaagggcaaccugcgcguccgggagcacccccugcucgggcccuacguggaggaccuguccaagcuggcggugaccagcuacaacgacauccaggaccucauggacuccggcaacaaggcccgcacggucgccgccaccaacaugaacgagaccagcagccggucccacgcgguguucaacaucaucuucacccagaagcgccacgacgccgagacgaacaucaccaccgagaaggugagcaagaucucccuggucgaccuggccgggagcgagcgggccgacuccaccggcgccaagggcacgcgccucaaggagggggcgaacaucaacaagagccugaccacccugggcaaggugaucuccgcccucgccgagauggacagcgggccgaacaagaacaagaagaagaagaagaccgacuucauccccuaccgggacuccgugcugacguggcugcuccgcgagaaccugggcggcaacagccggaccgccauggucgccgcgcugucccccgccgacaucaacuacgacgagacccucagcacccugcgcuacgccgaccgggccaagcagauccgcugcaacgccgugaucaacgaggaccccaacaacaagcugauccgggagcucaaggacgaggugacgcgccugcgcgaccugcucuacgcgcaggggcugggcgacaucaccgacaccaacaccgucccggggggccccaagcugacgaacgcccucguggggaugucccccagcuccagccuguccgcccugagcucccgggccgccagcgugagcucccuccacgagcgcauccuguucgcgcccggcagcgaggaggccaucgagcggcugaaggagaccgagaagaucaucgccgagcucaacgagaccugggaggagaagcugcgccggaccgaggccauccgcauggagcgggaggcgcugcucgccgagaugggcgucgccaugcgcgaggacgggggcacgcuggggguguucuccccgaagaagaccccccaccuggucaaccucaacgaggacccccugaugagcgagugccugcucuacuacaucaaggacggcaucacccggguggggcgcgaggacggcgagcggcgccaggacaucgugcuguccggccacuucaucaaggaggagcacugcgucuuccggagcgacucccgcgggggcagcgaggccguggugacccuggagcccugcgagggggccgacacguacgucaacggcaagaaggugaccgagccguccauccuccggagcgggaaccgcaucaucaugggcaagucccacguguuccgguucaaccaccccgagcaggcgcgccaggagcgggagcgcacccccugcgccgagacccccgccgagccggucgacugggccuucgcccagcgcgagcugcuggagaagcagggcaucgacaugaagcaggagauggagcagcggcugcaggagcucgaggaccaguaccgccgggagcgcgaggaggcgaccuaccugcuggagcagcagcggcucgacuacgagagcaagcuggaggcccugcagaagcagauggacucccgcuacuaccccgaggugaacgaggaggaggaggagcccgaggacgaggugcaguggacggagcgggagugcgagcucgcccugugggccuuccgcaaguggaagugguaccaguucaccagccugcgggaccuccugugggggaacgccaucuuccugaaggaggcgaacgccaucuccgucgagcucaagaagaaggugcaguuccaguucgugcugcugaccgacacccucuacagcccccugccgcccgaccugcuccccccggaggccgccaaggaccgcgagacgcggcccuucccccgcaccaucgucgcgguggaggugcaggaccagaagaacggcgccacccacuacuggacccuggagaagcugcggcagcgccucgaccugaugcgggagauguacgaccgcgccgccgagguccccuccagcgugaucgaggacugcgacaacguggucacggggggcgacccguucuacgaccgguuccccugguuccgccuggugggcagcuccgccaucagcgggugcaacuccuacccccuccugaacaccugcaugagcgagcggauggcggcccugacccccuccccgaccuucagcucccccgacagcgacgccacggagcccgccgaggagcaguccgugggcgaggaggaggaggaggaggaggaggaggaggacgaggaggaggaggaccucgaggacgacgucuuccccgagcacgcccugugcgacgggcgcgacccguucuacgaccggcccccccuguucagccucgugggccgcgcguucguguaccuguccaaccugcucuaccccgucccgcuggugcaccgcguggccaucgucagcgagaagggggaggugaagggcuuccugcggguggccguccaggccaucuccgccgacgaggaggcgcccgacuacggcagcggggugcgccaguccggcaccgccaagaucagcuucgacgaccagcacuucgagaaguuccaguccgagagcugccccguggucgggaugucccggagcggcaccagccaggaggagcuccgcaucguggaggggcagggccagggcgccgacguggggcccuccgccgacgaggucaacaacaacaccugcagcgcggugccgcccgagggccugcugcucgacuccagcgagaaggccgcccuggacgggccccuggacgccgcccucgaccaccugcggcugggcaacacguucaccuuccgcgugaccguccuccaggcguccagcaucuccgccgaguacgccgacaucuucugccaguucaacuucauccaccggcacgacgaggccuucagcaccgagccccugaagaacacggggcgcggcccgccccugggcuucuaccacgugcagaacaucgccguggaggucaccaaguccuucaucgaguacaucaagagccagcccaucguguucgagguguucgggcacuaccagcagcacccguuccccccccucugcaaggacguccuguccccccugcggccgagccgccggcacuucccccgcgugaugccccucuccaagcccgugccggcgaccaagcugagcacccugacgcggcccugccccggccccugccacugcaaguacgaccuccuggucuacuucgagaucugcgagcuggaggccaacggggacuacaucccggccguggucgaccaccgcggcgggaugcccugcaugggcaccuuccuccugcaccagggcauccagcggcgcaucaccgugacccugcuccacgagacggggucccacauccgguggaaggaggugcgcgagcuggucgugggccggauccgcaacacccccgagaccgacgagagccugaucgaccccaacauccucucccugaacauccugagcuccggguacauccacccggcccaggacgaccgcaccuucuaccaguucgaggccgcgugggacagcagcaugcacaacucccuccugcugaaccgggugacgcccuaccgcgagaagaucuacaugacccucagcgccuacaucgagauggagaacugcacccagcccgccgucgugaccaaggacuucugcaugguguucuacucccgggacgccaagcugcccgccagccgcuccauccggaaccuguucggcagcggcucccuccgcgcgagcgaguccaaccgggucacggggguguacgagcugagccugugccacguggccgacgccggcuccccggggaugcagcgccggcgccggcgcguccucgacaccagcguggccuacgugcggggcgaggagaaccuggcgggguggcgcccccgguccgacagccugauccucgaccaccagugggagcuggagaagcugucccuccugcaggaggucgagaagacccgccacuaccugcuccugcgggagaagcuggagaccgcccagcgccccgugcccgaggcccucagcccggccuucuccgaggacagcgagucccacggcagcagcuccgccagcuccccccugagcgcggagggccggcccuccccccuggaggccccgaacgagcgccagcgggagcucgccgugaagugccugcgccugcucacccacacguucaaccgcgaguacacccacagccacgucugcguguccgccagcgaguccaagcugagcgagauguccgugacccugcugcgggaccccagcauguccccccucggggucgccacccugacgccgagcuccaccugccccagccugguggagggccgcuacggggcgaccgaccuccggaccccccagcccugcucccgcccggccagccccgagcccgagcugcugcccgaggccgacuccaagaagcucccgagccccgcccgggccacggagaccgacaaggagccccagcgccugcuggugcccgacauccaggagauccgggucagcccgaucguguccaagaagggcuaccuccacuuccuggagccccacaccagcgggugggcgcgccgguucguggucgugcgccggcccuacgccuacauguacaacuccgacaaggacaccguggagcgcuucguccugaaccucgccacggcccagguggaguacagcgaggaccagcaggcgaugcugaagacccccaacaccuucgccgugugcaccgagcaccggggcauccugcuccaggccgccuccgacaaggacaugcacgacuggcuguacgccuucaacccgcugcucgcgggcacgauccgcagcaagcugucccggcgccggagcgcccagaugcgcgucuga

SEQ ID NO: 31990 - RNA, 3312 nt, Artificial Sequence
  derived and/or modified sequence opt1 from KIF1C__Homo_sapiens__NP_006603
auggccggcgccagcgugaaggucgcggugcgcgugcggcccuucaacgcccgcgagaccucccaggacgccaagugcgucgugagcaugcaggggaacaccacguccaucaucaaccccaagcagagcaaggacgcccccaaguccuucaccuucgacuacagcuacuggucccacaccagcaccgaggacccccaguucgccucccagcagcaggucuaccgggacaucggcgaggagaugcugcuccacgcguucgagggguacaacgucugcaucuucgccuacggccagacgggggccggcaagagcuacaccaugaugggccgccaggagcccgggcagcagggcaucgugccgcagcugugcgaggaccuguucucccgggugagcgagaaccaguccgcccagcucagcuacuccgucgaggugagcuacauggagaucuacugcgagcgcgugcgggaccugcugaaccccaagucccgcgggagccuccggguccgcgagcaccccauccugggccccuacgugcaggaccuguccaagcucgcggugaccagcuacgccgacaucgccgaccugauggacugcgggaacaaggcccggaccgucgccgcgacgaacaugaacgagaccagcucccgcagccacgccguguucaccaucguguucacccagcggugccacgaccagcugacgggccucgacuccgagaaggucagcaagaucucccugguggaccuggccggcagcgagcgcgccgacuccagcggggcccggggcaugcgccucaaggagggggcgaacaucaacaagucccugaccacccugggcaaggugaucagcgcccucgccgacaugcaguccaagaagcgcaagagcgacuucaucccguaccgcgacuccguccugaccuggcugcucaaggagaaccugggcgggaacagccggacggccaugaucgccgcgcugucccccgccgacaucaacuacgaggagacccucagcacccugcgcuacgccgaccggaccaagcagauccgcugcaacgccaucaucaacgaggaccccaacgcccgccugauccgggagcuccaggaggagguggcgcggcugcgggagcugcucauggcccagggccuguccgccagcgcccuggaggggcucaagacggaggagggcuccgugcgcggggcgcugcccgccgugagcagcccgcccgcccccgugucccccagcuccccgaccacccacaacggcgagcuggagcccagcuucucccccaacaccgagagccagaucggccccgaggaggccauggagcggcuccaggagacggagaagaucaucgccgagcugaacgagaccugggaggagaagcugcgcaagaccgaggcgcuccggauggagcgcgaggcccugcuggccgagaugggggucgccgugcgggaggacggcgggaccgugggcgucuucuccccgaagaagacgccccaccucgugaaccugaacgaggacccccugaugagcgagugccuccuguaccacaucaaggacggggugacccgcgucggccagguggacauggacaucaagcugaccggccaguucauccgggagcagcacugccucuuccgcuccaucccccagccggacggggagguggucgugacccuggagcccugcgagggcgccgagacguacgugaacgggaagcuggucaccgagccccuggugcucaagagcggcaaccggaucgugauggggaagaaccacgucuuccgcuucaaccaccccgagcaggcgcggcuggagcgcgagcggggcgugccgccgccgcccggcccgcccuccgagcccguggacuggaacuucgcccagaaggagcugcucgagcagcaggggaucgacaucaagcuggagauggagaagcgccugcaggaccucgagaaccaguaccggaaggagaaggaggaggccgaccugcugcucgagcagcagcgccuguacgccgacagcgacuccggcgacgacagcgacaagcgcuccugcgaggagagcuggcggcugaucuccagccuccgcgagcagcugccgcccaccaccguccagacgaucgugaagcggugcgggcugcccagcuccggcaagcgccgggcgccccgccggguguaccagaucccccagcgccggcgccuccagggcaaggacccccggugggccaccauggccgaccugaagaugcaggccgucaaggagaucugcuacgagguggcccuggcggacuuccgccacgggcgggccgagaucgaggcccucgccgcccugaagaugcgcgagcugugccggaccuacggcaagcccgacgggcccggcgacgcguggcgcgccguggcccgggacgucugggacaccgugggggaggaggagggcggcggggccggcagcgggggcggguccgaggagggcgcccgcggcgcggagguggaggaccuccgggcccacaucgacaagcugaccgggauccugcaggaggucaagcuccagaacagcuccaaggaccgcgagcugcaggcccugcgggaccgcaugcuccgcauggagcgggugaucccccuggcccaggaccacgaggacgagaacgaggagggcggggaggugcccugggccccgcccgagggcagcgaggcggccgaggaggccgcccccuccgaccgcaugcccagcgcgcggccgcccuccccgccccugagcuccugggagcgcgucagccggcucauggaggaggaccccgccuuccgccgggggcgccugcgguggcugaagcaggagcagcuccgccugcagggccugcagggcuccgggggccgcgggggcgggcuccggcggccgcccgcccgcuucgugccgccccacgacugcaagcugcgguuccccuucaagagcaacccccagcaccgcgaguccuggcccggcaugggcagcggggaggcccccacgccccugcagccgcccgaggaggugaccccgcaccccgccacccccgcgcggcgcccgcccagcccccggcgcucccaccacccccgccggaacucccucgacggcgggggccgcagccggggcgccgggagcgcccagcccgagccccagcacuuccagcccaagaagcacaacuccuacccccagccgccccagcccuaccccgcccagcgcccgcccggcccccgguacccgcccuacaccacgccgccccgcaugcggcgccagcggagcgcccccgaccugaaggaguccggggcggccgucuga

SEQ ID NO: 31991 - RNA, 2673 nt, Artificial Sequence
  derived and/or modified sequence opt1 from KIF20A__Homo_sapiens__NP_005724
augagccagggcauccuguccccgcccgccgggcuccugagcgacgacgacguggucgugucccccauguucgagagcaccgccgcggaccugggcuccgugguccgcaagaaccuccugagcgacugcuccguggugagcaccucccuggaggacaagcagcagguccccagcgaggacuccauggagaaggugaagguguaccuccggguccgcccccugcugccgagcgagcucgagcggcaggaggaccaggggugcgugcgcaucgagaacguggagacgcugguccugcaggcccccaaggacuccuucgcccucaagagcaacgagcggggcaucgggcaggccacccaccgcuucaccuucucccagaucuucggccccgaggugggccaggccagcuucuucaaccugaccgugaaggagauggucaaggacgugcugaaggggcagaacuggcucaucuacacguacggcgugaccaacuccgggaagacccacaccauccagggcacgaucaaggacgggggcauccugccccggagccuggcgcucaucuucaacucccugcagggccagcugcacccgacccccgaccucaagccccugcugagcaacgaggucaucuggcucgacagcaagcagauccgccaggaggagaugaagaagcugucccugcucaacgggggccugcaggaggaggagcugagcaccucccucaagcggagcguguacaucgagucccgcaucgggaccagcacguccuucgacagcggcaucgccggccuguccagcaucucccagugcaccagcuccagccagcuggacgagaccucccaccggugggcccagcccgacaccgccccgcuccccgugcccgcgaacauccgcuucagcaucuggaucuccuucuucgagaucuacaacgagcugcuguacgaccuccuggagcccccgagccagcagcggaagcgccagacgcugcggcucugcgaggaccagaacgggaaccccuacgucaaggaccugaacuggauccacgugcaggacgccgaggaggccuggaagcugcucaaggugggccgcaagaaccaguccuucgccagcacccaccugaaccagaacagcucccggagccacuccaucuucagcauccgcauccugcaccuccagggggagggcgacaucguccccaagaucuccgagcugagccugugcgaccucgccggguccgagcggugcaaggaccagaaguccggcgagcgccugaaggaggcgggcaacaucaacaccucccugcacacccuggggcggugcaucgccgcccuccgccagaaccagcagaaccgcagcaagcagaaccuggugcccuuccgggacuccaagcugacgcgcgucuuccagggcuucuucaccgggcggggccgcagcugcaugaucgugaacgugaacccgugcgccuccaccuacgacgagacccuccacgucgccaaguucagcgcgaucgccucccagcuggugcacgccccgcccaugcagcugggguuccccagccuccacuccuucaucaaggagcacagccuccaggugagccccucccuggagaagggcgccaaggccgacacgggccuggacgacgacaucgagaacgaggcggacaucagcauguacgggaaggaggagcugcugcaggucguggaggccaugaagacccuccugcugaaggagcggcaggagaagcuccagcuggagaugcaccuccgcgacgagaucugcaacgagaugguggagcagaugcagcagcgggagcaguggugcuccgagcaccuggacacccagaaggagcugcuggaggagauguacgaggagaagcucaacauccugaaggagagccugaccuccuucuaccaggaggagauccaggagcgcgacgagaagaucgaggagcucgaggcccugcugcaggaggcccggcagcagagcgucgcccaccagcaguccggcagcgagcucgcgcugcgccggucccagcgccuggccgccagcgccuccacgcagcagcuccaggaggugaaggcgaagcugcagcagugcaaggccgagcugaacagcaccaccgaggagcuccacaaguaccagaagaugcuggagcccccgcccuccgccaagcccuucaccaucgacguggacaagaagcuggaggaggggcagaagaacauccggcuccugcgcacggagcugcagaagcucggcgagagccugcaguccgccgagcgggccugcugccacagcaccggggcgggcaagcugcgccaggcccucacgaccugcgacgacauccugaucaagcaggaccagacccuggccgagcuccagaacaacaugguccuggugaagcuggaccuccggaagaaggccgccugcaucgcggagcaguaccacaccgugcugaagcugcagggccaggucuccgccaagaagcgccucgggaccaaccaggagaaccagcagcccaaccagcagcccccgggcaagaagcccuuccugcggaaccugcucccccgcaccccgaccugccagagcuccacggacugcagccccuacgcccgcauccugcggagccgccggagcccccugcucaagagcgggcccuucggcaagaaguacuga

SEQ ID NO: 31992 - RNA, 5463 nt, Artificial Sequence
  derived and/or modified sequence opt1 from KIF20B__Homo_sapiens__NP_001271188
auggagagcaacuucaaccaggagggggugccccgccccagcuacguguucagcgccgaccccaucgcccggcccagcgagaucaacuucgacgggaucaagcuggaccugagccacgaguucagccugguggcgcccaacaccgaggccaacagcuucgaguccaaggacuaccugcaggucugccuccgcauccggccguucacccagagcgagaaggagcuggaguccgagggcugcgugcacauccuggacagccagacgguggugcucaaggagccccagugcauccuggggcgccuguccgagaaguccuccggccagauggcccagaaguucagcuucuccaaggucuucgggcccgccaccacccagaaggaguucuuccagggcugcaucaugcagcccgugaaggaccuccugaagggccagagccggcugaucuucaccuacgggcucacgaacuccggcaagaccuacaccuuccaggggaccgaggagaacaucggcauccugccgcgcacgcugaacgugcuguucgacagccugcaggagcggcuguacaccaagaugaaccucaagccccaccgcucccgggaguaccugcgccugagcagcgagcaggagaaggaggagaucgccuccaagagcgcgcuccugcggcagaucaaggaggucaccgugcacaacgacuccgacgacacccuguacgggagccucacgaacucccugaacaucagcgaguucgaggaguccaucaaggacuacgagcaggccaaccugaacauggccaacagcaucaaguucuccgugugggucagcuucuucgagaucuacaacgaguacaucuacgaccucuucgugcccguguccagcaaguuccagaagcgcaagaugcugcggcugucccaggacgucaagggcuacagcuucaucaaggaccuccaguggauccagguguccgacagcaaggaggccuaccgccugcugaagcucggcaucaagcaccaguccguggcguucaccaagcugaacaacgccagcucccggagccacagcaucuucaccgucaagauccugcagaucgaggacuccgagaugagccgcgugauccggguguccgagcucagccugugcgaccuggccggguccgagcgcaccaugaagacgcagaacgagggcgagcggcuccgcgagaccgggaacaucaacaccagccugcugacccucggcaagugcaucaacguccugaagaacuccgagaaguccaaguuccagcagcacgugcccuuccgggaguccaagcugacgcacuacuuccagagcuucuucaacggcaaggggaagaucugcaugaucgugaacaucucccagugcuaccucgccuacgacgagacccugaacguccugaaguucagcgccaucgcgcagaaggugugcgucccggacacccucaacuccagccaggagaagcuguucggccccgugaaguccagccaggacgugucccuggacagcaacagcaacuccaagauccugaacgucaagcgcgccaccaucagcugggagaacucccucgaggaccugauggaggacgaggaccugguggaggagcucgagaacgccgaggagacgcagaacguggagaccaagcugcuggacgaggaccucgacaagacccuggaggagaacaaggccuucaucagccacgaggagaagcgcaagcugcucgaccugaucgaggaccugaagaagaagcucaucaacgagaagaaggagaagcugacccuggaguucaagauccgggaggaggucacgcaggaguucacccaguacugggcccagcgcgaggcggacuucaaggagacccuccugcaggagcgggagauccuggaggagaacgccgagcgccggcucgccaucuucaaggaccugguggggaagugcgacacccgcgaggaggccgccaaggacaucugcgcgacgaagguggagaccgaggagacccacaacuacgucggcuucgaggacaucaucgacucccugcaggacaacguggccgacaucaagaagcaggccgagaucgcccaccucuacaucgccagccugcccgacccccaggaggcgaccgccugccuggagcucaaguucaaccagaucaaggccgagcuggccaagacgaagggggagcugaucaagaccaaggaggagcucaagaagcgggagaacgaguccgacagccugauccaggagcuggagaccuccaacaagaagaucaucacccagaaccagcgcaucaaggagcucaucaacaucaucgaccagaaggaggacaccaucaacgaguuccagaaccucaagagccacauggagaacacguucaagugcaacgacaaggcggacaccuccagccugaucaucaacaacaagcucaucugcaacgagaccguggaggucccgaaggacuccaagagcaagaucugcuccgagcggaagcgcgugaacgagaacgagcugcagcaggacgagccgcccgccaagaagggcagcauccacguguccagcgccaucaccgaggaccagaagaaguccgaggagguccggcccaacaucgccgagaucgaggacauccgcgugcugcaggagaacaacgagggccuccgggccuuccugcugacgaucgagaacgagcucaagaacgagaaggaggagaaggcggagcugaacaagcagaucgugcacuuccagcaggagcugagccucagcgagaagaagaaccugacccuguccaaggagguccagcagauccagagcaacuacgacaucgccaucgccgagcuccacgugcagaaguccaagaaccaggagcaggaggagaagaucaugaagcugagcaacgagaucgagaccgccacccgcuccaucacgaacaacgugagccagaucaagcugaugcacaccaagaucgacgagcuccggacccuggacuccgucagccagaucuccaacaucgaccugcucaaccugcgcgaccugagcaacggguccgaggaggacaaccucccgaacacccagcuggaccugcucggcaacgacuaccuggugagcaagcaggucaaggaguaccggauccaggagcccaaccgcgagaacuccuuccacagcuccaucgaggccaucugggaggagugcaaggagaucgucaaggcgagcuccaagaagucccaccagaucgaggagcuggagcagcagaucgagaagcuccaggccgaggugaagggguacaaggacgagaacaaccggcugaaggagaaggagcacaagaaccaggacgaccugcucaaggagaaggagacgcugauccagcagcugaaggaggagcuccaggagaagaacgugacccuggacguccagauccagcacgugguggagggcaagcgcgcccuguccgagcucacccagggggugaccugcuacaaggccaagaucaaggagcuggagacgauccuggagacccagaagguggagugcagccacagcgccaagcucgagcaggacauccuggagaaggaguccaucauccugaagcucgagcgcaaccugaaggaguuccaggagcaccuccaggacagcgugaagaacaccaaggaccucaacgucaaggagcugaagcugaaggaggagaucacccagcucacgaacaaccugcaggacaugaagcaccuccugcagcugaaggaggaggaggaggagaccaaccggcaggagaccgagaagcugaaggaggagcucuccgcgagcuccgcccgcacccagaaccugaaggccgaccugcagcggaaggaggaggacuacgccgaccucaaggagaagcugacggacgcgaagaagcagaucaagcagguccagaaggaggugagcgucaugcgcgacgaggacaagcugcuccggaucaagaucaacgagcuggagaagaagaagaaccagugcucccaggagcuggacaugaagcagcgcaccauccagcagcugaaggagcagcucaacaaccagaagguggaggaggccauccagcaguacgagcgggccugcaaggaccugaacgugaaggagaagaucaucgaggacaugcgcaugacccuggaggagcaggagcagacccaggucgagcaggaccaggugcucgaggccaagcuggaggagguggagcggcuggccacggagcucgagaaguggaaggagaagugcaacgaccuggagaccaagaacaaccagcgcagcaacaaggagcacgagaacaacaccgacguccugggcaagcucaccaaccugcaggacgagcugcaggaguccgagcagaaguacaacgcggaccggaagaaguggcucgaggagaagaugaugcugaucacgcaggccaaggaggccgagaacauccgcaacaaggagaugaagaaguacgccgaggaccgggagcgcuucuucaagcagcagaacgagauggagauccugaccgcccagcucaccgagaaggacagcgaccugcagaaguggcgggaggagcgcgaccagcugguggcggcccucgagauccagcugaaggcccugaucuccagcaacgugcagaaggacaacgagaucgagcagcucaagcggaucaucuccgagaccagcaagaucgagacgcagaucauggacaucaagcccaagcgcaucuccagcgccgaccccgacaagcugcagaccgagccgcuguccaccagcuucgagaucucccggaacaagaucgaggacggcagcgucgugcucgacagcugcgagguguccaccgagaacgaccagagcacccgcuuccccaagcccgagcuggagauccaguucacgccccugcagccgaacaagauggccgucaagcaccccgggugcaccacccccgugaccgugaagaucccgaaggcgcggaagcgcaaguccaacgagauggaggaggaccucgucaagugcgagaacaagaagaacgccacgccccgcaccaaccugaaguuccccaucagcgacgaccggaacuccagcgugaagaaggagcagaaggucgccauccgccccuccagcaagaagaccuacucccugcggagccaggccuccaucaucggcgugaaccucgcgaccaagaagaaggaggggacgcugcagaaguucggcgacuuccugcagcacagcccguccauccuccagagcaaggccaagaagaucaucgagaccauguccagcuccaagcugagcaacguggaggccuccaaggagaacgucagccagcccaagcgcgccaagcggaagcuguacaccagcgagaucuccagccccaucgacaucuccggccaggugauccucauggaccagaagaugaaggagagcgaccaccagaucaucaagcgccggcugcgcaccaagacggccaaguga

SEQ ID NO: 31993 - RNA, 4914 nt, Artificial Sequence
  derived and/or modified sequence opt1 from KIF21A__Homo_sapiens__NP_001166934
augcugggcgcccccgacgagagcuccgugcgcgucgccgugcggauccgcccgcagcucgcgaaggagaagaucgaggggugccacaucugcaccagcgugacccccggcgagccccaggucuuccuggggaaggacaaggccuucacguucgacuacguguucgacaucgacucccagcaggagcagaucuacauccagugcaucgagaagcugaucgagggcugcuucgagggguacaacgccaccguguucgccuacggccagaccggcgccgggaagaccuacacgaugggcaccggguucgacgucaacaucguggaggaggagcucggcaucaucagccgggcggugaagcaccuguucaaguccaucgaggagaagaagcacaucgccaucaagaacgggcugcccgccccggacuucaaggucaacgcccaguuccucgagcuguacaacgaggaggugcuggaccucuucgacaccacccgcgacaucgacgccaagagcaagaaguccaacauccggauccacgaggacagcacgggcggcaucuacaccgugggggucaccacccgcacggugaacaccgaguccgagaugaugcagugccugaagcugggcgcgcucagccggaccaccgccuccacgcagaugaacgugcagagcucccgcagccacgccaucuucaccauccacgucugccagacccgggugugcccccagaucgacgccgacaacgcgaccgacaacaagaucaucuccgagagcgcccagaugaacgaguucgagacgcugaccgccaaguuccacuucguggaccuggccggguccgagcgccucaagcggaccggcgccaccggcgagcgcgcgaaggaggggaucagcaucaacugcggccugcuggcccucgggaacgucaucuccgcccugggcgacaagagcaagcgggccacgcacgugcccuaccgcgacagcaagcugacccggcuccugcaggacucccucgggggcaacagccagaccaucaugaucgccugcgugucccccagcgaccgcgacuucauggagacccugaacacgcugaaguacgcgaaccgggcccgcaacaucaagaacaaggucauggugaaccaggaccgggccucccagcagaucaacgcccugcgcagcgagaucacccggcuccagauggagcugauggaguacaagaccggcaagcgcaucaucgacgaggaggggguggaguccaucaacgacauguuccacgagaacgccaugcugcagaccgagaacaacaaccuccgcguccggaucaaggcgaugcaggagacgguggacgcccugcgcagccggaucacccagcuggucuccgaccaggccaaccacgugcucgcccgcgcgggcgaggggaacgaggagaucagcaacaugauccacuccuacaucaaggagaucgaggaccugcgggccaagcugcucgagagcgaggccgugaacgagaaccugcgcaagaaccugacccgggccaccgcccgcgcgccguacuucuccggcagcuccacguucagccccaccauccucuccagcgacaaggagaccaucgagaucaucgaccuggccaagaaggaccuggagaagcucaagcggaaggagaagcgcaagaagaaguccgucgccgggaaggaggacaacaccgacaccgaccaggagaagaaggaggagaagggcgugagcgagcgggagaacaacgagcuggagguggaggagagccaggaggucuccgaccacgaggacgaggaggaggaggaggaggaggaggaggacgacaucgacggcggggagagcuccgacgagagcgacuccgagagcgacgagaaggccaacuaccaggccgaccuggcgaacaucacgugcgagaucgccaucaagcagaagcucaucgacgagcuggagaacucccagaagcgccugcagacccucaagaagcaguacgaggagaagcugaugaugcugcagcacaagauccgggacacccagcuggagcgcgaccaggugcuccagaaccugggcagcguggaguccuacagcgaggagaaggccaagaagguccgguccgaguacgagaagaagcugcaggccaugaacaaggagcuccagcgccugcaggccgcgcagaaggagcacgcccggcugcucaagaaccagagccaguacgagaagcagcugaagaagcugcagcaggacgugauggagaugaagaagaccaaggugcgccucaugaagcagaugaaggaggagcaggagaaggcccggcugacggagucccgccgcaaccgggagaucgcccagcugaagaaggaccagcgcaagcgggaccaccagcuccgccugcuggaggcgcagaagcggaaccaggaggucgugcuccgccggaagaccgaggaggugaccgcccugcgccggcagguccgccccaugagcgacaagguggccgggaaggugacccggaagcuguccagcuccgacgcccccgcccaggacacgggcagcagcgcggccgccgucgagaccgacgccucccgcaccggggcccagcagaagaugcggaucccgguggcgcgcgugcaggcccuccccacccccgccacgaacggcaaccggaagaaguaccagcgcaagggccugaccgggcgggucuucaucagcaagaccgcccgcaugaaguggcagcugcucgagcggcgcgugaccgacaucaucaugcagaagaugacgaucuccaacauggaggccgacaugaaccggcugcugaagcagcgcgaggagcucaccaagcgccgggagaagcugagcaagcgccgggagaagaucgugaaggagaacggcgagggggacaagaacgucgcgaacaucaacgaggagauggagucccugaccgccaacaucgacuacaucaacgacagcaucuccgacugccaggccaacaucaugcagauggaggaggccaaggaggagggcgagacccucgacgugacggcggugaucaacgccugcacccugaccgaggcccgcuaccugcucgaccacuuccugagcaugggcaucaacaaggggcugcaggccgcccagaaggaggcgcagaucaagguccucgagggccggcugaagcagaccgagaucacguccgccacccagaaccagcuccuguuccacaugcugaaggagaaggccgagcugaaccccgagcucgacgcccugcuggggcacgcccuccaggagaacguggaggacagcaccgacgaggacgcgccgcugaacucccccggcagcgagggguccacccugagcuccgaccucaugaagcugugcggcgaggugaagcccaagaacaaggcccgccggcgcacgaccacccagauggagcugcucuacgccgacagcuccgagcuggccagcgacaccuccacgggcgacgccagccugcccgggccgcucacccccgucgcggagggccaggagaucgggaugaacaccgagaccagcggcacguccgcccgggagaaggagcugagcccgccgcccgggcugcccuccaagaucggcagcaucucccgccagagcucccucagcgagaagaagauccccgagcccucccccgugacccggcgcaaggccuacgagaaggccgagaaguccaaggccaaggagcagaagcacagcgacagcggcaccuccgaggcgagccuguccccgcccagcuccccgcccagccggccccgcaacgagcugaacguguucaaccggcucaccgucucccaggggaacaccagcgugcagcaggacaagggcaucaucaaccccuuccccgccagcaaggggauccgcgccuucccccugcagugcauccacaucgccgagggccacacgaaggcggugcugugcgucgacuccaccgacgaccuccuguucaccgggagcaaggaccggaccugcaagguguggaaccuggugacgggccaggagaucaugucccucggcgggcaccccaacaacgucgugagcgugaaguacugcaacuacaccucccuggucuucaccgugagcaccuccuacaucaaggugugggacauccgcgacagcgccaagugcauccggacgcugaccuccagcggccaggucacccucggggacgccugcuccgccagcaccucccgcacgguggccauccccagcggcgagaaccagaucaaccagaucgcgcugaacccgaccgggaccuuccuguacgccgccuccggcaacgccgugcgcaugugggaccucaagcgguuccagagcaccggcaagcugacggggcaccugggccccgucaugugccucaccguggaccagaucuccagcgggcaggaccugaucaucaccggcuccaaggaccacuacaucaagauguucgacgugaccgagggcgcccuggggacggucagccccacccacaacuucgagcccccgcacuacgacggcaucgaggcgcucaccauccagggggacaaccuguucagcggcucccgcgacaacgggaucaagaagugggaccugacccagaaggaccuccugcagcagguccccaacgcccacaaggacugggugugcgcccugggcguggugcccgaccaccccguccuccugagcggcugccgcgggggcauccugaagguguggaacauggacacguucaugccggugggggagaugaagggccacgacucccccaucaacgccaucugcgucaacagcacccacaucuucaccgccgcggacgaccggaccgugcggaucuggaaggcccgcaaccuccaggacgggcagaucuccgacacgggcgaccugggcgaggacaucgccagcaacuga

SEQ ID NO: 31994 - RNA, 4914 nt, Artificial Sequence
  derived and/or modified sequence opt1 from KIF21B__Homo_sapiens__NP_001239029
auggccggccagggggacugcugcgugaaggucgccgugcgcauccggccccagcugagcaaggagaagaucgagggcugccacaucugcaccuccgugaccccgggggagccccagguccuccugggcaaggacaaggcguucacguacgacuucguguucgaccuggacaccuggcaggagcagaucuacagcacgugcguguccaagcucaucgaggggugcuucgagggcuacaacgccaccguccuggccuacggccagaccggggccggcaagaccuacaccauggggaccggcuucgacauggccacgagcgaggaggagcaggggaucaucccccgcgcgaucgcccaccuguucggcggcaucgccgagcggaagcgccgggcccaggagcaggggguggcgggccccgaguucaagguguccgcccaguuccucgagcuguacaacgaggagauccuggaccucuucgacagcacccgcgacccggacacccggcaccgccgguccaacaucaagauccacgaggacgccaacgggggcaucuacaccacgggcgucaccagccgccugauccacucccaggaggagcugauccagugccucaagcagggggcccugagccggaccaccgccuccacgcagaugaacgugcagagcucccgcagccacgcgaucuucaccauccaccugugccagaugcggaugugcacccagcccgaccucgugaacgaggccgucaccggccugcccgacgggacgcccccguccagcgaguacgagacccugaccgccaaguuccacuucguggaccucgccggcuccgagcgccugaagcggaccggggccacgggcgagcgcgcgaaggagggcaucagcaucaacugcgggcugcucgcccugggcaacgugaucuccgcccugggggaccagagcaagaaggucgugcacgugcccuaccgggacagcaagcucacccgccugcugcaggacucccucggcgggaacagccagaccaucaugaucgccugcgucucccccagcgaccgggacuucauggagacccugaacacgcugaaguacgccaaccgcgcgcggaacaucaagaacaaggugguggucaaccaggacaagaccucccagcagaucagcgcccuccgcgccgagaucgcccgccugcagauggagcugauggaguacaaggccggcaagcgggugaucggcgaggacggggcggagggcuacuccgaccucuuccgcgagaacgccaugcugcagaaggagaacggggcccugcggcuccgcgugaaggccaugcaggaggcgaucgacgccaucaacaaccgggucacccagcugaugagccaggaggccaaccugcuccuggccaaggccggcgacgggaacgaggcgaucggcgcccugauccagaacuacauccgcgagaucgaggagcuccggaccaagcugcuggaguccgaggccaugaacgagagccuccgccggucccugagccgcgccuccgcccggagccccuacucccugggcgcgagcccggccgcccccgccuucgggggcucccccgccagcuccauggaggacgcgagcgaggugauccgccgggccaagcaggaccucgagcgccugaagaagaaggagguccggcagcgccgcaagagccccgagaaggaggccuucaagaagcgggccaagcugcagcaggagaacuccgaggagacggacgagaacgaggcggaggaggaggaggaggagcgggacgagagcgggugcgaggaggaggagggccgcgaggacgaggacgaggacuccggcagcgaggagucccugguggacagcgacuccgacccggaggagaaggaggugaacuuccaggccgaccucgccgaccugaccugcgagaucgagaucaagcagaagcugaucgacgagcucgagaacagccagcgccggcugcagacccugaagcaccaguacgaggagaagcucauccugcugcagaacaagauccgcgacacccagcucgagcgggaccgcguccugcagaaccuguccacgauggagugcuacaccgaggagaaggccaacaagaucaaggccgacuacgagaagcggcuccgcgagaugaaccgggaccugcagaagcugcaggcggcccagaaggagcacgcccgccuccugaagaaccagagccgguacgagcgcgagcugaagaagcuccaggccgagguggccgagaugaagaaggcgaagguggcccugaugaagcagaugcgggaggagcagcagcgccggcgccuggucgagaccaagcggaaccgcgagaucgcccagcucaagaaggagcagcggcgccaggaguuccagauccgggcccuggagucccagaagcgccagcaggagauggugcugcggcgcaagacccaggaggugagcgcccuccgccggcuggcgaagcccauguccgagcgcgucgccgggcgggccggccugaagccgcccaugcucgacagcggggccgagguguccgcgagcaccacguccagcgaggccgagagcggcgcccgcuccgugagcuccaucguccggcaguggaaccgcaagaucaaccacuuccugggggaccaccccgcccccaccgugaacggcacccggcccgcccgcaagaaguuccagaagaagggcgcgagccaguccuucagcaaggccgcccggcugaaguggcagucccucgagcgccggaucaucgacaucgugaugcagcgcaugaccaucgucaaccuggaggccgacauggagcggcugaucaagaagcgcgaggagcuguuccugcugcaggaggcccuccggcgcaagcgggagcgccugcaggcggagagccccgaggaggagaaggggcugcaggagcucgccgaggagaucgaggugcuggccgccaacaucgacuacaucaacgacggcaucacggacugccaggccaccaucgugcagcuggaggagaccaaggaggagcucgacuccaccgacacgagcgucgugaucuccagcugcucccuggcggaggcccggcugcuccuggacaacuuccugaaggccagcaucgacaaggggcuccagguggcccagaaggaggcccagauccgccugcuggagggccgccuccggcagaccgacauggcgggguccagccagaaccaccuccugcucgacgcccugcgcgagaaggccgaggcccacccggagcugcaggcgcucaucuacaacguccagcaggagaacggcuacgccuccaccgacgaggagaucagcgaguucuccgagggcagcuucagccaguccuucaccaugaaggggagcacgucccacgacgacuucaaguucaagagcgagcccaagcuguccgcccagaugaaggccgugagcgccgagugccugggcccgccccucgacaucuccaccaagaacaucaccaagagccuggcgucccugguggagaucaaggaggacggggucggcuucagcgugcgggaccccuacuaccgcgaccgggugucccgcaccgucagccuccccacgcggggguccaccuucccccgccagagccgggccaccgagaccuccccgcugacgcgccgcaagagcuacgaccggggccagcccauccgguccaccgacgugggcuucaccccgcccagcuccccgcccacccgcccccggaacgaccgcaacguguucagccggcugacgagcaaccagucccaggggagcgcccucgacaaguccgacgacagcgacuccagccuguccgagguccugcgcggcaucaucagccccgucgggggcgccaagggggcccggaccgcgccccuccagugcguguccauggccgagggccacaccaagcccauccugugccuggacgccaccgacgagcuccuguucacgggcagcaaggaccgcuccugcaagauguggaaccuggugaccgggcaggagaucgccgcccucaagggccaccccaacaacguggugagcaucaaguacugcucccacagcgggcuggucuucuccgugagcaccuccuacaucaaggugugggacauccgggacagcgcgaagugcauccgcacccugacguccagcggccaggucaucagcggcgacgccugcgccgccaccuccacccgcgcgaucaccagcgcccagggggagcaccagaucaaccagaucgcccucucccccagcggcacgaugcuguacgccgccuccgggaacgcggugcggaucugggagcugagccgcuuccagccggugggcaagcucaccgggcacaucggccccgucaugugccugaccgugacccagaccgccucccagcacgaccugguggucacgggcagcaaggaccacuacgugaagauguucgagcucggggagugcgugaccggcaccaucgggcccacccacaacuucgagcccccgcacuacgacggcaucgagugccuggccauccagggggacauccuguucuccggcagccgggacaacggcaucaagaagugggaccucgaccagcaggagcugauccagcagauccccaacgcccacaaggacugggucugcgcccuggcguucauccccgggcgccccaugcuccuguccgccugccgggccggcgugaucaagguguggaacgucgacaacuucacgccgaucggggagaucaagggccacgacagccccaucaacgccaucugcaccaacgccaagcacaucuucaccgcguccagcgacugccgcgugaagcuguggaacuacguccccgggcucacccccugccugccgcggcgcgugcuggccaucaagggccgggccacgacccugcccuga

SEQ ID NO: 31995 - RNA, 1794 nt, Artificial Sequence
  derived and/or modified sequence opt1 from KIF22__Homo_sapiens__NP_001243199
auggacagcugcucccuggagaucgccaacuggcgcaaccaccaggagacccucaaguaccaguucgacgccuucuacggcgagcggagcacccagcaggacaucuacgcgggguccgugcagcccauccugcgccaccuccuggagggccagaacgccagcguccuggccuacgggccgacgggcgccgggaagacccacaccaugcugggcucccccgagcagcccggcgugaucccccgggcccucauggaccugcugcagcucacccgcgaggagggggcggagggccggccgugggcccugagcgugacgauguccuaccuggagaucuaccaggagaagguccucgaccugcuggaccccgccagcggggaccucgugauccgcgaggacugccggggcaacauccugauccccgggcugucccagaagcccaucagcuccuucgccgacuucgagcgccacuuccucccggcgagccggaaccgcaccgugggcgccacccggcugaaccagcgcuccagccggucccacgccguccugcucgugaagguggaccagcgcgagcggcuggcccccuuccgccagcgggagggcaagcuguaccucaucgaccuggccgggagcgaggacaaccgccggaccggcaacaaggggcugcgccucaaggaguccggcgcgaucaacacgagccuguucguccugggcaaggugguggacgcccucaaccaggggcugccccggguccccuaccgcgacuccaagcugacccgccuccugcaggacagccugggcgggagcgcccacuccauccucaucgccaacaucgccccggagcggcgcuucuaccuggacaccgugagcgcgcugaacuucgccgcccgguccaaggaggugaucaaccgccccuucaccaacgagagccuccagccccacgcccugggccccgucaagcugucccagaaggagcuccuggggccgcccgaggccaagcgggcgcgcggccccgaggaggaggagaucggcagccccgagccgauggccgcccccgccuccgccagccagaagcugagcccccuccagaagcuguccuccauggaccccgcgaugcuggagcggcuccugagccuggaccgccugcucgccucccaggggagccagggcgccccgcugcuguccacgcccaagcgggagcgcauggugcucaugaagaccguggaggagaaggaccuggagaucgagcggcugaagaccaagcagaaggagcucgaggccaagaugcuggcgcagaaggccgaggagaaggagaaccacugccccaccaugcugcgcccccucagccaccggacggucaccggggccaagccgcugaagaaggccguggugaugccccugcagcucauccaggagcaggccgcgucccccaacgccgagauccacauccugaagaacaagggccgcaagcggaagcuggagagccucgacgcccuggagccggaggagaaggccgaggacugcugggagcugcagaucucccccgagcuccuggcccacgggcgccagaagauccuggaccuccugaacgagggcagcgcgcgggaccugcgcagccuccagcggaucggccccaagaaggcccagcugaucgucggguggcgcgagcugcacggccccuucucccagguggaggaccucgagcgcguggaggggaucaccggcaagcagauggagagcuuccugaaggccaacauccuggggcucgccgccggccagcggugcggcgcguccuga

SEQ ID NO: 31996 - RNA, 2571 nt, Artificial Sequence
  derived and/or modified sequence opt1 from KIF23__Homo_sapiens__NP_004847
augaaguccgcccgcgccaagacgccccggaagccgaccgugaagaagggcagccagaccaaccugaaggaccccgucgggguguacugccgcgugcggccccucggcuuccccgaccaggagugcugcaucgaggucaucaacaacaccaccgugcagcugcacaccccggagggguaccgccugaaccggaacggcgacuacaaggagacgcaguacagcuucaagcaggucuucgggacccacaccacccagaaggagcuguucgacgugguggcgaacccccuggugaacgaccugauccacggcaagaacggccuccuguucacguacggggucaccggcuccgggaagacccacaccaugacgggcagccccggggagggcggccugcucccccgcugccuggacaugaucuucaacuccaucgggagcuuccaggccaagcgguacguguucaaguccaacgaccgcaacagcauggacauccagugcgagguggacgcccugcucgagcggcagaagcgcgaggccaugccgaaccccaagaccuccagcuccaagcggcaggucgaccccgaguucgccgacaugaucaccgugcaggaguucugcaaggcggaggagguggacgaggacagcgucuacggcguguucguguccuacaucgagaucuacaacaacuacaucuacgaccugcuggaggagguccccuucgacccgaucaagcccaagccgccccagagcaagcuccugcgcgaggacaagaaccacaacauguacguggccgggugcaccgagguggaggucaaguccacggaggaggccuucgagguguucuggcggggccagaagaagcgccggaucgccaacacccaccugaaccgcgagagcucccggagccacuccguguucaacaucaagcucguccaggcgccccuggacgccgacggcgacaacgugcugcaggagaaggagcagaucaccaucagccagcucagccuggucgaccuggccggguccgagcgcaccaaccggacgcgcgccgagggcaaccggcuccgcgaggccgggaacaucaaccagagccugaugacccugcggaccugcauggacgugcuccgggagaaccagauguacggcaccaacaagauggugcccuaccgcgacuccaagcugacgcaccuguucaagaacuacuucgacggggagggcaagguccggaugaucgugugcgugaaccccaaggcggaggacuacgaggagaaccuccaggucaugcgcuucgccgaggugacccaggagguggaggucgcccggcccguggacaaggccaucugcggccugaccccggggcgccgguaccgcaaccagccccggggccccguggggaacgagccccuggucaccgacguggugcuccagagcuucccgccccugcccuccugcgagauccuggacaucaacgacgagcagacgcucccccgccugaucgaggcccuggagaagcggcacaaccuccgccagaugaugaucgacgaguucaacaagcagagcaacgcguucaaggcccugcugcaggaguucgacaacgccguccucuccaaggagaaccacaugcagggcaagcugaacgagaaggagaagaugaucagcgggcagaagcuggagaucgagcggcucgagaagaagaacaagacccuggaguacaagaucgagauccuggagaagaccaccacgaucuacgaggaggacaagcgcaaccuccagcaggagcuggagacccagaaccagaagcugcagcggcaguucuccgacaagcgccggcuggaggcccgccuccagggcauggugaccgagaccacgaugaagugggagaaggagugcgagcggcgcguggccgcgaagcagcuggagaugcagaacaagcugugggucaaggacgagaagcucaagcagcugaaggccaucgugaccgagccgaagaccgagaagcccgagcgccccagccgggagcgcgaccgggagaaggugacccagcgcuccgucagcccgucccccgugccccuccucuuccagcccgaccagaacgccccgcccauccggcugcgccaccggcgcagccgguccgccggcgaccgcuggguggaccacaagcccgccagcaacaugcagaccgagacggucaugcagccccacgugccgcacgcgaucaccguguccgucgccaacgagaaggcccuggccaagugcgagaaguacaugcucacccaccaggagcuggcgagcgacggggagaucgagaccaagcugaucaagggcgacaucuacaagacgcgcgggggcgggcaguccgugcaguucaccgacaucgagacccucaagcaggagagccccaacggcagccgcaagcggcgcuccagcaccguggcccccgcccagcccgacggcgccgaguccgaguggacggacgucgagacccggugcagcguggccguggagaugcgcgcggggucccagcugggcccgggguaccagcaccacgcccagcccaagcggaagaagcccuga

SEQ ID NO: 31997 - RNA, 4107 nt, Artificial Sequence
  derived and/or modified sequence opt1 from KIF24__Homo_sapiens__NP_919289
auggccagcuggcuguacgagugccucugcgaggccgagcuggcgcaguacuacucccacuucaccgcccugggccuccagaagaucgacgagcuggccaagaucaccaugaaggacuacagcaagcugggggugcacgacaugaacgaccgcaagcgccucuuccagcugaucaagaucaucaagaucaugcaggaggaggacaaggccgucuccauccccgagcgccaccuccagacgagcucccuccggaucaagagccaggagcugcgcuccggcccgcggcgccagcugaacuucgacagccccgccgacaacaaggaccggaacgcguccaacgacggguucgagaugugcagccucuccgacuucagcgccaacgagcagaaguccaccuaccugaaggugcuggagcacaugcuccccgacgacagccaguaccacaccaagaccggcauccugaacgccacggccggggacuccuacgugcagaccgagaucagcaccucccuguucagccccaacuaccucuccgcgauccugggcgacugcgacaucccgaucauccagcgcaucagccacgucagcggcuacaacuacgggaucccccacuccugcauccggcagaacaccagcgagaagcagaaccccuggacggagauggagaagauccgcgugugcgugcggaagcgcccccugggcaugcgggagguccgccgcggggagaucaacaucaucaccguggaggacaaggagacccuccuggugcacgagaagaaggaggccgucgaccugacccaguacauccuccagcacguguucuacuucgacgagguguucggcgaggccugcacgaaccaggacgucuacaugaagaccacccacccgcugauccagcacaucuucaacgggggcaacgcgaccugcuucgccuacggccagacgggggcgggcaagaccuacaccaugaucgggacccacgagaaccccggccuguacgcccucgccgccaaggacaucuuccggcagcuggaggugucccagccccggaagcaccuguucguguggaucagcuucuacgagaucuacugcggccagcucuacgaccugcugaaccgccggaagcgccucuucgcccgggaggacuccaagcacaugguccagaucguggggcugcaggagcugcaggucgacagcgucgagcuccugcuggaggugauccucaagggcuccaaggagcgcagcacgggggcgaccggcgugaacgccgacuccagccgcucccacgccgucauccagauccagaucaaggacagcgccaagcggaccuucgggcgcaucuccuucaucgaccuggccggcagcgagcgggccgccgacgcccgggacuccgaccggcagaccaagauggagggcgccgagaucaaccagagccugcuggcccugaaggagugcauccgcgcgcuggaccaggagcacacgcacacccccuuccggcaguccaagcucacccaggugcugaaggacagcuucaucgggaacgccaagaccugcaugaucgccaacaucuccccgagccacguggccacggagcacacccugaacacccuccgcuacgcggaccgggugaaggagcugaagaagggcaucaagugcugcaccagcgugacgucccgcaaccggaccagcgggaacuccagccccaagcgcauccaguccagccccggcgcccuguccgaggacaagugcagccccaagaaggucaagcugggguuccagcagucccucaccguggccgccccgggcagcacccggggcaaggugcacccccugacgucccacccgcccaacauccccuucaccagcgcccccaaggucuccgggaagcgcggcgggagccggggcucccccagccaggagugggugauccacgcgucccccgugaaggggaccguccgcagcggccacguggccaagaagaagccggaggagagcgcgccccugugcuccgagaagaaccggaugggcaacaagaccgugcucgggugggagagccgcgccuccggccccggggagggccugguccggggcaagcugagcaccaagugcaagaaggugcagacggugcagcccguccagaagcagcucgugucccgcguggagcugagcuucgggaacgcccaccaccgcgccgaguacucccaggacagccagcggggcaccccggcccgccccgccuccgaggccuggaccaacaucccgccccaccagaaggagcgggaggagcaccuccgcuucuaccaccagcaguuccagcagccgccccugcugcagcagaagcugaaguaccagccccucaagcggagccugcgccaguaccggccgcccgaggggcagcugaccaacgagacgccgccccucuuccacuccuacagcgagaaccacgacggcgcccaggucgaggagcuggacgacuccgacuucagcgaggacuccuucagccacaucuccagccagcgcgcgaccaagcagcggaacacccuggagaacuccgaggacagcuucuuccuccaccagaccugggggcagggccccgagaagcaggucgccgagcgccagcagagccuguucuccagcccccggacgggcgacaagaaggaccugaccaaguccuggguggacagccgcgaccccaucaaccaccggcgcgccgcccucgaccacuccugcagccccuccaaggggcccguggacuggagccgggagaacuccaccagcuccggccccagcccccgcgacucccuggcggagaagcccuacugcagccagguggacuucaucuaccggcaggagcgcgggggcggguccagcuucgaccugcggaaggacgccucccagagcgagguguccggcgagaacgagggcaaccucccgagccccgaggaggacggguucaccaucagccugucccacgucgccgugcccggcagccccgaccagcgcgacacggugaccaccccgcugcgggaggucuccgccgacgggcccauccaggugaccagcacggugaagaacggccacgccguccccggggaggacccccgcggccagcucggcacccacgcggaguacgccuccgggcugaugagcccgcugaccaugucccuccuggagaaccccgacaacgagggcagcccgcccuccgagcagcuggugcaggacggggccacccacagccucguggccgaguccacgggcgggcccgucgugagccacaccgugcccuccggcgaccaggaggccgcgcugcccgucagcuccgccacccgccaccuguggcucagcuccagcccgcccgacaacaagcccggcggggaccugcccgcccuguccccgagccccauccggcagcaccccgccgacaagcuccccagccgcgaggccgaccugggcgaggcgugccagucccgggagaccgugcuguucagccacgagcacaugggguccgagcaguacgacgccgacgccgaggagacgggccucgacggcagcuggggguucccgggcaagcccuucaccaccauccacaugggggugccccacuccggccccacccugacgccgcgcaccgggagcuccgacgucgccgaccagcugugggcgcaggagcggaagcaccccacccgccucggcuggcaggaguucggccugagcaccgaccccaucaagcugcccugcaacuccgagaacgugacguggcucaagccgcggcccaucagccgcugccuggcccggcccuccagcccccuggugccguccugcagccccaagaccgccgggacccuccgccagcccacccuggagcaggcccagcaggucgugauccgggcccaccaggagcagcuggacgagauggcggagcucggcuucaaggaggagacgcugaugucccagcuggccagcaacgacuucgaggacuucgugacccagcucgacgagaucaugguccugaaguccaagugcauccagagccugcgcucccagcuccagcuguaccugaccugccacgggcccaccgccgccccggagggcaccgugcccagcuga

SEQ ID NO: 31998 - RNA, 999 nt, Artificial Sequence
  derived and/or modified sequence opt1 from KIF25__Homo_sapiens__NP_005346
augaccuggaccagcggccagcugcagcgcgagaagcaggcccggcccggguccggcgccgugcucgcguucccggacgacaaggaccugcgcgucuacgggcccgccgagagccaguccgccguguucggcgacgugugcccccugcucacgagccugcuggacggguacaacgucugcgugauggccuacggccagaccggcuccggcaagagcuacaccaugcucgggcggcacuccgacgacgggcccgugcugccgcuggacccccagagcgaccucggcaucaucccccgcgucgccgaggagcuguuccggcugauccucgagaacaccucccgcagccccaagguggagguguccaucgucgagguguacaacaacgacaucuucgaccugcuggcgaaggacagcaucgccgccguguccggggucaagcgggagguggugacggccaaggacggccgcaccgaggucgcgcuccuggccagcgaggccgugggcuccgccagcaagcugauggagcucgugcacgggggccugcagcugcgggccaagcacccgacccucguccacgcggacuccagccgcucccaccugaucaucaccgugacgcugaccaccgccagcugcagcgacuccaccgccgaccaggccugcagcgccacgcucccccgggagcagaccgaggcggggcgcgccggccggucccgccgggccagccagggcgcccuggcgccccagcuggugcccgggaacccggccggccacgccgagcagguccaggcccgccuccagcugguggacuccgccgggagcgagugcgugggcggggacgccaagcugcucgucauccugugcaucucccccagccagcggcaccuggcgcagacccuccagggccugggcuucgggauccgcgcccgccaggugcagcggggccccgcccggaagaagcccccguccagccagaccgaggggaagcgccgccccgacuga

SEQ ID NO: 31999 - RNA, 5649 nt, Artificial Sequence
  derived and/or modified sequence opt1 from KIF26A__Homo_sapiens__NP_056471
auggugggccgcggggugccccugugcgccgcccagcccgccguggccgagggcgggcccgcccgggagccgccgccccugcuggaggugagcccccgcaagcggcugcccgccggccccgaccaggaccccugcgggagccgccccgcccccgagggcgccggcgccgggcccgagcagggccacagcgccgggggcgggggcuggugccggcacugccacaccaagcucgucgagcugaagcgccaggccuggaagcugguguccggccccgggaccacccugcgggaccccugccugagcgcccugcugcuggacaagcugcccgcccccggcgcccuccccgccugccgccccgaggccgagcggcgcugcgacgugugcgccacccaccuccagcagcugacccgggaggccaugcaccuccugcaggcccccgccucccacgaggaccuggacgcgccccacgggggccccagccucgccccgcccuccaccacgaccagcucccgcgacacccccggccccgccgggcccgccggccggcagcccgggcgcgccggccccgaccggaccaaggggcuggccuggagccccggccccuccguccaggugagcguggcccccgccggccucgggggcgcccucuccacggucaccauccaggcccagcagugccuggaggggauguggagcgugucccgcgugaacagcuuccugccgcccgccugccucgccgaggccgccgucgccgcgguggccguggccgacaccguccgggagugcccgcccguggccggccccgacgggcuguccaaggccuggggccgcggcggggugugcaccagcgcgcuggucacgcccacccccggcuccgucgggggcagcaccgggcccagcgccgccgccuccuucuucauccgggccaugcagaagcucagccuggcguccaagcgcaagaagccgcacccgccgcccccgcccgccacccggggcacgagcaccuaccccaccgacuucuccggcgugcugcagcucuggcccccgcccgcgccgcccugccugcugcgcgccgccagcaagaccaaggacaaccccggguccaucggcaaggucaaggugaugcuccgcaucuggcccgcgcagggggcccagcggagcgccgaggccauguccuuccugaagguggacccccgcaagaagcaggucauccuguacgaccccgcggccggcccgcccggcagcgccgggccccggcgcgccgccacggcggccgugccgaagauguucgccuucgacgccgucuucccccaggacuccgagcaggccgaggugugcagcggcaccguggcggacguccuccaguccguggugagcggggccgacggcugcaucuucuccuucgggcacaugagccugggcaaguccuacaccaugaucggcaaggacagcagcccccagucccuggggaucguccccugcgccaucagcuggcuguuccggcugaucgaggagcgccgggagcgcaccggcacgcgguucuccgugcgcgugagcgccgucgaggugugcgggcgggaccagucccugcgcgaccuccuggccgagguggcgccgggcagccugcaggacacccagucccccggggucuaccuccgggaggaccccgugugcggcgcccagcugcagaaccagagcgagcugcgcgcccccaccgccgagaaggcggccuucuaccucgacgccgcccuggccgcgcgguccaccagccgcgccggcugcggggaggacgcccggcgcuccagccacaugcuguucacgcugcacguguaccaguaccggauggagaagugcggccgcgggggcauguccgggggccgcagccggcuccaccugaucgaccugggcuccugcgaggccgccgcggggcgcgccggcgaggccgccgggggcccgcucugccugagccuguccgcccucgggagcgucauccuggcgcuggugaacggcgccaagcacgugcccuaccgggaccaccgccucaccaugcugcugcgggagucccucgccaccgccggcugccgcaccacgaugaucgcccacgucagcgacgcgcccgcccagcacgccgagacccugagcaccgugcagcuggccgcgcggauccaccgccuccggcgcaagaaggccaaguacgccuccagcuccagcgggggcgaguccagcugcgaggaggggcgggcccgccggcccccgcaccuccgccccuuccacccccggaccguggcccuggaccccgaccgcacgccgcccugccuccccggcgaccccgacuacuccagcuccagcgagcaguccugcgacaccgucaucuacgugggccccgggggcgcggcccugagcgaccgggagcugaccgacaacgaggggccgcccgacuucgugcccaucaucccggcccucucccgccaccggcccagcaagggcccccgcgacgccgaccacuuccggugcuccaccuucgccgagcugcaggagcgccuggagugcauggacgggaacgagggccccagcggcgggccgggcgggaccgacggcgcgcaggccucccccgcccgcgggggccggaagcccagcccgcccgaggccgccuccccgcgcaaggcggucggcacgcccauggccgccagcaccccgcgggggagcuccggccccgacacccaccaggggacccccgagcccugcaaggccaucguguggggcgaccagcgcgaggacagcuccgcguggccggagcuccuggugcccgagaaggccgccgucagcgggggccggcgcccccugcccuccccggcgccgccgccgccccagcuccuggaggccugccgggcgcccgaggagcccggcgggggcgggacggacggcguggcccgcaccccgcccgugggcaugagcgggcaggucgccggcucccccaugcugcccggggcgaccugcccccggcucgccgcgggcagccgcugccccgagcgggggcugcugaccacgaccgugacccuccagcgccccguggagcugaacggcgaggacgagcuggucuucaccgugguggaggagcucucccugggcgcccuggccggggccggccggcccacgagccucgccuccuucgacagcgacugcucccugcgcgcgcuggccagcgggucccggcccgucagcaucaucuccagcaucaacgacgaguucgacgccuacaccucccaggcccccgagggcgggccccucgagggcgcggccugggccggcagcagccacggguccagcaucuccagcuggcuguccgaggugagcgugugcaccgccgacucccgcgaccccaccccgcagccccgguucagccccgacucccuggccggccucgaccccgggggcccgcccgcgcuggacgggagccugggcgacggcuccagcggguuccucggccccgaccgccccgacuccccggggcccacguggggccccugccccggggaggucgccgccguggccccgagccggcccggccgcgagccccaggccggccccucccgcugggcgagcgccgcccagaccauccacuccagccugccgcggaagccccgcaccgccuccgccaccacgcggguggggugcgcgcgccugggccaguccccgcccgggcggggcggccucuucgaggacccguggcugcugcgcgucggggagugcgacacccaggccgccagcgccggccgggcccccucccccacccucgggagcccccgccugccggaggcccaggugaugcuggccugcgcccagcggguggucgacggcugcgagguggccgcgcgcgccgcccggcgccccgaggccguggcccggaucccgccccuccgccgcggggccaccacgcugggcgucaccacccccgccguguccuggggcgacgcccccaccgagguggucgccugcagcgggucccugaaggccagccccacguccaagaagggccucgcgcccaaggccggguuccugccccggcccagcggcgccgcgccgcccgcgccgcccacccggaaguccagccuggagcagcgcuccagccccgcguccgccccgccccacgccgugaaccccgcccgggucggggcggccgccgugcuccgcggcgaggaggagccccggcccagcucccgcgccgaccacagcgugccccgcgccaccuccagccugaaggcgcgggccuccaaggucgaggccgcccaccgccuggccggccacgcgagccucgagcgguacgaggggcuggcccacagcuccagcaagggccgcgaggcccccgggcggcccccgcgcgccgugcccaagcugggcgugccgcccuccagcccgacccacgggcccgcccccgcgugccgguccggcgccgccaaggccgucggcgcgcccaagccgcccgucgggggcgggaagggccgcgggcucguggccggcggcagccgggcccuggggcccuccgugaagcugagcacggccuccgugaccggccgcagccccgggggccccguggccggcccccgggcggcgccccgcgccgggccguccgucggcgccaaggccgggcggggcaccgugauggggaccaagcaggcgcuccgcgccgcccacagccgggugcacgagcuguccgccagcggcgcccccggccgcgggggcuccagcuggggguccgcggacagcgacuccggccacgacagcggggucaacgugggcgaggagcggccgcccacgggcccggcccugcccagccccuacuccaaggugaccgcgccccgccggccgcagcgcuacagcuccgggcacggcagcgacaacuccagcguccucuccggggagcugccgcccgccaugggccgcaccgcccuguuccaccacagcgggggcuccagcggcuacgagucccuccggcgcgacagcgaggcgaccggguccgccagcuccgcccccgacagcauguccgagagcggcgccgcgagcccgggggcccggacccgcucccucaagagccccaagaagcgggccacgggccugcagcgccggcgccucauccccgcgccccugccggacaccaccgcccugggccggaagcccucccuccccgggcaguggguggaccugcccccgccccuggcgggcagccucaaggagcccuucgagaucaagguguacgagaucgacgacgucgagcgccugcagcggccccgcccgacgccccgggaggcccccacgcaggggcuggccugcguguccacccgccuccggcuggccgagcgccggcagcagcgccugcgggaggugcaggccaagcacaagcaccucugcgaggagcuggcggagacccagggccgccugaugcuggagccggggcgguggcucgagcaguucgaggucgaccccgagcuggagcccgagagcgccgaguaccuggccgcccucgagcgcgccaccgcggcccuggagcagugcgugaaccugugcaaggcccacgugaugauggucacgugcuucgacaucuccguggccgcgagcgccgccauccccggcccgcaggagguggacgucuga

SEQ ID NO: 32000 - RNA, 6327 nt, Artificial Sequence
  derived and/or modified sequence opt1 from KIF26B__Homo_sapiens__NP_060482
augaacagcguggccggcaacaaggagcgccuggccguguccacccgggggaagaaguacggcgugaacgaggugugcagccccaccaagcccgcggcccccuucucccccgagagcugguaccgcaaggccuacgaggagucccgggccgggagccgccccacccccgagggcgccggguccgcccucggcagcuccggcacccccagccccggguccggcaccagcucccccagcuccuucaccgggagccccggccccgccucccccgggaucggcaccagcucccccggcagccucggcgggagccccggguucgggaccggcucccccgggagcggcuccgggggcgggagcucccccggcagcgaccggggcgucuggugcgagaacugcaacgcccgccugguggagcucaagcggcaggcccugcgccugcuccugcccgggcccuuccccggcaaggaccccgcguucuccgccgugauccacgacaagcugcagguccccaacaccauccggaaggccuggaacgaccgcgacaaccggugcgacaucugcgccacccaccucaaccagcugaagcaggaggccauccagauggugcugacccucgagcaggcggccgggagcgagcacuacgacgccucccccugcuccccgccgccccucuccaacauccccacccuggugggcagccgccacgucgggggccuccagcagccccgggacugggccuucgugcccgcccccugcgcgaccuccaacuacaccggcuucgccaacaagcacgggagcaagcccuccagccugggcguguccaacggggccgagaagaaguccggcucccccacgcaccaggccaaggucagccugcagauggccaccagccccuccaacgggaacauccucaacagcguggcgauccaggcccaccaguaccuggacggcaccuggucccugagccgcaccaacggcgugacgcucuaccccuaccagaucucccagcugaugaccgagagcucccgggaggggcugaccgaggccguccucaaccgcuacaacgccgacaagcccagcgccugcuccgugcccgcgagccagggcuccugcguggccagcgagaccuccacggggaccagcgucgccgccuccuucuucgcgcgggccgcccagaagcugaaccugagcuccaagaagaagaagcaccgccccagcaccagcuccgccgccgagccgccccucuucgcgaccagcuucuccggcauccugcagacgagcccgccgcccgcgccgcccugccugcuccgggccgugaacaaggugaaggacacccccggccuggggaaggucaaggugaugcugcgcaucugcuccacccucgcccgggacaccuccgaguccagcuccuuccugaagguggacccccgcaagaagcagaucacgcuguacgacccccugaccugcggcgggcagaacgccuuccagaagcgcggcaaccaggugccgcccaagauguucgcguucgacgccguguucccgcaggacgccagccaggccgaggucugcgccgggaccguggcggaggugauccaguccgucgugaacggcgccgacggcugcguguucugcuucgggcacgccaagcugggcaagagcuacaccaugaucgggaaggacgacuccaugcagaaccugggcaucauccccugcgccaucagcuggcuguucaagcugaucaacgagcggaaggagaagacgggggcgcgcuucuccguccgggugagcgccguggaggucuggggcaaggaggagaaccugcgcgaccuccuguccgagguggccaccggcagccugcaggacgggcagucccccggcguguaccucugcgaggaccccaucugcgggacccagcugcagaaccagagcgagcugcgggccccgaccgccgagaaggcggccuucuuccucgacgccgccaucgccagccgccggucccaccagcaggacugcgacgaggacgaccaccgcaacagccacgucuucuucacgcugcacaucuaccaguaccggauggagaaguccggcaagggcgggaugagcggcgggcgcucccggcugcaccugaucgaccucggcagcugcgugaaggcgcuguccaagaaccgcgagggcggcagcgggcugugccucucccugagcgcccugggcaacgugauccucgcccuggucaacggcuccaagcacauccccuacaaggagagcaagcuggccaugcuccugcgggagucccuggggaacaugaacugccgcaccaccaugaucgcccacaucagcgcggccgugggcuccuacgccgagacccucagcaccauccagaucgccucccgggugcugcgcaugaagaagaagaagacgaaguacaccagcuccagcagcgggggcgaguccagcugcgaggagggccggaugcgccggcccacccagcugcgccccuuccacacccgcgcgacggucgaccccgacuuccccaucgcccaccucuccagcgaccccgacuacuccagcuccagcgagcaguccugcgacaccgugaucuacaucgggccgaacggcaccgcccugagcgacaaggagcugaccgacaacgaggggccgcccgacuucgugcccaucgucccggcccuccagaagacgcggggcgacucccgccccgccgaggcgggggaggccgccgccggcaagagcgagcgggacugccugaagugcaacaccuucgccgagcugcaggagcgccucgacugcaucgacggcuccgaggagcccagcuccuuccccuucgaggagcugccggcgcaguucgggcccgagcaggccagccggggcccccgccugucccaggccgccggggccagcccccucuccgagagcgacaaggaggacaacggcagcgaggggcagcugaccaaccgggagggcccggagcugcccgcguccaagaugcagcgcagccacucccccgugcccgccgccgccccggcccacagccccucccccgcgagcccccgguccgugccgggcagcuccagccagcacuccgccagcccccucguccagucccccagccugcaguccagccgcgagucccugaacagcugcggguucguggagggcaagccccggccgauggggagcccccgccucggcaucgccagccugagcaagaccuccgaguacaagccgcccagcuccccgagccagcggugcaagguguacacgcagaaggggguccugcccucccccgccccgcugccgcccagcuccaaggacagcggcguggcgucccgcgagagccugcugcagcccgaggugcggaccccgcccgucggcaugagcccccaggugcucaagaaguccauguccgccgggagcgagggcuuccccgagaccccgguggacgacgagcagcaggccgccacccccuccgagagcaagaaggagauccuguccacgaccauggucaccgugcagcagccccuggagcucaacggggaggacgagcugguguucacccuggucgaggagcucacgaucagcggcgugcuggacuccggccgccccaccagcaucaucagcuucaacuccgacugcagcgcccgggcgcuggccuccgggagccgcccgguguccaucaucagcuccaucagcgaggaccucgagugcuacuccagcaccgcccccgucuccgaggugagcaucacccaguuccugccccugcccaagaugucccucgacgagaaggcccaggacgccggcagccggcgcuccagcaucuccagcuggcugagcgagauguccgcggggagcgagggcgagcaguccugccacagcuucaucgcccagacgugcuucgggcacggcgaggccauggccgagccgguggccuccgaguucgucagcucccugcagaacaccgcgguggugugccgggagaagcccaaggccagccccgacaaccuccugauccuguccgagaugggcgacgacagcuucaacaaggccgcccccaucaaggggugcaagaucuccaccgucagcaaggcgauggugaccaucuccaacacggccaaccucagcuccugcgagggcuacaucccgaugaagaccaacaucaccguguaccccugcaucgccaugagcccccgcaacauccaggagcccgaggccccgaccgccacgcccaaggcggggcccacccuggcccagucccgcgagagcaaggagaacuccgccaagaaggagaugaaguucgaggaccccuggcugaagcgggaggaggaggucaagaaggagaccgcccacccgaacgaggagggcaugaugcgcugcgagaccgccacggggcccagcaacgcggagacccgggccgagcaggagcaggacggcaagcccagcccgggcgaccgccucuccagcuccagcggggagguguccgccagccccgugaccgacaacuuccggcgcgucguggacggcugcgagauggcccugcccgggcuggccacccagucccccguccacccgaacaagagcgugaaguccagcucccucccccgggcguuccagaaggccagccgccaggaggagcccgacucccugagcuacuacugcgccgccgagaccaacggcgugggggcggccuccggcacgcccccgagcaaggccacccuggagggcaaggucgccucccccaagcacugcgugcucgcccggcccaaggggacgccgccccugccgcccgugcgcaagagcucccuggaccagaagaaccgggcgagcccccagcacagcgccuccggcagcgggaccuccagcccccucaaccagcccgccgccuuccccgccggccugcccgacgagccguccgggaagacgaaggacgcgagcuccagcuccaagcuguucagcgccaagcucgagcagcuggccucccgcagcaacucccugggccgggccaccgucagccacuacgagugccucucccuggagcgcgccgagagccuguccagcguguccagccggcuccacgcgggcaaggacgggaccaugccccgcgccggccggagccuggggcgcuccgccggcaccuccccgcccuccagcggcgccucccccaaggccgggcagagcaagaucuccgcggugagccggcugcuccuggccagcccccgcgcccgcggccccagcgccuccacgaccaagacccugagcuucuccaccaagagccucccgcaggcggucgggcagggcuccagcagcccgcccgggggcaagcacacgcccuggagcacccagucccugagccggaaccgcagcuccggccuggccagcaagcucccgcugcgggccguguccgggcgcaucagcgagcugcuccagggcggggccggcgcccgggggcugcagcugcgcgcgggccccgaggccgaggcccggggcggggcccucgccgaggacgagcccgcggccgcccaccuccugcccuccccguacagcaagaucacgccgccccgccggccccaccgcugcuccagcggccacggguccgacaacagcuccgugcucagcggcgagcugccgcccgccauggggaagaccgcccuguucuaccacuccggcggcagcuccggguacgagagcgucaugcgggacuccgaggcgacgggcagcgccuccagcgcccaggacagcaccuccgagaacagcuccagcgucgggggccgcugccggucccugaagacccccaagaagcgcagcaaccccgggucccagcggcgccggcucaucccggcccugagccuggacaccuccagccccgugcgcaagccgcccaacuccacgggcguccgguggguggacggcccgcuccgcagcagcccccgggggcugggcgagcccuucgagaucaagguguacgagaucgacgacgucgagcgccugcagcgccggcgcgggggcgcgagcaaggaggccaugugcuucaacgccaagcucaagauccuggagcaccggcagcagcgcaucgccgaggugcgggccaaguacgaguggcugaugaaggagcucgaggcgaccaagcaguaccugaugcuggaccccaacaaguggcucuccgaguucgaccuggagcaggucugggagcuggacagccucgaguaccuggaggcccuggagugcgucaccgagcgccucgagucccgggugaacuucugcaaggcccaccugaugaugaucacgugcuucgacaucacgagccgccggcgcuga

SEQ ID NO: 32001 - RNA, 2235 nt, Artificial Sequence
  derived and/or modified sequence opt1 from KIF2A__Homo_sapiens__NP_001091981
auggccaccgccaacuucggcaagauccagaucgggaucuacguggagaucaagcgcagcgacggccggauccaccaggcgauggucaccucccugaacgaggacaacgagagcgugacgguggaguggaucgagaacggggacaccaagggcaaggagaucgaccucgaguccaucuucagccugaaccccgaccuggucccggacgaggagaucgagcccucccccgagacgcccccgccgcccgccagcuccgccaaggugaacaagaucgugaagaaccgccggaccgucgccagcaucaagaacgacccgcccucccgcgacaaccgggugguggggagcgcccgcgcgcggcccucccaguuccccgagcagagcuccagcgcccagcagaacggcuccgucagcgacaucucccccgugcaggccgccaagaaggaguucggcccgcccagccgccggaaguccaacugcgugaaggaggucgagaagcuccaggagaagcgcgagaagcggcgccugcagcagcaggagcugcgggagaagcgcgcgcaggacguggacgccacgaaccccaacuacgagaucaugugcaugauccgggacuuccgcgggagccucgacuaccggccccugaccaccgccgaccccaucgacgagcaccgcaucugcgugugcguccggaagcgcccccugaacaagaaggagacccagaugaaggaccucgacgugaucacgauccccagcaaggacguggucauggugcacgagcccaagcagaagguggaccugacccgguaccuggagaaccagaccuuccgcuucgacuacgccuucgacgacuccgccccgaacgagauggucuaccgcuucaccgcgcggccccucguggagacgaucuucgagcgcggcauggcgaccugcuucgccuacgggcagaccggcagcgggaagacccacacgaugggcggcgacuucuccgggaagaaccaggacugcagcaagggcaucuacgcccuggccgcccgggacguguuccugaugcucaagaagcccaacuacaagaagcuggagcugcaggucuacgccaccuucuucgagaucuacuccgggaagguguucgaccuccugaaccgcaagaccaagcugcggguccucgaggacggcaagcagcagguccagguggugggccugcaggagcgcgaggugaagugcguggaggacguccugaagcucaucgacaucgggaacagcugccggaccuccggccagacgagcgccaacgcccacuccagccgcucccacgccguguuccagaucauccugcggcgcaaggggaagcugcacggcaaguucagccucaucgaccuggcggggaacgagcggggcgccgacaccuccagcgccgaccgccagacccggcuggagggcgccgagaucaacaagucccuccuggcccugaaggagugcauccgcgcgcucgggcggaacaagccccacaccccguuccgcgccagcaagcugacccaggugcugcgggacuccuucaucggcgagaacagccggaccugcaugaucgccaccaucucccccgggauggccagcugcgagaacacccucaacacgcugcgcuacgcgaaccgcgucaaggaguucggcaucagccccuccgacauccccuucagccagggguccggcagccgcccggaccugucccccagcuacgaguacgacgacuucucccccagcgugacccgggugaaggagcucaccgucgacccgaccgccgccggcgacgugcgccccaucaugcaccacccgcccaaccagaucgacgaccuggagacgcaguggggcgugggguccagcccccagcgggacgaccugaagcuccugugcgagcagaacgaggaggaggucagcccccagcuguucaccuuccacgaggccgugucccagaugguggagauggaggagcaggucguggaggaccaccgcgccguguuccaggaguccauccgguggcucgaggacgagaaggcgcugcuggagaugaccgaggaggucgacuacgacguggacagcuacgccacccagcucgaggccauccuggagcagaagaucgacauccugacggagcugcgcgacaaggugaaguccuuccgggccgcccuccaggaggaggagcaggcgagcaagcagaucaaccccaagcgcccccgggcccuguga

SEQ ID NO: 32002 - RNA, 2022 nt, Artificial Sequence
  derived and/or modified sequence opt1 from KIF2B__Homo_sapiens__NP_115948
auggccagccaguucugccugcccgaguccccgugccucagcccccugaagccccugaagccccacuucggcgacauccaggaggggaucuacguggccauccagcgcuccgacaagcggauccaccucgcggucgugaccgagaucaaccgcgagaacuacugggugaccgucgaguggguggagaaggccgugaagaagggcaagaagaucgaccuggagacgauccugcuccugaacccggcccuggacagcgccgagcaccccaugccgccgccgccccucagcccccuggcccuggcgcccuccuccgccauccgggaccagcgcaccgccaccaagugggucgccaugaucccccagaagaaccagaccgcgagcggggacucccucgacgugcgggugcccagcaagcccugccugaugaagcagaagaagucccccugccugugggagauccagaagcuccaggagcagcgcgagaagcggcgccggcugcagcaggagauccgcgcccggcgcgcccuggacgucaacacgcggaaccccaacuacgagaucaugcacaugaucgaggaguaccgccggcaccucgacagcuccaagaucagcgugcuggagccgccccaggagcaccgcaucugcgugugcguccggaagcgcccccugaaccagcgggagaccacccucaaggaccuggacaucaucaccgugcccuccgacaacguggucauggugcacgagagcaagcagaagguggaccugacgcgcuaccuccagaaccagaccuucugcuucgaccacgccuucgacgacaaggccuccaacgagcuggucuaccaguucaccgcgcagccccugguggagagcaucuuccggaagggcauggcgaccugcuucgccuacgggcagacgggcuccggcaagaccuacaccaugggcggggacuucagcgggaccgcccaggacugcagcaagggcaucuacgcccucguggcccaggacgucuuccugcugcuccgcaacuccacguacgagaagcuggaccugaagguguacgggaccuucuucgagaucuacggcggcaagguguacgaccuccugaacuggaagaagaagcugcagguccucgaggacgggaaccagcagauccagguggucggccugcaggagaaggaggugugcugcguggaggagguccugaaccucguggagaucgggaacagcugccgcaccucccggcagacccccgugaacgcccacagcucccgcagccacgccgucuuccagaucauccugaaguccggccggaucaugcacggcaaguucagccugguggaccucgccgggaacgagcgcggcgccgacacgaccaaggcgucccggaagcgccagcuggagggggccgagaucaacaagagccugcucgcccugaaggagugcauccuggcccucggccagaacaagccccacaccccguuccgggccuccaagcugacccuggugcugcgcgacagcuucaucgggcagaacuccagcacgugcaugaucgcgaccaucucccccggcaugaccagcugcgagaacacccucaacacgcugcgguacgccaaccgcgucaagaagcugaacguggacgugcggcccuaccaccgcggccacuaccccaucgggcacgaggccccgcggaugcucaagucccacaucggcaacagcgagaugucccugcagcgcgacgaguucaucaagauccccuacguccagagcgaggagcagaaggagaucgaggagguggagacccugcccacccuccuggggaaggacaccacgaucagcggcaagggguccagccaguggcuggagaacauccaggagcgggccggcggcgugcaccacgacaucgacuucugcaucgcgcgcucccucagcauccuggagcagaagaucgacgcccugaccgagauccagaagaagcucaagcugcugcucgccgaccugcacgucaaguccaagguggaguga

SEQ ID NO: 32003 - RNA, 2055 nt, Artificial Sequence
  derived and/or modified sequence opt1 from KIF2C__Homo_sapiens__NP_001284584
auggccauggacagcucccugcaggcccgccucuuccccggccuggcgaucaagauccagcggagcaacgggcugauccacuccgccaacgugcgcaccgucaaccucgagaaguccugcguguccguggagugggccgagggcggggccaccaagggcaaggagaucgacuucgacgacgucgccgcgaucaacccggagcugcugcagcuccugccccugcaccccaaggacaaccucccccugcaggagaacgugacgauccagaagcagaagcggcgcagcgugaacuccaagaucccggcccccaaggagagccugcggucccgcagcacccggauguccaccgucagcgagcuccgcaucaccgcccaggagaacgacauggagguggagcugcccgccgcggccaacucccggaagcaguucagcgugccccugcgccggaaguccugccucgucaaggagguggagaagaugaagaacaagcgcgaggagaagaaggcccagaacagcgagaugcggaugaagcgcgcccaggaguacgacuccagcuucccgaacugggaguucgcccggaugaucaaggaguuccgcgcgacgcuggagugccacccccugaccaugaccgaccccaucgaggagcaccggaucugcgugugcguccgcaagcggccccucaacaagcaggagcuggccaagaaggagaucgacgugaucuccaucccgagcaagugccugcuccuggugcacgagcccaagcugaaggucgaccucaccaaguaccuggagaaccaggccuucugcuucgacuucgccuucgacgagacggccagcaacgaggugguguaccgcuucaccgcgcggccccugguccagaccaucuucgagggcgggaaggcgaccugcuucgccuacggccagacgggguccggcaagacccacaccaugggcggggaccucagcgggaaggcccagaacgccuccaagggcaucuacgccauggccagccgcgacguguuccugcugaagaaccagcccugcuaccgcaagcucggccuggagguguacgucaccuucuucgagaucuacaacgggaagcuguucgaccuccugaacaagaaggccaagcugcgggugcucgaggacggcaagcagcagguccaggugguggggcugcaggagcaccuggucaacuccgccgacgacgugaucaagaugaucgacaugggcagcgccugccgcacguccggccagaccuucgcgaacagcaacuccagccggucccacgccugcuuccagaucauccuccgcgccaaggggcggaugcacggcaaguucagccugguggaccuggccgggaacgagcgcggcgcggacaccuccagcgccgaccggcagacccgcauggagggggccgagaucaacaagucccuccuggcccugaaggagugcauccgggcccucggccagaacaaggcgcacacgccguuccgcgagagcaagcugacccagguccugcgggacuccuucaucggcgagaacagccggaccugcaugaucgccaccaucucccccgggaucagcagcugcgaguacacgcucaacacccugcgcuacgccgaccgcgugaaggagcugagcccccacagcggccccuccggggagcagcugauccagauggagaccgaggagauggaggccugcagcaacggcgcccucaucccggggaaccuguccaaggaggaggaggagcugagcucccagaugagcuccuucaacgaggcgaugacccagauccgggagcucgaggagaaggccauggaggagcugaaggagaucauccagcagggccccgacuggcuggagcucagcgagaugacggagcagcccgacuacgaccuggagaccuucgugaacaaggccgaguccgcccuggcccagcaggcgaagcacuucagcgcccuccgcgacgucaucaaggcccugcggcuggccaugcagcucgaggagcaggcgucccgccagaucagcuccaagaagcggccccaguga

SEQ ID NO: 32004 - RNA, 2181 nt, Artificial Sequence
  derived and/or modified sequence opt1 from KIF3A__Homo_sapiens__NP_001287720
augcccaucaacaagagcgagaagccggaguccugcgacaacgugaaggucguggugcgcugccggccccugaacgagcgcgagaaguccaugugcuacaagcaggccgucagcguggacgagaugcggggcaccaucaccgugcacaagacggacagcuccaacgagccgcccaagaccuucaccuucgacaccgucuucgggcccgagagcaagcagcucgacguguacaaccugacggcccgccccaucaucgacuccgugcuggagggcuacaacgggaccaucuucgcguacggccagaccgggaccggcaagacguucaccauggagggcguccgggccauccccgagcuccgcgggaucauccccaacagcuucgcccacaucuucggccacaucgccaaggccgagggggacacccgguuccuggugcgcguguccuaccuggagaucuacaacgaggagguccgggaccuccugggcaaggaccagacccagcgccuggaggugaaggagcggccggacgugggggucuacaucaaggaccucagcgcguacguggugaacaacgccgacgacauggaccgcaucaugacgcugggccacaagaaccgguccgucggcgccaccaacaugaacgagcacagcucccgcagccacgccaucuucaccaucaccaucgagugcuccgagaaggggaucgacggcaacaugcacgugcggauggggaagcugcaccucguggaccuggcgggcagcgagcgccaggccaagacgggcgccaccgggcagcggcugaaggaggccaccaagaucaaccucucccugagcacccugggcaacgucaucuccgcccucguggacgggaaguccacgcacgugcccuaccgcaacagcaagcugacccggcugcuccaggacagccugggcgggaacagcaagaccaugaugugcgcgaacaucggccccgccgacuacaacuacgacgagaccaucuccacgcugcgcuacgccaaccgggccaagaacaucaagaacaaggcccgcaucaacgaggaccccaaggacgcgcuccugcgccaguuccagaaggagaucgaggagcugaagaagaagcucgaggagggcgaggagaucagcggguccgacaucagcggcuccgaggaggacgacgacgaggagggggaggucggcgaggacggggagaagcggaagaagcgccggggcagcuccagcuccagcuccagcgacuccacgugcagcgugaucgagaagccgcuggacaaguuccugcccaaccaggccggcaagaagaaggucucccccgacaagaugaucgagaugcaggccaagaucgacgaggagcgcaaggcccucgagaccaagcuggacauggaggaggaggagcggaacaaggcccgcgcggagcuggagaagcgggagaaggaccuccugaaggcccagcaggagcaccagagccugcucgagaagcuguccgcccuggagaagaaggugaucgucgggggcguggaccuccuggccaaggccgaggagcaggagaagcugcucgaggagagcaacauggagcuggaggagcgccggaagcgcgcggagcagcugcggcgcgagcucgaggagaaggagcaggagcggcuggacaucgaggagaaguacaccagccugcaggaggaggcccaggggaagaccaagaagcucaagaagguguggaccaugcugauggccgccaaguccgagauggcggaccugcagcaggagcaccagcgcgagaucgagggccugcucgagaacauccggcagcugagccgcgagcugcggcuccagaugcugaucaucgacaacuucaucccccgcgacuaccaggagaugaucgagaacuacgugcacuggaacgaggacaucggggaguggcagcugaagugcgucgccuacaccggcaacaacaugcggaagcagaccccggugcccgacaagaaggagaaggaccccuucgagguggaccucucccacgucuaccuggccuacacggaggagagccugcgccagucccucaugaagcuggagcgcccccggaccagcaagggcaaggcccgcccgaagaccgggcggcgcaagcgguccgccaagcccgagaccgugaucgacagccugcuccaguga

SEQ ID NO: 32005 - RNA, 2244 nt, Artificial Sequence
  derived and/or modified sequence opt1 from KIF3B__Homo_sapiens__NP_004789
augagcaagcugaaguccagcgaguccgugcgcgucguggugcggugccgccccaugaacggcaaggagaaggccgccagcuacgacaaggucguggacguggacgucaagcucggccagguguccgugaagaacccgaaggggaccgcgcacgagaugcccaagaccuucacguucgacgccgucuacgacuggaacgccaagcaguucgagcuguacgacgagaccuuccggccccugguggacagcgugcuccagggguucaacggcaccaucuucgccuacgggcagaccggcacgggcaagaccuacaccauggaggggauccgcggcgaccccgagaagcgcggggucaucccgaacuccuucgaccacaucuucacccacaucagccggucccagaaccagcaguaccuggugcgggccagcuaccuggagaucuaccaggaggagauccgcgaccuccuguccaaggaccagacgaagcggcuggagcucaaggagcgccccgacaccggcguguacgucaaggaccugagcuccuucgugaccaagagcgugaaggagaucgagcacgucaugaacguggggaaccagaaccgguccgugggcgcgaccaacaugaacgagcacagcucccgcagccacgccaucuucgucaucacgaucgagugcuccgaggugggccuggacggggagaaccacauccgggugggcaagcucaaccuggucgaccuggccgggagcgagcgccaggccaagaccggcgcgcagggcgagcggcucaaggaggccaccaagaucaaccugagccuguccgcccucgggaacgugaucagcgcccuggucgacggcaaguccacccacauccccuaccgcgacagcaagcugacgcggcuccugcaggacucccucgggggcaacgccaagaccgugaugguggcgaacgucgggcccgccagcuacaacguggaggagacccugaccacgcugcgcuacgccaaccgggccaagaacaucaagaacaagccgcgcgugaacgaggaccccaaggacgcccugcuccgggaguuccaggaggagaucgcgcgccugaaggcccagcuggagaagcgcuccaucggccggcgcaagcggcgcgagaagcggcgcgagggcgggggcagcgggggcgggggcgaggaggaggaggaggagggcgaggagggggaggaggagggcgacgacaaggacgacuacuggcgggagcagcaggagaagcucgagaucgagaagcgcgccaucgucgaggaccacucccugguggccgaggagaagaugcggcugcucaaggagaaggagaagaagauggaggaccugcgccgggagaaggacgccgcggagaugcugggggccaagaucaaggccauggagagcaagcuccuggugggcgggaagaacaucgucgaccacaccaacgagcagcagaagauccuggagcagaagcgccaggagaucgccgagcagaagcggcgcgagcgggagauccagcagcagauggagucccgcgacgaggagacccucgagcugaaggagaccuacagcucccugcagcaggagguggacaucaagacgaagaagcucaagaagcuguucagcaagcugcaggccgugaaggcggagauccacgaccuccaggaggagcacaucaaggagcggcaggagcuggagcagacccagaacgagcugacccgcgagcucaagcugaagcaccugaucaucgagaacuucaucccccuggaggagaaguccaagaucaugaaccgggccuucuucgacgaggaggaggaccacuggaagcuccaccccaucacccgccuggagaaccagcagaugaugaagcgcccggucagcgccgugggcuacaagcggccccugucccagcacgcccgcaugagcaugaugauccggcccgaggcgcgcuaccgggccgagaacaucgugcuccuggagcuggacaugcccucccgcacgacccgggacuacgagggcccggccaucgcccccaagguccaggccgcgcucgacgccgcccugcaggacgaggacgagauccagguggacgccagcagcuucgaguccaccgccaacaagaaguccaaggcgcgccccaagagcgggcgcaagagcggcuccagcuccagcuccagcgggacccccgccucccagcuguacccgcagagccggggccucgugcccaaguga

SEQ ID NO: 32006 - RNA, 2382 nt, Artificial Sequence
  derived and/or modified sequence opt1 from KIF3C__Homo_sapiens__NP_002245
auggccagcaagaccaaggccuccgaggcgcugaagguggucgcccgcugccggccccucagccgcaaggaggaggccgccggccacgagcagauccugaccauggacgugaagcugggccaggugacgcuccggaacccccgcgccgcgcccggggagcugcccaagaccuucaccuucgacgccgucuacgacgccuccagcaagcaggccgaccuguacgacgagaccgugcggccccucaucgacuccgugcugcagggguucaacggcacggucuucgcguacgggcagaccggcaccggcaagaccuacacgaugcaggggaccuggguggagccggagcugcgcggcgugauccccaacgccuucgagcacaucuucacccacaucagccggucccagaaccagcaguaccucguccgcgccagcuaccuggagaucuaccaggaggagauccgggaccugcucuccaaggagcccgggaagcgccuggagcugaaggagaaccccgagaccggcguguacaucaaggaccucagcuccuucgugacgaagaacgucaaggagaucgagcacgugaugaaccuggggaaccagacccgggccgugggcagcacccacaugaacgaggucuccagccgcucccacgccaucuucaucaucaccguggagugcagcgagcggggcuccgacgggcaggaccacauccgcgugggcaagcugaaccucgucgaccuggcggggagcgagcggcagaacaaggccggcccgaacacggccggcggggccgccacccccuccagcggcgggggcgggggcggcgggggcagcgggggcggggcgggcggcgagcgccccaaggaggccuccaagaucaaccugagccucuccgcccuggggaacgugaucgccgcccuggcgggcaaccggagcacccacauccccuaccgcgacuccaagcucacccggcugcugcaggacagccucgggggcaacgccaagacgaucaugguggccacccuggggccggccucccacagcuacgacgagucccugagcacccuccgcuucgccaaccgggcgaagaacaucaagaacaagccccgcgucaacgaggaccccaaggacacccugcugcgcgaguuccaggaggagaucgcccggcucaaggcccagcuggagaagcgcggcaugcugggcaagcggccccgccggaaguccagccgccggaagaaggccguguccgcgccgcccggguaccccgagggccccgugaucgaggccugggucgccgaggaggaggacgacaacaacaacaaccaccgcccgccccagcccauccucgagagcgcccuggagaagaacauggagaacuaccugcaggagcagaaggagcggcucgaggaggagaaggccgcgauccaggacgaccgcucccuggugagcgaggagaagcagaagcugcucgaggagaaggagaagaugcuggaggaccugcggcgcgagcagcaggccacggagcuccuggccgccaaguacaaggccauggaguccaagcugcucaucgggggccggaacaucauggaccacaccaacgagcagcagaagaugcuggagcugaagcgccaggagaucgcggagcagaagcggcgcgagcgggagaugcagcaggagaugaugcugcgcgacgaggagaccauggagcuccggggcaccuacacgagccugcagcaggaggucgaggugaagaccaagaagcugaagaagcucuacgccaagcugcaggccgugaaggccgagauccaggaccagcacgacgaguacauccgcguccgccaggaccuggaggaggcccagaacgagcagacccgggagcucaagcugaaguaccugaucaucgagaacuucaucccgcccgaggagaagaacaagaucaugaaccgccucuuccuggacugcgaggaggagcaguggaaguuccagccccuggugcccgcggggguguccagcagccagaugaagaagcggcccaccuccgccgucggcuacaagcgcccgaucagccaguacgcccggguggccauggcgauggggucccacccccgcuaccgggccgagaacaucauguuccucgagcuggacgugagcccgcccgccgucuucgagauggaguucucccacgaccaggagcaggacccccgcgcccugcacauggagcggcucaugcgccuggacagcuuccuggagcggcccuccacgagcaaggugcgcaagucccggagcuggugccagagcccccagcgcccgccgcccuccaccacccacgccucccucgcgagcgccucccugcggcccgccaccguggccgaccacgaguga

SEQ ID NO: 32007 - RNA, 3699 nt, Artificial Sequence
  derived and/or modified sequence opt1 from KIF4A__Homo_sapiens__XP_011529195
augaaggaggaggugaagggcauccccgugcgcguggcccugcggugccgcccgcucgugcccaaggagaucagcgaggggugccagaugugccuguccuucguccccggcgagccccaggugguggucgggaccgacaagagcuucaccuacgacuucguguucgacccguccacggagcaggaggagguguucaacaccgccgucgcgccccugaucaagggcguguucaagggguacaacgccaccgugcucgccuacggccagaccggcagcgggaagacguacuccaugggcggggccuacaccgccgagcaggagaacgagcccaccgucggcgugaucccccgggugauccagcugcuguucaaggagaucgacaagaaguccgacuucgaguucacccucaaggucagcuaccuggagaucuacaacgaggagauccuggaccuccugugcccgagccgcgagaaggcgcagaucaacauccgggaggaccccaaggaggggaucaagaucgugggccugacggagaagaccgugcucgucgcccuggacaccguguccugccuggagcagggcaacaacagccgcaccguggccuccacggccaugaacagccaguccagccggucccacgcgaucuucaccaucagccucgagcagcgcaagaaguccgacaagaacagcuccuuccggagcaagcugcaccuggucgaccucgccgggagcgagcgccagaagaagaccaaggccgagggcgaccggcugaaggaggggaucaacaucaaccgcggccugcucugccugggcaacgugaucuccgcccugggggacgacaagaagggcggguucgugcccuaccgggacagcaagcucacccgccugcugcaggacucccucggcgggaacagccacacgcugaugaucgccugcgucucccccgcggacagcaaccuggaggagacccucaacacccugcgguacgccgaccgcgcccggaagaucaagaacaagccgaucgugaacaucgacccccagaccgccgagcugaaccaccucaagcagcagguccagcagcuccaggugcugcugcugcaggcccacggcggcacgcugcccggguccaucaccguggagcccagcgagaaccuccagucccugauggagaagaaccagagccuggucgaggagaacgagaagcucucccgcggccugagcgaggcggccgggcagaccgcccagaugcuggagcggaucauccucaccgagcaggccaacgagaagaugaacgccaagcuggaggagcugcgccagcacgcggccugcaagcucgaccugcagaagcugguggagacgcuggaggaccaggagcucaaggagaacguggagaucaucugcaaccugcagcagcugaucacccagcucuccgacgagaccgucgccugcauggccgccgcgaucgacaccgccguggagcaggaggcccagguggagacgagcccggagaccucccggagcuccgacgccuucaccacccagcacgcgcugcgccaggcccagaugagcaaggagcuggucgagcucaacaaggcccuggcccugaaggaggcccucgcgcgcaagaugacgcagaacgacucccagcugcagcccauccaguaccaguaccaggacaacaucaaggagcuggagcucgaggugaucaaccugcagaaggagaaggaggagcuggugcucgagcugcagaccgccaagaaggacgccaaccaggccaagcugagcgagcggcgccggaagcgccuccaggagcuggagggccagaucgccgaccugaagaagaagcucaacgagcagagcaagcugcugaagcucaaggaguccaccgagcggaccgucagcaagcugaaccaggagauccgcaugaugaagaaccagcgggugcagcugaugcgccagaugaaggaggacgcggagaaguuccggcaguggaagcagaagaaggacaaggaggugauccagcucaaggagcgcgaccggaagcgccaguacgagcugcugaagcucgagcggaacuuccagaagcaguccaacguccugcgccggaagacggaggaggccgccgccgccaacaagcgccugaaggacgcgcuccagaagcagcgggagguggccgacaagcgcaaggagacccagagccgggggauggagggcaccgccgcccgcgugaagaacuggcugggcaacgagaucgaggucaugguguccaccgaggaggcgaagcgccaccugaacgaccuccuggaggaccggaagauccuggcccaggacguggcccagcucaaggagaagaaggagagcggggagaacccgccgcccaagcugcgccggcgcaccuucucccugacggagguccggggccaggugagcgaguccgaggacagcaucaccaagcagaucgagucccucgagaccgagauggaguuccgcagcgcccagaucgccgaccugcagcagaagcugcucgacgcggaguccgaggaccggcccaagcagcgcugggagaacaucgccaccauccuggaggccaagugcgcccugaaguaccucaucggggagcuggugagcuccaagauccaggucagcaagcuggaguccagccucaagcagagcaagacguccugcgccgacaugcagaagaugcuguucgaggagcggaaccacuucgcggagaucgagaccgagcugcaggccgagcucgugcgcauggagcagcagcaccaggagaaggugcuguaccugcucagccagcugcagcagucccagauggccgagaagcagcuggaggagagcgucuccgagaaggagcagcagcuccugagcacccugaagugccaggacgaggagcucgagaagaugcgggaggugugcgagcagaaccagcagcugcugcgcgagaacgagaucaucaagcagaagcucacccugcugcaggucgccucccggcagaagcaccuccccaaggacacgcugcugagccccgacuccagcuucgaguacgugccgcccaagcccaagcccucccgcgugaaggagaaguuccucgagcagagcauggacaucgaggaccugaaguacugcuccgagcacagcgugaacgagcacgaggacggcgacggggacgacgacgagggcgacgacgaggaguggaagcccaccaagcuggucaaggugucccggaagaacauccagggcugcagcugcaagggguggugcggcaacaagcagugcgggugccgcaagcagaaguccgacugcggcguggacugcugcugcgaccccaccaagugccggaaccgccagcagggcaaggacagccucgggaccgucgagcggacgcaggacuccgagggcagcuucaagcuggaggaccccaccgaggugaccccggggcugagcuucuucaaccccgugugcgccacccccaacuccaagauccucaaggagaugugcgacgucgagcagguccugagcaagaagacgcccccggcgcccucccccuucgaccugcccgagcucaagcacguggccaccgaguaccaggagaacaaggccccgggcaagaagaagaagcgcgcccuggcgagcaacaccuccuucuucagcgggugcucccccaucgaggaggaggcccacuga

SEQ ID NO: 32008 - RNA, 3705 nt, Artificial Sequence
  derived and/or modified sequence opt1 from KIF4B__Homo_sapiens__NP_001092763
augaaggaggaggugaagggcauccccguccgcguggcccugcggugccgcccgcucgugcccaaggagaucagcgaggggugccagaugugccuguccuucguccccggcgagacccaggugguggucgggaccgacaagagcuucacguacgacuucguguucgaccccugcaccgagcaggaggagguguucaacaaggccgucgcgccgcugaucaagggcaucuucaagggguacaacgccaccgugcucgccuacggccagaccggcuccgggaagacguacagcaugggcggggccuacaccgccgagcaggagaacgagcccaccgugggcaucaucccccgggucauccagcugcuguucaaggagaucgacaagaaguccgacuucgaguucacccucaaggugagcuaccuggagaucuacaacgaggagauccuggaccuccugugccccucccgcgagaaggcgcagaucaacauccgggaggacccgaaggaggggaucaagaucgugggccugacggagaagaccguccucguggcccuggacaccgugagcugccuggagcagggcaacaacucccgcaccgucgccagcacggccaugaacucccagagcucccggagccacgcgaucuucaccaucuccaucgagcagcgcaagaaguccgacaagaacugcagcuuccggagcaagcuccaccugguggaccuggccggguccgagcgccagaagaagaccaaggccgagggcgaccggcucaaggaggggaucaacaucaaccgcggccugcugugccucggcaacgugaucagcgcccugggggacgacaagaagggcagcuucguccccuaccgggacuccaagcugacccgccuccugcaggacagccucgggggcaacucccacacgcugaugaucgccugcgugagccccgcggacuccaaccuggaggagacccugagcacccuccgguacgccgaccgcgcccggaagaucaagaacaagcccaucgugaacaucgacccgcacaccgccgagcugaaccaccugaagcagcagguccagcagcuccaggugcugcugcuccaggcccacgggggcacgcugcccggcuccaucaacgcggagcccagcgagaaccugcagucccucauggagaagaaccagagccuggucgaggagaacgagaagcugucccgcugccucagcaaggccgccgggcagaccgcccagaugcuggagcggaucauccugaccgagcaggucaacgagaagcucaacgccaagcuggaggagcugcgccagcacguggcgugcaagcucgaccugcagaagcugguggagacccuggaggaccaggagcucaaggagaacguggagaucaucugcaaccugcagcagcugaucacgcagcucuccgacgagaccguggccugcaccgccgccgccaucgacaccgcggucgaggaggaggcccagguggagacgagccccgagaccucccggagcuccgacgccuucaccacccagcacgcccugcaccaggcgcagaugagcaaggagguggucgagcugaacaacgcccucgcccugaaggaggcccuggugcgcaagaugacgcagaacgacaaccagcuccagccgauccaguuccaguaccaggacaacaucaagaaccuggagcuggaggugaucaaccuccagaaggagaaggaggagcugguccgcgagcugcagaccgccaagaagaacgugaaccaggcgaagcucuccgagcaccggcacaagcugcugcaggagcucgagggccagaucgccgaccugaagaagaagcugaacgagcagagcaagcuccugaagcugaaggagagcaccgagcgcaccguguccaagcucaaccaggagaucuggaugaugaagaaccagcggguccagcugaugcgccagaugaaggaggacgccgagaaguuccggcaguggaagcagaagaaggacaaggaggugauccagcugaaggagcgcgaccggaagcgccaguacgagcuccugaagcuggagcggaacuuccagaagcagagcuccgugcuccgccggaagacggaggaggccgccgcggccaacaagcgccugaaggacgcccugcagaagcagcgggaggucaccgacaagcgcaaggagacccagagccacgggaaggagggcaucgccgcccgggugcgcaacuggcucgggaacgagaucgaggugauggucuccaccgaggaggcgaagcggcaccugaacgaccugcucgaggaccgcaagauccuggcccaggacguggugcagcugaaggagaagaaggagagccgggagaacccgccgcccaagcuccgcaagugcaccuucucccugagcgagguccacggccaggugcuggaguccgaggacugcaucacgaagcagaucgagagccucgagaccgagauggagcugcgcuccgcccagaucgccgaccugcagcagaagcuccuggacgcggagagcgaggaccggcccaagcagugcugggagaacaucgccaccauccuggaggccaagugcgcccucaaguaccugaucggcgagcugguguccagcaagauccacgucaccaagcucgagaacucccugcgccagagcaaggccuccugcgcggacaugcagaagaugcuguucgaggagcagaaccacuucagcgagaucgagacggagcuccaggccgagcuggugcggauggagcagcagcaccaggagaaggugcuguaccucgucagccagcugcaggagucccagauggccgagaagcagcuggagaaguccgccagcgagaaggagcagcagcucgugagcacccugcagugccaggacgaggagcuggagaagaugcgcgaggugugcgagcagaaccagcagcuccugcaggagaacgagaucaucaagcagaagcugauccuccugcaggucgccucccggcagaagcaccuccccaacgacacccugcugagccccgacuccagcuucgaguacaucccgcccaagcccaagcccucccgcgugaaggagaaguuccuggagcagagcauggacaucgaggaccucaaguacugcuccgagcacagcgugaacgagcacgaggacggggacggcgacggggacuccgacgagggcgacgacgaggaguggaagcccaccaagcuggucaaggugagccggaagaacauccaggggugcuccugcaagggcuggugcggcaacaagcagugcgggugccgcaagcagaaguccgacugcggcguggacugcagcugcgaccccacgaagugccggaaccgccagcaggggaaggacagccugggcaccgucgagcagacccaggacuccgagggcagcuucaagcucgaggaccccaccgaggugacgcccgggcugagcuucuucaacccggugugcgcgacccccaacuccaagauccugaaggagaugugcgacauggagcagguccucagcaagaagaccgcccccgcccccuccccguucgaccugcccgagagcaagcacggcgccaccgaguaccagcagaacaagccgcccgggaagaagaagaagcgggcccuggcguccaacacgagcuucuucuccggcugcagccccaucgaggaggaggcccacuga

SEQ ID NO: 32009 - RNA, 3099 nt, Artificial Sequence
  derived and/or modified sequence opt1 from KIF5A__Homo_sapiens__NP_004975
auggccgagaccaacaacgagugcagcaucaaggugcugugccgcuuccggccccucaaccaggccgagauccugcgcggcgacaaguucaucccgaucuuccagggggacgacuccgucgugaucggcgggaagcccuacguguucgaccgggucuucccgcccaacaccacgcaggagcaggucuaccacgcgugcgccaugcagaucgugaaggacgugcuggccggcuacaacgggaccaucuucgccuacggccagaccagcuccggcaagacccacacgauggaggggaagcuccacgacccccagcugaugggcaucaucccccgcaucgcccgggacaucuucaaccacaucuacagcauggacgagaaccuggaguuccacaucaagguguccuacuucgagaucuaccucgacaagauccgcgaccugcuggacgugaccaagaccaaccucagcguccacgaggacaagaaccgggugcccuucgugaaggggugcaccgagcgcuucgucuccagccccgaggagauccuggacgugaucgacgagggcaaguccaaccggcacguggcggucacgaacaugaacgagcacagcucccgcagccacuccaucuuccugaucaacaucaagcaggagaacauggagaccgagcagaagcucagcgggaagcuguaccugguggaccucgccggcuccgagaaggugagcaagaccggcgccgagggggccguccuggacgaggcgaagaacaucaacaagucccugagcgcccucggcaacgugaucuccgcccuggccgaggggaccaagagcuacgugccguaccgggacagcaagaugacgcgcauccugcaggacucccucggcggcaacugccggaccaccauguucaucugcugcagccccuccagcuacaacgacgccgagaccaaguccacgcugauguucgggcagcgcgcgaagaccaucaagaacaccgccagcgucaaccuggagcucaccgccgagcaguggaagaagaaguacgagaaggagaaggagaagacgaaggcccagaaggagaccaucgccaagcuggaggcggagcugucccgguggcgcaacggcgagaacgugcccgagaccgagcggcucgccggggaggaggccgcccugggcgccgagcugugcgaggagacccccgugaacgacaacagcuccaucgucgugcgcaucgcgccggaggagcggcagaaguacgaggaggagauccgccggcucuacaagcagcuggacgacaaggacgacgagaucaaccagcagagccagcugaucgagaagcucaagcagcagaugcuggaccaggaggagcugcucgucuccacgcgcggggacaacgagaaggugcagcgcgagcugagccaccuccaguccgagaacgacgccgccaaggacgaggugaaggagguccuccaggcccuggaggagcuggccgugaacuacgaccagaagucccaggagguggaggagaagucccagcagaaccagcuccuggucgacgagcugagccagaagguggcgaccaugcucagccuggagagcgagcugcagcggcuccaggagguguccggccaccagcgcaagcggaucgccgagguccugaacggccugaugaaggaccugagcgaguucagcgugaucguggggaacggcgagaucaagcuccccgucgagaucuccggggccaucgaggaggaguucaccguggcccgccuguacaucagcaagaucaaguccgaggucaagagcguggugaagcggugccgccagcuggagaaccuccagguggagugccaccggaagauggaggucaccggccgcgagcuguccagcugccagcugcucaucucccagcacgaggcgaagauccggagccugacggaguacaugcaguccguggagcugaagaagcgccaccucgaggagagcuacgacucccugagcgacgagcuggccaagcuccaggcccaggagaccgugcacgaggucgcccugaaggacaaggagcccgacacccaggacgccgacgaggugaagaaggcgcuggagcuccagauggagucccaccgggaggcccaccaccgccagcuggcccggcugcgcgacgagaucaacgagaagcagaagaccaucgacgagcucaaggaccugaaccagaagcugcagcucgagcuggagaagcugcaggccgacuacgagaagcucaagagcgaggagcacgagaaguccacgaagcugcaggagcugaccuuccucuacgagcggcacgagcagagcaagcaggaccugaaggggcuggaggagaccguggcccgcgagcuccagacccugcacaaccugcggaagcuguucguccaggacgugacgacccgcgugaagaaguccgcggagauggagcccgaggacagcggcggcauccacagccagaagcagaagaucuccuuccuggagaacaaccuggagcagcucaccaagguccacaagcagcuggugcgggacaacgccgaccugcgcugcgagcucccgaagcuggagaagcgccugcgggccaccgccgagcgcgugaaggcccucgagggggcgcugaaggaggccaaggagggcgccaugaaggacaagcggcgcuaccagcaggaggucgaccggaucaaggaggccgugcgcuacaagagcuccgggaagcggggccacagcgcgcagaucgccaagcccgugcgccccgggcacuaccccgccuccagcccgaccaaccccuacggcacgcggucccccgagugcaucagcuacaccaacucccuguuccagaacuaccagaaccucuaccugcaggccacccccagcuccaccagcgacauguacuucgccaacuccugcacgagcuccggcgcgaccagcuccgggggcccgcuggccagcuaccagaaggccaacauggacaacgggaacgccaccgacaucaacgacaaccgcuccgaccuccccugcggcuacgaggccgaggaccaggcgaagcuguucccccugcaccaggagaccgccgccagcuga

SEQ ID NO: 32010 - RNA, 2892 nt, Artificial Sequence
  derived and/or modified sequence opt1 from KIF5B__Homo_sapiens__NP_004512
auggccgaccuggccgagugcaacaucaaggugaugugccgcuuccggccccucaacgagagcgaggugaaccgcggcgacaaguacaucgcgaaguuccagggggaggacaccguggugaucgccuccaagccguacgccuucgaccgggucuuccagagcuccaccagccaggagcaggucuacaacgacugcgccaagaagaucgugaaggacgugcuggagggcuacaacgggacgaucuucgccuacggccagaccuccagcgggaagacccacaccauggagggcaagcugcacgaccccgagggcauggggaucaucccccgcaucgugcaggacaucuucaacuacaucuacuccauggacgagaaccucgaguuccacaucaaggugagcuacuucgagaucuaccuggacaagauccgggaccugcucgacgucuccaagacgaaccugagcgugcacgaggacaagaaccgcgugcccuacgucaagggcugcaccgagcgguucgugugcuccccggacgaggugauggacaccaucgacgagggcaagagcaaccgccacgucgcggugaccaacaugaacgagcacuccagccggucccacagcaucuuccugaucaacgugaagcaggagaacacgcagaccgagcagaagcucuccgggaagcuguaccuggucgaccucgccgggagcgagaagguguccaagaccggcgccgagggcgccgugcuggacgaggcgaagaacaucaacaagagccugagcgcccucgggaacgucaucuccgcccuggccgagggcagcaccuacgugcccuaccgcgacuccaagaugacgcggauccugcaggacagccucgggggcaacugccgcaccaccaucgugaucugcugcucccccagcuccuacaacgagagcgagaccaaguccacgcugcuguucggccagcgggccaagaccaucaagaacaccgucugcgugaacgucgagcucaccgcggagcaguggaagaagaaguacgagaaggagaaggagaagaacaagauccugcgcaacacgauccaguggcuggagaacgagcucaaccgguggcgcaacggggagaccgugcccaucgacgagcaguucgacaaggagaaggccaaccuggaggccuucaccguggacaaggacaucacccugacgaacgacaagccggccaccgccaucggcgucaucgggaacuucaccgacgcggagcggcgcaagugcgaggaggagaucgccaagcucuacaagcagcuggacgacaaggacgaggagaucaaccagcagagccagcugguggagaagcucaagacccagaugcuggaccaggaggagcugcucgccuccacgcggcgcgaccaggacaacaugcaggccgagcugaaccggcugcaggccgagaacgacgcgagcaaggaggaggugaaggagguccuccaggcccuggaggagcuggccgugaacuacgaccagaagucccaggagguggaggacaagaccaaggaguacgagcuccugagcgacgagcugaaccagaaguccgccacccucgccagcaucgacgcggagcugcagaagcugaaggagaugaccaaccaccagaagaagcgcgccgccgagaugauggccucccuccugaaggaccuggcggagaucggcaucgccgucgggaacaacgacgugaagcagcccgagggcacgggcaugaucgacgaggaguucaccguggcccgccucuacaucagcaagaugaaguccgaggucaagaccauggugaagcggugcaagcagcuggagagcacccagacggagagcaacaagaagauggaggagaacgagaaggagcuggccgccugccagcugcgcaucucccagcacgaggcgaagaucaagagccucaccgaguaccugcagaacguggagcagaagaagcggcagcuggaggaguccgucgacgcccucagcgaggagcuggugcagcugcgcgcccaggagaaggugcacgagauggagaaggagcaccucaacaagguccagaccgccaacgaggugaagcaggccguggagcagcagauccagucccaccgggagacccaccagaagcagaucagcucccugcgcgacgaggucgaggcgaaggccaagcugaucaccgaccuccaggaccagaaccagaagaugaugcuggagcaggagcggcugcgcguggagcacgagaagcucaaggccacggaccaggagaagucccggaagcugcacgagcugaccgugaugcaggaccgccgggagcaggcccgccaggaccucaaggggcuggaggagaccgucgccaaggagcugcagacccuccacaaccugcggaagcuguucgugcaggaccucgcgacgcgcgugaagaaguccgccgagaucgacagcgacgacaccggcgggagcgccgcccagaagcagaagaucagcuuccuggagaacaaccuggagcagcucaccaagguccacaagcagcuggugcgggacaacgcggaccugcgcugcgagcuccccaagcuggagaagcggcugcgcgccaccgccgagcgggugaaggcccucgaguccgcccugaaggaggcgaaggagaacgccagccgcgaccgcaagcgguaccagcaggaggucgaccgcaucaaggaggccgugcgguccaagaacauggcccgccggggccacagcgcccagaucgcgaagcccauccgcccggggcagcaccccgccgccucccccacgcaccccagcgccauccggggcggcggggccuucgugcagaacagccagccggucgcggugcgcggcgggggcgggaagcaggucuga

SEQ ID NO: 32011 - RNA, 2874 nt, Artificial Sequence
  derived and/or modified sequence opt1 from KIF5C__Homo_sapiens__NP_004513
auggccgaccccgccgagugcagcaucaaggugaugugccgcuuccggccgcugaacgaggcggagauccuccgcggcgacaaguucauccccaaguucaagggggacgagaccgucgugaucggccaggggaagcccuacguguucgaccggguccugcccccgaacaccacgcaggagcaggucuacaacgccugcgccaagcagaucgugaaggacgugcuggagggcuacaacgggaccaucuucgccuacggccagaccuccagcggcaagacccacacgauggaggggaagcuccacgacccccagcugaugggcaucaucccccgcaucgcccacgacaucuucgaccacaucuacuccauggacgagaaccuggaguuccacaucaaggugagcuacuucgagaucuaccucgacaagauccgggaccugcuggacguguccaagaccaaccucgcgguccacgaggacaagaaccgcgugcccuacgugaaggggugcaccgagcgguucgucagcuccccggaggaggugauggacgugaucgacgagggcaaggccaaccgccacgucgccgugaccaacaugaacgagcacagcucccggagccacuccaucuuccugaucaacaucaagcaggagaacguggagacggagaagaagcugagcgggaagcucuaccuggucgaccuggccggcuccgagaaggugagcaagaccggcgcggagggggccgugcucgacgaggccaagaacaucaacaagucccugagcgcccugggcaacgucaucuccgcccucgcggaggggaccaagacccacgugcccuaccgcgacagcaagaugacgcggauccugcaggacucccugggcggcaacugccgcaccaccaucgugaucugcugcagccccagcgucuucaacgaggccgagaccaaguccacgcucauguucgggcagcgggccaagaccaucaagaacaccgugagcgucaaccuggagcugaccgccgaggaguggaagaagaaguacgagaaggagaaggagaagaacaagacgcucaagaacgugauccagcaccuggagauggagcugaaccgcuggcggaacggcgaggccgugcccgaggacgagcagaucuccgcgaaggaccagaagaaccucgagccgugcgacaacacccccaucaucgacaacaucgcccccgucguggccgggaucagcaccgaggagaaggagaaguacgacgaggagaucuccagccuguaccgccagcuggacgacaaggacgacgagaucaaccagcagucccagcucgccgagaagcugaagcagcagaugcuggaccaggacgagcuccuggccagcacccggcgcgacuacgagaagauccaggaggagcugacgcggcuccagaucgagaacgaggcggccaaggacgaggugaaggagguccugcaggcccuggaggagcucgccgugaacuacgaccagaagucccaggagguggaggacaagacccgcgccaacgagcagcugaccgacgagcuggcgcagaagaccacgacccucaccaccacgcagcgggagcugagccagcugcaggagcucuccaaccaccagaagaagcgcgccaccgagauccugaaccugcuccugaaggaccugggcgagaucgggggcaucaucggcaccaacgacgucaagacccuggccgacgugaacggggugaucgaggaggaguucacgauggcccgccucuacaucagcaagaugaaguccgaggucaagagccuggugaaccgguccaagcagcuggagagcgcgcagauggacuccaaccgcaagaugaacgccagcgagcgggagcucgccgccugccagcugcugaucucccagcacgaggccaagaucaagagccucaccgacuacaugcagaacauggagcagaagcgccggcagcuggaggagagccaggacucccugagcgaggagcucgcgaagcugcgcgcccaggagaagaugcacgagguguccuuccaggacaaggagaaggagcaccugacccggcuccaggacgccgaggagaugaagaaggcccuggagcagcagauggagagccaccgcgaggcccaccagaagcagcugucccggcuccgcgacgagaucgaggagaagcagaagaucaucgacgagauccgggaccugaaccagaagcugcagcucgagcaggagaagcugagcuccgacuacaacaagcugaagaucgaggaccaggagcgcgagaugaagcucgagaagcugcugcuccugaacgacaagcgggagcaggcgcgcgaggaccugaagggccucgaggagaccgucagccgggagcugcagacccugcacaaccuccgcaagcuguucgugcaggaccugacgacccgggugaagaaguccgucgagcucgacaacgacgacgggggcgggagcgccgcccagaagcagaagaucuccuuccuggagaacaaccuggagcagcucaccaaggugcacaagcagcuggugcgcgacaacgccgaccugcggugcgagcuccccaagcuggagaagcgccugcgcgccaccgcggagcgggucaaggcccucgagagcgcccugaaggaggccaaggagaacgcgaugcgcgaccggaagcgcuaccagcaggagguggaccggaucaaggaggccgugcgcgccaagaacauggcccggcgcgcccacuccgcgcagaucgccaagccgauccggcccggccacuaccccgccagcucccccacggccguccacgccauccgcggcgggggcgggagcuccagcaacagcacccacuaccagaaguga

SEQ ID NO: 32012 - RNA, 2394 nt, Artificial Sequence
  derived and/or modified sequence opt1 from KIF6__Homo_sapiens__NP_001275949
auggugaagcagaccauccagaucuucgcccgcgucaagcccccggugcggaagcaccagcagggcaucuacagcaucgacgaggacgagaagcugauccccucccucgagaucauccugccccgcgaccuggccgacggguucgugaacaacaagcgggagagcuacaaguucaaguuccagcgcaucuucgaccaggacgcgaaccaggagaccgucuucgagaacaucgccaagcccguggccggcuccgugcucgccggguacaacggcaccaucuucgccuacgggcagaccggcagcggcaagaccuucaccaucaccgggggcgcggagcgguacuccgaccgcgggaucaucccgcggacccugagcuacaucuucgagcagcugcagaaggacuccagcaagaucuacaccacccacaucuccuaccucgagaucuacaacgagugcggcuacgaccugcuggacccccgccacgaggccagcucccucgaggaccugcccaaggucacgauccuggaggaccccgaccagaacauccaccucaagaaccugacccugcaccaggccaccaccgaggaggaggcccucaaccugcuguuccucggggacacgaaccggaugaucgcggagaccccgaugaaccaggccagcacccgcucccacugcaucuucaccauccaccugagcuccaaggagcccggcagcgccacggugcggcacgccaagcugcaccucguggaccuggccggcuccgagcgcgucgcgaagaccggggugggcgggcaccuccugaccgaggccaaguacaucaaccugagccugcacuaccucgagcaggucaucaucgcccuguccgagaagcaccggagccacauccccuaccgcaacagcaugaugaccuccgugcugcgggacagccucggcggcaacugcaugacgaccaugaucgccacccugucccuggagaagcgcaaccucgacgagagcaucuccacgugccgguucgcccagcgcguggcgcugaucaagaacgaggccgugcugaacgaggagaucaacccccggcucgucaucaagcgccugcagaaggagauccaggagcugaaggacgagcucgccauggugacgggggagcagcggaccgaggcccugaccgaggccgagcugcuccagcuggagaagcugaucaccagcuuccucgaggaccaggacuccgacagccgccuggaggugggcgcggacaugcgcaagguccaccacugcuuccaccaccugaagaagcuccugaacgacaagaagauccuggagaacaacacgguguccagcgaguccaaggaccaggacugccaggagccgcugaaggaggaggaguaccggaagcuccgcgacauccugaagcagcgggacaacgagaucaacauccuggugaacaugcucaagaaggagaagaagaaggcccaggaggcccugcaccuggccgggauggaccgccgggaguuccgccagagccaguccccgcccuuccggcucggcaaccccgaggaggggcagcgcaugcggcugagcuccgcccccagccaggcgcaggacuucuccauccugggcaagcgcagcucccuccugcacaagaagaucggcaugcgggaggagaugagccuggggugccaggaggccuucgagaucuucaagcgcgaccacgccgacagcgucaccaucgacgacaacaagcagauccucaagcagcgguucuccgaggccaaggcgcugggcgagagcaucaacgaggcccgcuccaagaucgggaucagcgagaacauggccgugccccugaugcccgaccagcaggaggagaagcuccggucccagcuggaggaggagaagcgccgguacaagaccauguucacccgccugaaggcccucaagguggagaucgagcaccuccagcugcugauggacaaggccaaggucaagcugcagaaggaguucgagguguggugggcggaggaggccacgaaccugcaggucaacagccccgccgugaacucccucgaccacaccaagccguuccugcagaccagcgacucccagcacgaguggagccagcugcucuccaacaagagcuccggcgggugggaggugcaggaccagggcaccggccgguucgacgucugcgacgugaacgcccgcaagauccugcccagccccugccccuccccgcacagccagaagcaguccagcacgagcacgccccuggaggacuccauccccaagcgccccgugagcuccaucccgcucaccggggacagccagaccgacuccgacaucaucgccuucaucaaggcgcggcagagcauccugcagaagcagugccugggcuccaacuga

SEQ ID NO: 32013 - RNA, 4032 nt, Artificial Sequence
  derived and/or modified sequence opt1 from KIF7__Homo_sapiens__XP_005254959
augggccuggaggcccagcgccuccccggggccgaggaggccccggugcgggucgcccugcgcgugcggccccugcuccccaaggagcugcugcacggccaccagagcugccuccagguggagcccgggcugggccgcgucacccuggggcgggaccgccacuucggcuuccacguggugcucgccgaggacgccggccaggaggccgucuaccaggcgugcgugcagccgcugcuggaggccuucuucgagggguucaacgccaccguguucgccuacggccagacgggguccggcaagaccuacaccaugggggaggcgagcgucgccucccuccuggaggacgagcagggcaucgugccccgggccauggccgaggccuucaagcugaucgacgagaacgaccuccuggacugccuggugcacgucagcuaccucgagguguacaaggaggaguuccgcgaccugcuggaggugggcaccgcgucccgggacauccagcuccgcgaggacgagcgggggaacgucgugcugugcggcgugaaggaggucgacguggaggggcuggacgaggugcucagccugcuggagaugggcaacgccgcccgccacacgggcgccacccaccucaaccaccuguccagccggucccacaccgucuucaccgugacgcuggagcagcgcgggcgggcccccagccgccucccccggccggcgcccggccagcugcugguguccaaguuccacuucgucgaccucgccgggagcgagcgcgugcugaagaccggcuccaccggggagcggcugaaggagagcauccagaucaacuccagccuccuggcccugggcaacgucaucuccgcccucggcgacccccagcgccgggggagccacauccccuaccgcgacuccaagaucacccgcauccugaaggacagccugggcgggaacgccaagacggugaugaucgcgugcgugagcccguccagcuccgacuucgacgagacccucaacacccugaacuacgccagccgggcccagaacauccgcaaccgggccaccgucaacuggcgccccgaggccgagcggccgcccgaggagacggcguccggcgcccgcgggccgccccggcaccgcagcgagacccggaucauccaccgcggccggcgcgcccccggccccgccaccgcguccgccgccgccgccaugcggcugggggcggagugcgcccgcuaccgggccugcaccgacgccgccuacagccuccugcgcgagcugcaggcggagcccggccuccccggggccgccgcccggaaggugcgcgacuggcugugcgccguggagggcgagcgguccgcgcugagcuccgccagcgggcccgacuccggcaucgagagcgccuccgucgaggaccaggccgcgcagggcgccgggggccgcaaggaggacgagggggcccagcagcugcucacgcugcagaaccagguggcccgccuggaggaggagaaccgggacuuccucgccgcgcuggaggacgccauggagcaguacaagcugcagagcgaccgccuccgggagcagcaggaggagaugguggagcugcgccugcggcucgagcugguccgccccggcuggggcgggccgcggcugcucaacggccugccgcccggguccuucgugccccgcccccacaccgcgccccugggcggggcccacgcccacgugcucggcauggugcccccggccugccugcccggcgacgagguggggagcgagcagcggggcgagcaggucaccaacgggcgcgaggccggcgccgagcugcucaccgaggucaaccggcugggguccggcagcagcgccgccuccgaggaggaggaggaggaggaggagccgccccgccggacgcugcaccuccgccggaaccgcaucagcaacugcucccagcgggcgggcgcccgccccgggagccugcccgagcggaagggccccgagcugugccucgaggagcuggacgccgccauccccgggucccgcgcggugggcgggagcaaggcccgggugcaggcccgccaggucccgcccgccaccgccuccgaguggcgccuggcgcaggcccagcagaagauccgggagcucgccaucaacauccgcaugaaggaggagcugaucggcgagcuggugcggaccggcaaggccgcccaggcgcucaaccgccagcacagccagcggauccgcgagcuggagcaggaggccgagcagguccgggccgagcuguccgaggggcagcgccagcuccgggagcuggagggcaaggagcugcaggacgccggggagcgcagccggcuccaggaguuccgccggcgcguggccgcggcccagucccagguccaggugcugaaggagaagaagcaggccaccgagcggcuggugagccucuccgcccagagcgagaagcgccugcaggagcuggagcggaacgugcagcucaugcgccagcagcagggccagcugcagcggcgccugcgcgaggagacggagcagaagcggcgccucgaggccgagauguccaagcggcagcaccgcgugaaggagcuggagcugaagcacgagcagcagcagaagauccucaagaucaagaccgaggagaucgcggccuuccagcggaagcgccggagcggguccaacggcagcgucgugagccuggagcagcagcagaagaucgaggagcagaagaaguggcuggaccaggagauggagaaggugcuccagcagcgccgggcccuggaggagcugggcgaggagcuccacaagcgcgaggccauccuggcgaagaaggaggcccugaugcaggagaagaccgggcucgaguccaagcggcugcgcagcucccaggcccugaacgaggacaucguccgggugagcucccgccucgagcaccuggagaaggagcugagcgagaaguccggccagcuccggcaggggagcgcccagucccagcagcagauccgcggcgagaucgacagccugcggcaggagaaggacucccugcucaagcagcgccuggagaucgacggcaagcugcggcaggggagccuccugucccccgaggaggagcgcacccuguuccagcucgacgaggccaucgaggcgcuggacgccgccaucgaguacaagaacgaggccaucacgugccggcagcgcgugcugcgcgccagcgcgucccuccugagccagugcgagaugaaccugauggccaagcucuccuaccugagcuccagcgagacccgggcccugcucugcaaguacuucgacaaggucgugacccugcgcgaggagcagcaccagcagcagaucgccuucagcgagcuggagaugcagcucgaggagcagcagcggcugguguacuggcuggaggucgcccucgagcgccagcggcuggagauggaccgccagcugacccuccagcagaaggagcacgagcagaacaugcagcugcugcuccagcagucccgggaccaccugggcgaggggcuggcggacagccgccggcaguacgaggcccgcauccaggcccuggagaaggagcucggccgguacauguggaucaaccaggagcugaagcagaagcucgggggcgugaacgccgugggccacucccgcgggggcgagaagcggagccugugcuccgaggggcgccaggcgcccggcaacgaggacgagcugcaccuggccccggagcuccuguggcugagcccccucacggagggggcgccccggacccgcgaggagacccgggaccugguccacgcgccccugccgcucaccuggaagcgcuccagccugugcggcgaggagcagggcucccccgaggagcugcggcagcgcgaggccgccgagccccucguggggcgcgugcugcccgucggcgaggccgggcugccguggaacuucggcccccucagcaagccccggcgcgagcugcggcgcgccucccccgggaugaucgacgugcggaagaacccgcuguga

SEQ ID NO: 32014 - RNA, 2373 nt, Artificial Sequence
  derived and/or modified sequence opt1 from KIF9__Homo_sapiens__NP_001128350
augggcacccgcaagaaggugcacgccuucguccgggugaagcccaccgacgacuucgcccacgagaugauccgcuacggggacgacaagcggagcaucgacauccaccugaagaaggacauccgccggggcguggucaacaaccagcagacggacugguccuucaagcucgacggggugcugcacgacgcgagccaggaccugguguacgagaccgucgccaaggacguggugucccaggcccucgacggcuacaacgggaccaucaugugcuacggccagaccggcgccgggaagacguacaccaugaugggcgccaccgagaacuacaagcaccgcgggauccugccgcgggcgcugcagcaggucuuccgcaugaucgaggagcggcccacccacgccaucacggugcgcgugagcuaccucgagaucuacaacgagucccuguucgaccugcucagcacccugcccuacgucggccccuccgugaccccgaugaccaucguggagaacccccagggggucuucaucaagggccugagcgugcaccucacgucccaggaggaggacgccuucagccugcuguucgagggcgagaccaaccggaucaucgccucccacaccaugaacaagaacagcucccgcagccacugcaucuucaccaucuaccucgaggcgcacucccggacgcugagcgaggagaaguacaucaccuccaagaucaaccugguggaccucgccgggagcgagcgccugggcaaguccgggagcgagggccagguccugaaggaggccaccuacaucaacaagagccucuccuuccuggagcaggccaucaucgcccugggcgaccagaagcgggaccacauccccuuccgccagugcaagcucacccacgcgcugaaggacagccucgggggcaacugcaacauggugcuggugacgaacaucuacggggaggccgcccagcuggaggagacccuguccagccuccgguucgccucccgcaugaagcuggucaccaccgagcccgccaucaacgagaaguacgacgcggagcggauggugaagaaccuggagaaggagcucgcccugcugaagcaggagcucgccauccacgacagccugacgaaccgcaccuucgugaccuacgacccgauggacgagauccagaucgccgagaucaacucccagguccggcgcuaccuggagggcacccucgacgagaucgacaucaucagccugcgccagaucaaggagguguucaaccaguuccgggucgugcugucccagcaggagcaggagguggagagcacgcuccgccggaaguacacccugaucgaccgcaacgacuucgccgcgaucuccgccauccagaaggccgggcuggucgacguggacggccaccucgugggcgagcccgaggggcagaacuucggccugggggucgcccccuucagcaccaagcccggcaagaaggccaaguccaagaagaccuucaaggagccgcugagcucccucgcgcggaaggagggggccagcucccccgugaacggcaaggaccuggacuacgugagcacguccaagacccagcugguccccagcagcaaggacggcgacgugaaggacaugcugucccgcgaccgggagaccagcuccaucgagccccucccgagcgacucccccaaggaggagcugcgccccauccggcccgacaccccgcccagcaagcccguggccuucgaggaguucaagaacgagcagggguccgagaucaaccgcaucuucaaggagaacaagagcauccugaacgagcggcgcaagcgggccuccgagacgacccagcacaucaacgcgaucaagcgcgagaucgacgucaccaaggaggcccucaacuuccagaagucccugcgggagaagcagggcaaguacgagaacaaggggcugaugaucaucgacgaggaggaguuccuccugauccugaagcucaaggaccugaagaagcaguaccgcagcgaguaccaggaccugcgggaccuccgcgccgagauccaguacugccagcaccugguggaccagugccggcaccgccugcucauggaguucgacaucugguacaacgagagcuucgugauccccgaggacaugcagauggcccugaagccgggcggguccauccgccccggcaugguccccgugaaccggaucgugagccugggcgaggacgaccaggacaaguucucccagcuccagcagcgcguccugcccgaggggccggacagcaucuccuucuacaacgccaaggugaagaucgagcagaagcacaacuaccugaagaccaugaugggccuccagcaggcgcaccggaaguga

SEQ ID NO: 32015 - RNA, 2145 nt, Artificial Sequence
  derived and/or modified sequence opt1 from KIFAP3__Homo_sapiens__NP_001191443
augagcaucgcccugggcaacaccuaccgccggucccucagcgacuccgagaccgugagcguccugcaggccucccugugcgaggagaagaaggagaaguccagcaagcccaaggacccgccgcccuucgaggggauggagaucgacgagguggcgaacaucaacgacauggacgaguacaucgagcuccuguacgaggacauccccgacaaggugcgcggcagcgcccugauccuccagcuggcccggaaccccgacaaccuggaggagcuccugcugaacgagacggcccucggggcccuggcgcgcguccugcgggaggacuggaagcaguccguggagcucgccaccaacaucaucuacaucuucuucugcuucagcuccuucagccaguuccacggccugaucacccacuacaagaucggggcccugugcaugaacaucaucgaccacgagcucaagcgccacgagcuguggcaggaggagcuguccaagaagaagaaggccguggacgaggaccccgagaaccagacccuccggaaggacuacgagaagacguucaagaaguaccagggccuggucgugaagcaggagcagcugcuccgcguggcgcuguaccugcuccugaaccuggccgaggacacccggaccgagcucaagaugcgcaacaagaacaucguccacaugcuggugaaggcccuggaccgggacaacuucgagcuccugauccugguggucagcuuccucaagaagcuguccaucuucauggagaacaagaacgacaugguggagauggacaucguggagaagcuggucaagaugauccccugcgagcacgaggaccuccugaacaucacccugcgccuccugcugaaccucagcuucgacacgggccugcggaacaagaugguccagguggggcugcuccccaagcugaccgcccugcugggcaacgacaacuacaagcagaucgccaugugcgugcucuaccacaucuccauggacgaccgcuucaagagcauguucgcguacaccgacugcaucccgcagcugaugaagaugcuguucgagugcuccgacgagcggaucgaccucgagcugaucagcuucugcaucaaccuggccgccaacaagcgcaacgugcagcucaucugcgaggggaacggccugaagaugcugaugaagcgggcccucaaguucaaggacccccugcugaugaagaugauccgcaacaucagccagcacgacgggcccaccaagaaccucuucaucgacuacgugggcgaccuggccgcgcagaucuccaacgacgaggaggaggaguucgucaucgagugccugggcacgcucgccaaccugaccauccccgaccuggacugggagcucgugcugaaggaguacaagcuggugccguaccucaaggacaagcugaagcccggggccgccgaggacgaccugguccucgagguggucaucaugaucggcaccgugagcauggacgacuccugcgccgcgcugcuggccaagagcgggaucauccccgcccucaucgagcugcugaacgcccagcaggaggacgacgaguucgugugccagaucaucuacgucuucuaccagaugguguuccaccaggccacccgggacgugaucaucaaggagacgcaggcgcccgccuaccucaucgaccugaugcacgacaagaacaacgagauccgcaaggucugcgacaacacccuggacaucaucgccgaguacgacgaggagugggccaagaagauccaguccgagaaguuccgguggcacaacagccaguggcucgagaugguggagucccgccagauggacgagagcgagcaguaccuguacggcgacgaccgcaucgagccguacauccacgagggcgacauccuggagcggcccgaccucuucuacaacuccgacgggcugaucgcgagcgagggcgccaucucccccgacuucuucaacgacuaccaccuccagaacggggacguggucggccagcacagcuuccccgggucccugggcauggacggcuucgggcagccggugggcauccuggggcgccccgccaccgccuacggcuuccggcccgacgagcccuacuacuacggguacggcagcuga

SEQ ID NO: 32016 - RNA, 2022 nt, Artificial Sequence
  derived and/or modified sequence opt1 from KIFC1__Homo_sapiens__NP_002254
auggacccccagcgcagcccgcugcucgaggugaagggcaacaucgagcugaagcggccccugaucaaggcccccucccagcucccccugagcgggucccgccugaagcggcgcccggaccagauggaggacggccucgagcccgagaagaagcggacccgcgggcugggcgccaccacgaagaucaccaccagccacccccggguccccucccugaccacggugccgcagacccaggggcagaccaccgcgcagaaggugagcaagaagacgggcccccgcugcuccaccgccaucgccaccggccucaagaaccagaagcccguccccgccgugccggugcagaaguccgggaccagcggcgucccgcccauggccgggggcaagaagcccagcaagcggcccgcgugggaccugaaggggcagcugugcgaccucaacgccgagcugaagcgcugccgggagcgcacgcagacccuggaccaggagaaccagcagcuccaggaccagcugcgggacgcccagcagcaggucaaggcccugggcaccgagcgcaccacgcucgagggccaccuggcgaaggugcaggcccaggccgagcaggggcagcaggagcugaagaaccuccgggccugcgugcuggagcuggaggagcgccucuccacccaggagggccuggugcaggagcugcagaagaagcaggucgagcuccaggaggagcggcgcgggcugaugagccagcuggaggagaaggagcggcgccuccagaccuccgaggccgcgcugagcuccagccaggccgagguggccucccugcggcaggagaccguggcccaggccgcgcuccugacggagcgcgaggagcgccugcacggccucgagauggagcggcgccggcugcacaaccagcugcaggagcucaagggcaacauccgcguguucugccggguccgccccgugcugcccggggagcccaccccgccgcccggccugcuccuguuccccagcgggcccggcgggcccuccgacccgcccacccggcugagccucagccgcuccgacgagcggcgcggcacccugagcggcgcccccgccccgcccacgcggcacgacuucuccuucgaccgcguguucccgcccgggagcggccaggacgaggucuucgaggagaucgccaugcuggugcaguccgcccucgacggguaccccgugugcaucuucgcguacggccagaccgggagcggcaagaccuucaccauggagggcgggcccggcggggacccccagcuggagggccugaucccccgggcccugcgccaccucuucuccgucgcccaggagcugagcgggcagggcuggacguacuccuucguggccagcuacguggagaucuacaacgagaccguccgggaccugcucgccaccggcacccgcaaggggcagggcggggagugcgagauccggcgcgcgggccccggcuccgaggagcugacggugaccaacgcccgguacguccccgugagcugcgagaaggagguggacgcccugcuccaccuggcccgccagaaccgcgcggucgcccggaccgcccagaacgagcgcuccagccggucccacagcguguuccagcugcagaucuccggggagcacagcucccgcggccuccagugcggggccccgcugagccugguggaccucgccggcagcgagcggcuggaccccgggcuggcgcucggccccggcgagcgcgagcggcugcgcgagacccaggccaucaacuccagccuguccacgcucgggcuggucaucauggcccugagcaacaaggagucccacgugcccuaccggaacagcaagcucaccuaccugcugcagaacucccucggcgggagcgccaagaugcugauguucgugaacaucuccccgcuggaggagaacgucagcgagucccucaacagccugcgcuucgccuccaaggugaaccagugcgugaucggcaccgcgcaggccaaccggaaguga

SEQ ID NO: 32017 - RNA, 2481 nt, Artificial Sequence
  derived and/or modified sequence opt1 from KIFC3__Homo_sapiens__NP_001123572
auggugcccagccgccggaccuggaaccugggcgccaccccgucccuccgcgggcuguggcgggucggccgcgcccccgagcccgagcccgggauggcgcggccggcccccgcccccgccagccccgccgcgcgcccguucccccacaccggccccgggcggcugcgcaccggccggggcaaggacacccccgugugcggggacgaggacuccagcgcccgcuccgccgcccggccggcgcucgcccagugccgcgcccugagcguggacugggccggccccgggagcccccacggccuguaccucacccugcaggucgagcaccugaaggagaagcucaucucccaggcccaggaggugucccggcugcgcagcgagcucgggggcacggaccucgagaagcaccgggaccugcugaugguggagaacgagcgccuccggcaggagaugcgccggugcgaggcggagcugcaggagcugcgcaccaagcccgccggcccgugccccgggugcgagcacucccaggagagcgcccagcuccgggacaagcugucccagcugcagcucgagauggccgagagcaagggcaugcuguccgagcugaaccucgagguccagcagaagaccgaccgccuggccgagguggagcugcgccucaaggacugccuggcggagaaggcccaggaggaggagcggcugagccgccggcuccgcgacucccacgagaccaucgccagccugcgggcccaguccccgcccgugaaguacgucaucaagacgguggagguggagagcagcaagaccaagcaggcccuguccgagagccaggcgcgcaaccagcaccuccaggagcaggucgccaugcagcgccaggugcugaaggagauggagcagcagcugcaguccagccaccagcucaccgcccggcugcgggcccagaucgccauguacgaguccgagcuggagcgcgcgcacgggcagaugcucgaggagaugcagagccuggaggaggacaagaaccgggccaucgaggaggccuucgcccgcgcccagguggagaugaaggcgguccacgagaaccuggccggcgugcggaccaaccuccugacgcugcagcccgcccuccgcacccugaccaacgacuacaacggccugaagcgccaggugcggggguucccccuccugcugcaggaggcccugcgguccgucaaggcggagaucggccaggccaucgaggaggugaacagcaacaaccaggagcuccugcgcaaguaccggcgcgagcugcagcuccgcaagaagugccacaacgagcuggugcggcugaaggggaacauccgcgucaucgcccgggugcgccccgugaccaaggaggacggcgaggggcccgaggccacgaacgccgucaccuucgacgcggacgacgacuccaucauccaccuccugcacaagggcaagccggugagcuucgagcuggacaaggucuucagcccccaggccucccagcaggacguguuccaggaggugcaggcccucgucaccuccugcaucgacggcuucaacgugugcaucuucgccuacgggcagaccggcgccgggaagacguacaccauggagggcaccgcggagaaccccgggaucaaccagcgggcccugcagcugcuguucagcgaggugcaggagaaggccuccgacugggaguacaccaucacggucagcgccgcggagaucuacaacgaggugcugcgcgaccugcucggcaaggagccccaggagaagcuggagauccggcugugcccggacggcuccgggcagcucuacgugcccggccugaccgaguuccagguccagagcguggacgacaucaacaagguguucgaguucgggcacaccaaccgcaccacggaguucaccaaccugaacgagcacuccagccggagccacgcccuccugaucgucaccgugcgcggcguggacugcuccaccgggcugcggacgaccggcaagcucaaccuggucgaccuggccggcagcgagcgcguggggaaguccggcgccgaggggagccggcuccgcgaggcccagcacaucaacaagucccugagcgcgcugggcgacgugaucgccgcccuccggucccgccagggccacguccccuuccggaacagcaagcugaccuaccugcuccaggacucccugagcggggacuccaagacccugaugguggugcaggucagcccgguggagaagaacacguccgagacccucuacagccugaaguucgccgagcgcgugcgguccgucgagcugggccccgggcuccgccgggccgagcugggcagcugguccagccaggagcaccuggagugggagcccgcgugccagacgccccagccgagcgcccgcgcccacuccgcccccagcuccgggaccagcucccgccccggcagcauccggcgcaagcuccagcccuccgccuga

SEQ ID NO: 32018 - RNA, 1182 nt, Artificial Sequence
  derived and/or modified sequence opt1 from KIN__Homo_sapiens__NP_036443
augggcaagagcgacuuccugacccccaaggccaucgccaaccgcaucaaguccaaggggcuccagaagcugcggugguacugccagaugugccagaagcagugccgcgacgagaacggcuucaagugccacugcaugagcgagucccaccagcggcagcugcuccuggcgagcgagaacccgcagcaguucauggacuacuucuccgaggaguuccgcaacgacuuccuggagcuccugcggcgccgguucgggaccaagcgcgugcacaacaacaucgucuacaacgaguacaucagccaccgggagcacauccacaugaacgccacgcagugggagacccugaccgacuucaccaaguggcucggccgcgaggggcugugcaagguggacgagacgcccaagggcugguacauccaguacaucgaccgggaccccgagaccauccgccggcagcuggagcucgagaagaagaagaagcaggaccuggacgacgaggagaagaccgccaaguucaucgaggagcagguccgccggggccuggaggggaaggagcaggaggugcccaccuucacggagcucucccgcgagaacgacgaggagaaggugaccuucaaccugagcaagggcgccugcuccagcuccggggccaccagcuccaagagcuccacccugggcccgagcgcgcucaagacgaucggguccagcgccuccgugaagcggaaggagagcagccaguccagcacccaguccaaggagaagaagaagaagaaguccgcccuggacgagaucauggagaucgaggaggagaagaagcgcaccgcccggaccgacuacuggcugcagcccgagaucaucgucaagaucaucacgaagaagcucggcgagaaguaccacaagaagaaggcgaucgugaaggaggugaucgacaaguacaccgccgucgugaagaugaucgacagcggcgacaagcugaagcuggaccagacccaccucgagaccgugauccccgcccccgggaagcgcauccugguccugaacggcggguaccggggcaacgagggcacgcucgagagcaucaacgagaagaccuucuccgccaccaucgugaucgagaccgggccgcugaagggccgccgcguggaggggauccaguacgaggacaucagcaagcuggccuga

SEQ ID NO: 32019 - RNA, 1047 nt, Artificial Sequence
  derived and/or modified sequence opt1 from KIR2DL1__Homo_sapiens__NP_055033
augagccugcucguggucuccauggccugcgugggcuucuuccugcugcagggggccuggccccacgagggcgugcaccgcaagccgagccuccuggcgcaccccgggcggcuggucaaguccgaggagaccgugauccuccagugcuggagcgacgugauguucgagcacuuccugcugcaccgcgagggcauguucaacgacacccuccggcugaucggggagcaccacgacggcgucuccaaggccaacuucagcaucucccgcaugacgcaggaccuggccggcaccuaccggugcuacgggagcgugacccacucccccuaccaggugagcgcccccuccgacccgcucgacaucgucaucaucggccuguacgagaagcccagccuguccgcccagcucgggcccaccgugcuggcgggcgagaacgugacgcugagcugcuccagccgcuccagcuacgacauguaccaccucucccgggagggggaggcccacgagcgccggcugcccgccggcccgaaggucaacggcaccuuccaggccgacuucccccuggggcccgcgacccacggcgggaccuaccgcugcuucggcagcuuccacgacagccccuacgagugguccaagagcuccgacccgcuccuggugagcgugacgggcaaccccuccaacagcuggcccucccccaccgagccgagcuccaagaccgggaacccccggcaccuccacauccucaucggcaccagcgucgugaucauccuguucauccugcuguucuuccugcugcaccgcuggugcuccaacaagaagaacgccgccgugauggaccaggagagcgccgggaaccggacggccaacuccgaggacagcgacgagcaggacccccaggaggucaccuacacccagcucaaccacugcguguucacccagcgcaagaucacgcggcccucccagcgcccgaagaccccgcccaccgacaucaucguguacaccgagcugcccaacgcggagagccgguccaaggucgugagcugccccuga

SEQ ID NO: 32020 - RNA, 1047 nt, Artificial Sequence
  derived and/or modified sequence opt1 from KIR2DL2__Homo_sapiens__NP_055034
augagccugaugguggucuccauggccugcgugggcuucuuccuccugcagggggccuggccccacgagggcgugcaccgcaagccgagccugcucgcgcaccccgggcggcuggucaaguccgaggagaccgugauccugcagugcuggagcgacgugcgcuucgagcacuuccuccugcaccgggagggcaaguucaaggacacccugcaccucaucggggagcaccacgacggcgucuccaaggccaacuucagcaucggccccaugaugcaggaccuggccgggacguaccgcugcuacggcuccgugacccacagccccuaccagcuguccgccccgagcgacccccucgacaucgugaucaccgggcuguacgagaagcccucccugagcgcccagcccggcccgaccguccucgcgggggaguccgugacgcugagcugcuccagccgguccagcuacgacauguaccaccugucccgcgagggcgaggcccacgagugccgguucagcgccggccccaaggugaacgggaccuuccaggccgacuucccccucggccccgcgacccacgggggcaccuaccgcugcuucggcagcuuccgggacuccccguacgaguggagcaacuccagcgacccccugcuggucuccgugacggggaaccccagcaacuccuggcccagcccgaccgagcccuccagcaagaccggcaacccccgccaccuccacauccugaucgggaccuccguggucaucauccuguucauccuccuguucuuccugcuccaccgguggugcagcaacaagaagaacgccgccgugauggaccaggaguccgccggcaaccgcacggccaacagcgaggacuccgacgagcaggacccccaggaggugaccuacacccagcugaaccacugcgucuucacccagcggaagaucacgcgcccgagccagcggcccaagaccccgcccaccgacaucaucguguacaccgagcugcccaacgcggagucccgcagcaagguggucuccugccccuga

SEQ ID NO: 32021 - RNA, 1026 nt, Artificial Sequence
  derived and/or modified sequence opt1 from KIR2DL3__Homo_sapiens__NP_056952
augagccugaugguggucuccauggugugcgugggcuucuuccuccugcagggggccuggccccacgagggcguccaccgcaagccgagccugcucgcccaccccgggccccuggugaaguccgaggagaccgugauccugcagugcuggagcgacguccgguuccagcacuuccuccugcaccgcgagggcaaguucaaggacacccugcaccucaucggggagcaccacgacggcguguccaaggcgaacuucagcaucggccccaugaugcaggaccuggccgggacguaccggugcuacggcuccgugacccacagcccguaccagcuguccgcccccagcgacccccucgacaucgucaucaccgggcuguacgagaagcccucccugagcgcccagccgggccccaccgugcucgccggggaguccgugacgcugagcugcuccagccgcuccagcuacgacauguaccaccugucccgggagggcgaggcgcacgagcgccgguucagcgccggccccaaggucaacgggaccuuccaggccgacuucccccucggcccggccacccacgggggcaccuaccgcugcuucggcagcuuccgggacucccccuacgaguggagcaacuccagcgacccccugcugguguccgugacggggaaccccagcaacuccuggccgagccccaccgagcccuccagcgagaccggcaacccccgccaccuccacguccugaucgggaccuccguggugaucauccuguucauccuccugcuguucuuccuccugcaccgguggugcugcaacaagaagaacgcggucgugauggaccaggagccggccggcaaccgcacggugaaccgggaggacagcgacgagcaggacccccaggaggucaccuacgcccagcugaaccacugcguguucacccagcgcaagaucacccggcccucccagcgccccaagacgccgcccaccgacaucaucguguacaccgagcuccccaacgccgagcccuga

SEQ ID NO: 32022 - RNA, 1029 nt, Artificial Sequence
  derived and/or modified sequence opt1 from KIR2DL4__Homo_sapiens__NP_001074239
augagcaugucccccaccgugaucauccuggccugccucggcuucuuccuggaccagagcgucugggcccacgucgggggccaggacaagccguucugcuccgcguggcccagcgccguggugccccagggcgggcacgugacccugcgcugccacuaccggcgcggguucaacaucuucacgcucuacaagaaggacggcgugcccgucccggagcuguacaaccggaucuucuggaacuccuuccugaucagccccgugacccccgcccacgccggcaccuaccgcugccggggguuccacccccacuccccgaccgaguggagcgcccccuccaacccccucgugaucauggucacgggccuguacgagaagcccagccugaccgcgcgcccggggcccaccgugcgggccggcgagaacgugacccucuccugcagcucccagagcuccuucgacaucuaccaccugagccgcgagggggaggcccacgagcugcggcuccccgccguccccuccaucaacggcacguuccaggcggacuucccgcugggccccgccacccacggggagaccuaccgcugcuucggcagcuuccacgggucccccuacgaguggagcgaccccagcgacccgcugcccguguccgugaccggcaaccccagcuccagcuggcccuccccgacggagcccagcuucaagaccgacgccgccgucaugaaccaggagcccgccggccaccggaccgugaaccgcgaggacuccgacgagcaggacccccaggaggugaccuacgcgcagcucgaccacugcaucuucacgcagcggaagaucaccgggccgagccagcgcuccaagcggcccagcaccgacaccuccgucugcaucgagcugcccaacgccgagccgcgcgcccugagccccgcccacgagcaccacucccaggcccucaugggcagcucccgggagacgaccgcgcugagccagacccagcuggccuccagcaacgugcccgccgccgggaucuga

SEQ ID NO: 32023 - RNA, 1128 nt, Artificial Sequence
  derived and/or modified sequence opt1 from KIR2DL5A__Homo_sapiens__NP_065396
augagccugauggugaucuccauggccugcgucggcuucuuccuccugcagggggccuggacccacgagggcgggcaggacaagccccugcucagcgcguggccguccgccguggugccccgcggcgggcacgucacccugcugugccggagccgccucggcuucacgaucuucucccuguacaaggaggacggcgugcccgugcccgagcuguacaacaagaucuucuggaaguccauccucauggggccggucacccccgcccacgccggcaccuaccggugccgcgggagccacccccggagccccaucgagugguccgccccgagcaacccccuggugaucguggucaccggccuguucgggaagcccucccucagcgcgcagcccggcccgacggugcgcaccggcgagaacgugacccuguccugcagcucccggagcuccuucgacauguaccaccugagccgcgaggggcgggcccacgagccccgccuccccgccguccccuccgugaacggcaccuuccaggccgacuucccgcuggggcccgcgacgcacggcggcaccuacacgugcuucgggagccugcacgacagccccuacgagugguccgaccccagcgacccgcuccugguguccgucaccggcaacagcuccagcuccagcuccagccccaccgagcccuccagcaagaccgggauccggcgccaccuccacauccugaucggcaccuccguggccaucauccuguucaucauccuguucuucuuccuccugcacugcugcugcagcaacaagaagaacgccgccgugauggaccaggagcccgccggggaccggaccgucaaccgcgaggacuccgacgaccaggacccgcaggaggugacguacgcgcagcuggaccacugcguguucacccagaccaagaucaccagccccucccagcggcccaagacgcccccgaccgacaccaccauguacauggagcuccccaacgccaagccccgcagccuguccccggcccacaagcaccacagccaggcccugcggggcagcucccgcgagacgaccgcccucagccagaaccgggucgcguccagccacgugcccgccgccggcaucuga

SEQ ID NO: 32024 - RNA, 1128 nt, Artificial Sequence
  derived and/or modified sequence opt1 from KIR2DL5B__Homo_sapiens__NP_001018091
augagccugauggugaucuccauggccugcgucggcuucuuccuccugcagggggccuggacccacgagggcgggcaggacaagccccugcucagcgcguggccguccgccguggugccccgcggcgggcacgucacccugcugugccggagccgccucggcuucacgaucuucucccuguacaaggaggacggcgugcccgugcccgagcuguacaacaagaucuucuggaaguccauccucauggggccggucacccccgcccacgccggcaccuaccggugccgcgggagccacccccggagccccaucgagugguccgccccgagcaacccccuggugaucguggucaccggccuguucgggaagcccucccucagcgcgcagcccggcccgacggugcgcaccggcgagaacguggcccuguccugcagcucccggagcuccuucgacauguaccaccugagccgcgaggggcgggcccacgagccccgccuccccgccguccccuccguggacggcaccuuccaggcggacuucccgcuggggcccgccacccacggcggcacguacacgugcuucagcagccugcacgacucccccuacgaguggagcgaccccuccgacccgcuccuggugagcgucaccgggaacuccagcuccagcuccagcucccccaccgagcccagcuccaagaccggcauccggcgccaccuccacauccugaucgggaccagcguggccaucauccuguucaucauccuguucuucuuccuccugcacugcugcugcuccaacaagaagaacgccgccgugauggaccagggccccgcgggggaccggaccgucaaccgcgaggacagcgacgaccaggacccgcaggaggugaccuacgcccagcuggaccacugcguguucacgcagaccaagaucaccucccccagccagcggcccaaggcgcccccgaccgacacgaccauguacauggagcuccccaacgccaagccccgcucccugagcccggcccacaagcaccacagccaggcccugcggggcuccagccgcgagaccaccgcccucucccagaaccgggucgccagcucccacgugcccgccgccggcaucuga

SEQ ID NO: 32025 - RNA, 915 nt, Artificial Sequence
  derived and/or modified sequence opt1 from KIR2DS1__Homo_sapiens__NP_055327
augagccugaccguggucuccauggccugcgugggcuucuuccuccugcagggggccuggccccacgagggcgugcaccgcaagccgagccugcucgcgcaccccgggcggcuggucaaguccgaggagaccgugauccugcagugcuggagcgacgugauguucgagcacuuccuccugcaccgcgagggcauguucaacgacacgcugcggcucaucggggagcaccacgacggcgucuccaaggccaacuucagcaucucccgcaugaagcaggaccuggccggcaccuaccggugcuacgggagcgugacccacucccccuaccagcugagcgcccccuccgacccgcucgacaucgugaucaucggccuguacgagaagcccagccuguccgcccagcccgggcccaccguccucgcgggcgagaacgugacgcugagcugcuccagccgcuccagcuacgacauguaccaccugucccgggagggggaggcccacgagcgccggcucccggccggcaccaaggugaacggcaccuuccaggccaacuucccccuggggcccgcgacccacggcgggacguaccgcugcuucggcagcuuccgggacagccccuacgagugguccaagagcuccgacccgcugcucgucagcgugaccggcaaccccuccaacagcuggcccucccccaccgagccgagcuccgagaccgggaacccccgccaccuccacgugcugaucggcacgagcgucgugaagauccccuucaccauccugcuguucuuccugcuccaccgguggugcuccgacaagaagaacgccgccgugauggaccaggagcccgccgggaaccgcaccgucaacagcgaggacuccgacgagcaggaccaccaggaggugagcuacgccuga

SEQ ID NO: 32026 - RNA, 1017 nt, Artificial Sequence
  derived and/or modified sequence opt1 from KIR2DS2__Homo_sapiens__NP_001278624
augagccugaugguggucuccauggccugcgugggcuucuuccuccugcagggggccuggccccacgagggcgugcaccgcaagccgagccugcucgcgcaccccgggccccuggucaaguccgaggagaccgugauccugcagugcuggagcgacgugcgguucgagcacuuccuccugcaccgcgagggcaaguacaaggacacccugcaccucaucggggagcaccacgacggcgucuccaaggccaacuucagcaucggccccaugaugcaggaccuggccgggacguaccggugcuacggcuccgugacccacagcccguaccagcuguccgcccccagcgacccccucgacaucgugaucaccgggcuguacgagaagcccucccugagcgcccagccgggccccaccguccucgcgggggaguccgugacgcugagcugcuccagccgcuccagcuacgacauguaccaccugucccgggagggcgaggcccacgagcgccgguucagcgccggccccaaggugaacgggaccuuccaggccgacuucccccucggcccggcgacccacgggggcaccuaccgcugcuucggcagcuuccgggacucccccuacgaguggagcaacuccagcgacccccugcuggucuccgugacggggaaccccagcaacuccuggccgagccccaccgagcccuccagcaagaccggcaacccccgccaccuccacgugcugaucgggaccuccgucgugaagaucccguucacgauccuccuguucuuccugcugcaccgguggugcagcaacaagaagaacgccgccgugauggaccaggagcccgccggcaaccgcaccgucaacuccgagcgggagaucacccgccccagcgagcggcccaagaccccgcccacggacaccuccauguacaucgagcuccccaacgccgagccccgcagcaaggugguguucugcccgcgggcgccccaguccgggcuggagggcaucuucuga

SEQ ID NO: 32027 - RNA, 915 nt, Artificial Sequence
  derived and/or modified sequence opt1 from KIR2DS3__Homo_sapiens__NP_036445
augagccugauggugaucuccauggccugcgucggcuucuucuggcuccagggggccuggccccacgagggcuuccgccggaagccgagccugcuggcgcaccccgggcgccucgugaaguccgaggagaccgugauccugcagugcuggagcgacgucauguucgagcacuuccugcuccaccgggagggcaccuucaacgacacgcugcgccugaucggggagcacaucgacggcguguccaaggccaacuucagcaucggccggaugcgccaggaccucgccgggaccuaccggugcuacggcuccgugccccacagccccuaccaguucuccgccccgagcgacccccuggacaucgucaucaccgggcuguacgagaagcccucccucagcgcccagcccggcccgaccgugcuggcgggggaguccgugacgcugagcugcuccagcugguccagcuacgacauguaccaccucuccaccgagggcgaggcccacgagcgccgguucagcgccggccccaaggucaacgggaccuuccaggccgacuucccccugggccccgcgacccagggcgggacguaccgcugcuucggcagcuuccacgacuccccguacgaguggagcaaguccagcgacccccugcucguguccgugaccgggaaccccagcaacuccuggcccagcccgaccgagcccuccagcaagaccggcaacccccggcaccuccacguccugaucgggacguccguggugaagcugcccuucaccauccugcuguucuuccuccugcaccgcuggugcagcgacaagaagaacgccuccgucauggaccagggcccggccgggaaccggaccgugaaccgcgaggacagcgacgagcaggaccaccaggagguguccuacgccuga

SEQ ID NO: 32028 - RNA, 915 nt, Artificial Sequence
  derived and/or modified sequence opt1 from KIR2DS4__Homo_sapiens__NP_036446
augagccugauggugaucaucauggccugcgucggcuucuuccuccugcagggggccuggccccaggagggcgugcaccgcaagccguccuuccuggcgcuccccgggcaccuggucaagagcgaggagaccgugauccugcagugcugguccgacgugauguucgagcacuuccuccugcaccgggagggcaaguucaacaacacccugcaccucaucggggagcaccacgacggcgugagcaaggccaacuucuccaucggccccaugaugcccguccuggccgggacguaccgcugcuacggcagcgugccgcacucccccuaccagcugagcgcccccuccgacccccucgacauggugaucaucgggcuguacgagaagccgagccuguccgcccagcccggccccaccguccaggcgggggagaacgugacccucagcugcuccagccgguccagcuacgacauguaccaccugucccgcgagggcgaggcccacgagcggcgccugcccgccgugcggagcaucaacggcaccuuccaggccgacuucccgcucgggcccgcgacgcacggcgggaccuaccgcugcuucggcuccuuccgggacgcccccuacgaguggagcaacagcuccgacccccugcuggucagcgugaccggcaacccguccaacagcuggcccucccccaccgagcccagcuccaagacggggaacccgcgccaccuccacgugcugaucggcaccagcgucgugaagauccccuucaccauccuccuguucuuccugcugcaccgguggugcuccgacaagaagaacgccgccgugauggaccaggagcccgccgggaaccgcaccgucaacagcgaggacuccgacgagcaggaccaccaggaggugagcuacgcguga

SEQ ID NO: 32029 - RNA, 1335 nt, Artificial Sequence
  derived and/or modified sequence opt1 from KIR3DL1__Homo_sapiens__NP_037421
augagccugaugguggucuccauggccugcgugggccucuuccuggugcagcgcgccgggccccacaugggcgggcaggacaagccguuccugagcgcguggcccuccgccgucgugccccggggcgggcacgugacccuccgcugccacuaccggcaccgcuucaacaacuucaugcuguacaaggaggaccggauccacauccccaucuuccacggccgcaucuuccaggagagcuucaacauguccccggucaccacggcccacgccggcaacuacacgugccgggggagccacccccacucccccaccggcuggagcgcccccuccaacccgguggugaucauggucaccgggaaccaccgcaagcccagccugcucgcgcaccccggcccccuggugaaguccggggagcgggugauccugcagugcuggagcgacaucauguucgagcacuucuuccuccacaaggagggcaucuccaaggacccgagccgccuggucggccagauccacgacgggguguccaaggccaacuucagcaucggccccaugaugcuggcccucgccgggaccuaccggugcuacggcuccgugacccacacccccuaccagcugagcgcgcccuccgacccgcuggacaucgucgugaccggccccuacgagaagcccagccucagcgcccagcccgggccgaaggugcaggccggcgaguccgucacgcugagcugcuccagccgcuccagcuacgacauguaccaccugucccgggagggcggggcccacgagcgccggcuccccgccgugcgcaaggugaaccggaccuuccaggcggacuucccccuggggcccgccacccacggcggcaccuaccgcugcuucgggagcuuccggcacuccccguacgaguggagcgaccccuccgacccccugcucgucagcgugacgggcaaccccuccagcuccuggccgagccccaccgagcccuccagcaaguccgggaacccgcgccaccuccacauccugaucggcaccagcguggucaucauccucuucauccugcugcuguucuuccugcugcaccucuggugcagcaacaagaagaacgccgccgugauggaccaggagcccgccgggaaccggaccgcgaacuccgaggacagcgacgagcaggaccccgaggaggucacguacgcccagcuggaccacugcguguucacccagcgcaagaucacccgccccucccagcggccgaagaccccgcccacggacaccauccuguacaccgagcuccccaacgccaagccccgcagcaagguggucuccugccccuga

SEQ ID NO: 32030 - RNA, 1317 nt, Artificial Sequence
  derived and/or modified sequence opt1 from KIR3DL2__Homo_sapiens__NP_001229796
augagccugaccguggucuccauggccugcgugggcuucuuccuccugcagggggccuggccccugaugggcgggcaggacaagccguuccucagcgcgcgccccuccaccguggucccccggggcgggcacguggcccugcagugccacuaccgccggggcuucaacaacuucaugcuguacaaggaggaccgcagccacgugcccaucuuccacggccggaucuuccaggaguccuucaucauggggccggucacgcccgcccacgccggcaccuaccgcugccgggggagccgcccccacucccucaccggcuggagcgcccccuccaacccgcuggugaucauggugaccgggaaccaccggaagcccagccugcucgcgcaccccggcccccugcugaaguccggcgagacggucauccuccagugcuggagcgacgugauguucgagcacuucuuccugcaccgcgaggggaucuccgaggacccgagccggcuggugggccagauccacgacggggucuccaaggccaacuucagcaucggcccccucaugcccgugcuggccggcaccuaccgcugcuacggguccgugccccacagcccguaccagcuguccgcccccagcgacccccucgacaucgucaucaccggccuguacgagaagcccagccuguccgcgcagccggggcccaccgugcaggccggcgagaacgugacgcucagcugcuccagcugguccagcuacgacaucuaccaccugucccgggagggggaggcccacgagcgccggcugcgcgccguccccaaggugaaccggaccuuccaggccgacuucccccucggcccggcgacccacggcgggaccuaccgcugcuucggcagcuuccgggcccugcccugcgugugguccaacagcuccgacccccugcucgucagcgugacggggaucugccgccaccuccacgugcugaucggcaccuccgucgugaucuuccucuucauccugcugcuguucuuccugcuguaccgguggugcagcaacaagaagaacgccgccgucauggaccaggagcccgccggggaccgcaccgugaaccgccaggacuccgacgagcaggacccgcaggaggugaccuacgcgcagcucgaccacugcgucuucauccagcggaagaucagccgccccucccagcggcccaagacgccgcugaccgacaccagcguguacaccgagcugcccaacgccgagccccgcuccaagguggucagcugcccccgggccccgcagagcggccucgagggcguguucuga

SEQ ID NO: 32031 - RNA, 1233 nt, Artificial Sequence
  derived and/or modified sequence opt1 from KIR3DL3__Homo_sapiens__NP_703144
augagccugaugguggucuccauggccugcgugggcuucuuccuccuggaggggcccuggccgcacgugggcgggcaggacaagcccuuccugagcgccuggcccggcaccgucguguccgaggggcagcacgugacccuccagugccgcagccggcugggcuucaacgaguucucccugagcaaggaggacggcaugcccgucccggagcucuacaaccgcaucuuccggaacuccuuccugauggggcccgugacgcccgcgcacgccggcaccuaccgcugcugcagcucccacccccacagcccgaccgggugguccgcccccagcaaccccguggucaucauggugaccggcgugcaccggaagcccucccugcucgcccacccggggccccuggucaagagcggcgagacggugauccugcagugcugguccgacgugcgcuucgagcgguuccuccugcaccgcgagggcaucaccgaggacccccugcggcucgucgggcagcugcacgacgccggcagccaggugaacuacuccauggggcccaugaccccggcgcuggccggcaccuaccgcugcuucggcagcgugacgcaccuccccuacgagcuguccgcccccagcgacccccuggacaucgucgugguggggcucuacggcaagccgagccuguccgcccagcccgggcccaccguccaggcgggcgagaacgugacccugagcugcuccagccggucccucuucgacaucuaccaccugagccgcgaggccgaggccggggagcugcggcucaccgccgugcugcgcgucaacggcacguuccaggccaacuucccccugggcccggugacccacgggggcaacuaccggugcuucggguccuuccgcgcgcucccccacgccuggagcgaccccuccgacccccugccggucagcgugaccggcaacucccggaaccugcacgugcucaucgggaccagcgucgugaucauccccuucgccauccugcuguucuuccuccugcaccgcuggugcgccaacaagaagaacgccguggucauggaccaggagcccgcgggcaaccggacggugaaccgcgaggacuccgacgagcaggacccgcaggaggugaccuacgcccagcugaaccacugcgucuucacccagcggaagaucacccgccccagccagcgccccaagacgcccccgaccgacaccuccguguga

SEQ ID NO: 32032 - RNA, 1902 nt, Artificial Sequence
  derived and/or modified sequence opt1 from KIRREL2__Homo_sapiens__NP_115499
augcugcgcaugcgggugcccgcccuccugguccuccuguucugcuuccgcggccgggccgggcccagcccccacuuccugcagcagcccgaggaccugguggugcuccugggcgaggaggcgcgccugcccugcgcccucggggccuacuggggccugguccaguggaccaaguccgggcuggcccucggcggccagcgggaccugccgggguggagccgcuacuggaucuccggcaacgccgcgaacgggcagcacgaccugcacauccggcccguggagcucgaggacgaggccagcuacgagugccaggccacccaggccggccugcgcucccggcccgcgcagcugcacgugcucgugcccccggaggcgccccagguccucgggggccccagcgugucccuggucgccggcgugcccgccaaccugacgugccgcagccgcggggacgcccggccgacccccgagcugcugugguuccgggacggcgugcuccuggacggggccaccuuccaccagacccugcucaaggagggcacgcccggcuccgucgagagcacccugacccugacccccuucucccacgacgacggggccacguucgugugccgcgcccggagccaggcccucccgaccggccgcgacaccgccaucacccugucccugcaguacccgcccgaggugacgcucagcgcgagcccccacaccguccaggagggggagaaggugaucuuccugugccaggccaccgcccagccgcccgugaccggcuaccggugggccaagggcgggucccccguccugggcgcccgcgggccccggcucgaggugguggcggacgccuccuuccugacggagccggucagcugcgagguguccaacgccgugggcagcgccaaccgcagcaccgcccuggacguccucuucgggcccauccugcaggcgaagcccgagcccguguccgucgacgugggcgaggacgccagcuucuccugcgccuggcgggggaacccgcugccccgcgugaccuggacccgccggggcggcgcccagguccucgggagcggcgcgacgcugcgccugcccuccguggggccggaggacgccggcgacuacgugugccgggccgaggccgggcucagcggccugcgcggcggggccgcggaggcccggcugaccgucaacgccccgcccguggugaccgcccuccacuccgcccccgcguuccugcgcggccccgcccggcugcagugccuggucuucgccagccccgcccccgacgccguggugugguccugggacgagggguuccucgaggcgggcagccagggccgcuuccuggucgagaccuuccccgccccggagucccgcgggggccuggggcccggccucaucagcgugcugcacaucuccgggacgcaggagagcgacuucucccggagcuucaacugcuccgcccggaaccgccugggcgagggcggggcccaggcgagccucggccggcgcgaccugcugcccaccgugcggaucgucgccgggguggccgccgccaccaccacgcuccugauggugaucaccggcgucgcgcugugcugcuggcgccacuccaaggccagcgccagcuucuccgagcagaagaaccucaugcggauccccgggagcuccgacggcagcuccagccgcggcccggaggaggaggagaccgggucccgggaggaccgcggccccaucgugcacaccgaccacagcgaccuggugcuggaggaggaggggacgcucgagaccaaggaccccaccaacggcuacuacaagguccgcgggguguccccgcccgccagccccgacucccgggugaccagcuuccaguggaagucccccggcaucagcaaccugcccuga

SEQ ID NO: 32033 - RNA, 1803 nt, Artificial Sequence
  derived and/or modified sequence opt1 from KIRREL3__Homo_sapiens__NP_001155179
augaagcccuuccagcuggaccuccuguucgugugcuucuuccuguucagccaggagcucggccugcagaagcgcgggugcugccugguccucggcuacauggccaaggacaaguuccggcgcaugaacgagggccagguguacuccuucagccagcagccccaggaccagguggucguguccggccagcccgugacccugcugugcgccauccccgaguacgacggguucguccucuggaucaaggacggccuggcgcugggcguggggcgggaccucagcuccuacccccaguaccugguggucggcaaccaccugagcggggagcaccaccucaagauccugcgcgccgagcugcaggacgacgccguguacgagugccaggccauccaggccgcgauccggucccgcccggcccggcucaccgugcuggucccgcccgacgaccccgugauccugggcgggcccgugaucagccuccgcgccggcgacccccugaaccugacgugccacgccgacaacgcgaagcccgccgccuccaucaucuggcuccggaagggcgaggucaucaacggggccaccuacagcaagacccugcugcgcgacggcaagcgggaguccaucgugagcacccucuucaucucccccggggacguggagaacggccagagcaucgucugccgcgccacgaacaaggcgaucccgggcgggaaggagaccuccgugaccaucgacauccagcacccgccccuggugaaccugagcgucgagccccagcccgugcucgaggacaacguggucaccuuccacugcuccgccaaggccaaccccgccgugacgcaguaccggugggccaagcgcggccagaucaucaaggaggcgagcggggaggucuaccggaccaccguggacuacaccuacuucuccgagcccgugagcugcgaggucacgaacgcccugggcagcaccaaccugucccgcaccguggacguguacuucgggccccggaugaccacggagccgcagagccuccuggucgaccugggcuccgacgccaucuucagcugcgccuggaccggcaaccccucccucaccaucguguggaugaagcgcgggagcggcgugguccuguccaacgagaagacccugacgcucaagagcgugcggcaggaggacgccgggaaguacgugugccgcgcggucgugccccgggugggcgccggggagcgcgaggucacccugaccgugaacgggcccccgaucaucuccagcacccagacgcagcacgcccugcacggcgagaaggggcagaucaagugcuucauccgcuccaccccgccgcccgaccggaucgccuggagcuggaaggagaacgugcucgaguccggcaccagcgggcgcuacaccgucgagacgaucuccaccgaggagggcgugaucagcacccugaccaucuccaacaucgugcgggccgacuuccagacgaucuacaacugcaccgcguggaacagcuucggguccgacaccgagaucauccgccugaaggagcagggcagcgagaugaaguccggcgccgggcucgaggccgagagcguccccauggccgugaucaucggcguggcggucggggccggcguggccuuccuggugcugauggccaccaucgucgccuucugcugcgcgcggagccagcgcuccacgggcgggcggagcggcaucuccgggcgcggcaccgagaagaaggcccggcuccgccugccccggcgcgccagcaagcaggagugcaacgagcagggguccuga

SEQ ID NO: 32034 - RNA, 1974 nt, Artificial Sequence
  derived and/or modified sequence opt1 from KIRREL__Homo_sapiens__NP_001273278
augcugagccuccugguguggauccugacccucuccgacaccuucagccagguccccccggaggacacgcgcaucgacggcgggcccgugauccugcugcaggccggcaccccccacaaccucaccugccgggccuucaacgcgaagcccgccgccaccaucaucugguuccgcgacgggacgcagcaggagggcgccguggccuccaccgagcugcugaaggacgggaagcgggagaccaccgucagccagcuccugaucaacccgacggaccuggacaucggccgcguguucaccugccgguccaugaacgaggcgauccccagcggcaaggagaccuccaucgagcucgacgugcaccacccccccaccgucacgcugagcaucgagccgcagaccgugcaggagggggagcgcguggucuucaccugccaggccaccgccaaccccgagauccugggcuaccggugggccaaggggggcuuccucaucgaggacgcgcacgagucccgcuacgagacgaacguggacuacagcuucuucaccgagcccguguccugcgagguccacaacaagguggggagcaccaacguguccacccuggucaacgugcacuucgccccccggaucguggucgacccgaagcccacgaccaccgacaucggcagcgacgugacccugacgugcgugugggucggcaaccccccccucacccugaccuggaccaagaaggacuccaacauggugcugagcaacuccaaccagcuccugcugaagagcgugacgcaggccgacgccgggaccuacaccugccgcgccaucgucccgcggaucggcguggcggagcgcgaggucccccucuacgugaacgggccccccaucaucuccagcgaggccgugcaguacgccguccggggcgacggcgggaagguggagugcuucaucggcagcaccccgccccccgaccgcaucgccugggccuggaaggagaacuuccuggagguggggacgcuggagcgguacaccgucgagcgcaccaacuccggcagcggggugcucuccacccugacgaucaacaacgugauggaggcggacuuccagacccacuacaacugcaccgccuggaacagcuucggccccggcaccgccaucauccagcuggaggagcgggagguccucccgguggggaucaucgccggcgccaccaucggggcguccauccugcugaucuucuucuucaucgcccucguguucuuccuguaccgccggcgcaagggcagccggaaggacgucacgcugcgcaagcucgacaucaagguggagaccgugaaccgcgagccccugaccaugcacuccgaccgggaggacgacaccgccagcgucuccacggccacccgcgugaugaaggccaucuacagcuccuucaaggacgacguggaccugaagcaggaccuccggugcgacaccaucgacacccgcgaggaguacgagaugaaggaccccacgaacggguacuacaacguccgggcgcacgaggaccgccccagcucccgggccgugcuguacgccgacuaccgcgccccgggccccgcgcgguucgacggccgccccagcucccggcugagccacuccagcggguacgcccagcucaacaccuacucccgcggcccggccagcgacuacgggcccgagcccacccccccgggccccgccgcccccgcggggaccgacacgaccagccagcuguccuacgagaacuacgagaaguucaacagccaccccuucccgggcgccgccggcuaccccaccuaccggcugggguacccccaggcccccccguccggccucgagcgcacccccuacgaggccuacgaccccaucgggaaguacgcgacggccacccgguucagcuacaccucccagcacagcgacuacggccagcgcuuccagcagcggaugcagacccacguguga

SEQ ID NO: 32035 - RNA, 417 nt, Artificial Sequence
  derived and/or modified sequence opt1 from KISS1__Homo_sapiens__XP_011507827
augaacagccugguguccuggcagcuccugcuguuccucugcgccacccacuucggcgagccccuggagaaggucgccagcguggggaacucccgcccgaccggccagcagcuggagagccucgggcugcuggcgcccggcgagcagucccuccccugcacggagcggaagcccgccgccaccgcccgccugagccggcgcgggaccucccugagcccgccgcccgaguccagcggcagcccccagcagcccggccucuccgccccgcacucccggcagauccccgcgccccagggggccgugcugguccagcgcgagaaggaccugcccaacuacaacuggaacagcuucggccuccgguucgggaagcgcgaggccgcccccggcaaccacgggcgguccgcgggccgcggcuga

SEQ ID NO: 32036 - RNA, 1197 nt, Artificial Sequence
  derived and/or modified sequence opt1 from KISS1R__Homo_sapiens__NP_115940
augcacaccguggccaccagcggccccaacgccuccuggggcgccccggccaacgccagcgggugccccgggugcggcgccaacgccuccgacgggcccguccccagcccgcgcgcgguggacgccuggcuggugccccucuucuucgccgcccugaugcugcucggccuggucggcaacucccuggugaucuacgugaucugccggcacaagcccaugcgcaccgucaccaacuucuacaucgcgaaccucgccgccaccgacgugaccuuccugcugugcugcgugcccuucacggcccuccuguacccgcugcccggguggguccucggcgacuucaugugcaaguucgugaacuacauccagcaggucagcgugcaggcgaccugcgccacccugaccgccauguccguggaccggugguacgugacggucuucccccugcgcgcccuccaccggcgcacgccccggcuggcccuggccgugagccucuccaucuggguggggagcgcggccgucuccgccccggugcuggcccugcaccgccucagccccggcccccgggccuacugcuccgaggcguuccccagccgcgcccuggagcgggccuucgcccuguacaaccuccuggcccuguaccuccugccgcugcucgcgaccugcgccugcuacgccgccaugcugcgccaccuggggcggguggcgguccgccccgcccccgccgacuccgcccuccagggccaggugcuggccgagcgggcgggcgccgugcgcgccaaggucagccggcugguggccgccgucgugcuccuguucgcggccugcugggggcccauccagcuguuccucgugcugcaggcccugggcccggccggguccuggcacccccgcagcuacgccgcguacgcccucaagaccugggcccacugcauguccuacagcaacagcgcccugaacccccugcucuacgcguuccugggcucccacuuccggcaggccuuccgccgggucugccccugcgccccgcgccgcccccggcgcccccggcgccccggcccgagcgaccccgccgcgccccacgccgagcugcuccggcuggggucccacccggcccccgcccgcgcccagaagcccggcagcuccgggcuggccgcgcggggccugugcgugcucggggaggacaacgcgccccuguga

SEQ ID NO: 32037 - RNA, 2931 nt, Artificial Sequence
  derived and/or modified sequence opt1 from KIT__Homo_sapiens__NP_000213
augcgcggcgcccgcggggccugggacuuccugugcgugcuccugcugcuccugcggguccagaccggcagcucccagcccagcguguccccgggggagcccagcccgcccuccauccaccccggcaagagcgaccugaucgugcgggucggggacgagauccgccuccugugcaccgaccccggcuucgugaaguggacguucgagauccuggacgagaccaacgagaacaagcagaacgaguggaucaccgagaaggcggaggccaccaacacgggcaaguacacgugcaccaacaagcacgggcucuccaacagcaucuacguguucguccgggaccccgccaagcuguuccugguggaccgcucccucuacggcaaggaggacaacgacacccuggugcggugcccccugaccgacccggaggucaccaacuacagccucaaggggugccagggcaagccccugcccaaggaccugcgcuucauccccgacccgaaggccgggaucaugaucaaguccgugaagcgggccuaccaccgccucugccugcacugcagcguggaccaggagggcaaguccguccugagcgagaaguucauccucaaggugcggcccgcguucaaggccgugcccgucguguccgugagcaaggccuccuaccugcugcgcgagggcgaggaguucaccgugaccugcacgaucaaggacgucagcuccagcguguacagcaccuggaagcgggagaacucccagaccaagcuccaggagaaguacaacagcuggcaccacggggacuucaacuacgagcgccaggccacccugacgaucuccagcgcgcgggucaacgacuccggcguguucaugugcuacgccaacaacaccuucgggagcgccaacgugaccaccacgcuggaggucguggacaagggcuucaucaacaucuuccccaugaucaacaccaccgucuucgugaacgacggcgagaacguggaccucaucgucgaguacgaggccuucccgaagcccgagcaccagcaguggaucuacaugaaccgcaccuucacggacaagugggaggacuaccccaaguccgagaacgagagcaacauccgguacguguccgagcugcaccugacccgccucaaggggaccgagggcgggaccuacacguuccuggugagcaacuccgacgucaacgccgcgaucgccuucaacguguacgugaacaccaagcccgagauccugaccuacgaccggcucgucaacggcaugcugcagugcguggccgccggguucccggagcccaccaucgacugguacuucugccccggcacggagcagcgcugcagcgccuccgugcugcccgucgacgugcagacccucaacagcuccggcccgcccuucgggaagcuggugguccagagcuccaucgacagcuccgcguucaagcacaacggcaccguggagugcaaggccuacaacgacguggggaagaccagcgccuacuucaacuucgccuucaagggcaacaacaaggagcagauccacccccacacgcuguucacgccccuccugaucggguucgucaucguggccggcaugaugugcaucaucgugaugauccugaccuacaaguaccuccagaagccgauguacgagguccaguggaaggugguggaggagaucaacggcaacaacuacgucuacaucgaccccacccagcugcccuacgaccacaagugggaguucccgcggaaccgccugagcuucgggaagacccucggcgcgggggccuucggcaaggugguggaggccaccgccuacgggcugaucaaguccgacgccgcgaugaccgucgccgugaagaugcugaagcccagcgcccaccucaccgagcgcgaggcccugauguccgagcugaaggugcugagcuaccucggcaaccacaugaacaucgucaaccugcugggcgcgugcaccaucgggggccccacgcucgugaucaccgaguacugcugcuacggggaccugcugaacuuccuccggcgcaagcgggacuccuucaucugcagcaagcaggaggaccacgccgaggccgcccuguacaagaaccugcuccacuccaaggagagcuccugcagcgacuccaccaacgaguacauggacaugaagcccggcgugagcuacgucgugccgaccaaggccgacaagcgccgguccgugcgcaucggcagcuacaucgagcgggacgucacgcccgcgaucauggaggacgacgagcuggcccuggaccucgaggaccugcuguccuucagcuaccagguggccaaggggauggccuuccucgccuccaagaacugcauccaccgcgaccuggcggcccggaacauccugcucacccacggccgcaucaccaagaucugcgacuucgggcuggcccgggacaucaagaacgacagcaacuacguggucaagggcaacgcccgccugcccgugaaguggauggcccccgagagcaucuucaacugcguguacaccuucgaguccgacgucuggagcuacgggaucuuccucugggagcuguucucccugggcagcuccccguaccccggcaugcccguggacagcaaguucuacaagaugaucaaggagggguuccggaugcucucccccgagcacgcgccggccgagauguacgacaucaugaagacgugcugggacgccgacccccugaagcgccccaccuucaagcagaucgugcagcugaucgagaagcagaucagcgaguccaccaaccacaucuacagcaaccucgccaacugcucccccaaccggcagaagccggucguggaccacagcgugcgcaucaacuccgucggcagcaccgcguccagcucccagccccugcuggugcacgacgacguguga

SEQ ID NO: 32038 - RNA, 822 nt, Artificial Sequence
  derived and/or modified sequence opt1 from KITLG__Homo_sapiens__NP_000890
augaagaagacccagaccuggauccugacgugcaucuaccuccagcugcuccuguucaacccccuggugaagaccgagggcaucugccgcaaccgggucaccaacaacgugaaggacgugaccaagcuggucgccaaccucccgaaggacuacaugaucacgcugaaguacgugcccgggauggacgugcugcccagccacugcuggaucuccgagauggucgugcagcucagcgacucccugaccgaccugcucgacaaguucagcaacaucuccgagggccugagcaacuacuccaucaucgacaagcuggugaacaucgucgacgaccucguggagugcgugaaggagaacagcuccaaggaccugaagaaguccuucaagagccccgagccgcgccuguucacccccgaggaguucuuccggaucuucaaccgcagcaucgacgccuucaaggacuucgucguggcguccgagaccagcgacugcguggucuccagcacgcucucccccgagaaggacagccggguguccgugaccaagcccuucaugcugccgcccgucgccgccagcagccugcgcaacgacuccagcuccagcaaccggaaggccaagaacccgcccggggacuccagccuccacugggccgcgauggcccugcccgcccuguucucccucaucaucggcuucgccuucggggcgcuguacuggaagaagcgccagcccagccugacccgggccguggagaacauccagaucaacgaggaggacaacgagaucuccaugcuccaggagaaggagcgcgaguuccaggagguguga

SEQ ID NO: 32039 - RNA, 3135 nt, Artificial Sequence
  derived and/or modified sequence opt1 from KLB__Homo_sapiens__NP_783864
augaagcccggcugcgccgccgggagcccgggcaacgaguggaucuucuucuccaccgacgagaucaccacgcgcuaccggaacaccaugagcaacgggggccugcagcgcuccgugauccucagcgcgcugauccugcuccgggccgucaccggguucuccggcgacggccgcgccaucuggagcaagaaccccaacuucacccccgugaacgagucccagcuguuccuguacgacacguuccccaagaacuucuucugggggaucggcaccggggcccuccagguggagggcagcuggaagaaggacgggaagggcccguccaucugggaccacuucauccacacccaccugaagaacgucagcuccaccaacggcagcuccgacagcuacaucuuccuggagaaggaccucuccgcccuggacuucaucggggugagcuucuaccaguucuccaucagcuggccccggcuguuccccgacggcaucgugacggucgcgaacgccaaggggcuccaguacuacuccacccugcuggacgcccucgugcugcgcaacaucgagcccaucgugacccuguaccacugggaccucccgcuggcccugcaggagaaguacggcggcuggaagaacgacaccaucaucgacaucuucaacgacuacgcgacguacugcuuccagauguucggggaccgggucaaguacuggaucaccauccacaaccccuaccucguggccuggcacggcuacgggaccggcaugcacgcccccggggagaagggcaaccuggccgccguguacaccgucggccacaaccugaucaaggcgcacagcaagguguggcacaacuacaacacgcacuuccgcccccaccagaagggguggcucagcaucacccugggcucccacuggaucgagccgaaccggagcgagaacaccauggacaucuucaagugccagcaguccauggugagcguccuggggugguucgccaaccccauccacggcgacggggacuaccccgagggcaugcgcaagaagcuguucuccgugcuccccaucuucagcgaggccgagaagcacgagaugcggggcaccgccgacuucuucgccuucuccuucgggccgaacaacuucaagccccugaacacgauggcgaagaugggccagaacgugagccucaaccugcgcgaggcccugaacuggaucaagcucgaguacaacaacccccggauccugaucgccgagaacgggugguucaccgacucccgcgucaagaccgaggacaccacggccaucuacaugaugaagaacuuccugagccaggugcuccaggccauccggcuggacgagauccgcguguucggcuacaccgcguggucccugcucgacggguucgaguggcaggacgccuacaccauccggcgcggccuguucuacgucgacuucaacagcaagcagaaggagcggaagcccaaguccagcgcccacuacuacaagcagaucauccgcgagaacggcuucucccugaaggagagcaccccggacgugcaggggcaguuccccugcgacuucuccuggggcgugacggagagcguccucaagcccgaguccguggccagcagcccccaguucuccgacccgcaccuguacgucuggaacgccaccgggaaccggcugcuccaccgcguggagggcgugcgccugaagacccggcccgcgcagugcaccgacuucgucaacaucaagaagcagcuggagaugcucgcccgcaugaaggugacgcacuaccgguucgcccuggacugggccagcgugcugcccaccggcaaccuguccgcggucaaccgccaggcccuccgguacuaccgcugcguggugagcgaggggcugaagcugggcaucuccgccauggucacccucuacuaccccacccacgcccaccuggggcugccggagccccuccugcacgccgacggcuggcugaaccccagcacggcggaggccuuccaggccuacgccgggcucugcuuccaggagcugggcgaccuggugaagcucuggaucaccaucaacgagccgaaccggcuguccgacaucuacaaccgcagcggcaacgacaccuacggggccgcgcacaaccugcucguggcccacgcccuggccuggcggcuguacgaccgccaguuccggcccucccagcgcggcgccgucagccucucccugcacgcggacugggccgagcccgccaaccccuacgccgacagccacuggcgggcggccgagcgcuuccugcaguucgagaucgccugguucgccgagccccucuucaagaccggggacuacccggccgcgaugcgggaguacaucgccuccaagcaccgccggggccugagcuccagcgcccugccccgccucaccgaggccgagcggcgccugcugaaggggacgguggacuucugcgcccucaaccacuucaccacccgcuucgugaugcacgagcagcuggcgggcucccgguacgacagcgaccgcgacauccaguuccugcaggacaucacccggcucagcucccccacgcgccuggccgucaucccguggggcgugcggaagcugcuccgcugggugcggcgcaacuacggggacauggacaucuacaucaccgccagcggcaucgacgaccaggcccuggaggacgaccggcugcgcaaguacuaccucgggaaguaccugcaggagguccugaaggccuaccucaucgacaaggugcggaucaagggcuacuacgcguucaagcuggccgaggagaaguccaagccccgcuucggguucuucaccagcgacuucaaggccaaguccagcauccaguucuacaacaaggugaucuccagccggggcuuccccuucgagaacuccagcucccgcugcagccagacccaggagaacacggagugcaccgucugccuguuccucgugcagaagaagccccugaucuuccugggcugcugcuucuucuccacccucgugcugcugcucagcaucgccaucuuccagcggcagaagcgccggaaguucuggaaggcgaagaaccugcagcacaucccgcugaagaaggggaagcgcgucguguccuga

SEQ ID NO: 32040 - RNA, 1857 nt, Artificial Sequence
  derived and/or modified sequence opt1 from KLC1__Homo_sapiens__NP_001123579
auguacgacaacaugagcaccaugguguacaucaaggaggacaagcuggagaagcucacccaggacgagaucaucuccaagacgaagcaggucauccagggccuggaggcccugaagaacgagcacaacagcauccuccagucccugcuggagacccucaagugccugaagaaggacgacgagagcaaccugguggaggagaaguccaacaugauccgcaagagccucgagaugcuggagcuggggcucuccgaggcccaggugaugauggcgcugagcaaccaccugaacgccgucgaguccgagaagcagaagcuccgggcccaggugcgccggcugugccaggagaaccaguggcugcgcgacgagcucgccaacacccagcagaagcugcagaaguccgagcagagcguggcccagcuggaggaggagaagaagcaccucgaguucaugaaccagcugaagaaguacgacgacgacaucagccccuccgaggacaaggacaccgacagcacgaaggagccgcuggacgaccucuuccccaacgacgaggacgaccccggccaggggauccagcagcagcacuccagcgcggccgccgccgcgcagcagggcggguacgagauccccgcccggcugcgcacccugcacaaccucgucauccaguacgccucccagggccgguacgagguggccgugccgcugugcaagcaggcccuggaggaccucgagaagaccagcggccacgaccaccccgacgucgcgaccaugcugaacauccuggcccucguguaccgcgaccagaacaaguacaaggacgccgccaaccugcugaacgacgcccucgcgauccgggagaagacgcuggggaaggaccaccccgccguggccgccacccugaacaaccucgccguccuguacggcaagcgcgggaaguacaaggaggcggagccccugugcaagcgggcccucgagauccgcgagaaggugcugggcaaggaccacccggacguggccaagcagcugaacaaccucgcccugcugugccagaaccaggggaaguacgaggaggucgaguacuacuaccagcgggcccucgagaucuaccagaccaagcugggccccgacgaccccaacguggcgaagaccaagaacaaccuggccuccugcuaccugaagcagggcaaguucaagcaggccgagacgcucuacaaggagauccugacccgcgcccacgagcgggaguucgggagcguggacgacgagaacaagcccaucuggaugcacgcggaggagcgcgaggagugcaagggcaagcagaaggacgggaccagcuucggcgaguacggcgggugguacaaggccugcaaggucgacuccccgaccgugacgaccacccugaagaaccucggcgcccuguaccggcgccaggggaaguucgaggccgccgagacccuggaggaggcggccaugcggagccgcaagcagggccucgacaacgugcacaagcagcgggucgccgaggugcugaacgaccccgagaacauggagaagcgccgcucccgggagagccugaacguggacgucgugaaguacgaguccgggcccgacggcggcgaggaggucagcauguccguggaguggaacggggacggcacggggagccucaagcgcuccggcagcuucuccaagcugcgggccagcauccgccgguccagcgagaagcuggugcgcaagcucaagggcggguccagccgggaguccgagcccaagaacccgggcgccagccuggcggagccccuguucgucgagaacgacuccagcagcuccgggcucgaggacgccaccgccaacuga

SEQ ID NO: 32041 - RNA, 1410 nt, Artificial Sequence
  derived and/or modified sequence opt1 from KLF10__Homo_sapiens__NP_001027453
auggaggagcgcauggagaugaucagcgagcggcccaaggaguccauguacagcuggaacaagaccgccgagaaguccgacuucgaggccguggaggcgcugaugagcauguccugcagcuggaaguccgacuucaagaaguacgucgagaaccgcccggugacccccgugagcgaccucuccgaggaggagaaccugcugcccggcacgcccgacuuccacaccaucccggccuucugccucaccccgcccuacagccccuccgacuucgagcccagccaggucuccaaccugauggcccccgcccccagcaccgugcacuucaagucccugagcgacacggccaagccccacaucgcggccccguucaaggaggaggagaagucccccgugagcgcccccaagcuccccaaggcccaggcgaccuccgucauccggcacaccgccgacgcccagcugugcaaccaccagaccugcccgaugaaggccgccagcauccugaacuaccagaacaacagcuuccgccggcgcacgcaccucaacguggaggcggcccggaagaacauccccugcgccgccgugucccccaaccgcagcaagugcgagcggaacaccgucgccgacguggacgagaaggcguccgccgcccuguacgacuucagcgugcccuccagcgagaccgucaucugccgcucccagccggcccccgugagcccccagcagaaguccgugcuggucagcccgcccgccguguccgccgggggcgugccgcccaugcccgucaucugccagauggugccccuccccgcgaacaaccccguggucaccacgguggugccgagcaccccgcccucccagccgcccgccgucugcccgcccguggucuucauggggacccaggugcccaagggcgccgugauguucgucgugccccagcccgugguccagagcuccaagccgcccguggugagccccaacgggacccggcugucccccaucgcccccgcgcccggcuucagccccuccgccgccaaggucacgccccagaucgacagcagccgcauccggucccacaucugcagccaccccggcugcgggaagaccuacuucaaguccagccaccugaaggcccacacccgcacccacacgggcgagaagcccuucuccugcagcuggaaggggugcgagcggcgcuucgcgcgguccgacgagcucagccgccaccggcgcacccacaccggcgagaagaaguucgccugcccgaugugcgaccggcgcuucaugcgcuccgaccaccugaccaagcacgcccggcgccaccugagcgccaagaagcuccccaacuggcagauggagguguccaagcugaacgacaucgcccugccgcccacgcccgcgcccacccaguga

SEQ ID NO: 32042 - RNA, 1539 nt, Artificial Sequence
  derived and/or modified sequence opt1 from KLF11__Homo_sapiens__NP_003588
augcacacccccgacuucgccggcccggacgacgcccgcgcgguggacaucauggacaucugcgagagcauccuggagcggaagcgccacgacuccgagcggagcacgugcuccauccucgagcagaccgacauggaggccgucgaggcccuggugugcaugagcuccugggggcagcgcagccagaagggcgaccugcuccggauccgcccccugacccccguguccgacagcggggacgucaccaccacggugcacauggacgccgccacccccgagcugccgaaggacuuccacucccucagcacccugugcaucaccccgccccagucccccgaccugguggagcccagcacgcggacccccgucagcccccaggugaccgacuccaaggcgugcaccgccacggacgugcuccaguccagcgccgucguggcccgcgcgcuguccggcggggccgagcggggccugcucggccuggagcccgugccgagcucccccugccgcgccaaggggaccagcgucauccggcacaccggcgagagccccgccgccugcuuccccaccauccagacgccggacugccgccuguccgacagccgggagggggaggagcagcuccugggccacuucgagacccugcaggacacccaccucaccgacucccugcugagcacgaaccucguguccugccagcccugccugcacaagagcgggggccugcuccugaccgacaagggccagcaggcgggguggcccggcgccgugcagaccugcucccccaagaacuacgagaacgaccugccgcgcaagaccacgccccucaucagcgucuccgugcccgcgcccccggugcugugccagaugauccccgucaccgggcagagcuccaugcugcccgccuuccucaagcccccgccccagcugagcgugggcaccgugcggcccauccuggcccaggccgccccggcgccccagcccgucuucgugggccccgccgugccgcagggggccgucaugcucgugcugccccagggcgcccugcccccgcccgcccccugcgccgccaacgucauggccgcggggaacaccaagcuccugccccuggcccccgccccgguguucaucacguccagccagaacugcgugccccaggucgacuucucccgccggcgcaacuacgugugcagcuuccccggcugccggaagaccuacuucaaguccagccaccucaaggcccaccuccgcacccacaccggggagaagcccuucaacugcuccugggacggcugcgacaagaaguucgcgcggagcgacgagcugagccgccaccgccggacgcacaccggcgagaagaaguucgugugcccggucugcgaccgccgguucaugcgcuccgaccaccugaccaagcacgcccggcgccacaugaccacgaagaagauccccggguggcaggccgaggugggcaagcugaaccggaucgccagcgccgagucccccgggagcccccugguguccaugccggcgagcgccuga

SEQ ID NO: 32043 - RNA, 1209 nt, Artificial Sequence
  derived and/or modified sequence opt1 from KLF12__Homo_sapiens__XP_011533211
augaacauccacaugaagcgcaagaccaucaagaacaucaacaccuucgagaaccggaugcugaugcucgacggcaugcccgccgugcgcgucaagacggagcugcuggagagcgagcagggguccccgaacgugcacaacuaccccgacauggaggccgugccccuccugcugaacaacgucaagggcgagcccccggaggacagccucuccguggaccacuuccagacccagaccgagcccguggaccugagcaucaacaaggcgcggaccucccccacggccgucagcuccagccccguguccaugaccgccagcgccuccagcccguccagcaccuccaccagcuccagcuccagcagccgccuggccuccagccccacggugaucaccuccgucagcuccgcgagcuccagcuccaccgugcucacccccgggccccugguggccagcgccuccggcgucgggggccagcaguuccugcacaucauccacccggugccgcccagcucccccaugaaccuccagagcaacaagcugucccacgugcaccggauccccgucguggugcagagcguccccgugguguacacggccguccgcucccccggcaacgugaacaacaccaucguggucccccugcucgaggacgggcggggccacgggaaggcgcagauggacccgcgcggccugagcccccggcaguccaagagcgacagcgacgacgacgaccugcccaacgugacccucgacuccgucaacgagaccgggagcacggcccuguccaucgcccgcgccgugcaggaggugcaccccagcccggucucccgggugcgcggcaaccggaugaacaaccagaaguuccccugcagcaucucccccuucagcaucgaguccacccgccggcagcgccggagcgagucccccgacagccgcaagcggcgcauccaccggugcgacuucgagggcugcaacaagguguacaccaaguccagccaccugaaggcccaccgccgcacccacacgggggagaagccguacaagugcaccugggagggcugcaccuggaaguucgcgcgguccgacgagcucacccgccacuaccggaagcacacgggggucaagcccuucaagugcgccgacugcgaccgcagcuucucccggagcgaccaccuggcccugcaccgccggcgccacaugcucguguga

SEQ ID NO: 32044 - RNA, 867 nt, Artificial Sequence
  derived and/or modified sequence opt1 from KLF13__Homo_sapiens__NP_057079
auggccgccgcggccuacguggaccacuucgccgccgagugccuggucagcauguccagccgcgccguggugcacggcccccgggaggggccggagucccgccccgagggcgcggccgucgccgccacccccacccucccccggguggaggagcgccgggacgggaaggacagcgcgucccuguucguggucgcccgcauccuggccgaccucaaccagcaggccccggcccccgcgcccgccgagcggcgcgagggcgccgccgcccggaaggcgcgcacgcccugccggcugccgccgcccgcccccgagcccaccagccccggggccgagggcgccgccgcggccccgcccucccccgccuggagcgagcccgagcccgaggccggccuggagcccgagcgcgagccggggcccgccggcuccggggagcccggccuccggcagcgcgugcggcgcgggcggagccgcgcggaccuggagagcccccagcggaagcacaagugccacuacgccggcugcgagaagguguacggcaaguccucccaccugaaggcccaccuccgcacccacaccggggagcggccguucgccugcagcuggcaggacugcaacaagaaguucgcgcgcuccgacgagcuggcccgccacuaccggacgcacaccggcgagaagaaguucagcugccccaucugcgagaagcgcuucaugcgguccgaccaccugaccaagcacgcccgccggcacgccaacuuccaccccgggaugcuccagcgccggggcggcgggagccgcaccggcucccugagcgacuacagccgguccgacgccagcucccccacgaucagcccggcguccagccccuga

SEQ ID NO: 32045 - RNA, 972 nt, Artificial Sequence
  derived and/or modified sequence opt1 from KLF14__Homo_sapiens__NP_619638
augagcgccgccguggcgugccuggacuacuucgccgccgagugccucgucuccaugagcgccggcgccguggugcaccgccggcccccggaccccgagggggcgggcggggccgccggcuccgaggucggggccgcgccgcccgagagcgcccugcccggccccggcccgcccgggcccgccuccgugccccagcugccccaggugcccgccccgagccccggcgccgggggcgcggccccgcaccuccuggccgccuccgucugggccgaccugcgcgggagcuccggcgagggcagcugggagaacuccggggaggcgccccgggccagcuccggcuucagcgaccccauccccugcuccgugcagacccccugcagcgagcucgcccccgccuccggggccgcggccgugugcgccccggagagcuccagcgacgcccccgccguccccagcgcgcccgccgccccgggcgcccccgcggccuccggcggguucagcggcggggcccugggcgccgggcccgcccccgcggccgaccaggccccgcgccggcgcuccgugacccccgccgccaagcggcaccagugccccuucccgggcugcaccaaggcguacuacaagagcucccaccucaagagccaccagcgcacccacaccggcgagcggcccuucuccugcgacuggcuggacugcgacaagaaguucacccgcagcgacgagcuggcccggcacuaccgcacgcacaccggggagaagcgguucuccugcccccugugccccaagcaguucagccgcuccgaccaccucaccaagcacgcccggcgccacccgaccuaccaccccgacaugaucgaguaccggggccgccggcgcacgccccggaucgacccgccccugaccagcgagguggaguccagcgccuccgggagcggccccgggcccgcccccuccuucacgaccugccuguga

SEQ ID NO: 32046 - RNA, 1251 nt, Artificial Sequence
  derived and/or modified sequence opt1 from KLF15__Homo_sapiens__NP_054798
augguggaccaccuccugcccgucgacgagaacuucagcuccccgaagugccccgugggcuaccugggggaccgccuggugggccggcgcgccuaccacaugcuccccagccccgucuccgaggacgacagcgacgccuccagcccgugcuccugcagcucccccgacagccaggcgcugugcuccugcuacgggggcgggcugggcaccgagagccaggacuccauccucgacuuccugcugagccaggccacccucggcuccgggggcgggagcggcuccagcaucggggccuccagcggccccguggccuggggccccuggcggcgcgccgcggccccggugaagggggagcacuucugccugcccgaguucccccugggcgaccccgacgacgucccgcggcccuuccagcccacgcucgaggagaucgaggaguuccuggaggagaacauggagcccggggugaaggaggugccggagggcaacagcaaggaccuggacgccugcucccagcucagcgccggcccccacaagucccaccuccaccccgggagcuccggccgcgagcggugcagcccgccgcccgggggcgcguccgccgggggcgcccagggccccgggggcgggcccacccccgacggccccauccccguccugcugcagauccagcccgugccggugaagcaggagagcgggaccggccccgccucccccggccaggccccggagaacgucaagguggcgcagcugcuggugaacauccaggggcagaccuucgcccucgucccccagguggugcccagcuccaaccugaaccugcccagcaaguucguccgcaucgccccggugcccaucgccgccaagcccgugggcuccgggccccucggcccggggcccgcgggccugcugaugggccagaaguuccccaagaaccccgccgccgagcucaucaagaugcacaagugcacguucccggggugcagcaagauguacaccaaguccagccaccugaaggcccaccuccggcgccacaccggcgagaagcccuucgccugcaccuggcccgggugcggcuggcgguucucccgcagcgacgagcugucccggcaccgccggagccacagcggcgucaagcccuaccagugcccggugugcgagaagaaguucgcgcgcuccgaccaccugagcaagcacaucaaggugcaccgguucccccgcuccagccgguccguccgcagcgugaacuga

SEQ ID NO: 32047 - RNA, 759 nt, Artificial Sequence
  derived and/or modified sequence opt1 from KLF16__Homo_sapiens__NP_114124
augagcgccgccguggcgugcgucgacuacuucgccgccgacgugcugauggccaucuccagcggcgccgugguccaccgcgggcggcccggcccggagggggcgggccccgccgccgggcucgacgugcgcgccgcgcggcgcgaggccgccucccccggcacccccggcccgcccccgccgccgcccgccgccagcgggcccggccccggggcggccgccgcgccccaccuccuggccgccuccauccuggccgaccugcggggcgggcccggcgccgcccccggcggggccagccccgcguccagcuccagcgccgccuccagccccuccagcggccgcgcccccggggccgcgcccuccgccgccgccaagagccaccggugccccuucccggacugcgcgaaggccuacuacaaguccagccaccugaagucccaccuccgcacccacacgggcgagcggcccuucgccugcgacuggcagggcugcgacaagaaguucgcccgcagcgacgagcuggcccggcaccaccgcacccacaccggggagaagcgguucagcugcccccugugcuccaagcgcuucacccggagcgaccaccucgcgaagcacgcccgccggcaccccggcuuccacccggaccugcugcgccggcccggggcccgcuccacgagccccuccgacagccuccccugcucccuggccggcagcccggcccccucccccgcgccgagccccgcccccgccgggcuguga

SEQ ID NO: 32048 - RNA, 1089 nt, Artificial Sequence
  derived and/or modified sequence opt1 from KLF1__Homo_sapiens__NP_006554
auggccaccgccgagaccgcgcugcccagcaucuccacgcucaccgcccugggcccguuccccgacacccaggacgacuuccugaagugguggcgcagcgaggaggcccaggacauggggcccgggcccccggaccccaccgagccgccccuccacgugaaguccgaggaccagcccggcgaggaggaggacgacgagcggggcgccgacgccacgugggaccuggaccugcuccugaccaacuucagcgggcccgagcccggcggcgcgccccagaccugcgcccuggccccguccgaggccagcggggcgcaguacccgcccccgcccgagacccucggcgccuacgccgggggccccgggcuggucgccggccugcucggcuccgaggaccacagcgggugggugcgccccgcccugcgggcgcgcgcccccgacgccuucgugggccccgcccuggcccccgcgcccgcccccgagccgaaggcccucgcccugcagcccgucuaccccgggcccggcgccggcuccagcgggggcuacuucccgcggacggggcuguccgugcccgcggccagcggcgcccccuacgggcuccuguccggcuacccggccauguaccccgcgccccaguaccagggccacuuccagcuguuccgcgggcuccagggccccgccccggggcccgccaccagccccuccuuccugagcugccugggccccgggaccgugggcaccggccucgggggcacggccgaggacccgggggucaucgccgagaccgcgcccuccaagcggggccgccggagcugggcccgcaagcggcaggccgcccacacgugcgcccaccccgggugcggcaaguccuacaccaagagcagccaccugaaggcgcaccuccgcacccacaccggcgagaagcccuacgccugcaccugggaggggugcggcuggcgguucgcccgcuccgacgagcugacccggcacuaccgcaagcacacggggcagcggccguuccgcugccagcugugcccccgggccuucagccgcuccgaccaccuggcccuccacaugaagcggcaccuguga

SEQ ID NO: 32049 - RNA, 1068 nt, Artificial Sequence
  derived and/or modified sequence opt1 from KLF2__Homo_sapiens__NP_057354
auggcccugagcgagcccauccucccguccuucagcaccuucgccucccccugccgcgagcggggccugcaggagcgcuggccccgggcggagcccgagagcgggggcaccgacgacgaccugaacuccgugcucgacuucauccugagcauggggcuggacggccucggggccgaggccgccccggagcccccccccccgcccccccccccggccuucuacuaccccgagcccggcgcgcccccgcccuacuccgcccccgccggcgggcuggucagcgagcugcuccgccccgagcuggacgccccgcugggccccgcgcuccacgggcgguuccugcuggccccccccggccgccucgugaaggccgagccgcccgaggccgacgggggcggcggguacggcugcgcccccgggcugacgcggggcccccgcggccugaagcgggagggggcgccgggccccgccgccuccugcaugcgcgggcccggcgggcggccgcccccccccccggacacccccccccucagccccgacggcccggcccgccugcccgcccccggcccccgggcguccuucccgccccccuucgggggccccggguucggcgccccggggcccggccugcacuacgccccccccgccccgcccgccuucggccucuucgacgacgcggccgccgccgccgcggcccuggggcuggccccccccgccgcgcgcggccuccugaccccgcccgccagcccccuggagcuccuggaggccaagccgaagcgggggcgccgguccuggccccgcaagcggaccgccacgcacaccugcagcuacgccggcugcgggaagaccuacaccaaguccagccaccugaaggcgcaccuccgcacgcacaccggcgagaagcccuaccacugcaacugggacggcugcggguggaaguucgcccgguccgacgagcugacccgccacuaccgcaagcacaccggccaccggcccuuccagugccaccugugcgaccgcgccuucagccgguccgaccaccucgcccugcacaugaagcgccacauguga

SEQ ID NO: 32050 - RNA, 1038 nt, Artificial Sequence
  derived and/or modified sequence opt1 from KLF3__Homo_sapiens__NP_057615
augcugauguucgaccccgugccggucaagcaggaggccauggaccccgugagcguguccuaccccagcaacuacauggaguccaugaagcccaacaaguacggcgucaucuacagcaccccgcuccccgagaaguucuuccagacccccgaggggcugucccacggcauccagauggagcccguggaccugacggugaacaagcgcagcuccccgcccagcgccgggaacucccccagcucccucaaguuccccagcucccaccggcgcgcgagcccgggccuguccaugcccagcuccuccccgcccaucaagaaguacagcccgcccagccccgggguccagcccuucggcgugccccugagcaugccgcccgugauggccgccgcccucucccggcacggcauccgcagccccgggauccugcccgucauccagcccguggugguccagcccgugcccuucauguacaccucccaccuccagcagccgcugauggugagccuguccgaggagauggagaacagcuccagcuccaugcagguccccgugaucgagagcuacgagaagcccaucucccagaagaagaucaagaucgagccgggcaucgagccccagcggaccgacuacuaccccgaggagaugagcccgccccugaugaacuccgugagcccgccccaggcccuccugcaggagaaccaccccuccgucaucgugcagcccgggaagcgcccccugcccguggagagccccgacacccagcggaagcgccggauccaccgcugcgacuacgacggcugcaacaaggucuacacgaaguccagccaccucaaggcgcaccggcgcacccacaccggggagaagccguacaagugcaccugggagggcugcacguggaaguucgcccgguccgacgagcugacccgccacuuccggaagcacaccggcaucaagcccuuccagugccccgacugcgaccgcagcuucagccgguccgaccaccuggcccuccaccgcaagcggcacaugcugguguga

SEQ ID NO: 32051 - RNA, 1440 nt, Artificial Sequence
  derived and/or modified sequence opt1 from KLF4__Homo_sapiens__NP_004226
augcgccagcccccgggcgagagcgacauggccguguccgacgcccugcuccccagcuucuccaccuucgcgagcgggcccgccggccgggagaagacccugcgccaggccggggcccccaacaaccgguggcgcgaggagcugucccacaugaagcggcucccgcccguccugcccggccgccccuacgaccuggccgcggccacgguggccaccgaccucgagagcgggggcgccggcgcggccugcgggggcuccaaccuggccccgcugccccggcgcgagaccgaggaguucaacgaccuccuggaccuggacuucauccucagcaacucccugacccacccgcccgagagcguggccgccacggucuccagcuccgcgagcgccuccagcuccagcucccccagcagcuccgggcccgccagcgcccccuccacgugcagcuucaccuaccccauccgggccggcaacgacccggggguggcgcccggcggcaccgggggcgggcugcucuacggccgcgaguccgccccgccgcccaccgcccccuucaaccuggccgacaucaacgacgugagccccuccggcggguucgucgccgagcugcuccggcccgagcuggaccccguguacaucccgccccagcagccccagccgcccggcgggggccugauggggaaguucgugcucaaggcgagccuguccgcccccggcagcgaguacggcucccccagcgucaucuccgugagcaaggggucccccgacggcagccaccccguggucguggcccccuacaacgggggcccgccccggaccugccccaagaucaagcaggaggccguguccagcugcacccaccugggggccgggcccccgcucuccaacggccaccgccccgcggcccacgacuucccccugggccgccagcugcccagccggaccacgccgacccucggccuggaggagguccugagcucccgcgacugccaccccgcccucccccugcccccgggguuccacccccaccccggccccaacuacccgagcuuccugcccgaccagaugcagccccaggugcccccgcuccacuaccaggagcugaugccgcccggguccugcaugcccgaggagcccaagcccaagcggggccgccggagcuggccccgcaagcggaccgccacccacacgugcgacuacgcgggcugcgggaagaccuacaccaaguccagccaccugaaggcccaccuccgcacccacacgggcgagaagccguaccacugcgacugggacgggugcggcuggaaguucgcccgcuccgacgagcugacccggcacuaccgcaagcacaccggccaccggcccuuccagugccagaagugcgaccgcgccuucagccgguccgaccaccuggcccuccacaugaagcgccacuucuga

SEQ ID NO: 32052 - RNA, 1101 nt, Artificial Sequence
  derived and/or modified sequence opt1 from KLF5__Homo_sapiens__NP_001273747
auggagaaguaccugacgccccagcucccgcccgugcccaucauccccgagcacaagaaguaccgccgggacagcgccuccgucguggaccaguucuucaccgacaccgagggccugccguacagcaucaacaugaacguguuccugcccgacaucacccaccuccgcaccgggcuguacaagucccagcggcccugcgucacccacaucaagacggagcccguggccaucuucagccaccaguccgagaccaccgcgccgccgcccgcccccacccaggcccugcccgaguucacgagcaucuucuccagccaccagaccgccgcccccgaggugaacaacaucuucaucaagcaggagcuccccacccccgaccugcaccuguccgucccgacccagcagggccaccucuaccagcugcugaacacgcccgaccucgacaugcccagcuccaccaaccagaccgcggccauggacacccugaacgugagcauguccgccgccauggcggggcugaacacgcacaccagcgccgugccccagaccgccgucaagcaguuccagggcaugccgcccugcaccuacacgaugcccucccaguuccucccccagcaggccaccuacuucccgcccagcccgcccuccagcgagcccgggucccccgaccgccaggccgagaugcugcagaaccugacgcccccgcccagcuacgcggccaccaucgccagcaagcucgccauccacaaccccaaccugcccaccacccugccggugaacucccagaacauccagcccgugcgguacaaccgccggagcaaccccgaccucgagaagcgccggauccacuacugcgacuaccccggcugcaccaaggucuacaccaaguccagccaccugaaggcccaccuccgcacgcacaccggcgagaagccguacaagugcaccugggaggggugcgacuggcgguucgcgcgcuccgacgagcugacccggcacuaccgcaagcacacgggcgccaagcccuuccagugcggggugugcaaccggagcuucucccgcagcgaccaccuggcccugcacaugaagcggcaccagaacuga

SEQ ID NO: 32053 - RNA, 714 nt, Artificial Sequence
  derived and/or modified sequence opt1 from KLF6__Homo_sapiens__NP_001153597
auggacgugcugcccaugugcagcaucuuccaggagcuccagaucguccacgagaccggcuacuucuccgcccugccgagccuggaggaguacuggcagcagaccugccucgagcuggagcgcuaccugcaguccgagcccugcuacgugagcgccuccgagaucaaguucgacagccaggaggaccucuggacgaagaucauccuggcgcgggagaagaaggaggaguccgagcugaagaucagcuccagcccgcccgaggacacccucaucucccccagcuucugcuacaaccuggagaccaacucccugaacagcgacguguccagcgaguccagcgacuccagcgaggagcucagccccaccgccaaguucacguccgaccccaucggggagguccuggugagcuccggcaagcugagcuccagcgugaccuccacgcccccgagcucccccgagcucagccgcgagcccucccagcugugggggugcguccccggcgagcugccgagccccgggaaggugcgguccggcaccagcggcaagcccggggacaagggcaacggggacgccucccccgacggccgccggcgcgugcaccggugccacuucaacgggugccgcaaggucuacaccaagagcucccaccucaaggcccaccagcggacccacaccggcguguucccgggccugaccacguggcccugcaccuga

SEQ ID NO: 32054 - RNA, 693 nt, Artificial Sequence
  derived and/or modified sequence opt1 from KLF7__Homo_sapiens__NP_001257871
auggacgugcuggccagcuacuccaucuuccaggagcuccagcugguccacgacaccggcuacuucagcgcccugcccucccucgaggagaccuggcagcagacgugccuggagcuggagcgcuaccuccagaccgagccgcggcgcaucagcgagaccuucggggaggaccuggacugcuuccugcacgcguccccgccgcccugcaucgaggagagcuuccggcgccucgacccccugcugcuccccguggaggccgccaucugcgagaaguccagcgccguggacauccugcugucccgggacaagcuccugagcgagaccugccugucccuccagcccgccagcuccagccuggacuccuacacggcggucaaccaggcccagcugaacgccgugaccagccucaccccgcccuccagccccgagcugucccgccaccuggugaagaccagccagacgcucagcgccgucgacggcaccgugacccugaagcugguggcgaagaaggccgcccucuccagcgucaaggugcggucccugaucagcgcccacgggcgcgacguguccggcguccugcacgaggccaugagcucccgggggaccacgggcaacacccaggugcagagccccuccaacgcgaccaccgccacgggcguguuccccgggcucaccauccugcccagcaccuga

SEQ ID NO: 32055 - RNA, 1080 nt, Artificial Sequence
  derived and/or modified sequence opt1 from KLF8__Homo_sapiens__XP_005262036
augguggacauggacaagcugaucaacaaccucgagguccagcugaacagcgagggcggguccaugcaggucuucaagcaggucaccgccagcgugcgcaaccgggacccgcccgagaucgaguaccgcuccaacaugaccagccccacgcugcucgacgccaaccccauggagaaccccgcgcuguucaacgacaucaagaucgagccgcccgaggagcugcucgccuccgacuucagccugccccagguggagcccguggaccuguccuuccacaagccgaaggcgccccuccagcccgccagcaugcugcaggcccccauccggccgcccaagccccaguccagcccccagacccuggugguguccaccagcaccuccgacaugagcacguccgccaacaucccgaccgugcucacccccggcagcguccugaccuccagccaguccacggggagccagcagauccugcacgugauccacaccauccccagcgugucccuccccaacaagaugggcgggcugaagaccaucccggucguggugcagagccugcccauggucuacaccacgcuccccgccgacggcggccccgccgccaucaccgugccgcugaucgggggcgacgggaagaacgcgggcuccgugaaggucgaccccaccagcaugagcccccuggagauccccuccgacuccgaggagagcaccaucgaguccgggagcuccgcccuccagagccugcagggccugcagcaggagccggccgccauggcccagaugcagggcgaggagucccucgaccugaagcgccggcgcauccaccagugcgacuucgcggggugcagcaagguguacacgaaguccagccaccugaaggcccaccggcgcauccacaccggcgagaagcccuacaagugcaccugggacgggugcuccuggaaguucgcccggagcgacgagcucacccgccacuuccggaagcacacgggcaucaagcccuuccgcugcaccgacugcaaccgguccuucagccgcagcgaccaccugucccugcaccggcgccggcacgacaccauguga

SEQ ID NO: 32056 - RNA, 735 nt, Artificial Sequence
  derived and/or modified sequence opt1 from KLF9__Homo_sapiens__NP_001197
augagcgccgccgcguacauggacuucguggccgcccagugccuggucuccaucagcaaccgcgccgccgugcccgagcacggcguggcgccggacgccgagcggcuccgccugcccgagcgggaggucaccaaggagcacggggaccccggcgacaccuggaaggacuacugcacgcuggugaccaucgccaagucccuccuggaccugaacaaguaccgccccauccagaccccgagcgugugcuccgacagccucgagucccccgacgaggacauggggagcgacuccgacgucaccacggagagcggcuccagccccucccacagccccgaggagcggcaggacccgggguccgcccccagcccccugucccugcuccaccccggcguggcggccaagggcaagcacgccagcgagaagcgccacaagugcccguacuccgggugcggcaagguguacggcaagagcagccaccugaaggcccacuaccggguccacaccggggagcgccccuuccccugcaccuggcccgacugccugaagaaguucucccggagcgacgagcucacccgccacuaccggacgcacaccggggagaagcaguuccgcugcccgcugugcgagaagcgguucaugcgcuccgaccaccugaccaagcacgcccggcgccacaccgaguuccaccccagcaugaucaagcgguccaagaaggcgcucgccaacgcccuguga

SEQ ID NO: 32057 - RNA, 1221 nt, Artificial Sequence
  derived and/or modified sequence opt1 from KLHDC1__Homo_sapiens__NP_751943
auggccgacagccagcuguucugcguggccgaggagcgcuccggccacugcgcggucguggacgggaacuuccucuacguguggggcggguacgucagcaucgaggacaacgagguguaccugcccaacgacgagaucuggaccuacgacaucgacuccggccuguggcggaugcaccucauggagggggagcugcccgccagcauguccggcagcugcggcgccugcaucaacgggaagcuguacaucuucggcggguacgacgacaagggcuacuccaaccgccucuacuucgugaaccugcggacccgcgacgagacguacaucugggagaagaucaccgacuucgaggggcagccgcccacgccccgggacaagcugagcugcugggucuacaaggaccgccucaucuacuucggcggcuacgggugccggcgccacuccgagcugcaggacugcuucgacgugcacgacgccagcugggaggagcagaucuucuggggcuggcacaacgacgugcacaucuucgacaccaagacccagaccugguuccagcccgagaucaagggcggggucccgccccagccccgggccgcgcacacgugcgccgugcugggcaacaagggguacaucuucggcgggcgcgugcuccagacccggaugaacgaccugcacuaccugaaccucgacaccuggaccugguccggccgcaucaccaucaacggggagagccccaagcaccgguccuggcacacccugacgcccaucgccgacgacaagcuguuccucugcggcggccugagcgccgacaacaucccccuguccgacggguggauccacaacgucaccaccaacugcuggaagcagcucacccaccuccccaagacgcgcccgcggcuguggcacaccgcgugccugggcaaggagaacgagaucaugguguucgggggcagcaaggacgaccugcuggcccucgacaccgggcacugcaacgaccugcugaucuuccagacccagcccuacucccuccugcgcagcugccuggacugcaucggcaagaacuccaucaugcucgagagccagaucagccugcugccgcccaagcuccugcagcagguccugaagaagaucacguucugggccgccgccaaccaccgggaggagcagcgcgugcagaaggaggagaccgagaacaaguaccaguggaucuccagcaacuga

SEQ ID NO: 32058 - RNA, 1221 nt, Artificial Sequence
  derived and/or modified sequence opt1 from KLHDC2__Homo_sapiens__NP_055130
auggccgacggcaacgaggaccugcgcgccgacgaccugcccgggccggcguucgagagcuacgaguccauggagcuggccugccccgccgagcggagcggccacguggccgucuccgacgggcgccacauguucguguggggcggguacaagagcaaccaggugcggggccuguacgacuucuaccucccccgcgaggagcuguggaucuacaacauggagaccggccgguggaagaagaucaacaccgagggggacgugcccccguccaugagcggcuccugcgccgucugcguggaccgcguccuguaccucuucgggggccaccacagccgggggaacacgaacaaguucuacaugcuggacucccgcagcaccgaccgggugcugcagugggagcgcaucgacugccagggcaucccgcccuccagcaaggacaagcucggcgugugggucuacaagaacaagcugaucuucuucgggggcuacggguaccugcccgaggacaaggugcucggcaccuucgaguucgacgagaccuccuucuggaacagcucccacccccggggcuggaacgaccacgugcacauccuggacacggagaccuucaccuggagccagcccaucaccacggggaaggcgcccagcccccgcgccgcccacgccugcgcgaccgucggcaaccggggguucguguucggcgggcgcuaccgggacgcccgcaugaacgaccugcacuaccucaaccuggacaccugggaguggaacgagcugaucccgcagggcaucugccccgugggccgguccuggcacucccucacccccgucagcagcgaccaccuguuccuguucgggggcuucacgaccgacaagcagccccucuccgacgccuggaccuacugcaucagcaagaacgaguggauccaguucaaccacccguacaccgagaagccccgccuguggcacacggccugcgccuccgacgagggggaggugaucguguucggcgggugcgcgaacaaccugcucguccaccaccgggccgcccacagcaacgagauccugaucuucuccgugcagcccaagagccuggugcgccucucccuggaggccgucaucugcuucaaggagaugcuggccaacagcuggaacugccuccccaagcaccuccugcacuccgugaaccagcgguucggcagcaacaacaccuccggcagcuga

SEQ ID NO: 32059 - RNA, 1053 nt, Artificial Sequence
  derived and/or modified sequence opt1 from KLHDC8A__Homo_sapiens__XP_006711492
auggaggugcccaacgucaaggacuuccaguggaagcgccuggccccgcuccccagccggcgcguguacugcucccugcuggagaccggcgggcaggucuacgccaucggcgggugcgacgacaacggcgugcccauggacugcuucgagguguacagccccgaggcggaccaguggaccgcccucccgcggcugcccacggcccgcgccgggguggccgucaccgcgcugggcaagcggaucauggugaucggcggggugggcaccaaccagcucccccugaaggucguggagauguacaacaucgacgaggggaaguggaagaagcgcuccaugcugcgggaggccgccaugggcaucagcgugaccgccaaggacuaccgcgucuacgcggccgggggcaugggccucgaccugcggccccacaaccaccuccagcacuacgacaugcugaaggacaugugggugucccuggccccgaugcccacgccccgcuacgccgccaccagcuuccugcggggguccaagaucuacgugcucggcgggcgccagagcaaguacgcggucaacgccuucgagguguucgacaucgagacccgguccuggaccaaguuccccaacaucccguacaagcgcgccuucagcuccuucgugacgcuggacaaccaccuguacagccucggcggccugcggcaggggcgccuguaccggcagcccaaguuccuccgcaccauggacgucuucgacauggagcagggcggguggcugaagauggagcgguccuucuuccugaagaagcgccgggccgacuucguggccggcagccucuccgggcgcgugaucgucgcgggcggccuggggaaccagcccaccgugcuggagaccgccgaggccuuccaccccggcaagaacaagugggagauccucccggccaugcccacgccccgcugcgccugcagcuccaucguggucaagaacugccugcuggcggucgggggcgugaaccaggggcucagcgacgccguggaggcccugugcguguccgacagcuga

SEQ ID NO: 32060 - RNA, 1065 nt, Artificial Sequence
  derived and/or modified sequence opt1 from KLHDC8B__Homo_sapiens__NP_775817
augagcgccggcgggggccgcgccuucgcguggcaggucuucccgcccaugccgaccugccggguguacgggaccguggcccaccaggacggccaccuccuggugcucgggggcugcggccgcgccgggcugccccuggacacggccgagacccuggacauggccucccacaccuggcuggcgcucgcgccccugcccaccgcccgggccggcgccgccgccgucgugcuggggaagcagguccucguggugggcgggguggacgagguccagagccccguggccgccguggaggcguuccugauggacgagggccgcugggagcggcgcgccacgcugccccaggccgccaugggcgucgccaccguggagcgggacgggaugguguacgcgcucggcgggaugggccccgacaccgccccgcaggcccagguccgcguguacgagccccggcgcgacugcuggcugucccugcccagcaugcccaccccgugcuacggcgccuccacguuccuccacgggaacaagaucuacgugcugggcgggcggcagggcaagcugcccgucaccgccuucgaggcguucgaccucgaggcccgcaccuggacccggcaccccagccugcccucccgccgggccuucgccgggugcgccauggcggagggcagcguguucucccugggcgggcuccagcagccgggcccccacaacuucuacagccgcccccacuucgugaacacggucgagauguucgaccuggagcacggguccuggaccaagcugccccggagccuccgcaugcgggacaagcgcgccgacuucguggugggcucccucgggggccacaucgucgccaucggcgggcugggcaaccagccgugcccccuggggagcguggaguccuucagccuggcccggcgccgcugggaggcgcugcccgccaugcccaccgcccggugcuccugcagcucccuccaggccggcccgcgccuguucgucaucgggggcguggcccagggccccagccaggcgguggaggcccugugccuccgggacggggucuga

SEQ ID NO: 32061 - RNA, 1827 nt, Artificial Sequence
  derived and/or modified sequence opt1 from KLHL10__Homo_sapiens__NP_689680
auggagauggagagcgccgccgcguccacccgcuuccaccagccccacauggagcggaagaugagcgccauggccugcgagaucuucaacgagcugcgccucgagggcaagcugugcgacguggucaucaaggugaacggguucgaguucuccgcccacaagaacauccugugcagcugcuccagcuacuuccgggcccucuucaccuccggcuggaacaacacggagaagaagguguacaacaucccggggaucagccccgacaugaugaagcugaucaucgaguacgcguacacccgcaccguccccaucacccccgacaacguggagaagcugcucgccgccgccgaccaguucaacaucaugggcaucgugcgggggugcugcgaguuccugaaguccgagcugugccucgacaacugcaucggcaucugcaaguucacggacuacuacuacugcccggagcugcgccagaaggcguacauguucauccugcacaacuucgaggagauggucaaggugagcgccgaguuccucgagcuguccgugaccgagcugaaggacaucaucgagaaggacgagcucaacgucaagcaggaggacgccguguucgaggccauccugaaguggaucagccacgacccccagaaccggaagcagcacaucuccauccugcuccccaaggugcgccuggcccugaugcacgcggaguacuucaugaacaacgucaagaugaacgacuacgugaaggacagcgaggagugcaagcccgugaucaucaacgcccucaaggccauguacgaccugaacaugaacggcccguccaacagcgacuucaccaacccccugacccggccccgccuccccuacgccauccuguucgccaucgggggcugguccgggggcagcccgacgaacgcgaucgaggccuacgacgcccgggccgaccgcugggucaacgugaccugcgaggaggagagcccccgggccuaccacggggcggccuaccugaagggcuacguguacaucaucggcggguucgacuccgucgacuacuucaacagcgugaagcgcuucgaccccgugaagaagaccuggcaccaggucgcccccaugcacucccggcgcugcuacgugagcgugaccguccucggcaacuucaucuacgccaugggcggguucgacggcuacgugcggcugaacacggccgagcgcuacgagccggagaccaaccaguggacccugaucgcgcccaugcacgagcagcgguccgacgccagcgccaccacgcucuacgggaaggucuacaucugcggcggguucaacggcaacgagugccuguucaccgccgagguguacaacaccgaguccaaccaguggaccgugaucgcgcccaugcgcagccggcgcuccgggaucggcgucaucgccuacggcgagcacguguacgccgucgggggcuucgacggggccaaccgccugcggagcgccgaggcguacucccccguggccaacacguggcgcaccaucccgaccauguucaacccccggagcaacuucggcaucgaggugguggacgaccuccuguucgucgucgggggcuucaacggcuucaccacgaccuucaacguggagugcuacgacgagaagaccgacgagugguacgacgcccacgacauguccaucuaccgcagcgcccuguccugcugcguggugcccgggcucgccaacguggaggaguacgcggcccggcgcgacaacuuccccggccuggcccugcgggacgaggucaaguacagcgccuccaccagcacgcucccgguguga

SEQ ID NO: 32062 - RNA, 1821 nt, Artificial Sequence
  derived and/or modified sequence opt1 from KLHL12__Homo_sapiens__NP_001289980
auggacgugaacaaguucgaggccagcgucggcuuccuggacgugaagaaguuccucuccaccuggaagcugcagaacccccgcacccacuucgugcugagcccgcacugcuucaugggcgggaucauggcccccaaggacaucaugacgaacacccacgcgaaguccauccucaacagcaugaacucccugcgcaagagcaacacccugugcgacgucacccuccggguggagcagaaggacuuccccgcccaccggaucgugcuggccgccugcuccgacuacuucugcgccauguucacgagcgagcuguccgagaaggggaagcccuacgucgacauccagggccucaccgcgagcaccauggagauccugcuggacuucguguacaccgagacggugcacgucaccguggagaacgugcaggagcuccugccggccgccugccugcuccagcugaagggggucaagcaggccugcugcgaguuccuggagucccagcucgaccccagcaacugccugggcauccgcgacuucgcggagacccacaacugcguggaccugaugcaggccgccgagguguucucccagaagcacuuccccgaggucgugcagcacgaggaguucauccuccugagccagggcgagguggagaagcugaucaagugcgacgagauccaggucgacuccgaggagcccguguucgaggccgugaucaacugggucaagcacgccaagaaggagcgggaggagagccucccgaaccugcugcaguacgugcgcaugccccuccugacgccccgguacaucaccgacgugaucgacgcggagcccuucauccgcugcucccugcagugccgggaccucgucgacgaggccaagaaguuccaccuccgcccggagcugcggagccagaugcaggggccccgcacccgggcccgccugggcgccaacgaggugcugcuggucgucgggggcuucgggucccagcagagccccaucgacgugguggagaaguacgaccccaagacccaggaguggagcuuccucccguccaucacccggaagcgccgguacguggccagcgugucccugcacgaccgcaucuacgucaucggcggcuacgacgggcggagccgccuguccagcguggagugccucgacuacacggcggacgaggacggcgugugguacuccgucgcccccaugaacgugcggcgcgggcuggccggcgccaccacccugggcgacaugaucuacgugagcgggggcuucgacgggucccgccggcacaccagcauggagcgcuacgaccccaacaucgaccagugguccaugcucggcgacaugcagacggcccgggagggggcgggccuggucguggccagcggcgugaucuacugccucgggggcuacgacgggcugaacauccugaacuccgucgagaaguacgacccccacaccggccacuggaccaacgugaccccgauggccacgaagcgcagcggggccggcguggcccugcucaacgaccacaucuacgucgugggcggguucgacggcaccgcgcaccuguccagcguggaggccuacaacauccggaccgacuccuggaccacggucaccagcaugaccacgccccgcugcuacgugggggccaccgugcugcggggccgccuguacgccaucgcgggguacgacggcaacucccuccugagcagcaucgagugcuacgaccccaucaucgacuccugggaggucgugaccagcaugggcacccagcggugcgacgccggggugugcguccugcgcgagaaguga

SEQ ID NO: 32063 - RNA, 2064 nt, Artificial Sequence
  derived and/or modified sequence opt1 from KLHL1__Homo_sapiens__NP_001273654
augagcggcuccgggcgcaaggacuucgacgugaagcacauccugcggcuccgcuggaagcuguucagccaccccuccccgagcaccggcgggcccgccggcgggggcugccugcagcaggacggcuccgggagcuucgagcacuggggccccucccagagccggcuccugaagucccaggagcgcagcggggucuccaccuucuggaagaagcccagcuccagcuccagcuccagcuccagcccgagcuccagcuccagcuccuucaacccccugaacggcacgcuccugcccguggccacccggcugcagcagggggcgcccggccagggcacccagcagccggcccgcacccucuucuacguggagagccuggaggaggaggucgugcccgggauggacuuccccggcccccacgagaaggggcuggugcuccaggagcugaaggucgagccggacaacuccagccaggccacgggcgagggcugcgggcaccggcuggugcucuccagcguguccgacuacuucgccgccauguucaccagcgacgucugcgaggcgaagcaggaggagaucaagauggagggcaucgaccccaacgcccugugggaccuggugcaguucgccuacaccgggugccucgagcugaaggaggacaccaucgagaaccugcucgccgcggccugccugcugcagcucccccagguggucgaggugugcugccacuuccugaugaagcugcuccaccccuccaacugccugggcauccgcgccuucgccgacgcccaggggugcaucgagcugaugaagguggcgcacagcuacacgauggagaacaucauggaggucauccggaaccaggaguuccuccugcugccggccgaggagcuccacaagcugcuggccuccgacgacgugaacgugcccgacgaggagaccaucuuccacgcccucaugaugugggucaaguacgacaugcagagccgcugcaacgaccuguccaugcugcucgccuucauccggcugccccugcugcccccgcagauccuggcggaccuggagaaccacgcccucuucaagaacgaccuggagugccagaagcugauccucgaggccaugaaguaccaccuccugcccgagcgccggacccugaugcagagcccccgcaccaagccccggaaguccacggugggcacccucuacgccgugggcgggauggacaacaacaagggcgccaccaccaucgagaaguacgaccugcgcacgaaccuguggauccaggcggggaugaugaacggccggcgccuccaguucggggucgccgugaucgacgacaagcuguucgugaucggcggccgggacgggcugaagacccucaacaccgucgagugcuacaacccgaagaccaagacguggaccgugcugccgcccaugagcacccaccgccacggccugggggucaccgugcucgagggccccaucuacgccgucgggggccacgacggcuggagcuaccugaacacgguggagcggugggacccccagucccagcaguggaccuucguggccagcauguccaucgcccgcagcaccgugggggucgcggcccugaacggcaagcucuacuccgucgggggccgcgacggcagcuccugccugagcuccauggaguacuacgacccccacaccaacaaguggaacaugugcgcccccaugugcaagcggcgcgggggcguggggguggccacgugcgacggcuuccuguacgcggucgggggccacgacgccccggccagcaaccacugcucccggcuccuggacuacguggagcgcuacgaccccaagaccgacaccuggaccaugguggcgccccugagcaugccccgggacgccgugggcgugugccuccugggggaccgccuguacgccgucggcggguacgacggccagacguaccucaacaccauggaguccuacgacccgcagaccaacgaguggacccagauggccagccugaacaucgggcgggccggcgccugcgugguggucaucaagcagcccuga

SEQ ID NO: 32064 - RNA, 1830 nt, Artificial Sequence
  derived and/or modified sequence opt1 from KLHL20__Homo_sapiens__NP_055273
auggagggcaagcccaugcgccggugcaccaacauccgcccgggggagaccggcauggacgugacgagccggugcacccugggggaccccaacaagcuccccgagggcgucccccagccggcccgcaugcccuacaucuccgacaagcacccccggcagacccuggaggugaucaaccugcuccgcaagcaccgggagcugugcgacgugguccugguggugggggccaagaagaucuacgcgcaccgcgucauccucagcgccugcucccccuacuuccgggccauguucaccggcgagcuggccgagagccgccagacggagguggugauccgggacaucgacgagcgcgccauggagcugcucaucgacuucgcguacaccucccagaucaccgucgaggagggcaacgugcagacccugcugccggccgccugccuccugcagcuggccgagauccaggaggcgugcugcgaguuccucaagcggcagcuggaccccagcaacugccuggggauccgcgccuucgccgacacgcacuccugccgggagcuccugcgcaucgccgacaaguucacccagcacaacuuccaggaggugauggagagcgaggaguucaugcugcuccccgccaaccagcugaucgacaucaucuccagcgacgagcugaacguccgguccgaggagcaggucuucaacgcggugauggccugggugaaguacagcauccaggagcgccggccccagcucccccaggugcugcagcacgugcgccugccgcuccugucccccaaguuccuggucggcaccguggggagcgacccccucaucaaguccgacgaggagugccgggaccugguggacgaggccaagaacuaccugcuccugccgcaggagcgcccccugaugcagggcccccgcacccggccccgcaagccgauccggugcggggagguccucuucgccgugggcggcuggugcagcggggacgccaucuccagcguggagcgcuacgacccccagacgaacgaguggcggauggucgcguccaugagcaagcgccggugcggcgugggggucagcgugcuggacgaccugcucuacgccgugggcggccacgacggguccagcuaccugaacuccgucgagcgcuacgaccccaagaccaaccaguggagcuccgacguggcccccaccagcacgugccggaccuccgugggcgucgccgugcucgggggcuuccuguacgccgucgggggccaggacggcgugagcugccugaacaucguggagcgcuacgacccgaaggagaacaaguggacccggguggcguccaugagcacccgccggcugggggucgccguggccgugcucggcggguuccuguacgccgucggcggguccgacggcaccagcccccugaacacgguggagcgcuacaacccccaggagaaccgguggcacaccaucgcccccaugggcacccgccggaagcaccucgggugcgcgguguaccaggacaugaucuacgccgucggcgggcgcgacgacaccacggagcuguccagcgccgagcgguacaacccgcgcaccaaccaguggucccccgugguggccaugaccagccgccgguccggcgucgggcuggcgguggugaacggccagcugauggccgucggcggguucgacggcaccacguaccucaagaccaucgagguguucgaccccgacgccaacaccuggcgccuguacgggggcaugaacuaccggcgccugggcgggggcgugggggucaucaagaugacccacugcgagagccacaucugguga

SEQ ID NO: 32065 - RNA, 1770 nt, Artificial Sequence
  derived and/or modified sequence opt1 from KLHL25__Homo_sapiens__NP_071925
augagcguguccguccacgagacccgcaagagccgguccagcaccggcuccaugaacgugacgcuguuccacaaggccagccaccccgacugcgugcuggcccaccugaacacccugcgcaagcacugcauguucaccgacgucacccucugggcgggggaccgggccuucccgugccaccgcgccgugcuggccgccuccagccgguacuucgaggcgauguucucccacggccugcgcgagagccgggacgacacggugaacuuccaggacaaccuccaccccgagguccuggagcugcuccuggacuucgccuacuccagccgcaucgccaucaacgaggagaacgccgagucccugcucgaggcgggggacaugcugcaguuccacgacgugcgggacgccgccgccgaguuccuggagaagaaccucuuccccagcaacugccugggcaugaugcugcucuccgacgcccaccagugccgccggcuguacgaguucagcuggcgcaugugccuggugcacuucgagaccguccggcaguccgaggacuucaacagccucuccaaggacacccugcuggaccucaucagcagcgacgagcuggagaccgaggacgagcgcgugguguucgaggcgauccugcagugggucaagcacgaccucgagccccggaaggugcaccucccggagcugcugcgcuccgugcggcuggcccugcuccccagcgacugccugcaggaggccgucuccagcgaggcccugcucauggccgacgagcgcacgaagcugaucauggacgaggcgcugcggugcaagacccgcauccuccagaacgacgggguggugaccucccccugcgcccggccccgcaaggccggccacacccugcugauccucggcgggcagacguucaugugcgacaagaucuaccaggucgaccacaaggccaaggagaucaucccgaaggccgaccugcccagcccccgcaaggaguucuccgcgagcgccaucggcugcaagguguacgugaccgggggccggggguccgagaacggcgucagcaaggacguguggguguacgacaccguccacgaggagugguccaaggccgcccccaugcugaucgcccgcuucggccacgggagcgcggagcucgagaacugccuguacguggucggcgggcacaccucccuggccggcguguucccggccagccccuccgugagccucaagcaggucgagaaguacgaccccggcgccaacaaguggaugaugguggcgccccugcgggacgggguguccaacgccgccgucgugagcgccaagcugaagcuguucguguucggcgggacguccauccaccgcgacauggucagcaaggugcagugcuacgacccgagcgagaaccgguggaccaucaaggccgagugcccccagcccuggcgcuacaccgcggccgccgugcucggcucccagaucuucaucaugggcggggacaccgaguucacggccgccagcgcguaccgguucgacugcgagaccaaccaguggacccgcaucggcgacaugaccgccaagcggauguccugccacgcccuggccagcgggaacaagcuguacgucgugggcggguacuucggcacgcagcgcugcaagacccucgacugcuacgaccccaccuccgacaccuggaacugcaucacgaccgugccguacagccugauccccaccgccuucgucuccaccuggaagcaccuccccgcguga

SEQ ID NO: 32066 - RNA, 1848 nt, Artificial Sequence
  derived and/or modified sequence opt1 from KLHL26__Homo_sapiens__NP_060786
auggccgagagcggcggguccagcggcggggccggcgggggcggcgcguucggggccggccccgggccggagcgccccaacuccaccgccgacaagaacggcgcccugaagugcaccuucagcgcccccucccacagcacgucccuccugcaggggcuggcgacccuccgggcccagggccagcugcuggacgugguccucaccaucaaccgcgaggccuuccccgcccacaagguggugcuggcggccugcagcgacuacuuccgggccauguucaccggcgggaugcgcgaggccucccaggacgucaucgagcugaagggcgugagcgcccgggggcuccgccacaucaucgacuucgcguacuccgccgaggugacgcuggaccuggacugcguccaggacgugcucggcgccgccguguuccugcagaugcugccggucguggagcucugcgaggaguuccugaaggccgcgaugagcguggagaccugccugaacaucggccagauggccaccaccuucucccucgccagccugcgggaguccgucgacgccuucacguuccgccacuuccugcagaucgccgaggaggaggacuuccuccggcugccccuggagcgccucguguucuuccugcagagcaaccggcugcaguccugcgcggagaucgaccucuuccgcgccgccgugcgguggcugcagcacgaccccgcccgccggccccgcgccagccacguccugugccacauccgguucccgcucaugcaguccagcgagcugguggacagcgugcagacccuggacaucauggucgaggacgugcucugccgccaguaccugcuggaggcguucaacuaccaggugcuccccuuccggcagcacgagaugcagagcccccgcaccgccguccgguccgacgugcccucccuggugaccuucgggggcacgccguacaccgacagcgaccgcuccgucagcuccaagguguaccagcugcccgagcccggggcccgccacuuccgggagcucaccgagauggaggucggcugcagccacacgugcguggccgugcuggacaacuucgucuacguggccgggggccagcaccuccaguaccgcuccggcgagggggcgguggacgccugcuaccgguacgacccccaccugaaccgcuggcugcggcugcaggccaugcaggagagccgcauccaguuccagcucaacguccugugcggcaugguguacgccaccgggggccggaaccgcgcggggucccuggccagcguggagcgguacugcccgcgccggaacgaguggggcuacgccugcucccucaagcgccggaccuggggccacgccggggccgcgagcggcgggcgccuguacaucuccggcggguacggcaucagcgucgaggacaagaaggcccugcacugcuacgaccccguggccgaccagugggaguucaaggcccccauguccgagccccgggugcugcacgccauggucggcgccgggggccgcaucuacgcgcucgggggccggauggaccacguggaccgcugcuucgacgugcuggccgucgaguacuacgugccggagaccgaccaguggaccagcgugucccccaugcgggccggccagagcgaggcggggugcugccugcucgagcgcaagaucuacaucgucggcggguacaacuggcgccugaacaacgugacgggcaucgugcaggucuacaacaccgacaccgacgagugggagcgggaccugcacuuccccgagagcuucgccgggaucgccugcgcccccgugcuccugccgcgcgccggcacccggcgcuga

SEQ ID NO: 32067 - RNA, 2628 nt, Artificial Sequence
  derived and/or modified sequence opt1 from KLHL29__Homo_sapiens__NP_443152
augagccgccaccacucccgguucgagcgcgacuaccgggugggcugggaccgccgggaguggagcgucaacgggacccacggcaccacguccaucugcagcgugaccuccggggccggcgggggcaccgccagcucccugagcgugcgccccggccuccugccgcugcccgucgugcccucccggcuccccaccccggcgacggcccccgcccccugcaccaccgggagcuccgaggccaucaccagccugguggccuccagcgcguccgccgucacgaccaaggcccccggcaucagcaagggggacucccagagccagggccuggccaccuccauccgcugggggcagaccccgaucaaccagagcacgcccugggacaccgacgagccgcccagcaagcagaugcgggaguccgacaaccccggcaccggccccugggugaccacgguggcggccgggaaccagcccacccucaucgcccacagcuacggcgucgcccagcccccgaccuucucccccgccgugaacgugcaggcgcccgucaucggggugacccccagccugccgccccacgugggcccccagcugccccucaugccgggccacuacucccugccccagccgcccagccagccccuguccagcgucguggugaacaugcccgcccaggcccucuacgccagcccccagccgcuggccgucuccacgcugcccggggugggccagguggcgcgccccgggcccaccgccgucggcaacgggcacauggccggcccgcuccugcccccgccgccgcccgcccagcccuccgccacccugcccagcggcgcgcccgccaccaacgggccgcccacgaccgacuccgcccacggccuccagaugcugcggaccaucggggugggcaaguacgaguucaccgaccccgggcacccccgcgagaugcugaaggagcucaaccagcagcggcgcgccaaggccuucacggaccugaagaucguggucgagggccgggaguucgaggugcaccagaacguccuggcgagcugcucccucuacuucaaggaccugauccagcgcagcgugcaggacuccggccagggcgggcgggagaagcuggagcucgugcugagcaaccugcaggccgacguccucgagcugcugcucgaguucguguacaccgggucccuggugaucgacagcgccaacgccaagacccugcucgaggcggccagcaaguuccaguuccacaccuucugcaaggucugcguguccuuccuggagaagcagcugacggccagcaacugccucggcgugcuggccauggccgaggcgaugcagugcuccgagcuguaccacauggccaaggccuucgcccuccagaucuuccccgaggucgccgcgcaggaggagauccugagcaucuccaaggacgacuucaucgccuacgugagcaacgacucccugaacaccaaggccgaggagcucguguacgagaccgucaucaaguggaucaagaaggaccccgccacccgcacgcaguacgccgcggagcugcuggccguggugcggcuccccuucauccaccccagcuaccugcugaacgucguggacaacgaggagcugaucaaguccagcgaggccugccgcgaccucgugaacgaggccaagcgguaccacaugcugccccacgcgcgccaggagaugcagacgccccgcacccggccccgccuguccgccggggucgccgaggugaucgugcucgucggcggccggcagaugguggggaugacccagcgcagccugguggccgugaccugcuggaacccgcagaacaacaagugguacccccuggccucccuccccuucuacgaccgggaguucuucagcgucguguccgcgggcgacaacaucuaccugagcgggggcauggaguccggcgucacccuggccgacguguggugcuacaugagccuccuggacaacuggaaccuggugagccgcaugaccgucccgcggugccgccacaacucccucguguacgacgggaagaucuacacccugggcgggcugggcguggccgggaacgucgaccacguggagcgguacgacaccaucacgaaccagugggaggccguggcgccccuccccaaggccguccacagcgccgccgccaccgugugcggcggcaagaucuacguguucgggggcgucaacgaggccgggcgcgcggccggcgugcugcaguccuacgugccccagaccaacaccuggagcuucaucgaguccccgaugaucgacaacaaguacgcccccgccgucacgcugaacggguucguguucauccucggcggcgcguacgcccgggccaccaccaucuacgaccccgagaaggggaacaucaaggccggccccaacaugaaccacagccgccaguucugcuccgccgugguccuggacgggaagaucuacgcgaccggcgggaucgugagcuccgagggcccggcccugggcaacauggaggccuacgagcccacgaccaacaccuggacccuccugccccacaugcccugcccgguguuccggcacgggugcgucgugaucaagaaguacauccagagcggcuga

SEQ ID NO: 32068 - RNA, 1794 nt, Artificial Sequence
  derived and/or modified sequence opt1 from KLHL2__Homo_sapiens__NP_001154993
augguguggcuggaggcccgcccccagauccucuucgucugcaccaagcagggccaccagaagccgcuggacagcaaggacgacaacaccgagaagcacugccccgugacggugaaccccuggcacaugaagaaggccuucaaggucaugaacgagcugcggucccagaaccuccugugcgacgugaccaucguggcggaggacauggagaucagcgcccaccgcgucgugcuggccgccugcucccccuacuuccacgccauguucaccggggagaugagcgagucccgggcgaagcgcgugcggaucaaggaggucgacggcuggacccuccgcaugcugaucgacuacguguacacggccgagauccaggugaccgaggagaacguccaggugcugcucccggccgccgggcugcugcagcuccaggacgugaagaagaccugcugcgaguuccuggagagccagcugcaccccgucaacugccucggcauccgggcguucgccgacaugcacgccugcaccgaccugcugaacaaggccaacacguacgccgagcagcacuucgcggacguggugcucuccgaggaguuccugaaccuggggaucgagcaggucugcagccucaucuccagcgacaagcugaccaucuccagcgaggagaagguguucgaggccgugaucgccugggucaaccacgacaaggacgugcgccaggaguucauggcccggcugauggagcacgugcgccucccccugcugccccgggaguaccucguccagcgcguggaggaggaggcccuggucaagaacuccagcgcgugcaaggacuaccugaucgaggccaugaaguaccaccuccugccgaccgagcagcggauccugaugaaguccgugcgcacccggcuccgcacgcccaugaaccugcccaagcugaugguggucgugggcggccaggcccccaaggccauccggagcguggagugcuacgacuucaaggaggagcgcuggcaccaggucgccgagcucccgucccggcgcugccgggcggggaugguguacauggccggccugguguucgccgucgggggcuucaacgggagccugcgcgugcgcaccguggacuccuacgaccccgucaaggaccaguggaccagcguggccaacaugcgggaccgccggagcacccucggcgccgcggugcugaacggccugcucuacgccgucgggggcuucgacggguccacgggccugagcuccguggaggccuacaacaucaagagcaacgagugguuccacguggcccccaugaacacccgccgguccagcgucggcguggggguggucggcgggcugcucuacgcggugggcggguacgacggcgccucccgccagugccugagcaccguggagugcuacaacgccaccacgaacgaguggaccuacaucgccgagauguccacccggcgcagcggcgccggggucggcgugcugaacaaccuccuguacgcggucgggggccacgacgggccccuggugcggaaguccguggagguguacgacccgaccacgaacgccuggcgccaggucgccgacaugaacaugugccggcgcaacgccggcgugugcgccgugaacggccugcucuacgucgucgggggcgacgacgggagcugcaaccuggcguccguggaguacuacaaccccaccaccgacaaguggaccguggugagcuccugcaugagcacgggccgguccuacgccggggugaccgucaucgacaagccccuguga

SEQ ID NO: 32069 - RNA, 1905 nt, Artificial Sequence
  derived and/or modified sequence opt1 from KLHL31__Homo_sapiens__NP_001003760
auggcccccaagaagaagaucgugaagaagaacaagggcgacaucaacgagaugaccaucaucgucgaggacagcccgcugaacaagcucaacgcccugaacgggcugcucgagggcgggaacggccuguccugcaucagcuccgagcugaccgacgcgagcuacgggcccaaccuccuggagggccuguccaagaugcgccaggagaacuuccucugcgaccuggugaucggcacgaagaccaagagcuucgacgugcacaaguccgucauggccagcugcuccgaguacuucuacaacauccugaagaaggaccccagcauccagcggguggaccucaacgacaucagcccccuggggcuggccaccgugaucgccuacgccuacaccggcaagcucacgcugucccuguacaccaucggguccaucaucagcgcggccgucuaccuccagauccacacccuggugaagaugugcuccgacuuccugauccgcgagaugagcguggagaacugcauguacgucgugaacaucgccgagaccuacucccucaagaacgccaaggcggccgcccagaaguucauccgggacaacuuccuggaguucgccgagagcgaccaguucaugaagcugacguucgagcagaucaacgagcuccugaucgacgacgaccugcagcucccguccgagaucguggccuuccagaucgcgaugaaguggcuggaguucgaccagaagcgcgucaaguacgccgccgaccugcucagcaacauccgguucggcaccaucagcgcccaggaccuggugaacuacgugcaguccgucccccgcaugaugcaggacgccgacugccaccggcugcucguggacgcgaugaacuaccaccuccugcccuaccaccagaacacccugcagagccgccggacccgcauccgcgggggcugccgggugcuggucacggugggcgggcggcccggccugaccgagaagucccucagccgcgacauccuguaccgggacccggagaacgggugguccaagcugaccgagaugcccgccaagagcuucaaccagugcguggccgucauggacggcuuccucuacguggccggcggggaggaccagaacgacgcccgcaaccaggcgaagcacgccguguccaacuucugccgguacgacccccgcuucaacaccuggauccaccuggccagcaugaaccagaagcggacgcacuucucccugagcgucuucaacggccucguguacgccgccgggggccgcaacgcggaggggucccuggccagccuggagugcuacguccccuccaccaaccaguggcagccgaagacgccccucgagguggcccggugcugccacgccagcgcgguggccgacggccgcguccuggugaccggcggguacaucgccaacgccuacucccgcagcgugugcgccuacgaccccgcguccgacagcuggcaggagcugcccaaccuguccaccccgcggggcuggcacugcgccgucacccucagcgaccgcguguacgugaugggcgggagccagcuggggccccggggcgagcgcgucgacgugcugaccguggagugcuacucccccgccaccggccaguggagcuacgccgcgccccuccaggucgggguguccacggccggcgugagcgcccugcacgggcgggccuaccuggucggcggguggaacgagggcgagaagaaguacaagaagugcauccagugcuucuccccggagcucaacgaguggaccgaggacgacgagcugcccgaggccaccgugggcgugagcugcugcacccuguccaugcccaacaacgucacgcgcgagagccgggccuccagcguguccagcgugcccgucuccaucuga

SEQ ID NO: 32070 - RNA, 1752 nt, Artificial Sequence
  derived and/or modified sequence opt1 from KLHL35__Homo_sapiens__NP_001034637
augcgccagggccacgcccccgaggagagcgagccggggugcgaggcccccugcgcgggccccugccacgcccagcgggugcugcaggcccucaacgccuaccgccgguccgggacccugaccgacgucgugcugcgcgccggcgggcgggacuuccccugccaccgcgcggcccucagcgccggcuccgccuacuuccggagccuguucgcggccggccgcccggagcgggggcccgccgugguccccguggugcccgucgccccggaggcccccggcacgucccccgcgggggccgccgccgcccuggcgguggugcucgacuacgucuacggcgccggggugcgccugcgggccgaggacgaggccgccgcggugcuggcccucgccgagcgccugggcgucgccggccugcgggaggccugcgugcgcuuccucgaggggcggcugcgcgcggccaacagccuggcccuccggcgcguggccgcggccuucucccuggcgccccuggccgagcggugcggccgcguccuccggcaggccuucgccgagguggcccgccacgccgacuuccuggagcuggccccggacgagguggucgcccuccuggcggaccccgcccuggggguggcccgcgaggaggccguguucgaggccgcgaugcgguggguccgccacgacgcccccgcccggcgcggccagcuccggcgccugcuggagcacgugcggcucccccugcuggccccggcguacuuccucgagaagguggaggccgacgagcugcugcaggccugcggcgagugccgcccccuccugcuggaggcccgggccugcuucauccucgggcgcgaggcgggcgcccugcggacccgcccccggcgcuucauggaccuggccgaggucaucguggucaucgggggcugcgaccggaaggggcuccugaagcugcccuucgccgacgccuaccacccggagagccagcgcuggacgccccuccccucccugcccggcuacacccggagcgaguucgcggccugcgcccugcgcaacgacguguacguguccggcgggcacaucaacagccacgacgucuggauguucuccagccaccuccacaccuggaucaagguggccucccugcacaagggccgguggcgccacaagauggccgugguccaggggcagcuguucgcggugggcggguucgacggccuccgccggcugcacagcguggagcgcuacgacccguucuccaacaccugggccgccgccgcgccccugcccgaggccgucagcuccgccgccguggccagcugcgcgggcaagcuguucgugaucgggggcgcccggcagggcggggucaacaccgacaaggugcagugcuucgaccccaaggaggaccgcuggagccuccgguccccggcccccuucagccagcgcugccuggaggccgugucccuggaggacaccaucuacgucaugggcgggcucaugagcaagaucuucacguacgaccccggcaccgacguguggggcgaggccgcggugcugccgucccccgucgagagcugcggggugaccgugugcgacgggaagguccacauccugggcggccgggacgaccgcggggaguccaccgacaagguguucacguucgaccccagcuccggccagguggagguccagcccagccuccagcggugcaccuccagccacgggugcgugaccaucauccagucccugggccgcuga

SEQ ID NO: 32071 - RNA, 1668 nt, Artificial Sequence
  derived and/or modified sequence opt1 from KLHL3__Homo_sapiens__NP_001244123
augggcaaggccuucaaggugaugaacgagcugcgcagcaagcagcuccugugcgacgucaugaucguggccgaggacguggagaucgaggcgcaccgggucgugcuggccgccugcucccccuacuucugcgccauguucaccggggacaugagcgaguccaaggccaagaagaucgagaucaaggacguggacggccagacccucagcaagcugaucgacuacaucuacacggcggagaucgaggucaccgaggagaacguccaggugcugcucccggccgccucccugcugcagcucauggacgugcgccagaacugcugcgacuuccugcagagccagcugcaccccaccaacugccucgggauccgggccuucgcggacgugcacacgugcaccgaccugcugcagcaggccaacgccuacgccgagcagcacuuccccgaggugaugcucggcgaggaguuccugucccugagccucgaccaggucugcucccugaucagcuccgacaagcugaccgugagcuccgaggagaagguguucgaggccgucaucagcuggaucaacuacgagaaggagacccgccucgagcacauggcgaagcugauggagcacgugcggcugccccuccugccgcgcgacuaccuggugcagaccgucgaggaggaggcccucaucaagaacaacaacacgugcaaggacuuccugaucgaggccaugaaguaccaccuccugccccuggaccagcggcugcucaucaagaacccccgcaccaagccccggaccccggugucccugcccaaggugaugaucgucgucgggggccaggcccccaaggccauccgcagcguggagugcuacgacuucgaggaggaccggugggaccagaucgcggagcugcccucccgccggugccgcgccggcgugguguucauggccgggcacgucuacgccgugggcggguucaacggcagccuccgggugcgcaccgucgacguguacgacggggugaaggaccaguggacguccaucgccagcaugcaggagcggcgcagcacccugggcgcggccguccugaacgaccuccuguacgccgugggcggguucgacggcuccaccgggcuggccagcguggaggccuacuccuacaagaccaacgagugguucuucgucgcgccgaugaacacgcggcgcagcuccgugggcgugggcgucguggaggggaagcucuacgccgugggcggguacgacggcgccagccggcagugccuguccaccgucgagcaguacaaccccgccaccaacgaguggaucuacguggcggacaugagcacccgccgcuccggggccggcgugggcguccugagcgggcagcucuacgccacgggcgggcacgacggcccccuggugcggaaguccguggaggucuacgaccccgggaccaacaccuggaagcaggucgccgacaugaacaugugccgccggaacgccggcgugugcgcggugaacggccugcucuacguggucgggggcgacgacgggagcugcaaccuggccuccguggaguacuacaacccggugaccgacaaguggacgcugcugcccaccaacaugagcaccggccgcuccuacgccgggguggccgucauccacaagagccucuga

SEQ ID NO: 32072 - RNA, 1866 nt, Artificial Sequence
  derived and/or modified sequence opt1 from KLHL40__Homo_sapiens__NP_689606
auggcccugggccucgagcaggccgaggagcagcgccuguaccagcagacccugcuccaggacgggcugaaggacaugcuggaccacggcaaguuccucgacugcgugguccgggcgggggagcgcgaguuccccugccaccggcuggugcuggccgccugcagcccguacuuccgcgcccgguuccucgccgagcccgagcgcgcgggcgagcugcaccuggaggaggugucccccgacgucguggcccaggugcuccacuaccuguacaccagcgagaucgcccuggacgaggccuccguccaggaccucuucgcggccgcccaccgguuccagauccccagcaucuucacgaucugcguguccuuccugcagaagcgccugugccucagcaacugccuggccguguuccggcuggggcuccugcuggacugcgcccgccucgcggucgccgcccgggacuucaucugcgcccacuucacccugguggcccgcgacgcggacuuccugggccucuccgccgacgagcugaucgccaucaucagcuccgacggccugaacguggagaaggaggaggccgucuucgaggccgugaugcggugggcggggagcggcgacgccgaggcccaggccgagcgccagcgggcccucccgaccguguucgaguccguccgcugccggcugcugccccgcgcguuccucgagagccggguggagcgccacccccuggugcgggcccagcccgagcugcuccgcaagguccagauggugaaggacgcccacgaggggcgcaucaccacgcugcggaagaagaagaagggcaaggacggggccggcgcgaaggaggccgacaagggcaccuccaaggccaaggccgaggaggacgaggaggccgagcgcauccugccggggauccucaacgacacccugcgguucggcauguuccugcaggaccucaucuucaugaucagcgaggagggggcgguggccuacgaccccgccgccaacgagugcuacugcgccucccugagcaaccagguccccaagaaccacgugucccuggugaccaaggagaaccaggucuucguggcgggcggccucuucuacaacgaggacaacaaggaggaccccaugagcgccuacuuccugcaguucgaccaccuggacuccgaguggcucgggaugccgccccugcccagcccccgcugccuguucggccugggggaggcccucaacagcaucuacgucgugggcgggcgggagaucaaggacggcgagcgcugccuggacuccgugaugugcuacgaccggcugagcuucaaguggggcgaguccgacccgcuccccuacgucguguacgggcacacggugcugagccacauggaccuggucuacgugaucggcgggaagggcuccgaccgcaagugccucaacaagaugugcguguacgaccccaagaaguucgaguggaaggagcuggcccccaugcagaccgcccggagccuguucggggcgaccguccacgacggccgcaucaucguggccgccggcgugaccgacacggggcucaccuccagcgccgaggucuacuccaucaccgacaacaagugggcgccguucgaggccuucccccaggagcggagcucccugagccuggugucccucgugggcacccuguacgccaucgggggcuucgccacgcuggagaccgagagcggggagcucguccccaccgagcugaacgacaucuggcgcuacaacgaggaggagaagaagugggagggcgugcugcgggagaucgccuacgcggccggcgccaccuuccuccccgugcgccugaacguccugugccucacgaagauguga

SEQ ID NO: 32073 - RNA, 1821 nt, Artificial Sequence
  derived and/or modified sequence opt1 from KLHL41__Homo_sapiens__NP_006054
auggacagccagcgcgagcuggccgaggagcuccggcuguaccaguccacccugcuccaggacggccugaaggaccugcucgacgagaagaaguucaucgacugcacccugaaggccggggacaagagccugcccugccaccgccucauccuguccgcgugcagcccguacuuccgggaguacuuccuguccgagaucgacgaggccaagaagaaggaggugguccucgacaacguggaccccgccauccuggaccugaucaucaaguaccucuacagcgccuccaucgaccugaacgacggcaacgugcaggacaucuucgcccuggcgagccgcuuccagauccccuccgucuucacggugugcgugagcuaccuccagaagcggcuggcccccgggaacugccuggccauccuccgccugggccugcuccuggacugcccgcggcuggccaucuccgcgcgcgaguucgucagcgaccgguucgugcagaucugcaaggaggaggacuucaugcagcucagcccccaggagcugaucuccgugaucuccaacgacagccugaacgucgagaaggaggaggccguguucgaggccgugaugaaguggguccgcaccgacaaggagaaccgggugaagaaccucuccgagguguucgacugcauccgcuuccggcugaugaccgagaaguacuucaaggaccacgucgagaaggacgacaucaucaagagcaaccccgaccugcagaagaagaucaaggugcucaaggacgccuucgccgggaagcugcccgagccguccaagaacgcggccaagaccggcgccggcgaggugaacggggacgucggcgacgaggaccugcuccccggguaccugaacgacaucccccgccacggcauguucgugaaggaccugauccuccuggugaacgacacggccgccgucgcguacgaccccaccgagaacgagugcuaccugaccgcccucgccgagcagaucccgcggaaccacagcagcaucgugacccagcagaaccagaucuacguggucgggggccuguacguggacgaggagaacaaggaccagccccugcaguccuacuucuuccagcucgacagcaucgccuccgagugggucggccugccgccccugcccagcgcccgcugccucuucgggcugggcgagguggacgacaagaucuacguggucgcggggaaggaccugcagacggaggccucccuggacagcgugcucugcuacgaccccguggccgccaaguggaacgaggucaagaagcugcccaucaagguguacggccacaacgugaucucccacaagggcaugaucuacugccucgggggcaagaccgacgacaagaagugcaccaaccgggucuucaucuucaaccccaagaagggggacuggaaggaccuggccccgaugaagaucccccgcagcauguucggcguggcggugcacaaggggaagaucgucaucgccggcggcgugaccgaggacgggcuguccgccagcguggaggccuucgaccugacgaccaacaagugggacgucaugaccgaguucccccaggagcgguccagcaucucccucgugagccuggcgggcucccuguacgccaucgggggcuucgccaugauccagcucgagagcaaggaguucgcccccaccgaggugaacgacaucuggaaguacgaggacgacaagaaggagugggccgggaugcugaaggagauccgcuacgcguccggcgccagcugccuggccacgcggcucaaccuguucaagcuguccaagcucuga

SEQ ID NO: 32074 - RNA, 1518 nt, Artificial Sequence
  derived and/or modified sequence opt1 from KLHL42__Homo_sapiens__NP_065833
augagcgccgaggagauggugcagauccgccuggaggaccggugcuaccccgucuccaagcgcaagcucaucgagcagagcgacuacuuccgggcccuguaccgcuccggcaugcgggaggcgcugagccaggaggccgggggcccggaggugcagcagcuccgcgggcuguccgcccccggccugcggcucgugcuggacuucaucaacgccgggggcgcccgcgagggcuggcugcucgggccccggggcgagaagggcggcggggucgacgaggacgaggagauggacgaggugagccugcuguccgagcucguggaggcggccagcuuccugcaggucaccucccugcuccagcugcugcucagccaggugcgccugaacaacugccuggagauguaccggcucgcccagguguacgggcugcccgaccugcaggaggccugccuccgcuucauggucgugcacuuccacgaggugcugugcaagccgcaguuccaccuccucggcuccccgccccaggcgcccggggacgucagccugaagcagcggcugcgcgaggcccggaugaccggcacgcccgugcucguggcccugggggacuuccugggcggcccccucgcgccccaccccuaccagggggagccgcccuccaugcugcgcuacgaggagaugaccgagcggugguucccccuggccaacaaccugcccccggaccuggucaacgugcgcggcuacgggagcgccauccuggacaacuaccucuucaucgugggcggguaccggaucaccucccaggagaucagcgccgcccacuccuacaaccccagcaccaacgaguggcugcaggucgccuccaugaaccagaagcgcagcaacuucaagcugguggccgugaacagcaagcucuacgcgaucggcggccaggccgucuccaacguggagugcuacaaccccgagcaggacgccuggaacuucguggcgccccugccgaacccccuggccgaguucagcgccugcgagugcaaggggaagaucuacgucaucggcggguacacgacccgggaccgcaacaugaacauccuccaguacugccccuccagcgacauguggacccuguucgagaccugcgacgugcacauccgcaagcagcagauggucuccguggaggagacgaucuacaucgugggcgggugccugcacgagcucggccccaaccggcgcagcucccagagcgaggacaugcugaccguccaguccuacaacaccgugacccggcaguggcuguaccugaaggagaacacgagcaaguccggccucaaccugaccugcgcccugcacaacgacgggaucuacaucaugagccgcgacgugacccucuccaccagccuggagcaccgggucuuccugaaguacaacaucuucuccgacagcugggaggccuuccgccgguucccggccuucggccacaaccuccugguguccagccuguaccuccccaacaaggccgagacguga

SEQ ID NO: 32075 - RNA, 2130 nt, Artificial Sequence
  derived and/or modified sequence opt1 from KLHL5__Homo_sapiens__NP_001007076
augagcggcucccgcaaggaguucgacgugaagcagauccugaagauccgguggcgcugguucgggcaccaggccagcucccccaacagcaccgucgacucccagcagggcgaguucuggaaccgggggcagaccggcgccaacgggggccgcaaguuccucgacccgugcagccugcagcugccccucgcguccaucggcuaccggcgcagcucccagcuggacuuccagaacagccccuccuggcccauggccagcacguccgaggugccggccuucgaguucaccgccgaggacugcgggggcgcccacuggcuggaccggcccgagguggacgacgggaccagcgaggaggagaacgaguccgacagcuccagcugccgcaccuccaacagcagccagacgcucuccagcugccacaccauggagcccugcaccuccgacgaguucuuccaggcgcugaaccacgccgagcagaccuucaagaagauggagaacuaccugcggcacaagcagcucugcgacgucauccugguggccggcgaccgccggauccccgcccaccgccuggugcucagcuccgucagcgacuacuucgcggccauguucacgaacgacgugcgggaggcccgccaggaggagaucaagauggaggggguggagccgaacucccuguggagccugauccaguacgccuacaccggccggcucgagcugaaggaggacaacaucgagugccugcucuccaccgccugccugcugcagcucagccaggucguggaggcgugcugcaaguuccugaugaagcagcugcaccccuccaacugccucggcauccgcagcuucgccgacgcccaggggugcaccgaccugcacaagguggcccacaacuacacgauggagcacuucauggaggucauccggaaccaggaguucgugcugcuccccgccuccgagaucgcgaagcugcuggccagcgacgacaugaacauccccaacgaggagaccauccucaacgcccugcugaccugggugcgccacgaccucgagcagcggcgcaaggaccuguccaagcugcucgccuacauccggcugccgcugcucgcgccccaguuccuggccgacauggagaacaacguccuguuccgcgacgacaucgagugccagaagcucaucauggaggccaugaaguaccaccuccugcccgagcgccggcccaugcugcagagcccgcgcaccaagccccggaaguccacggugggcacccuguucgccgucgggggcauggacagcaccaagggcgccaccuccaucgagaaguacgaccugcgcacgaacauguggacccccguggccaacaugaacgggcggcgccuccaguucggcguggcggugcuggacgacaagcuguacgucgucgggggccgggacgggcugaagacccucaacaccguggagugcuacaaccccaagacgaagaccuggagcgugaugccgcccaugagcacccaccgccacggccugggcguggccguccuggaggggcccauguacgccgugggcgggcacgacggcugguccuaccucaacaccguggagcggugggacccccaggcccgccaguggaacuucgucgcgacgaugagcaccccgcgguccaccguggggguggccguccugagcggcaagcuguacgccgugggcgggcgcgacggcuccagcugccucaaguccguggagugcuucgacccccacaccaacaaguggacgcugugcgcccagaugagcaagcggcgcgggggcgucggggugaccaccuggaacggccugcucuacgccaucggcgggcacgacgcgcccgccuccaaccugaccagccggcuguccgacugcguggagcgcuacgaccccaagacggacauguggaccgccgucgccagcauguccaucagccgggacgccgugggcgugugccuccugggggacaagcuguacgcggucggcggcuacgacgggcaggccuaccucaacaccguggaggccuacgacccgcagaccaacgaguggacccagguggcgccccugugccugggccgcgccggggccugcgucgugacggugaagcucuga

SEQ ID NO: 32076 - RNA, 1866 nt, Artificial Sequence
  derived and/or modified sequence opt1 from KLHL6__Homo_sapiens__NP_569713
augcugauggccggccagcgcggggccuggaccaugggcgacguggucgagaagucccucgaggggccccuggcgccguccaccgacgagcccagccagaagacgggcgaccugguggagauccucaacggggagaaggugaaguucgacgacgccggccugucccugauccuccagaacggccuggagacccugcggauggagaacgcccucaccgacgucauccugugcguggacauccaggaguucagcugccaccgcgugguccuggccgccgcguccaacuacuuccgggccauguucugcaacgaccucaaggagaaguacgagaagcgcaucaucaucaaggggguggacgccgagaccaugcacacgcugcuggacuacaccuacaccagcaaggcccucaucaccaagcagaacgugcagcggguccuggaggcggccaaccuguuccaguuccuccgcaugguggacgccugcgccuccuuccugacggaggcccugaaccccgagaacugcgugggcauccuccggcuggcggacacccacagccuggacucccucaagaagcagguccagagcuacaucauccagaacuucgugcagauccugaacuccgaggaguuccuggaccuccccguggacacccugcaccacauccucaagagcgacgaccuguacgucaccgaggaggcccagguguucgagacggugauguccuggguccgccacaagccgagcgagcggcugugccugcuccccuacgugcuggagaacgugcgccugccccuccuggaccccugguacuucgucgagaccguggaggccgacccgcugauccggcagugccccgagguguucccccuccugcaggaggcccgcauguaccaccuguccgggaacgagaucaucagcgagcggaccaagccccgcaugcacgaguuccaguccgaggucuucaugaucaucggcgggugcaccaaggacgagcgguucguggccgaggucacgugccucgacccgcugcgccggagccgccuggagguggcgaagcucccccugaccgagcacgagcuggaguccgagaacaagaaguggguggaguucgccugcgucacccucaagaacgagguguacaucagcggcggcaaggagacccagcacgacguguggaaguacaacagcuccaucaacaaguggauccagaucgaguaccugaacaucgggcgguggcgccacaagauggucgugcugggcgggaagguguacgucaucggcggcuucgacgggcugcagcggaucaacaacguggagacguacgaccccuuccacaacugcuggagcgaggccgcgccccuccuggugcacgucuccagcuucgccgccaccucccacaagaagaagcuguacgugaucggcgggggcccgaacgggaagcucgccaccgacaagacccagugcuacgaccccagcacgaacaaguggucccugaaggccgccaugcccguggaggccaagugcaucaacgcggucagcuuccgcgaccgcaucuacguggugggcggcgccaugcgggcccuguacgccuacagcccccucgaggacagcuggugccuggucacccagcugucccacgagcgcgcgagcugcgggaucgccccgugcaacaaccggcucuacaucaccggcgggcgcgacgagaagaacgaggugaucgccaccgugcugugcugggaccccgaggcccagaagcugacggaggagugcguccucccccggggcgugucccaccacgggagcgugaccauccgcaaguccuacacccacauccggcgcaucguccccggcgccgugagcguguga

SEQ ID NO: 32077 - RNA, 1761 nt, Artificial Sequence
  derived and/or modified sequence opt1 from KLHL7__Homo_sapiens__NP_001026880
auggccgccagcggcguggagaaguccagcaagaagaagaccgagaagaagcuggcggcccgcgaggaggccaagcuccuggccggguucaugggcgucaugaacaacaugcggaagcagaagacccugugcgacgugauccucauggugcaggagcgcaagauccccgcccaccgggucgugcuggcggccgccucccacuucuucaaccugauguucaccaccaacaugcucgagagcaaguccuucgagguggagcugaaggacgccgagccggacaucaucgagcagcuggucgaguucgcguacaccgcccgcaucagcgugaacuccaacaacgugcagagccuccuggacgccgccaaccaguaccagaucgagcccgucaagaagaugugcguggacuuccugaaggagcaggucgacgccuccaacugccucgggaucagcgugcuggcggagugccuggacugccccgagcucaaggccaccgccgacgacuucauccaccagcacuucacggagguguacaagaccgacgaguuccugcagcuggacgugaagcgggucacccaccuccugaaccaggacacccugacggugcgcgccgaggaccagguguacgacgccgcgguccgguggcucaaguacgacgagcccaaccgccagccguucaugguggacauccuggccaaggugcgguucccccugaucuccaagaacuuccucagcaagaccguccaggccgagccccugauccaggacaaccccgagugccugaagauggugaucuccggcaugcgcuaccaccuccugagcccggaggaccgggaggagcugguggacgggacccgcccccggcgcaagaagcacgacuaccggaucgcccucuucggcggcucccagccccagagcugccgcuacuucaaccccaaggacuacuccuggaccgacauccggugcccguucgagaagcgccgggacgccgcgugcgucuucugggacaacguggucuacauccucgggggcagccagcuguuccccaucaagcgcauggacugcuacaacguggugaaggacuccugguacagcaagcuggggccgcccacgccccgggacagccuggccgccugcgccgccgagggcaagaucuacaccuccgggggcagcgaggucggcaacuccgcgcuguaccucuucgagugcuacgacacccgcaccgagagcuggcacacgaagcccuccaugcugacccagcgcugcagccacgggaugguggaggccaacggccugaucuacgugugcgggggcucccucggcaacaacgucagcgggcgggugcugaacuccugcgagguguacgaccccgccaccgagaccuggacggagcugugccccaugaucgaggcccgcaagaaccacggccucgucuucgugaaggacaagaucuucgcggucgggggccagaacgggcugggcggccuggacaacguggaguacuacgacaucaagcucaacgaguggaagauggugagcccgaugcccuggaagggggugaccgucaagugcgccgccgugggcuccaucguguacguccuggccggguuccagggcguggggcggcugggccacauccucgaguacaacaccgagaccgacaaguggguggccaacagcaagguccgcgcguuccccgugacguccugccugaucugcguggucgacacgugcggcgccaacgaggagacccuggagaccuga

SEQ ID NO: 32078 - RNA, 1854 nt, Artificial Sequence
  derived and/or modified sequence opt1 from KLHL9__Homo_sapiens__NP_061335
augaaggugagccugggcaacggggagaugggcgucuccgcccaccuccagcccugcaaggccgggaccacccgcuucuucacgagcaacacccacuccagcguggugcugcagggcuucgaccagcugcggaucgaggggcuccugugcgacgucacccuggugccgggcgacggcgacgagaucuuccccgugcaccgcgcgaugauggccuccgccagcgacuacuucaaggccauguucaccgggggcaugaaggagcaggaccucaugugcaucaagcugcacggggucaacaaggugggccugaagaagaucaucgacuucaucuacacggccaagcucucccugaacauggacaaccugcaggacacccucgaggcggccagcuuccugcagauccugcccgugcucgacuucugcaaggucuuccugaucuccggggugagccuggacaacugcguggaggucggccggaucgccaacaccuacaaccucaucgagguggacaaguacgugaacaacuucauccugaagaacuuccccgcccugcucuccaccggcgaguuccugaagcugccguucgagcgccucgcguucguccugagcuccaacagccugaagcacugcacggagcucgagcuguucaaggccgccugccgguggcugcgccucgaggacccccggauggacuacgccgccaagcugaugaagaacauccgcuucccccugaugaccccgcaggaccucaucaacuacgugcagaccguggacuucaugcggaccgacaacacgugcgucaaccugcugcucgaggcguccaacuaccagaugaugcccuacaugcagcccgugaugcagagcgaccgcaccgccauccgguccgacagcacccaccuggugacccucgggggcguccugcgccagcagcuggugguguccaaggagcugcggauguacgacgagcgcgcccaggaguggcggagccucgcccccauggacgcgccccgcuaccagcacgggaucgccgucaucggcaacuuccuguacguggucggcgggcagagcaacuacgacacgaagggcaagaccgccguggacaccguguuccgguucgacccgcgcuacaacaaguggaugcaggucgccucccugaacgagaagcggaccuucuuccaccucagcgcccugaaggggcaccuguacgccgugggcgggcgcuccgcggccggcgagcucgccacgguggagugcuacaacccccggaugaacgaguggagcuacgucgccaagauguccgagccccacuacggccacgccgggaccguguacggcgggcugauguacaucagcggcgggaucacccacgacaccuuccagaacgagcugaugugcuucgaccccgacacggacaaguggaugcagaaggcgccgaugaccaccgugcgcggccugcacugcaugugcaccgucggcgacaagcucuacgugaucgggggcaaccacuuccgcgggacguccgacuacgacgacgugcugagcugcgaguacuacucccccacccuggaccaguggacccccaucgccgccaugcuccggggccagagcgacgucgggguggccguguucgagaacaagaucuacgucgugggcggcuacuccuggaacaaccgcugcaugguggagaucguccagaaguacgaccccgagaaggacgaguggcacaagguguucgaccugccggagagccucgggggcauccgggcgugcacccugacgguguucccgcccgaggagaaccccgggucccccagccgcgagagcccccuguccgcccccuccgaccacagcuga

SEQ ID NO: 32079 - RNA, 3039 nt, Artificial Sequence
  derived and/or modified sequence opt1 from KL__Homo_sapiens__NP_004786
augcccgccagcgccccgccccgccggccccggcccccgccgcccucccugagccuccugcuggugcuccugggccucgggggccgccgccugcgggcggagcccggggacggcgcccagaccugggcccgcuucucccggccgcccgcccccgaggccgcggggcuguuccagggcaccuuccccgacggcuuccugugggccgucgggagcgccgccuaccagacggagggcggguggcagcagcacggcaagggggcguccaucugggacaccuucacccaccacccccucgccccgcccggcgacagccgcaacgccucccugccccugggcgcccccagcccccuccagcccgccaccggggacguggcguccgacagcuacaacaacguguuccgggacacggaggcccugcgcgagcugggcgucacccacuaccgguucuccaucagcugggcccgcgugcuccccaacggguccgccggcgugccgaaccgggagggccugcgcuacuaccggcgccugcucgagcggcugcgcgagcuggggguccagcccguggugacccucuaccacugggaccugccccagcggcugcaggacgccuacggcgggugggcgaaccgcgcccucgccgaccacuuccgggacuacgccgagcugugcuuccgccacuucggcgggcaggucaaguacuggaucaccaucgacaaccccuacgugguggccuggcacggcuacgcgacgggccgccuggccccggggauccggggcagcccccgccucggguaccuggucgcccacaaccugcuccuggcccacgccaagguguggcaccuguacaacaccuccuuccggcccacccagggcggccaggugagcaucgcgcucuccagccacuggaucaacccccgccggaugaccgaccacuccaucaaggagugccagaagucccuggacuucguccuggggugguucgccaagccgguguucaucgacggcgacuaccccgagagcaugaagaacaaccucagcagcauccugcccgacuucacggaguccgagaagaaguucaucaaggggaccgccgacuucuucgcccugugcuucggcccgacccucagcuuccagcugcuggacccccacaugaaguuccgccagcucgagucccccaaccugcggcagcugcucagcuggaucgaccuggaguucaaccacccccagaucuucaucguggagaacgggugguucgucuccggcaccacgaagcgcgacgacgcgaaguacauguacuaccugaagaaguucaucauggagacccucaaggccaucaagcuggacgggguggacgugaucggcuacaccgccuggagccugauggacggcuucgaguggcaccggggguacuccauccgccggggccuguucuacgucgacuuccucagccaggacaagaugcugcugccgaaguccagcgcccucuucuaccagaagcugaucgagaagaacggguucccgccccugcccgagaaccagccccucgagggcaccuuccccugcgacuucgccuggggcgugguggacaacuacauccaggucgacacgacccugucccaguucaccgaccugaacguguaccucugggacguccaccacagcaagcgccugaucaagguggacgggguggucaccaagaagcggaaguccuacugcguggacuucgcggccauccagccccagaucgcccugcuccaggagaugcacgugacgcacuuccgcuucagccuggacugggcccugauccucccccugggcaaccagucccaggucaaccacaccauccugcaguacuaccggugcauggccagcgagcucgugcgcgugaacaucaccccggucguggcgcuguggcagcccauggcccccaaccaggggcugccccggcuccuggcccgccagggcgccugggagaacccguacaccgcccuggcguucgccgaguacgcccggcucugcuuccaggagcuggggcaccacgugaagcuguggaucacgaugaacgagcccuacacccgcaacaugaccuacuccgccggccacaaccuccugaaggcgcacgcccuggccuggcacgucuacaacgagaaguuccgccacgcccagaacggcaagaucagcaucgcccuccaggcggacuggaucgagcccgccugccccuucagccagaaggacaaggagguggccgagcgggugcuggaguucgacaucggguggcuggccgagccgaucuucggcuccggggacuaccccugggucaugcgcgacuggcucaaccagcggaacaacuuccugcugcccuacuucaccgaggacgagaagaagcucauccagggcacguucgacuuccuggcccugagccacuacaccaccauccucguggacuccgagaaggaggaccccaucaaguacaacgacuaccuggaggugcaggagaugaccgacaucacguggcugaacagcccgucccaggucgcgguggugcccugggggcuccgcaagguccugaacuggcugaaguucaaguacggcgaccuccccauguacaucaucagcaacggcaucgacgacgggcugcacgccgaggacgaccagcugcggguguacuacaugcagaacuacaucaacgaggcccucaaggcccacauccuggacggcaucaaccugugcggguacuucgccuacuccuucaacgaccgcaccgcgccgcgguucggccucuaccgcuacgccgccgaccaguucgagcccaaggccagcaugaagcacuaccggaagaucaucgacuccaacggguuccccggccccgagacccuggagcgcuucugcccggaggaguucaccgugugcaccgagugcagcuucuuccacacgcggaagucccugcucgcguucaucgccuuccuguucuucgccagcaucaucucccugagccucaucuucuacuacuccaagaagggccgccggagcuacaaguga

SEQ ID NO: 32080 - RNA, 831 nt, Artificial Sequence
  derived and/or modified sequence opt1 from KLK10__Homo_sapiens__NP_002767
augcgcgcgccccaccuccaccugagcgccgccuccggcgcccgggcccuggccaagcugcucccgcugcugauggcccagcucugggcggccgaggccgcccugcugccccagaacgacacccgccucgaccccgaggcguacgggagccccugcgcccggggcucccagccguggcaggucagccuguucaacgggcuguccuuccacugcgccggcgugcucguggaccagagcugggugcugaccgccgcccacugcgggaacaagccccugugggcgcgcgucggcgacgaccaccuccugcugcuccagggcgagcagcugcggcgcacgacccgguccguggugcaccccaaguaccaccaggggagcggccccauccugccgcgccggaccgacgagcacgaccucaugcugcugaagcucgcccgccccgucgugcuggggccccgggugcgcgcccugcagcuccccuaccggugcgcccagccgggcgaccagugccaggucgccggguggggcaccacggcggcccgccgggugaaguacaacaagggccugaccugcuccagcaucaccauccugucccccaaggagugcgagguguucuaccccggggucgugaccaacaacaugaucugcgccggccucgaccgcgggcaggaccccugccagagcgacuccggcggcccgcuggugugcgacgagacgcugcaggggauccucagcuggggcgucuaccccugcggguccgcccagcaccccgccguguacacccagaucugcaaguacaugagcuggaucaacaaggugauccgguccaacuga

SEQ ID NO: 32081 - RNA, 753 nt, Artificial Sequence
  derived and/or modified sequence opt1 from KLK11__Homo_sapiens__NP_001129504
augcgcauccugcagcucauccugcuggcccucgccaccggccuggucgggggcgagacccggaucaucaagggguucgagugcaagccccacagccagccguggcaggcggcccuguucgagaagacgcgccuccugugcggcgccacccugaucgcgccccgguggcuccugaccgccgcccacugccugaagccccgcuacaucgugcaccucgggcagcacaaccugcagaaggaggagggcugcgagcagacccggacggccaccgaguccuucccccacccgggcuucaacaacagccugcccaacaaggaccaccgcaacgacaucaugcucgugaagauggccucccccgugagcaucaccugggccguccggccccugacccuguccagccgcugcgugacggcggggaccuccugccucaucagcggcuggggguccaccagcuccccgcagcugcggcugccccacacccuccgcugcgccaacaucacgaucaucgagcaccagaagugcgagaacgccuaccccggcaacaucaccgacaccauggugugcgccagcguccaggagggcgggaaggacuccugccagggcgacagcgggggcccccuggugugcaaccagucccugcaggggaucaucagcuggggccaggacccgugcgccaucacccggaagcccggcguguacacgaaggucugcaaguacguggacuggauccaggagaccaugaagaacaacuga

SEQ ID NO: 32082 - RNA, 765 nt, Artificial Sequence
  derived and/or modified sequence opt1 from KLK12__Homo_sapiens__NP_062544
augggccugagcaucuuccuccugcugugcgugcucgggcugucccaggccgccacccccaagaucuucaacggcaccgagugcgggcgcaacagccagccguggcaggucggccuguucgaggggacgucccuccggugcggcggcgugcugaucgaccaccgcugggugcugaccgcggcccacugcagcgggucccgguacuggguccgccucggcgagcacagccugucccagcuggacuggaccgagcagauccggcacagcggguucuccgugacccaccccggcuaccucggggccagcacgucccacgagcacgaccugcgccugcuccggcugcgccugcccgugcgggucaccagcuccgugcagccccucccgcugcccaacgacugcgccaccgccggcaccgagugccacgugagcggcugggggaucacgaaccacccccgcaaccccuucccggaccugcuccagugccugaaccuguccaucgucagccacgcgaccugccacggcguguaccccgggcggaucaccuccaacauggugugcgccggcggcguccccgggcaggacgccugccagggcgacagcgggggcccccucgugugcgggggcgugcugcagggccuggucuccugggggagcgugggcccgugcgggcaggacggcauccccgggguguacaccuacaucugcaacagcacgcucgucggccugggcaccuccuggaacuucaacagcugccagcccuucuga

SEQ ID NO: 32083 - RNA, 834 nt, Artificial Sequence
  derived and/or modified sequence opt1 from KLK13__Homo_sapiens__NP_056411
auguggccccuggcccucgugaucgccagccugacccuggcgcucuccggcggggucagccaggaguccagcaaggugcugaacaccaacggcacguccggguuccugccgggcggguacacgugcuucccccacagccagcccuggcaggccgcccuccuggugcagggccgccugcucugcggcgggguccuggugcaccccaagugggugcugaccgccgcccacugccucaaggagggccugaaggucuaccuggggaagcacgcgcucggccggguggaggccggggagcagguccgcgagguggugcacuccaucccgcaccccgaguaccggcgcagccccacccaccugaaccacgaccacgacaucaugcugcucgagcugcagucccccgugcagcugaccggcuacauccagacccucccgcugagccacaacaaccggcugacccccggcaccacgugccgcgucuccggguggggcaccaccaccagcccccaggugaacuaccccaagacgcuccagugcgccaacauccagcugcgguccgacgaggagugccgccagguguacccggggaagaucaccgacaacaugcugugcgccggcaccaaggagggcgggaaggacagcugcgagggcgacuccgggggcccccucgucugcaaccggacccuguacgggaucgugagcuggggcgacuuccccugcggccagcccgaccgcccggggguguacacgcgggucucccgcuacgugcuguggauccgggagaccauccgcaaguacgagacccagcagcagaaguggcucaagggcccccaguga

SEQ ID NO: 32084 - RNA, 804 nt, Artificial Sequence
  derived and/or modified sequence opt1 from KLK14__Homo_sapiens__NP_071329
augagccugcgcgugcucggcuccgggaccuggcccagcgccccgaagauguuccugcugcucaccgcccugcagguccuggcgaucgccaugacgcagucccaggaggacgagaacaagaucaucggcgggcacacgugcacccggagcucccagcccuggcaggccgcccuccuggccggcccccgccggcgcuuccugugcgggggcgcgcuccugagcggccagugggugaucaccgccgcccacugcgggcggcccauccuccagguggcccugggcaagcacaaccugcgccggugggaggcgacccagcagguccugcgcguggugcggcaggucacccacccgaacuacaacucccgcacccacgacaacgaccucaugcugcugcagcuccagcagcccgcccggaucgggcgcgccgugcggcccaucgaggugacccaggccugcgccagccccggcacguccugccgcgucagcggguggggcaccaucuccagcccgaucgcgcgguaccccgccucccugcagugcgugaacaucaacaucagccccgacgaggugugccagaaggccuacccccgcaccaucaccccgggcauggucugcgccggggugccccagggcgggaaggacuccugccagggcgacagcggcgggccccuggugugccggggccagcuccaggggcuggucuccuggggcauggagcgcugcgcccugcccggguacccgggcguguacacgaaccucugcaaguaccggagcuggaucgaggagaccaugcgcgacaaguga

SEQ ID NO: 32085 - RNA, 768 nt, Artificial Sequence
  derived and/or modified sequence opt1 from KLK15__Homo_sapiens__NP_001264010
auguggcugcuccugacccugagcuuccuccuggccuccaccgcccaggacggcgacaagcugcucgagggggacgagugcgcgccccacagccagccguggcaggucgcccuguacgagcgcggccgguucaacugcggggccucccugaucagcccccacugggugcucuccgccgcccacugccagagccgcuucaugcgggugcgccugggcgagcacaaccugcggaagcgcgacgggcccgagcagcuccggacgaccucccgcgugaucccccacccgcgguacgaggcgcgcagccaccggaacgacaucaugcugcugcgccucguccagcccgcccggcugaacccccaggugcgccccgccgugcugccgacccggugcccccaccccggcgaggccugcgucguguccggcugggggcucgugagccacaacgagcccggcaccgcgggguccccgcgcagccaggucucccugcccgacacgcugcacugcgccaacaucagcaucaucuccgacaccagcugcgacaaguccuaccccggccggcucaccaacaccauggugugcgccggggccgagggccgcggcgccgagagcugcgagggggacuccggcgggccccuggugugcggcggcauccugcaggggaucgucagcuggggcgacgugccgugcgacaacacgaccaagcccgggguguacaccaaggucugccacuaccucgaguggauccgggagaccaugaagcgcaacuga

SEQ ID NO: 32086 - RNA, 789 nt, Artificial Sequence
  derived and/or modified sequence opt1 from KLK1__Homo_sapiens__NP_002248
augugguuccuggugcucugccuggcccugagccucggcgggaccggcgccgcgcccccgauccagucccgcaucgucgggggcugggagugcgagcagcacagccagcccuggcaggccgcccuguaccacuucuccaccuuccagugcgggggcauccuggugcaccggcagugggugcucacggccgcccacugcaucagcgacaacuaccagcuguggcugggccgccacaaccucuucgacgacgagaacaccgcgcaguucguccacguguccgagagcuucccccaccccggguucaacaugucccugcuggagaaccacacccggcaggccgacgaggacuacagccacgaccucaugcugcugcgccucaccgagccggccgacacgaucaccgacgccgugaaggucguggagcugcccaccgaggagcccgaggugggcuccacgugccuggcgagcggguggggcuccaucgagcccgagaacuucagcuucccggacgaccuccagugcgucgaccugaagauccugcccaacgacgagugcaagaaggcccacgugcagaaggugaccgacuucaugcucugcgucgggcaccuggagggcggcaaggacacgugcgugggggacuccggcgggccccugaugugcgacggcgugcuccagggcgucaccagcuggggguacgugcccugcggcaccccgaacaagcccuccguggccguccgggugcugagcuacgugaaguggaucgaggacaccaucgccgagaacuccuga

SEQ ID NO: 32087 - RNA, 672 nt, Artificial Sequence
  derived and/or modified sequence opt1 from KLK2__Homo_sapiens__NP_001002231
augugggaccuggugcucagcaucgcccuguccgucggcugcaccggggccgugccccugauccagagccgcaucgugggcgggugggagugcgagaagcacucccagccguggcaggucgcgguguacagccacggcugggcccacugcgggggcgugcucguccacccccagugggugcugaccgccgcccacugccugaagaagaacucccagguguggcucggccggcacaaccuguucgagcccgaggacaccgggcagcgcguccccgugagccacuccuucccgcacccccuguacaacaugagccuccugaagcaccagucccugcggcccgacgaggacagcucccacgaccucaugcugcugcgccucagcgagcccgccaagaucaccgacguggucaaggugcugggccugccgacccaggagcccgcgcucgggaccacgugcuacgccuccggcugggggagcaucgagcccgaggaguuccugcggccccgcucccugcagugcgugagccuccaccuccuguccaacgacaugugcgcccgggccuacagcgagaaggucaccgaguucaugcugugcgcgggccuguggaccggcgggaaggacacgugcggcgugucccacccguacagccagcaccuggaggggaagggcuga

SEQ ID NO: 32088 - RNA, 717 nt, Artificial Sequence
  derived and/or modified sequence opt1 from KLK3__Homo_sapiens__NP_001025218
augugggugcccgucguguuccugacccucagcgugaccuggaucggcgccgccccgcugauccugucccgcaucgucgggggcugggagugcgagaagcacagccagcccuggcagguccucguggcgucccgggggcgcgccgugugcggcggggugcuggugcacccccaguggguccugaccgccgcccacugcauccggaacaagagcgugauccuccugggccgccacucccuguuccaccccgaggacaccggccagguguuccaggucagccacuccuucccgcacccccucuacgacaugagccugcugaagaaccgguuccuccgccccggggacgacuccagccacgaccugaugcugcuccggcuguccgagcccgccgagcugaccgacgcggugaaggugauggaccucccgacccaggagcccgcccugggcacgaccugcuacgccagcggguggggcuccaucgagcccgaggaguuccugacccccaagaagcuccagugcgucgaccugcacgugaucagcaacgacgugugcgcccagguccacccgcagaaggugaccaaguucaugcugugcgcggggcgcuggacgggcggcaaguccacgugcagcugggugauccucaucaccgagcugaccaugcccgcccugcccaugguccuccacgggucccuggugcccuggcggggcgggguguga

SEQ ID NO: 32089 - RNA, 765 nt, Artificial Sequence
  derived and/or modified sequence opt1 from KLK4__Homo_sapiens__NP_004908
auggccaccgccggcaaccccugggggugguuccugggcuaccucauccuggggguggcgggcagccuggucuccgggagcugcucccagaucaucaacggcgaggacugcagcccgcacucccagcccuggcaggccgcccucgugauggagaacgagcuguucugcagcggcgugcugguccacccccagugggugcucuccgccgcccacugcuuccagaacagcuacaccaucgggcugggccugcacucccucgaggcggaccaggagcccgggagccagaugguggaggccucccugagcguccgccacccggaguacaaccggccccugcucgccaacgaccugaugcugaucaagcucgacgaguccgugagcgaguccgacacgauccgcagcaucuccaucgccagccagugccccaccgcgggcaacuccugccuggugagcggguggggccugcucgccaacggccggaugcccaccguccugcagugcgugaacgugagcgucguguccgaggaggugugcagcaagcuguacgacccgcucuaccaccccuccauguucugcgccgggggcgggcaggaccagaaggacagcugcaacggcgacuccggcgggccccugaucugcaacggcuaccugcaggggcucgucagcuucggcaaggcccccugcggccaggugggggugccgggcgucuacaccaaccugugcaaguucacggaguggaucgagaagaccgugcaggccuccuga

SEQ ID NO: 32090 - RNA, 882 nt, Artificial Sequence
  derived and/or modified sequence opt1 from KLK5__Homo_sapiens__NP_036559
auggccaccgcccggcccccguggaugugggugcugugcgcgcucaucaccgcccugcugcucggcgucacggagcacgugcuggccaacaacgacgugagcugcgaccaccccuccaacaccguccccagcggguccaaccaggaccugggcgccggggccggcgaggacgcgcgcagcgacgacuccagcucccgcaucaucaacgggagcgacugcgacaugcacacccagcccuggcaggccgcccuccugcugcggccgaaccagcucuacugcggcgccgugcuggugcacccccaguggcugcucaccgcggcccacugccgcaagaaggucuuccgggugcgccugggccacuacucccugagccccguguacgaguccgggcagcagauguuccagggcgucaagagcaucccccacccgggguacucccaccccggccacagcaacgaccucaugcugaucaagcugaaccggcgcauccggcccacgaaggacgugcgccccaucaacguguccagccacugcccguccgccgggaccaagugccucgucagcggcuggggcaccaccaagagcccccaggugcacuuccccaaggugcugcagugccugaacaucuccguccucagccagaagcggugcgaggacgccuacccccgccagaucgacgacacgauguucugcgccggggacaaggcgggccgggacuccugccagggggacagcggcggcccgguggugugcaacgggucccugcagggccuggucagcuggggcgacuaccccugcgcccgccccaaccggcccgggguguacaccaaccucugcaaguucaccaaguggauccaggagaccauccaggccaacuccuga

SEQ ID NO: 32091 - RNA, 735 nt, Artificial Sequence
  derived and/or modified sequence opt1 from KLK6__Homo_sapiens__NP_001012982
augaagaagcugauggugguccucagccugaucgccgccgcgugggccgaggagcagaacaagcuggugcacggcgggcccugcgacaagaccucccacccguaccaggccgcccucuacaccagcggccaccuccugugcgggggcgugcugauccacccccuguggguccugacggccgcgcacugcaagaagcccaaccuccagguguuccuggggaagcacaaccugcgccagcgggaguccagccaggagcaguccagcgugguccgcgccgugauccaccccgacuacgacgccgccucccacgaccaggacaucaugcuccugcggcuggcgcgcccggccaagcucagcgagcugauccagccccugccccucgagcgggacugcuccgccaacaccaccagcugccacauccugggcuggggcaagaccgccgacggggacuuccccgacacgauccagugcgccuacauccaccuggugucccgcgaggagugcgagcacgcguacccgggccagaucacccagaacaugcucugcgccggggacgagaaguacggcaaggacagcugccagggggacuccggcggcccccuggucugcggggaccaccuccggggccuggugagcugggggaacauccccugcggcuccaaggagaagcccggcguguacaccaacgucugccgcuacaccaacuggauccagaagacgauccaggccaaguga

SEQ ID NO: 32092 - RNA, 546 nt, Artificial Sequence
  derived and/or modified sequence opt1 from KLK7__Homo_sapiens__NP_001193982
augaacgaguacaccgugcaccugggcagcgacacccucggggaccgccgggcccagcgcaucaaggccuccaagagcuuccggcaccccggcuacuccacgcagacccacgucaacgaccugaugcuggugaagcucaacagccaggcgcgccuguccagcauggugaagaagguccggcugccgucccgcugcgagccgcccgggacgaccugcaccgugagcggcugggggaccaccaccucccccgacgugacguuccccagcgaccucaugugcgucgacgugaagcugaucagcccccaggacugcaccaagguguacaaggaccugcucgagaacuccaugcugugcgccggcauccccgacuccaagaagaacgccugcaacggcgacagcgggggcccccuggucugccgggggacccuccagggccugguguccugggggaccuucccgugcggccagcccaacgaccccggcguguacacgcaggucugcaaguucaccaaguggaucaacgacaccaugaagaagcaccgcuga

SEQ ID NO: 32093 - RNA, 783 nt, Artificial Sequence
  derived and/or modified sequence opt1 from KLK8__Homo_sapiens__NP_009127
augggccgcccccggccgcgcgccgccaagaccuggauguuccugcuccugcucgggggcgcgugggccgggcacagccgggcccaggaggacaaggugcugggcgggcacgagugccagccccacucccagcccuggcaggccgcccuguuccagggccagcagcugcucugcggcgggguccuggugggcgggaacugggugcugaccgcggcccacugcaagaagcccaaguacacgguccgccucggcgaccacagccugcagaacaaggacgggccggagcaggagauccccguggugcaguccaucccccaccccugcuacaacagcuccgacgucgaggaccacaaccacgaccugaugcuccugcagcugcgggaccaggccagccucggcuccaaggugaagccgaucagccuggccgaccacugcacccagcccggccagaagugcaccguguccggguggggcaccgucacgagcccccgcgagaacuuccccgacacccugaacugcgcggaggugaagaucuucccgcagaagaagugcgaggacgccuaccccgggcagaucaccgacggcauggugugcgccggcuccagcaagggggccgacacgugccagggcgacuccgggggcccccucgucugcgacggggcccugcagggcaucaccagcuggggcuccgaccccugcgggcggagcgacaagccgggcguguacaccaacaucugccgcuaccuggacuggaucaagaagaucaucggguccaagggcuga

SEQ ID NO: 32094 - RNA, 753 nt, Artificial Sequence
  derived and/or modified sequence opt1 from KLK9__Homo_sapiens__NP_036447
augaagcugggccuccugugcgcccugcucagccugcuggccgggcacggcugggcggacacccgcgccaucggggccgaggagugccggcccaacucccagccguggcaggccggccucuuccaccugacccgccuguucugcggggccacgcucaucagcgaccgguggcugcugaccgcggcccacugccgcaagcccuaccucugggugcggcugggcgagcaccaccuguggaagugggagggccccgagcagcuguuccgcgucaccgacuucuucccccacccgggguucaacaaggaccucuccgccaacgaccacaacgacgacaucaugcugauccggcucccccgccaggcccggcugagccccgcggugcagccccugaaccucucccagaccugcgugagcccgggcaugcagugccugaucuccggguggggcgccgucagcucccccaaggcccuguuccccgugacgcuccagugcgccaacaucagcauccuggagaacaagcugugccacugggccuaccccgggcacaucuccgacagcaugcucugcgcgggccugugggagggcgggcgcggcuccugccagggggacagcggcggcccgcuggugugcaacgggacccucgccggcgucguguccgggggcgccgagcccugcagccggccccgccggcccgccguguacaccuccgucugccacuaccuggacuggauccaggagaucauggagaacuga

SEQ ID NO: 32095 - RNA, 1917 nt, Artificial Sequence
  derived and/or modified sequence opt1 from KLKB1__Homo_sapiens__NP_000883
augauccuguucaagcaggccaccuacuucaucagccucuucgccaccguguccugcggcugccugacgcagcuguacgagaacgcguucuuccgcgggggcgacgucgccagcauguacacccccaacgcccaguacugccagaugcggugcaccuuccacccgcgcugccuccuguucuccuuccugcccgccagcuccaucaacgacauggagaagcgguucgggugcuuccucaaggacagcgugaccggcacgcugcccaaggugcaccgcaccggggccgucuccggccacagccugaagcagugcggccaccagaucuccgcgugccaccgggacaucuacaaggggguggacaugcgcggcgugaacuucaacgucagcaagguguccagcguggaggagugccagaagcggugcaccuccaacauccgcugccaguucuucagcuacgccacccagacguuccacaaggccgaguaccggaacaacugccuccugaaguacucccccgggggcaccccgaccgccaucaagguccugagcaacguggaguccggguucagccucaagcccugcgcgcuguccgagaucggcugccacaugaacaucuuccagcaccuggccuucagcgacguggacgucgcccgcgugcucacccccgacgccuucgugugccggacgaucugcaccuaccaccccaacugccuguucuucaccuucuacaccaacgucuggaagaucgagagccagcgcaacgugugccugcucaagacguccgagagcggcaccccguccagcuccacgccccaggagaacaccaucagcggguacucccugcugaccugcaagcggacccuccccgagcccugccacagcaagaucuacccgggcguggacuucgggggcgaggagcugaacgucaccuucgugaagggcgugaacgucugccaggagaccugcacgaagaugauccgcugccaguucuucaccuacucccugcuccccgaggacugcaaggaggagaagugcaagugcuuccugcggcugagcauggacgggucccccacccgcaucgccuacggcacccaggggagcuccggcuacagccuccggcugugcaacacgggggacaacuccgugugcaccaccaagaccagcacgcgcaucgugggcggcaccaacuccagcuggggcgaguggcccuggcaggucucccuccaggugaagcugaccgcgcagcggcaccugugcggcgggagccugaucgggcaccaguggguccucaccgccgcccacugcuucgacgggcugccgcugcaggacguguggcgcaucuacagcggcauccucaaccuguccgacaucacgaaggacacccccuucagccagaucaaggagaucaucauccaccagaacuacaagguguccgagggcaaccacgacaucgcccugaucaagcuccaggcgccccugaacuacaccgaguuccagaagcccaucugccugccgagcaagggggacaccuccaccaucuacacgaacugcugggucaccggcuggggguucagcaaggagaagggcgagauccagaacauccuccagaaggugaacaucccccuggugaccaacgaggagugccagaagcgguaccaggacuacaagaucacccagcgcauggucugcgccggguacaaggagggcggcaaggacgccugcaagggggacuccggcgggccccuggugugcaagcacaacggcauguggcgccucgugggcaucacgagcuggggcgaggggugcgcccggcgcgagcagcccggggucuacaccaagguggccgaguacauggacuggauccuggagaagacccaguccagcgacggcaaggcccagaugcaguccccggcguga

SEQ ID NO: 32096 - RNA, 537 nt, Artificial Sequence
  derived and/or modified sequence opt1 from KLLN__Homo_sapiens__NP_001119521
auggaccgccccggcccggggagcgcccggcccggccgcaccgugcacgucuggggguaccggguggaguggaaggugcgcaacggccggaagcugcagcccuccgagugggccgggcgcggcgaccucggcggguucaagcggcgcuggaaggacacccgggcgaccgucggcaccaccuuccgccggcgcagccgggugucccuggugggggagcugagcaaguucccccucccguccgacagcuccggcggcaagagcuccagcuccuucgcccgcggggcccuggccuggugccggcagcgcaaccccaaccccagcugcgccgcggccgagaccggcgcccggacgucccugcccaaggagcgcugccggggguggcgccucggcaacuggcugcacaagcacccgcaccccaacacgugcccccggcugcccgccugcuggcucccgcccauccugaccgagcgcggggagcgcguccccaagcuggugccccuccuggcgugcuaccccaagagcaagccgaaggacuga

SEQ ID NO: 32097 - RNA, 678 nt, Artificial Sequence
  derived and/or modified sequence opt1 from KLRB1__Homo_sapiens__NP_002249
auggaccagcaggccaucuacgccgagcugaaccuccccaccgacagcggcccggaguccagcucccccagcucccugccccgcgacgugugccaggggagccccuggcaccaguucgcgcugaagcucuccugcgccggcaucauccugcugguccucguggugaccgggcugagcgucuccgugacgagccugauccagaaguccagcaucgagaagugcuccguggacauccagcagagccggaacaagaccaccgagcgcccgggccuccugaacugccccaucuacuggcagcagcugcgggagaagugccuccuguucucccacaccgucaaccccuggaacaacagccuggccgacugcuccacgaaggagagcucccuccugcugauccgcgacaaggacgagcucauccacacccagaaccugauccgggacaaggccauccuguucuggaucgggcucaacuucagccugagcgagaagaacuggaaguggaucaacggcuccuuccugaacagcaacgaccucgagauccgcggcgacgccaaggagaacuccugcaucagcaucucccagaccagcguguacuccgaguacugcagcaccgagauccgguggaucugccagaaggagcugacgcccgugcgcaacaaggucuacccggacuccuga

SEQ ID NO: 32098 - RNA, 648 nt, Artificial Sequence
  derived and/or modified sequence opt1 from KLRC1__Homo_sapiens__NP_998822
auggacaaccagggcgugaucuacagcgaccugaaccugcccccgaaccccaagcgccagcagcggaagcccaaggggaacaaguccagcauccuggccaccgagcaggagaucaccuacgccgagcugaaccuccagaaggcgucccaggacuuccagggcaacgacaagacguaccacugcaaggaccugcccagcgccccggagaagcugaucgucgggauccucggcaucaucugccugauccugauggccuccguggugaccaucgucgugauccccagccgccacugcgggcacugccccgaggaguggaucaccuacuccaacagcugcuacuacaucggcaaggagcggcgcaccugggaggagucccuccuggccugcacgagcaagaacuccagccugcucuccaucgacaacgaggaggagaugaaguuccugagcaucaucucccccagcuccuggaucggcguguuccggaacagcucccaccacccgugggucaccaugaacgggcuggccuucaagcacgagaucaaggacagcgacaacgcggagcucaacugcgccgugcuccaggugaaccgccucaagagcgcccagugcggcuccagcaucaucuaccacugcaagcacaagcuguga

SEQ ID NO: 32099 - RNA, 696 nt, Artificial Sequence
  derived and/or modified sequence opt1 from KLRC2__Homo_sapiens__NP_002251
augaacaagcagcgcggcaccuucagcgaggugucccuggcccaggaccccaagcggcagcagcgcaagccgaaggggaacaagagcuccaucagcggcaccgagcaggagaucuuccaggucgagcugaaccugcagaaccccucccugaaccaccaggggaucgacaagaucuacgacugccagggccuccugcccccgcccgagaagcugacggccgaggugcucgggaucaucugcaucgugcugauggcgaccguccugaagaccaucgugcucauccccuuccuggagcagaacaacuucagccccaacacccggacgcagaaggcccgccacugcggccacugccccgaggaguggaucaccuacuccaacagcugcuacuacaucggcaaggagcggcgcaccugggaggagucccugcucgccugcaccagcaagaacuccagccugcuguccaucgacaacgaggaggagaugaaguuccucgccagcauccugccguccagcuggaucgggguguuccggaacuccagccaccaccccugggucacgaucaacggccuggccuucaagcacaagaucaaggacuccgacaacgcggagcucaacugcgccgugcuccaggugaaccgccucaagagcgcccagugcgggagcuccaugaucuaccacugcaagcacaagcuguga

SEQ ID NO: 32100 - RNA, 477 nt, Artificial Sequence
  derived and/or modified sequence opt1 from KLRC4__Homo_sapiens__NP_038459
augaacaagcagcgcggcaccuacagcgaggugucccuggcccaggaccccaagcggcagcagcgcaagcucaaggggaacaagaucagcaucuccggcaccaagcaggagaucuuccaggucgagcugaaccugcagaacgccagcuccgaccaccaggggaacgacaagacguaccacugcaagggccuccugccgccgcccgagaagcugaccgcggaggugcucgggaucaucugcaucgugcugauggccaccguccugaagaccaucgugcucauccccugcaucggcgugcuggagcagaacaacuucagccugaaccggcgcaugcagaaggcccggcacugcggccacugccccgaggaguggaucacguacuccaacagcugcuacuacaucgggaaggagcgccggaccugggaggagcgcgucugcuggcccgugcuccggcgcacccugaucugcuuccuguga

SEQ ID NO: 32101 - RNA, 651 nt, Artificial Sequence
  derived and/or modified sequence opt1 from KLRC4-KLRK1__Homo_sapiens__NP_001186734
augggcuggauccgcgggcggcgcagccggcacuccugggagaugagcgaguuccacaacuacaaccuggaccucaagaaguccgacuucagcacccgcuggcagaagcagcggugccccguggucaaguccaagugccgcgagaacgccagcccguucuucuucugcugcuucaucgccguggcgaugggcauccgguucaucaucauggugaccaucugguccgccgucuuccugaacagccuguucaaccaggaggugcagaucccccucacggaguccuacugcgggcccugccccaagaacuggaucugcuacaagaacaacugcuaccaguucuucgacgagagcaagaacugguacgagucccaggccagcugcaugucccagaacgccagccugcugaagguguacuccaaggaggaccaggaccuccugaagcuggucaagagcuaccacuggaugggccucgugcacaucccgaccaacggguccuggcagugggaggacggcagcauccugucccccaaccugcucaccaucaucgagaugcagaagggcgacugcgcccuguacgcgagcagcuucaagggguacaucgagaacugcuccacccccaacacguacaucugcaugcagcgcaccguguga

SEQ ID NO: 32102 - RNA, 540 nt, Artificial Sequence
  derived and/or modified sequence opt1 from KLRD1__Homo_sapiens__NP_001107868
auggccguguucaagaccacccuguggcgccucaucagcggcacgcuggggaucaucugccugucccucauggccacccugggcauccugcucaagaacagcuucaccaagcuguccaucgagcccgcguucaccccggggcccaacaucgagcugcagaaggacagcgacugcugcuccugccaggagaagugggucggcuaccggugcaacugcuacuucaucagcuccgagcagaagacguggaacgagagccgccaccucugcgccucccagaaguccagccugcugcagcuccagaacaccgacgagcuggacuucaugagcuccagccagcaguucuacuggaucgggcuguccuacagcgaggagcacaccgccuggcucugggagaacggcuccgcccugagccaguaccuguuccccuccuucgagaccuucaacacgaagaacugcaucgccuacaaccccaacggcaacgcgcucgacgagagcugcgaggacaagaaccgguacaucugcaagcagcagcugaucuga

SEQ ID NO: 32103 - RNA, 570 nt, Artificial Sequence
  derived and/or modified sequence opt1 from KLRG1__Homo_sapiens__NP_005801
augaccgacagcgugaucuacuccaugcuggagcuccccaccgccacgcaggcccagaacgacuacggcccgcagcagaaguccagcagcucccgccccagcugcuccugccuggucgcgaucgcccuggggcuccugaccgccgugcugcucagcgugcugcuguaccaguggauccucugccagggcuccaacuacagcacgugcgccuccugccccagcugccccgaccgguggaugaaguacgggaaccacugcuacuacuucuccgucgaggagaaggacuggaacagcucccuggaguucugccuggcccgcgacagccaccuccuggugaucaccgacaaccaggagaugucccugcuccagguguuccugagcgaggcguucugcuggaucggccugcggaacaacuccggguggcgcugggaggacggcagcccgcucaacuucagccggaucuccagcaacuccuucguccagaccugcggcgccaucaacaagaacgggcugcaggccagcuccugcgaggugccccugcacugggugugcaagaagguccgccucuga

SEQ ID NO: 32104 - RNA, 1230 nt, Artificial Sequence
  derived and/or modified sequence opt1 from KLRG2__Homo_sapiens__NP_940910
auggaggagagcugggaggccgcccccggcgggcaggcgggcgccgagcugccgauggagcccguggggucccucguccccacccuggagcagccccaggugccggccaaggugcgccagcccgagggccccgagagcucccccagcccggccggggccgucgagaaggcggccggcgccggccuggagcccuccagcaagaagaagccgcccagcccccggcccgggagcccccgcgugcccccgcucucccugggcuacggggugugccccgagccgcccagccccggccccgcccuggucaagcucccccggaacggggaggcgcccggcgccgagccggcccccuccgccugggcccccauggagcuccagguggacgugcgcgucaagcccgugggcgcggccgggggcuccuccaccccgagcccccggcccuccacccgcuuccugaaggugccgguccccgagagccccgccuucucccggcacgccgaccccgcccaccagcugcugcugcgcgcgccgagccagggcgggaccuggggccggcgcagcccccucgccgccgcccggaccgaguccgggugcgacgccgagggccgcgcgagccccgccgagggguccgccggcagccccggguccccgaccugcugccggugcaaggagcugggccuggagaaggaggacgccgcccuccugccccgcgcgggccuggacggggacgagaagcucccccgggccgugacgcugaccggccugcccauguacgucaagagccucuacugggcccuggccuucauggcggugcugcucgccguguccgggguggucaucguggugcuggccagccgcgccggcgcccggugccagcagugcccgcccggguggguccuguccgaggagcacugcuacuacuucagcgcggaggcccaggccugggaggccucccaggccuucugcagcgcguaccacgccacccucccccugcugucccacacccaggacuuccucggccgcuaccccgugagccggcacuccugggugggcgccuggcgcgggccgcagggcuggcacuggaucgacgaggcgccccugccgccccagcugcuccccgaggacggggaggacaaccuggacaucaacugcggcgcccuggaggaggggacgcucgucgccgccaacugcagcacgccccggcccugggugugcgccaagggcacccaguga

SEQ ID NO: 32105 - RNA, 1461 nt, Artificial Sequence
  derived and/or modified sequence opt1 from KMO__Homo_sapiens__NP_003670
auggacagcuccgugauccagcgcaagaaggucgccgugaucggcgggggccugguggggagccuccaggccugcuuccuggcgaagcggaacuuccagaucgacgucuacgaggcccgcgaggacacccggguggccaccuucacgcgcggccgguccaucaaccuggcccucagccaccgcgggcggcaggcccugaaggcggugggccuggaggaccagaucgucucccagggcauccccaugcgcgcccggaugauccacagccucuccgggaagaaguccgccaucccguacggcaccaagucccaguacauccugagcgugucccgcgagaaccugaacaaggaccuccugaccgccgcggagaaguaccccaacgugaagaugcacuucaaccaccggcugcucaagugcaaccccgaggaggggaugaucaccguccugggcagcgacaaggugcccaaggacgugacgugcgaccugaucgucgggugcgacggcgccuacuccaccgugcgcagccaccucaugaagaagccgcgguucgacuacucccagcaguacaucccccacggcuacauggagcugaccaucccgcccaagaacggggacuacgccauggagcccaacuaccugcacaucuggccccgcaacaccuucaugaugaucgcccuccccaacaugaacaagagcuucacgugcacccuguucaugcccuucgaggaguucgagaagcugcucaccuccaacgacguggucgacuucuuccagaaguacuucccggacgccaucccccugaucggcgagaagcugcucgugcaggacuucuuccugcugcccgcgcagcccaugaucagcgugaagugcuccagcuuccacuucaagagccacugcguccuccugggggacgccgcccacgccaucgugccguucuucggccagggcaugaacgccggguucgaggacugccugguguucgacgagcucauggacaaguucuccaacgaccugagccugugccuccccgucuucucccggcugcgcauccccgacgaccacgcgaucagcgaccuguccauguacaacuacaucgagaugcgggcccacgugaacagcuccugguucaucuuccagaagaacauggagcgcuuccuccacgccaucaugcccagcaccuucaucccgcuguacacgauggugaccuucucccggauccgcuaccacgaggccguccagcgguggcacuggcagaagaaggugaucaacaagggccuguucuuccucgggagccugaucgccaucuccagcaccuaccugcucauccacuacaugagcccccgcagcuuccugcgccugcggcgccccuggaacuggaucgcgcacuuccggaacaccacgugcuuccccgccaaggccgucgacucccucgagcagaucagcaaccugaucucccgcuga

SEQ ID NO: 32106 - RNA, 11919 nt, Artificial Sequence
  derived and/or modified sequence opt1 from KMT2A__Homo_sapiens__NP_001184033
auggcccacagcugccgcuggcgguuccccgcccgcccgggcaccaccgggggcgggggcgggggcggccggcgcgggcugggcggggcgccccggcagcgcgugcccgcccuccugcugcccccgggcccccccgucgggggcggcgggcccggcgccccgcccuccccccccgccguggccgcggccgccgccgcggccgggagcuccggcgccggcgugccggggggcgccgccgcggccagcgccgccuccagcuccagcgccuccagcuccagcuccagcuccagcuccgcgagcuccgggcccgcccuccugcgggucggccccggguucgacgccgcccugcaggugagcgccgcgaucggcacgaaccuccgccgguuccgcgccguguucggcgagagcgggggcgggggcggguccggcgaggacgagcaguuccugggcuucgggagcgacgaggagguccgggugcgcucccccacccggagcccguccgugaagaccagcccccgcaagccccggggccgcccccgguccgggagcgaccgcaacuccgccauccugagcgacccguccgucuucagcccccucaacaaguccgagaccaagagcggcgacaagaucaagaagaaggacuccaagagcaucgagaagaagcgggggcgcccccccacguucccgggcgugaagaucaagaucacccacggcaaggacaucuccgagcugcccaaggggaacaaggaggacagccugaagaagaucaagcggacccccuccgccaccuuccagcaggccacgaagaucaagaagcuccgcgcgggcaagcugagcccccugaagagcaaguucaagaccgggaagcuccagaucggccgcaagggcgugcagaucguccggcgccgggggcgcccgcccuccaccgagcggaucaagacccccagcggccugcugaucaacuccgagcucgagaagccgcagaaggugcgcaaggacaaggaggggacgcccccccugaccaaggaggacaagaccgugguccggcagagcccccgccggaucaagccggugcgcaucauccccuccagcaagcggaccgacgccacgaucgccaagcagcugcuccagcgcgccaagaagggcgcgcagaagaagaucgagaaggaggccgcccagcugcaggggcggaaggugaagacccaggucaagaacauccgccaguucaucaugcccgugguguccgccaucagcucccggaucaucaagaccccccgccgguucaucgaggacgaggacuacgacccgcccaucaagaucgcccgccuggagagcacccccaacucccgguucagcgcgcccuccugcggcagcuccgagaagagcuccgccgccagccagcacagcucccagaugagcuccgacagcucccgcagcuccagcccguccgucgacacgagcaccgacucccaggccagcgaggagauccaggugcuccccgaggagcgcuccgacacccccgaggugcaccccccgcugcccaucagccagucccccgagaacgagagcaacgaccggcgcucccggcgcuacagcgucuccgagcggagcuucggcagccgcaccacgaagaagcuguccacccuccagagcgccccccagcagcagaccuccagcuccccgccccccccccugcugaccccgccccccccgcuccagcccgcgagcuccaucagcgaccacacgcccuggcugaugcccccgaccaucccccuggccucccccuuccuccccgccagcaccgccccgaugcaggggaagcggaaguccauccugcgcgagcccaccuuccgguggacgagccugaagcacucccgcagcgagccccaguacuucuccagcgccaaguacgcgaaggagggccucauccggaagcccaucuucgacaacuuccgcccgcccccccugacccccgaggacgugggguucgccuccggcuucagcgccuccgggaccgccgcgagcgcccggcuguucagcccgcuccacuccggcacccgcuucgacaugcacaagcggagcccccugcugcgcgccccccgguucacgcccuccgaggcccacagccgcaucuucgaguccgucacccucccgagcaaccggaccuccgccggcaccagcuccagcgggguguccaaccgcaagcggaagcgcaagguguucagccccauccgcuccgagccccggagccccucccacagcaugcgcacccgguccggccgccugagcuccagcgagcugagcccgcucacgccccccuccagcgucuccagcucccugagcaucuccgugagcccccuggcgaccuccgcccucaacccgaccuucaccuuccccagccacucccugacgcagagcggggaguccgccgagaagaaccagcggccccgcaagcagaccagcgccccggccgagcccuucuccagcuccagccccaccccccuguucccgugguucacccccggcucccagacggagcgggggcgcaacaaggacaaggcgcccgaggagcugagcaaggaccgggacgccgacaagagcguggagaaggacaagucccgcgagcgggaccgcgagcgggagaaggagaacaagcgcgagagccggaaggagaagcgcaagaagggcuccgagauccagagcuccagcgcccucuaccccgucggccggguguccaaggagaagguggucggggaggacguggccaccagcuccagcgccaagaaggcgaccggccgcaagaaguccagcucccacgacagcgggaccgacaucacguccgugacccugggcgacaccaccgccgucaagacgaagauccugaucaagaaggggcggggcaaccucgagaagaccaaccuggaccugggcccgaccgcccccagccucgagaaggagaagacccugugccuguccacgcccagcuccagcaccgugaagcacagcaccuccagcaucggguccaugcucgcccaggcggacaagcugcccaugaccgacaagcgcguggccagccugcucaagaaggccaaggcccagcugugcaagaucgagaaguccaagagccugaagcagacggaccagccgaaggcccagggccaggaguccgacagcuccgagaccagcguccgcgggccccggaucaagcacgugugccgccgggcggccguggcccucggccgcaagcgggccgucuuccccgacgacaugcccacccuguccgcccugccgugggaggagcgcgagaagauccucagcuccaugggcaacgacgacaagagcuccaucgcggggagcgaggacgccgagccccuggccccccccaucaagccgaucaagcccgugacccggaacaaggccccccaggagcccccggugaagaagggccgccggucccgccggugcgggcagugccccggcugccagguccccgaggacugcggggugugcacgaacugccuggacaagcccaaguucggcggccgcaacaucaagaagcagugcugcaagaugcggaagugccagaaccuccaguggaugccgagcaaggccuaccugcagaagcaggcgaaggccgugaagaagaaggagaagaagagcaagaccuccgagaagaaggacagcaaggaguccagcgucgugaagaacguggucgacuccagccagaagcccacccccuccgcccgcgaggacccggcccccaagaagagcuccagcgagccccccccgcggaagcccguggaggagaaguccgaggaggggaacgugagcgcccccggccccgaguccaagcaggcgaccacgccggccagccgcaaguccagcaagcaggucucccagcccgcccuggugauccccccccagccgcccaccaccgggcccccccggaaggaggugccgaagaccacgcccagcgagcccaagaagaagcagcccccgccccccgaguccggccccgagcagagcaagcagaagaaggucgccccgcgccccagcauccccgugaagcagaagccgaaggagaaggagaagcccccccccgugaacaagcaggagaacgcggggacccucaacauccuguccacccugagcaacggcaacuccagcaagcagaagaucccggccgacggcguccaccggauccgcguggacuucaaggaggacugcgaggccgagaacgugugggagauggggggccucgggauccugaccuccguccccaucaccccccggguggugugcuuccugugcgccagcuccggccacgucgaguucguguacugccaggugugcugcgagcccuuccacaaguucugccucgaggagaacgagcgcccgcuggaggaccagcuggagaacuggugcugccgccggugcaaguucugccacgucugcgggcgccagcaccaggccacgaagcagcuccuggagugcaacaagugccggaacagcuaccaccccgagugccugggccccaacuaccccaccaagccgaccaagaagaagaagguguggaucugcaccaagugcgugcgcugcaaguccugcggcagcacgacccccgggaagggcugggacgcgcaguggucccacgacuucagccucugccacgacugcgccaagcuguucgccaaggggaacuucugcccccugugcgacaagugcuacgacgacgacgacuacgaguccaagaugaugcagugcggcaagugcgaccgguggguccacagcaagugcgagaaccucuccggcaccgaggacgagauguacgagauccugagcaaccugcccgaguccguggccuacaccugcgugaacugcacggagcgccacccggccgaguggcggcucgcgcuggagaaggagcugcagaucagccucaagcagguccugaccgcccugcucaacucccgcaccaccagccaccugcugcgguaccgccaggccgccaagccccccgaccucaaccccgagacggaggagagcaucccgucccggagcucccccgaggggcccgaccccccggugcugaccgaggucagcaagcaggacgaccagcagccccuggaccucgagggcgugaagcgcaagauggaccaggggaacuacaccuccgugcuggaguucagcgacgacaucgucaagaucauccaggccgcgaucaacuccgacggcgggcagcccgagaucaagaaggccaacagcauggugaaguccuucuucauccggcagauggagcgcguguuccccugguucagcgucaagaagucccgguucugggagccgaacaaggugagcuccaacagcggcaugcugcccaacgccgugcuccccccgucccuggaccacaacuacgcccaguggcaggagcgcgaggagaacagccacaccgagcagcccccccugaugaagaagaucauccccgcgccgaagcccaagggccccggggagcccgacuccccgacgccccuccacccccccaccccgcccauccugagcaccgaccggucccgcgaggacagccccgagcugaaccccccgcccggcaucgaggacaaccggcagugcgcccucugccugaccuacggggacgacagcgccaacgacgccggccgccugcucuacaucgggcagaacgaguggacgcacgucaacugcgcccugugguccgcggagguguucgaggacgacgacggcagccugaagaacgugcacauggccgucauccgcggcaagcagcuccggugcgaguucugccagaagcccggggccaccgugggcugcugccugaccuccugcaccagcaacuaccacuucaugugcucccgcgccaagaacugcguguuccuggacgacaagaaggucuacugccagcggcaccgcgaccucaucaagggggagguggugcccgagaacggcuucgaggucuuccggcgcguguucguggacuucgaggggaucagccugcggcgcaaguuccugaacggccucgagccggagaacauccacaugaugaucggcuccaugacgaucgacugccuggggauccugaacgaccucagcgacugcgaggacaagcuguuccccaucggcuaccagugcucccgggucuacuggagcaccaccgacgcccgcaagcggugcguguacaccugcaagaucguggagugccgcccccccgucguggagccggacaucaacuccacgguggagcacgacgagaaccggaccaucgcgcacagccccaccuccuucaccgagagcuccagcaaggagucccagaacacggccgagaucaucagcccccccuccccggaccgccccccccacagccagaccagcggguccugcuacuaccacgucaucagcaaggugccgcggauccgcacccccuccuacagccccacccagcggucccccggcugccgcccgcugcccagcgccgggucccccacgcccaccacccacgagaucgugaccgucggcgacccgcuccugagcuccggccugcggagcaucgggucccgccggcacagcaccuccagccucuccccccagcgcagcaagcugcgcaucaugucccccaugcggacgggcaacaccuacagccgcaacaacguguccagcgugagcaccaccgggacggccaccgaccuggaguccagcgccaaggucguggaccacgugcucggcccccugaacuccagcaccucccugggccagaacaccagcacguccagcaaccuccagcggaccgucgugaccguggggaacaagaacucccaccuggacggcagcuccagcuccgagaugaagcagagcuccgcgagcgaccuggucuccaagagcagcucccucaagggggagaagaccaaggugcugagcuccaagagcuccgagggcagcgcccacaacguggccuacccggggauccccaagcuggccccccagguccacaacacgaccucccgcgagcugaacgugagcaagaucggcuccuucgcggagcccagcuccgugagcuucuccagcaaggaggcccucuccuucccgcaccugcaccugcggggccagcgcaacgaccgggaccagcacaccgacagcacccaguccgccaacagcucccccgacgaggacacggaggucaagacccucaagcugagcgggaugagcaaccgcuccagcaucaucaacgagcacaugggcuccagcucccgggaccgccggcagaaggggaagaagagcugcaaggagaccuucaaggagaagcacuccagcaaguccuuccuggagcccggccaggugaccacgggggaggagggcaaccucaagcccgaguucauggacgaggugcugaccccggaguacaugggccagcgccccugcaacaacgucagcuccgacaagaucggggacaagggccugagcaugcccggggugcccaaggccccgcccaugcagguggagggcuccgccaaggagcuccaggcgccccggaagcgcaccgucaaggugacccugacgccccugaagauggagaacgagagccaguccaagaacgcccucaaggagagcuccccggccagcccccugcagaucgaguccaccagccccaccgagccgaucagcgccuccgagaaccccggggacggccccgucgcccagcccagcccgaacaacaccuccugccaggacagccaguccaacaacuaccagaaccugcccgugcaggaccggaaccucaugcugcccgacggccccaagccgcaggaggacgggagcuucaagcgccgguacccccgccgguccgcgcgcgcccgcagcaacauguucuucggccugacgccccucuacggggugcgguccuacggcgaggaggacauccccuucuacagcuccagcaccgggaagaagcgcggcaagcgguccgccgagggccaggucgacggggccgacgaccugagcaccuccgacgaggacgaccuguacuacuacaacuucacccgcacggugaucagcuccggcggggaggagcggcucgccagccacaaccuguuccgcgaggaggagcagugcgaccugccgaagaucucccagcucgacggcguggacgacggcaccgagagcgacaccagcgucaccgcgacgacccggaaguccagccagauccccaagcgcaacgggaaggagaacggcaccgagaaccugaagaucgaccggcccgaggacgccggggagaaggagcacgugaccaaguccagcgugggccacaagaacgagcccaagauggacaacugccacuccgucagccgcgugaagacgcaggggcaggacucccuggaggcccagcucagcucccuggagagcucccggcgcgugcacaccagcaccccguccgacaagaaccugcucgacaccuacaacaccgagcugcugaagagcgacuccgacaacaacaacagcgacgacugcggcaacauccuccccuccgacaucauggacuucguccugaagaacacgcccagcaugcaggcccugggcgagucccccgagagcagcuccagcgagcuccugaaccugggggagggccucgggcuggacuccaaccgggagaaggacaugggccuguucgagguguucagccagcagcucccgaccaccgagcccguggacuccagcgucuccagcuccaucagcgccgaggagcaguucgagcugccccuggagcuccccuccgaccugagcgugcugaccacgcgcuccccgaccgugcccagccagaaccccucccggcucgcggucaucagcgacuccggggagaagcgcgugaccaucaccgagaagagcguggccuccagcgagagcgacccggcccugcugucccccggcgucgaccccacgcccgagggccacaugaccccggaccacuucauccaggggcacauggacgccgaccacaucagcuccccccccugcggcagcguggagcaggggcacggcaacaaccaggaccucacccggaacuccagcacccccgggcugcaggugccggucucccccacggugcccauccagaaccagaaguacgugcccaacagcaccgacuccccgggccccagccagaucuccaacgcggccguccagaccacccccccccaccugaagccggccacggagaagcucaucguggugaaccagaacaugcagccccuguacguccugcagacccuccccaacggcgugacccagaagauccagcugaccagcuccgugagcuccacgcccagcgucauggagaccaacaccuccgugcuggggccgaugggcgggggccucacccugacgaccggccugaaccccagccuccccaccagccagucccuguuccccagcgccuccaaggggcugcucccgaugagccaccaccagcaccugcacuccuuccccgccgcgacccagagcuccuucccccccaacaucagcaacccgcccuccggccugcucaucggggugcagcccccgcccgacccccagcugcuggucagcgaguccagccagcgcacggaccucuccaccaccguggccacccccagcuccggccugaagaagcggccgaucagccgccugcagacgcggaagaacaagaagcucgcccccuccagcacccccuccaacaucgcccccagcgacguggucagcaacaugacccugaucaacuucaccccgucccagcugcccaaccaccccagccuccuggaccuggggucccucaacacgagcucccaccgcaccgugcccaacaucaucaagcgcagcaaguccagcaucauguacuucgagccggccccccugcugccccaguccgugggcggcaccgcggccaccgccgccgggaccagcacgaucucccaggacaccagccaccucaccuccggcagcgucuccgggcuggccagcuccagcuccgugcugaacguggucagcaugcagaccacgaccacccccaccagcuccgcgagcgugccgggccacgugacgcucaccaacccccggcugcuggggacccccgacaucggcuccaucagcaaccuccugaucaaggccucccagcagagccugggcauccaggaccagcccgucgcccucccgcccuccagcgggauguucccccagcugggcaccucccagacgcccagcaccgccgcgaucaccgccgccuccagcaucugcgugcugccguccacccagacgaccgggaucaccgccgccagccccuccggcgaggcggacgagcacuaccagcuccagcacgugaaccagcugcuggccagcaagaccgggauccacuccagccagcgcgaccucgacuccgccagcggcccccaggucagcaacuucacgcagaccguggacgcccccaacuccaugggccuggagcagaacaaggcccugagcuccgcgguccaggccagcccgaccucccccgggggcagccccuccagcccguccagcgggcagcgguccgccagccccuccgugcccggccccaccaagccgaagcccaagacgaagcgcuuccagcugccccucgacaaggggaacggcaagaagcacaaggugagccaccugcggaccuccagcuccgaggcccacauccccgaccaggagaccaccagccugacguccggcaccgggaccccgggcgccgaggcggagcagcaggacaccgccagcgucgagcagagcucccagaaggagugcgggcagcccgccggccagguggccgugcuccccgagguccaggugacgcagaaccccgcgaacgagcaggagagcgccgagccgaagaccguggaggaggaggaguccaacuucagcuccccccugaugcuguggcuccagcaggagcagaagcgcaaggagagcaucaccgagaagaagcccaagaagggccuggucuucgagaucuccagcgacgacggguuccagaucugcgccgaguccaucgaggacgccuggaagagccugaccgacaaggugcaggaggcccgguccaacgcgcgccucaagcagcugagcuucgccggcgugaacgggcugcggaugcucggcauccugcacgacgccgucguguuccugaucgagcagcucuccggggccaagcacugccgcaacuacaaguuccgguuccacaagcccgaggaggccaacgagccgccccugaacccccacggcagcgcgcgcgccgaggugcaccugcggaaguccgccuucgacauguucaacuuccucgccagcaagcaccgccagcccccggaguacaaccccaacgacgaggaggaggaggagguccagcugaaguccgcccggcgcgcgacgagcauggaccugcccaugcccaugcgguuccgccaccucaagaagaccuccaaggaggccgugggcguguaccggagcccgauccacgggcgcggccuguucugcaagcgcaacaucgacgccggggagauggucaucgaguacgccggcaacgugauccggagcauccagaccgacaagcgcgagaaguacuacgacuccaaggggaucggcugcuacauguuccggaucgacgacagcgagguggucgacgccaccaugcacggcaacgcggcccgcuucaucaaccacuccugcgagcccaacugcuacagccgggugaucaacaucgacgggcagaagcacaucgugaucuucgccaugcgcaagaucuaccggggcgaggagcugaccuacgacuacaaguuccccaucgaggacgccuccaacaagcucccgugcaacugcggggcgaagaagugccgcaaguuccugaacuga

SEQ ID NO: 32107 - RNA, 8148 nt, Artificial Sequence
  derived and/or modified sequence opt1 from KMT2B__Homo_sapiens__NP_055542
auggccgccgcggccggcgggggcagcugccccgggccgggcuccgcccgcgggcgguuccccggccgcccccggggcgccgggggcgggggcgggcgcggcggccgggggaacggcgccgagcgcgugcgggucgcgcugcgccgggggggcggcgccaccgggcccggcggggccgagccgggcgaggacaccgcccuccugcgccugcucgggcugcggcgcggccugcggcgccuccggcgccugugggcgggcccccgggugcagcgcgggcggggccgcgggcggggccgcggguggggccccagccgcggcugcgugcccgaggaggaguccagcgacggggaguccgacgaggaggaguuccagggcuuccacagcgacgaggacgucgccccguccagccugcgguccgcccuccgcagccagcgggggcgcgccccccggggccgcgggcggaagcacaagacgaccccccugcccccgccccgccuggccgacguggcgcccacccccccgaagacccccgcccggaagcgcggcgaggagggcacggagcggauggugcaggcccucaccgagcugcugcgccgggcccaggccccccaggcgccccgcucccgggccugcgagccgagcaccccccgccggucccgcgggcggccccccggccgcccggccgggcccugccgccggaagcagcaggccgucgugguggccgaggcggccgucaccauccccaagcccgagccgccccccccgguggugcccgucaagcaccagacgggcagcuggaagugcaaggagggccccgggcccggcccggggaccccccgccggggcgggcaguccagccgcggcggccgggggggccgcgggcggggccgcgggggcggccuccccuucgugaucaaguucgugucccgggccaagaaggucaagauggggcagcugagccugggccucgaguccgggcagggccaggggcagcacgaggagagcuggcaggacgugccccagcgccgggugggcagcggccaggggggcuccccgugcuggaagaagcaggagcagaagcuggacgacgaggaggaggagaagaaggaggaggaggagaaggacaaggagggggaggagaaggaggagcgcgccgucgccgaggagaugaugcccgcggccgagaaggaggaggccaagcugccccccccgccccucaccccccccgccccgagccccccccccccgcugcccccccccuccaccagcccgccccccccgcugugccccccccccccgccccccgugucccccccgccccuccccagccccccgcccccccccgcgcaggaggagcaggaggaguccccgccccccgugguccccgccacgugcagccggaagcgcggccggccgccccugacccccucccagcgcgccgagcgggaggccgcccgcgcggggcccgagggcaccagcccgcccacccccacgcccuccaccgccaccggcgggccgcccgaggacagccccaccguggccccgaaguccacgaccuuccugaagaacauccggcaguucaucaugcccguggucagcgcccgcuccagccgggugaucaagaccccccgccgcuucauggacgaggaccccccgaagccccccaaggucgaggugucccccgugcuccggccgcccaucaccacgagcccccccgucccgcaggagcccgcccccgugcccuccccgccccgcgcgcccacccccccgagcacccccgugccccugcccgagaagcggcgcagcauccugcgggagccgaccuuccgcuggacgucccucacccgggagcugcccccccccccgcccgcccccccgcccccccccgccccgagccccccccccgccccggccaccuccagccgccggccccugcuccugcgcgcgccccaguucacccccuccgaggcccaccugaagaucuacgagagcguccucacgccgcccccccugggcgcccccgaggccccggagcccgagccccccccggcggacgacucccccgccgagcccgagccccgggccguggggcgcaccaaccaccugagccucccgcgguucgcccccguggucaccacccccgugaaggccgagguguccccgcacggcgcgcccgcccugagcaacggcccccagacgcaggcccagcugcuccagccccugcaggcccugcagacccagcuccugccgcaggcccugccccccccccagccgcagcuccagcccccccccuccccgcagcagaugcccccccuggagaaggcgcgcaucgccggggucggcagccugccccuguccgggguggaggagaagauguucagccuccugaagcgggccaaggugcagcuguucaagaucgaccagcagcagcagcagaaggucgccgccuccaugccgcucagccccggcgggcagauggaggagguggcgggcgccgugaagcagaucuccgaccgcggccccguccggagcgaggacgagagcguggaggccaagcgcgagcggcccuccgggccggagagccccgugcagggcccccgcaucaagcacgucugccgccacgccgcgguggcccuggggcaggcccgggccauggugcccgaggacgucccgcgccuguccgcccucccccugcgggaccgccaggaccuggcgaccgaggacaccagcuccgccagcgagaccgaguccgugcccagccggucccgccggggcaagguggaggccgccgggcccggcggcgagagcgagccgacgggguccggcgggacccucgcccacaccccccgccggagccugcccucccaccacggcaagaagaugcgcauggcgcggugcgggcacugccgcggcugccugcggguccaggacugcggcagcugcgugaacugccucgacaagccgaaguucgggggccccaacaccaagaagcagugcugcguguaccgcaagugcgacaagaucgaggcccggaagauggagcgccuggccaagaaggggcggacgaucgucaagacccugcuccccugggacuccgacgagagccccgaggccuccccgggcccccccggcccccgccggggggccggcgcggggggcccgcgcgaggaggugguggcccaccccgggcccgaggagcaggacagccugcugcagcggaaguccgcccgccgcugcgucaagcagcggcccagcuacgacaucuucgaggacagcgacgacuccgagccgggcggcccccccgccccccgccggcgcaccccgcgggagaacgagcucccccugcccgagcccgaggagcagagccgcccgcggaagcccacccugcagcccgugcuccagcugaaggcccgccggcgccuggacaaggacgcgcucgcccccgggccguucgccuccuuccccaacggcuggacggggaagcagaagagccccgacggcgugcaccggguccgcguggacuucaaggaggacugcgaccuggagaacguguggcugauggggggccucuccguccugaccagcgugcccggcgggccgcccauggugugccugcucugcgccuccaagggccugcacgagcuggucuucugccaggugugcugcgaccccuuccacccguucugccucgaggaggcggagcggccccugccccagcaccacgacaccuggugcugccgccggugcaaguucugccacgugugcgggcgcaagggccgggggagcaagcaccugcucgagugcgagcgcugccggcacgccuaccaccccgccugccugggcccguccuaccccacccgcgccacgcgcaagcggcgccacuggaucugcagcgccugcguccggugcaaguccugcggcgcgacccccgggaagaacugggacguggaguggagcggcgacuacucccugugcccccgcugcacccagcucuacgagaaggggaacuacugcccgaucugcacccggugcuacgaggacaacgacuacgagagcaagaugaugcagugcgcccagugcgaccacugggugcacgccaagugcgagggccuguccgacgaggacuacgagauccugagcgggcuccccgacuccguccuguacacgugcggccccugcgccggcgccgcgcagccccgcuggcgggaggcccugagcggggcccuccagggcgggcugcgccaggugcugcagggccuccuguccagcaagguggucggcccgcugcuccugugcacccagugcgggcccgacggcaagcagcugcaccccgggcccugcggccuccaggccgugagccagcgguucgaggacgggcacuacaaguccguccacagcuucauggaggacauggugggcauccugaugcgccacuccgaggagggcgagaccccggaccggcgcgccgggggccagaugaaggggcugcuccugaagcugcucgagagcgcguucggcugguucgacgcccacgaccccaaguacuggcggcgcuccacccggcugcccaacggggugcugcccaacgccguccucccgcccagccuggaccacguguacgcccaguggcgccagcaggagcccgagacgcccgaguccggccagccgcccggcgaccccagcgcggccuuccaggggaaggaccccgccgccuucucccaccuggaggacccgcggcagugcgcccucugccugaaguacggcgacgcggacagcaaggaggccgggcgccugcucuacaucggccagaacgaguggacccacgugaacugcgccaucugguccgccgaggucuucgaggagaacgacgggagccugaagaacgugcacgccgcgguggcccggggccgccagaugcggugcgagcugugccucaagcccggcgccaccgucgggugcugccuguccagcugccuguccaacuuccacuucaugugcgcccgcgccagcuacugcaucuuccaggacgacaagaagguguucugccagaagcacaccgaccuccuggacggcaaggagaucgugaaccccgacggguucgacguccugcgccggguguacguggacuucgagggcaucaacuucaagcgcaaguuccucacggggcuggagccggacgcgaucaacguccugaucggcuccauccggaucgacagccucggcacccuguccgaccugagcgacugcgaggggcgccucuuccccaucggcuaccagugcagccggcuguacugguccaccguggacgcccgccggcgcugcugguaccggugccgcauccuggaguaccggcccugggggccccgcgaggagccggcccaccucgaggccgcggaggagaaccagaccaucgugcacagccccgcccccuccagcgagcccccgggcggcgaggaccccccccuggacacggacguccuggugcccggggccccggagcggcacucccccauccagaaccucgaccccccccugcgcccggacagcggcuccgcccccccccccgccccgcggagcuucuccggggcgcgcaucaaggugcccaacuacagccccucccggcgcccccugggcggggucagcuucggcccgcuccccucccccggcagcccguccagccugacccaccacauccccaccgugggggaccccgacuuccccgccccgccccggcgcucccgccggcccagcccccuggccccgcgccccccccccucccggugggccagcccgccccugaagaccagcccccagcuccgcgugcccccgcccacguccgucgugaccgcccugacccccaccagcggcgagcuggcgcccccggggcccgcccccucccccccgccccccgaggaccucggccccgacuucgaggacauggagguggucagcgggcuguccgccgccgaccuggacuucgccgcgagccuccugggcacggagccguuccaggaggagaucguggccgccggcgccaugggguccagccacggcgggcccggcgacuccagcgaggaggaguccagccccaccucccgguacauccacuucccggugaccgucgugagcgcccccgggcuggcgcccuccgccacccccggcgccccgcgcaucgagcagcucgacggcguggacgacgggaccgacagcgaggccgaggcgguccagcagccccggggccaggggacgccccccuccggcccgggcguggugcgcgccgggguccugggcgccgccggggaccgggcccgcccccccgaggaccugcccagcgagaucguggacuucgugcucaagaaccugggcgggccgggcgacggcggggcgggcccccgggaggagucccugccccccgccccgccccucgccaacgggagccagcccagccagggccugaccgccucccccgccgacccgacccgcaccuucgcguggcugcccggggcccccggcguccgggugcucagccugggccccgccccggagccccccaagcccgccacguccaagaucauccuggugaacaagcucgggcaggucuucgugaagauggccggcgagggggagccggugccccccccggucaagcagcccccccugcccccgaccaucagccccaccgcgcccaccuccuggacgcugcccccgggcccccuccugggggugcugcccguggucggcguggugcgccccgccccgcccccccccccgcccccccucacccugguccugagcuccggccccgccagcccgccccggcaggccauccgcgugaagcgggucuccaccuucagcgggcgcuccccccccgcgccgccccccuacaaggccccgcggcucgacgaggacggcgaggccagcgaggacaccccccaggugcccgggcugggcuccgggggcuucagccgcgugcggaugaagacgcccaccguccgcggcgugcuggaccucgaccgcccgggggagcccgccggcgaggagucccccgggccccugcaggagcggagcccgcugcucccccugcccgaggacggccccccgcaggugcccgacggcccccccgaccugcuccuggagucccaguggcaccacuacagcggggaggccagcuccagcgaggaggagccgcccucccccgacgacaaggagaaccaggcgcccaagcgcaccggcccgcaccugcgguucgagaucagcuccgaggacggguucagcgucgaggccgagucccucgagggcgccuggcgcacccugaucgagaaggugcaggaggcccgggggcacgcccgccugcggcaccucagcuucuccggcaugagcggcgcgcgccugcuggggauccaccacgacgccgugaucuuccucgccgagcagcugcccggcgcccagcggugccagcacuacaaguuccgcuaccaccagcagggggagggccaggaggagcccccccugaacccgcacggggccgcgcgggccgaggucuaccuccgcaagugcacguucgacauguucaacuuccuggccucccagcaccgggugcugcccgagggcgccaccugcgacgaggaggaggacgaggugcagcuccgcagcacccggcgcgcgaccucccuggagcugcccauggccaugcgguuccgccaccucaagaagacgagcaaggaggccgucggcguguaccgguccgccauccacgggcgcggccuguucugcaagcgcaacaucgacgccggggagauggugaucgaguacagcggcaucgucauccgguccgugcugaccgacaagcgcgagaaguucuacgacgggaagggcaucggcugcuacauguuccggauggacgacuucgacguggucgacgcgaccaugcacgggaacgccgcccgcuucaucaaccacagcugcgagcccaacugcuucucccgggugauccacguggagggccagaagcacaucgucaucuucgcccuccgccggauccugcgcggggaggagcugaccuacgacuacaaguucccgaucgaggacgccagcaacaagcuccccugcaacugcggcgcgaagcggugccgccgguuccugaacuga

SEQ ID NO: 32108 - RNA, 14736 nt, Artificial Sequence
  derived and/or modified sequence opt1 from KMT2C__Homo_sapiens__NP_733751
augagcuccgaggaggacaagagcguggagcagccccagccgcccccccccccgcccgaggagcccggcgcccccgccccgucccccgcggccgccgacaagcgcccccgggggcgcccccggaaggacggcgccagcccguuccagcgcgcccggaagaagccccgcucccgggggaagaccgcggucgaggacgaggacagcauggacggccuggagaccacggagaccgagaccaucguggagaccgagaucaaggagcaguccgccgaggaggacgccgaggccgagguggacaacagcaagcagcucauccccacgcugcagcgcuccgucagcgaggaguccgcgaacagccugguguccgugggggucgaggccaagaucagcgagcagcucugcgccuucugcuacugcggcgagaaguccagccugggccagggggaccugaagcaguuccggaucacccccggcuucauccucccguggcgcaaccagcccuccaacaagaaggacaucgacgacaacagcaacgggaccuacgagaagaugcagaacuccgccccccggaagcagcgcggccagcggaaggagcgcagcccccagcagaacaucgugagcugcguguccgucagcacccagacggccuccgacgaccaggcggggaagcugugggacgagcugagccucgugggccugccggacgccaucgacauccaggcccuguucgacuccaccggcaccugcugggcccaccaccggugcguggaguggagccucggggucugccagauggaggagccccugcuggugaacguggacaaggccgucguguccggcagcaccgagcgcugcgcguucugcaagcaccucggggccacgaucaagugcugcgaggagaagugcacccagauguaccacuaccccugcgccgccggcgccggcaccuuccaggacuucucccacaucuuccugcugugccccgagcacaucgaccaggcgccggagcggagcaaggaggacgccaacugcgccgugugcgacucccccggggaccuccuggaccaguucuucugcaccacgugcggccagcacuaccacgggaugugccuggacaucgccgucaccccccucaagcgcgccggcuggcagugccccgagugcaaggugugccagaacugcaagcagagcggggaggacuccaagaugcuggugugcgacaccugcgacaagggcuaccacaccuucugccugcagccggucaugaagagcgugcccacgaacggcuggaagugcaagaacugccggaucugcaucgagugcgggacccgcuccagcucccaguggcaccacaacugccucaucugcgacaacugcuaccagcagcaggacaaccugugccccuucugcggcaagugcuaccacccggagcugcagaaggacaugcuccacugcaacaugugcaagcggugggugcaccuggagugcgacaagcccaccgaccacgagcuggacacccagcucaaggaggaguacaucugcauguacugcaagcaccugggggcggagauggaccgccugcagcccggcgaggaggucgagaucgccgagcucacgaccgacuacaacaacgagauggagguggaggggcccgaggaccagauggucuucagcgagcaggccgccaacaaggacgugaacggccaggaguccaccccgggcaucgugcccgacgcgguccaggugcacaccgaggagcagcagaagagccaccccagcgagucccuggacacggacagccugcucaucgccguguccagccagcacaccgucaacaccgagcuggagaagcagaucuccaacgagguggacagcgaggaccugaagauguccagcgaggugaagcacaucugcggggaggaccagaucgaggacaagauggaggucaccgagaacaucgagguggugacgcaccagaucaccguccagcaggagcagcuccagcugcuggaggagcccgagaccguggugucccgcgaggagagccggccgcccaagcucgucauggaguccgugacccugccccuggagacgcucgugagcccccacgaggaguccaucagccugugcccggaggagcagcuggucaucgagcgccuccagggcgagaaggagcagaaggagaacuccgagcugagcaccgggcugauggacuccgagaugacccccaccaucgagggcugcgugaaggacgugagcuaccaggggggcaagagcaucaagcuguccagcgagaccgaguccagcuucuccagcuccgccgacaucagcaaggccgacgucuccagcucccccacgcccagcuccgaccucccgagccacgacaugcugcacaacuaccccuccgcccugagcuccagcgcgggcaacaucaugcccaccaccuacaucuccgugacccccaagaucgggaugggcaagccggccaucacgaagcggaaguucagccccgggcgcccccggagcaagcagggcgccugguccacccacaacaccgugagccccccguccuggagccccgacaucuccgagggccgcgagaucuucaagccccggcagcucccggggagcgccaucugguccaucaaggucggccgcgggagcggcuuccccgggaagcggcgcccccggggcgccggccuguccgggcgcggcgggcggggccgcagcaagcugaaguccgggaucggcgcgguggugcuccccggcgucagcaccgccgacaucuccagcaacaaggacgacgaggagaacuccaugcacaacacgguggugcuguucagcuccagcgacaaguucacccugaaccaggacaugugcgucgugugcggguccuucggccagggggccgagggccggcuccuggccugcagccagugcgggcagugcuaccacccguacugcgugagcaucaagaucaccaaggucgugcuguccaagggcuggcgcugccucgagugcaccgugugcgaggccugcggcaaggcgacggaccccgggcggcugcugcucugcgacgacugcgacaucagcuaccacaccuacugccuggaccccccccugcagaccgucccgaagggcggguggaagugcaaguggugcguguggugccgccacugcggcgccaccuccgccgggcuccggugcgaguggcagaacaacuacacgcagugcgcccccugcgcgagccuguccagcugccccgugugcuaccgcaacuaccgcgaggaggaccugauccuccagugccggcagugcgaccgcuggaugcacgccgucugccagaaccugaacaccgaggaggagguggagaacguggccgacaucggcuucgacugcuccaugugccggcccuacaugccggccagcaacguccccuccagcgacugcugcgaguccagccugguggcccagaucgugaccaaggucaaggagcucgacccccccaagaccuacacgcaggacggcgugugccugaccgaguccgggaugacccagcugcagagccucaccgugacggucccgcgccggaagcgcuccaagcccaagcugaagcugaagaucaucaaccagaacagcguggcggugcuccagaccccccccgacauccaguccgagcacagccgggacggcgagauggacgacucccgcgagggggagcugauggacugcgacggcaagagcgagagcuccccggagcgggaggccgucgacgacgagaccaagggcguggaggggaccgacggcgucaagaagcgcaagcggaagcccuaccgccccgggaucggcggguucauggugcggcagcgcagccggacgggccagggcaagaccaagcgcuccgugauccggaaggacagcuccgggagcaucuccgagcagcugcccugccgcgacgacggcuggagcgagcagcucccggacacccuggucgacgaguccgugagcgugaccgaguccacggagaagaucaagaagcgguaccgcaagcggaagaacaagcuggaggagaccuuccccgccuaccuccaggaggccuucuucgggaaggaccugcuggacaccagccgccaguccaagaucagccucgacaaccuguccgaggacggcgcccagcugcucuacaagaccaacaugaacacgggguuccuggaccccagccuggacccccuccuguccagcuccagcgcgccgaccaagagcggcacccacggccccgccgacgacccccuggccgacaucuccgagguccucaacaccgacgacgacauccuggggaucaucagcgacgaccuggccaaguccguggaccacagcgacaucggcccggugaccgacgaccccuccagccucccccagcccaacgucaaccaguccagccgcccgcuguccgaggagcagcuggacgggauccucagccccgagcuggacaagauggugacggacggcgccauccuggggaagcucuacaagauccccgagcugggcggcaaggacguggaggaccuguucaccgcgguccucucccccgccaacacccagccgaccccccugccccagcccccgccccccacgcagcugcuccccauccacaaccaggacgccuucagccggaugccgcugaugaacgggcugaucggcuccagcccccaccucccccacaacucccugcccccggggagcggccugggcaccuucuccgccaucgcgcagagcuccuaccccgacgcccgcgacaagaacagcgccuucaaccccauggccagcgaccccaacaacuccuggaccagcuccgccccgaccguggagggggagaacgacacgaugagcaacgcgcagcgguccacccucaagugggagaaggaggaggcccugggcgagauggccaccguggcccccguccuguacaccaacaucaacuuccccaaccucaaggaggaguuccccgacuggacgacccgcgugaagcagaucgccaagcuguggcggaaggcgagcucccaggagcgcgccccguacgugcagaaggcccgggacaaccgcgccgcccugcggaucaacaagguccagaugagcaacgacuccaugaagcgccagcagcagcaggacagcaucgaccccuccagccggaucgacuccgagcucuucaaggacccccugaagcagcgcgagagcgagcacgagcaggaguggaaguuccggcagcagaugcgccagaaguccaagcagcaggcgaagaucgaggccacccagaagcuggagcaggugaagaacgagcagcagcagcagcagcagcagcaguucgggagccagcaccuccuggugcaguccggcagcgacaccccgagcuccgggauccagagcccccugacgccccagcccggcaacggcaacauguccccggcccagagcuuccacaaggagcucuucaccaagcagccccccuccacccccaccagcacguccagcgacgacgucuucgugaagccgcaggcccccccccccccgcccgcccccucccggauccccauccaggacagccugucccaggcgcagaccagccagccgcccuccccccagguguucagccccggguccagcaacucccgcccgcccagccccauggaccccuacgccaagauggucggcaccccgcggccccccccgguggggcacuccuucagccgccggaacagcgccgcccccguggagaacugcaccccccuguccagcgucucccgcccccuccagaugaacgagacgaccgcgaaccgcccgagccccgugcgggaccugugcuccagcuccaccaccaacaacgaccccuacgccaagcccccggacacgccccgccccgugaugaccgaccaguuccccaagagccugggccucucccggagcccggucguguccgagcagaccgccaaggggcccaucgccgccggcaccagcgaccacuucacgaagcccuccccccgcgcggacguguuccagcggcagcgcaucccggacagcuacgcccggccccugcugacccccgccccccucgacuccggcccggggcccuucaagacccccaugcagcccccgcccagcucccaggaccccuacggcagcgucucccaggccagccgccggcugagcguggaccccuacgagcgcccggcccugaccccccggcccaucgacaacuucucccacaaccagagcaacgacccguacucccagcccccccucacgccccacccggcggugaacgagagcuucgcccaccccucccgcgccuucagccagcccgggaccaucucccggcccaccagccaggacccguacucccagccccccggcaccccccgcccggucguggacagcuacucccagagcuccgggaccgcccggagcaacacggaccccuacucccagccccccggcaccccgcgccccaccaccguggaccccuacagccagcagccccagacgccgcggcccuccacccagaccgaccuguucgucacccccgugacgaaccagcgccacagcgaccccuacgcccacccgcccggcaccccccggcccgggaucuccgugccguacagccagccccccgcgaccccgcgcccccggaucagcgagggcuucacccgcuccagcaugacgcgccccguccugaugcccaaccaggacccguuccugcaggccgcccagaaccgggggcccgcccuccccggcccccuggugcgcccgcccgacaccugcucccagaccccccggcccccggggcccggccugagcgacaccuucucccgcgugagccccuccgcggcccgggaccccuacgaccagagcccgaugacgccccgcucccagagcgacuccuucggcaccagccagaccgcccacgacgucgccgaccagccccggcccggguccgagggcagcuucugcgccuccagcaacuccccgaugcacagccaggggcagcaguucuccggcgugagccagcuccccggccccgugcccaccagcggggucacggacacccagaacaccgugaacauggcgcaggccgacaccgagaagcugcgccagcggcagaagcugcgcgagaucauccuccagcagcagcagcagaagaagaucgccggccggcaggagaaggggucccaggacagcccggccgugccccaccccggcccccugcagcacuggcagccggagaacgucaaccaggccuucacgcgcccccccccgcccuaccccgggaacauccggucccccguggcgccgccccugggcccccgcuacgccgucuuccccaaggaccagcggggcccguacccccccgacguggccagcauggggaugcgcccccacggcuuccgguucggguucccgggcgggucccacggcaccaugcccagccaggagcgcuuccucgugcccccccagcagauccagggcuccggggucagcccgcagcugcggcgcuccgugagcguggacaugccccgcccccugaacaacucccagaugaacaaccccgucggccucccgcagcacuucagcccccagucccugcccgugcagcagcacaacauccuggggcaggccuacaucgagcuccggcaccgcgcccccgacggccggcagcgccugccguucagcgcgccccccggguccguggucgaggccagcuccaaccugcggcacggcaacuucaucccgcgccccgacuuccccggcccccggcacaccgacccgaugcgccggcccccccaggggcuccccaaccagcugccggugcaccccgaccuggagcaggugccccccagccagcaggagcagggccacuccguccacagcagcuccauggugaugcgcacccucaaccacccgcuggggggcgaguucagcgaggccccccuguccacgagcgugcccuccgagaccaccagcgacaaccuccagaucaccacgcagcccuccgacgggcuggaggagaagcuggacagcgacgacccguccgucaaggagcucgacgugaaggaccuggagggcguggaggucaaggaccuggacgacgaggaccucgagaaccugaaccuggacaccgaggacggcaaggugguggagcucgacacccuggacaaccuggagaccaacgaccccaaccucgacgaccugcugcggagcggggaguucgacaucaucgccuacacggaccccgagcucgacaugggcgacaagaaguccauguucaacgaggagcuggaccugcccaucgacgacaagcucgacaaccagugcgucagcguggagccgaagaagaaggagcaggagaacaagacccuggugcuguccgacaagcacagcccccagaagaaguccaccgucaccaacgaggugaagacggaggugcucagccccaacuccaaggucgagagcaagugcgagaccgagaagaacgacgagaacaaggacaacguggacacccccugcagccaggcguccgcccacagcgaccugaacgacggggagaagaccucccugcacccgugcgaccccgaccucuucgagaagcgcaccaaccgggagacggccggccccagcgccaacgugauccaggccuccacccagcugcccgcgcaggacgucaucaacagcugcggcaucaccggguccaccccggugcugagcucccuccuggccaacgagaagagcgacaacuccgacauccgccccagcggcucccccccgccccccacgcugcccgccagcccguccaaccacgugagcucccucccccccuucaucgcccccccggggcggguccuggacaacgccaugaacagcaacgugaccguggucucccgcgugaaccacguguucagccagggcguccaggugaaccccgggcugauccccggccagagcaccgugaaccacucccucggcaccgggaagcccgcgacgcagaccggcccgcagaccagccaguccgggaccagcuccaugagcggcccccagcagcugaugaucccccagacgcuggcccagcagaaccgggagcgcccccuccugcuggaggagcagccgcuccugcugcaggaccuccuggaccaggagcggcaggagcagcagcagcagcgccagaugcaggccaugauccggcagcgcuccgagcccuucuuccccaacaucgacuucgacgccaucaccgaccccaucaugaaggccaagauggucgcgcugaaggggaucaacaaggugauggcccagaacaaccucggcaugccgcccauggugaugagccgcuuccccuucaugggccaggucgugaccgggacccagaacuccgagggccagaaccuggggccccaggccaucccgcaggacggcagcaucacgcaccagaucucccggcccaacccccccaacuucgggccgggcuucgugaacgacagccagcgcaagcaguacgaggaguggcugcaggagacccagcagcuccugcagaugcagcagaaguaccuggaggagcagaucggcgcccaccggaaguccaagaaggcccucagcgcgaagcagcgcaccgccaagaaggccgggcgggaguuccccgaggaggacgccgagcagcugaagcacgucaccgagcagcaguccauggugcagaagcagcuggagcagauccgcaagcagcagaaggagcacgcggagcucaucgaggacuaccggaucaagcagcagcagcagugcgccauggcccccccgacgaugaugcccagcgugcagccccagcccccgcugauccccggcgccaccccccccaccaugucccagccgaccuuccccauggucccccagcagcugcagcaccagcagcacacgaccgugaucagcgggcacaccucccccguccgcaugccgagccuccccggcuggcagcccaacagcgcccccgcgcaccugccgcugaaccccccccggauccagcccccgaucgcccagcuccccaucaagaccugcacgcccgcccccggcaccguguccaacgccaacccgcagagcgggccccccccgcgcguggaguucgacgacaacaaccccuucuccgagagcuuccaggagcgggagcgcaaggagcggcugcgcgagcagcaggagcggcagcgcauccagcugaugcaggaggucgaccggcagcgcgcccuccagcagcggauggagauggagcagcacggcauggugggguccgagaucagcuccagccgcaccuccgugagccagauccccuucuacuccagcgaccugcccugcgacuucaugcagccgcugggcccccuccagcaguccccccagcaccagcagcagauggggcagguccugcagcagcagaacauccagcagggcagcaucaacucccccagcacccagacguucaugcagaccaacgagcgccggcaggugggcccgcccuccuucgugcccgacagccccuccaucccggucgggagccccaacuucagcuccgugaagcagggccacgggaaccugagcggcaccuccuuccagcagagccccgugcgccccuccuucaccccggcgcuccccgccgccccccccgucgccaacagcucccugccgugcgggcaggacagcacgaucacccacggccacuccuaccccggcagcacccagucccugauccagcucuacagcgacaucauccccgaggagaaggggaagaagaagcggacccgcaagaagaagcgggacgacgacgccgaguccaccaaggcgcccagcacgccgcacuccgacaucaccgccccccccacccccggcaucagcgagaccacguccaccccggccgugagcacccccuccgagcugccccagcaggccgaccaggagagcguggagccggucgggcccagcacccccaacauggcggccggccagcugugcacggagcucgagaacaagcugcccaacuccgacuucagccaggccaccccgaaccagcagaccuacgccaacuccgagguggacaagcugagcauggagacccccgccaagacggaggagaucaagcuggagaaggcggagaccgaguccugccccgggcaggaggagcccaagcucgaggagcagaacggcagcaagguggagggcaacgccgucgccugcccgguguccagcgcccagucccccccccacagcgccggggcgcccgccgccaagggcgacuccgggaacgagcugcugaagcaccuccugaagaacaagaagagcuccagccugcucaaccagaagccggagggcuccaucugcagcgaggacgacugcaccaaggacaacaagcugguggagaagcagaaccccgccgaggggcugcagacccucggcgcccagaugcagggcggguucggcugcgggaaccagcugcccaagacggacggcggcuccgagaccaagaagcagcgcagcaagcggacccagcgcaccggggagaaggcggccccccgguccaagaagcgcaagaaggacgaggaggagaagcaggccauguacagcagcacggacaccuucacccaccugaagcagcagaacaaccucuccaacccgcccaccccccccgccagccugccgcccacgccccccccgauggcgugccagaagauggccaacggcuucgccaccaccgaggagcuggccgggaaggccggcguccucgugucccacgaggugaccaagacgcuggggcccaagcccuuccagcugcccuuccggccgcaggacgaccuccuggcgcgcgcccuggcccagggccccaagaccgucgacgugcccgccagccucccgacccccccccacaacaaccaggaggagcugcggauccaggaccacugcggcgaccgcgacacccccgacuccuucgugccgagcuccagccccgaguccgucguggggguggaggucagccgguaccccgaccugucccucgugaaggaggagcccccggagcccgugcccagccccaucaucccgauccugcccuccacggccggcaagagcuccgagagccgccggaacgacaucaagaccgagcccgggacccuguacuucgcgucccccuucggcccgagccccaacgggccccgcagcggccucaucuccgucgccaucacccugcaccccacggccgccgagaacaucagcuccgugguggccgcguucagcgaccugcuccacguccggaucccgaacuccuacgaggugagcuccgcccccgacgugcccagcaugggccuggucuccagccaccgcaucaaccccgggcuggaguaccggcagcaccuccugcugcgcggcccgccccccggguccgccaacccgccccgccucgugagcuccuaccggcugaagcagcccaacgugcccuucccgcccaccagcaacggccuguccggguacaaggacagcucccacggcaucgccgagagcgccgcgcuccgcccccaguggugcugccacugcaaggucgugauccugggcuccggggugcggaagagcuucaaggaccugacccuccugaacaaggacagccgcgaguccaccaagcgggucgagaaggacaucguguucugcagcaacaacugcuucauccuguacuccagcaccgcccaggccaagaacuccgagaacaaggagagcauccccucccucccgcagagccccaugcgcgagacgcccuccaaggccuuccaccaguacagcaacaacaucuccacccuggacgugcacugccugccccagcucccggagaaggcgagcccccccgccucccccccgaucgccuucccccccgccuucgaggccgcgcaggucgaggccaagcccgacgagcugaaggugaccgugaagcugaagccgcggcuccgcgccguccacggcggguucgaggacugccggccccugaacaagaaguggcgcggcaugaaguggaagaaguggagcauccacaucgugauccccaagggcaccuucaagcccccgugcgaggacgagaucgacgaguuccugaagaagcucgggacgucccugaagcccgaccccguccccaaggacuaccggaagugcugcuucugccacgaggagggcgacgggcugaccgacggcccggcccgccuccugaaccuggaccucgaccugugggugcaccugaacugcgcccucuggagcaccgagguguacgagacccaggcgggggcccugaucaacgucgagcuggcccuccggcgcggccugcagaugaagugcguguucugccacaagacgggcgccaccuccgggugccaccgguuccgcugcaccaacaucuaccacuucaccugcgccaucaaggcgcagugcauguucuucaaggacaagacgaugcugugccccaugcacaagcccaagggcauccacgagcaggagcucagcuacuucgccguguuccggcgcgucuacgugcagcgggacgaggugcgccagaucgccuccaucguccagcgcggggagcgggaccacaccuuccgcgugggcagccugaucuuccacaccaucgggcagcugcucccgcagcagaugcaggccuuccacagccccaaggcgcuguuccccgugggcuacgaggccucccggcuguacuggagcacccgcuacgccaaccggcgcugccgguaccucugcuccaucgaggagaaggacggccgccccgucuucgugauccggaucguggagcaggggcacgaggaccugguccugagcgacaucuccccgaagggcgugugggacaagauccucgagcccguggccugcguccgcaagaagagcgagaugcugcagcuguuccccgccuaccucaagggggaggaccuguucggccugacgguguccgcgguggcccggaucgccgagagccuccccggggucgaggccugcgagaacuacaccuuccgcuacggccggaacccgcugauggagcugccccucgccgugaaccccaccggcugcgcgcgcuccgagcccaagaugagcgcccacgugaagcgguucguccugcgcccgcacacccugaacuccacgagcaccuccaagagcuuccaguccaccgugaccggggagcucaacgcccccuacagcaagcaguucgugcacuccaagagcucccaguaccggaagaugaagacggaguggaagagcaacgucuaccuggcccgcagccggauccagggccuggggcucuacgccgcgcgcgacaucgagaagcacaccauggugaucgaguacaucggcaccaucauccggaacgagguggccaaccgcaaggagaagcuguacgagucccagaaccgcggggucuacauguuccggauggacaacgaccacgugaucgacgccacccugacgggcggccccgcccgcuacaucaaccacagcugcgcccccaacugcguggcggaggucgugaccuucgagcgggggcacaagaucaucaucuccagcucccgccggauccagaagggcgaggagcucugcuacgacuacaaguucgacuucgaggacgaccagcacaagaucccgugccacugcggggccgugaacugccgcaaguggaugaacuga

SEQ ID NO: 32109 - RNA, 16614 nt, Artificial Sequence
  derived and/or modified sequence opt1 from KMT2D__Homo_sapiens__XP_005269219
auggacagccagaagcuggccggcgaggacaaggacuccgagcccgccgcggacgggccggccgccagcgaggaccccuccgccaccgagagcgaccuccccaacccccacgugggcgaggucuccgugcugagcuccgggagcccgcgccugcaggagaccccccaggacugcuccggcgggcccgugcggcgcugcgcccucugcaacugcggcgagcccagccugcacggccagcgggagcugcgccgguucgagcucccguucgacuggccccgcugccccgucgugucccccgggggcagcccggggcccaacgaggcggugcugcccuccgaggaccugagccagaucggcuuccccgaggggcucacgccggcccaccugggcgagcccggcggguccugcugggcccaccacuggugcgccgcguggagcgccggcgucugggggcaggagggccccgagcugugcggcguggacaaggccaucuucuccgggaucagccagcggugcucccacugcacccgccucggcgccagcauccccugccggagcccggggugcccccgccuguaccacuuccccugcgccaccgcguccggcagcuuccuguccaugaagacccuccagcugcugugccccgagcacagcgagggggccgccuaccucgaggaggcccggugcgccgugugcgagggcccgggcgagcugugcgaccuguucuucugcacguccugcgggcaccacuaccacggcgcgugccucgacaccgcccugaccgcccgcaagcgggccggguggcagugccccgagugcaaggucugccaggccugccgcaagcccggcaacgacagcaagaugcuggugugcgagaccugcgacaagggguaccacacguucugccucaagcccccgauggaggagcugcccgcgcacuccuggaagugcaaggccugccgggugugccgcgccugcggcgccggcagcgccgagcugaaccccaacuccgagugguucgagaacuacagccucugccaccggugccacaaggcgcaggggggccagaccauccgcuccgucgccgagcagcacaccccggugugcagccgguucuccccccccgagcccggggacaccccgacggacgagcccgacgcccuguacguggccugccagggccagcccaaggggggccacgucaccagcaugcagcccaaggagccgggcccccugcagugcgaggcgaagccccucgggaaggccggcgugcagcuggagccccagcuggaggccccgcucaacgaggagaugccccugcugccccccccggaggaguccccccucagcccccccccggaggagucccccaccagcccccccccggaggccucccgccugagcccccccccggaggagcugcccgccagcccccuccccgaggcgcugcaccugucccggccgcucgaggagagcccccuguccccccccccggaggagagcccccuguccccccccccggagagcucccccuucagcccccucgaggaguccccccugagcccgcccgaggaguccccccccagcccggcccuggagaccccccucuccccccccccggaggccagcccccuguccccccccuucgaggagagcccgcuguccccccccccggaggagcugcccacgagcccccccccggaggccagccgccucucccccccccccgaggagagcccgaugucccccccccccgaggagagcccgaugucccccccccccgaggccagccgccuguucccgcccuucgaggaguccccccugagccccccgcccgaggaguccccccucagccccccgcccgaggcgucccggcugagcccccccccggaggacucccccaugagccccccgcccgaggagucccccaugagccccccgcccgaggugucccgccugagcccccuccccgucgugucccggcugagcccgccccccgaggagagcccccuguccccgccccccgaggagagccccaccuccccgccccccgaggccagccgccucucccccccgcccgaggacagccccaccucccccccgcccgaggacagccccgccuccccgccccccgaggacagccugaugucccugccccucgaggagagcccgcugcugccccuccccgaggagccccagcugugcccgcgguccgaggggccccaccugagcccccgccccgaggagccgcaccucuccccccggcccgaggagccccaccugagcccgcaggccgaggagccccaccuguccccccagcccgaggagccgugccucugcgccgugcccgaggagccccaccugagcccccaggcggagggcccgcaccuguccccccagcccgaggagcuccaccugagcccccagaccgaggagccgcaccugagccccguccccgaggagccgugccucuccccccagcccgaggagagccaccuguccccccagagcgaggagccgugccuguccccccgccccgaggagagccaccucucccccgagcuggagaagccgccccugagcccccggcccgagaagccgcccgaggagcccggccagugccccgccccggaggagcucccccuguucccccccccgggggagcccucccugagcccccuccugggcgagcccgcccuguccgagccgggggagcccccccucagcccccugccggaggagcugccccucucccccagcggcgagccgucccugagcccccagcugaugccccccgacccgcucccccccccccuguccccgaucaucacggccgcggccccccccgcccugagcccccucggggagcuggaguacccguucggcgccaagggcgacuccgaccccgagagcccccuggccgcgcccauccucgagaccccgaucagccccccccccgaggccaacugcaccgacccggagcccgugccccccaugauccugccgcccucccccgggagccccgugggcccggccucccccauccugauggagccccucccgccccagugcagcccccugcugcagcacucccucgucccccagaacagcccgcccucccagugcagcccccccgcccugccgcuguccgugcccagcccccucucccccaucgggaaggucgugggcgugagcgacgaggccgagcugcacgagauggagaccgagaaggucuccgagccggagugccccgcgcuggagcccagcgccacguccccccucccgagccccaugggggaccuguccugccccgcccccagcccggcccccgcccuggacgacuucuccggccucggcgaggacaccgcgccccuggacgggaucgacgcccccggcagccagccggagcccgggcagacccccggcagccuggccuccgagcucaaggggagcccggugcugcuggaccccgaggagcucgcccccgugacccccauggaggucuacccggagugcaagcagacggcgggccagggcucccccugcgaggagcaggaggagccccgcgcccccguggccccgaccccccccacccugaucaagagcgacaucgugaacgagaucuccaaccugagccagggggacgccuccgccagcuuccccggcuccgagccgcuccuggggagccccgaccccgagggcgggggcucccugagcauggagcucggcgucuccaccgacgugagccccgcgcgggacgaggggucccugcgccugugcacggacagccucccggagaccgacgacucccugcugugcgacgccggcaccgccaucagcgggggcaaggccgagggcgagaaggggcggcgccgguccagccccgcccgcagccggaucaagcagggccgcuccagcuccuuccccgggcggcgccgcccccggggcggggcgcacggcggccgcgggcggggccgcgcccggcucaagagcaccgccuccagcaucgagacgcugguggucgccgacaucgacuccagcccguccaaggaggaggaggaggaggacgacgacaccaugcagaacaccguggugcuguucagcaacaccgacaaguucguccucaugcaggacaugugcguggugugcggguccuucggccgcggggccgagggccaccugcuggcgugcagccagugcucccagugcuaccaccccuacugcgucaacagcaagaucaccaaggugaugcuccugaagggcuggcggugcguggagugcaucgucugcgaggugugcgggcaggccuccgaccccagccgccugcuccugugcgacgacugcgacaucuccuaccacacguacugccuggaccccccgcugcucaccgugcccaagggcggguggaagugcaaguggugcgucagcugcaugcagugcggcgccgccagccccggguuccacugcgaguggcagaacuccuacacccacugcggccccugcgccagccuggugaccugcccgaucugccacgcgcccuacguggaggaggaccugcucauccagugccggcacugcgagcgcuggaugcacgccggcugcgagucccuguucacggaggacgacgucgagcaggccgccgacgagggguucgacugcgugagcugccagcccuacguggucaagccgguggcgcccguggccccccccgagcuggucccgaugaaggugaaggagcccgagccccaguacuuccgguucgagggcguguggcucaccgagaccgggauggcccugcugcgcaaccucaccauguccccccugcacaagcggcgccagcggcgcggccggcugggccucccgggggaggccggccuggaggggagcgagcccuccgacgcccugggccccgacgacaagaaggacggggaccucgacacggacgagcugcugaagggcgagggcggggucgagcacauggagugcgagaucaagcucgagggccccgugagcccggacguggagcccgggaaggaggagaccgaggaguccaagaagcgcaagcggaagcccuaccgccccggcaucgggggcuucaugguccggcagcgcaagagccacacccgcaccaagaagggcccggcggcccaggccgaggugcuguccggggacggccagcccgacgaggugauccccgccgaccugcccgccgagggggcggucgagcagagccucgccgagggcgacgagaagaagaagcagcagcggcgcgggcggaagaaguccaagcuggaggacauguucccggccuaccugcaggaggccuucuucggcaaggagcuccuggaccugagccgcaaggcccucuucgcggugggcguggggcggcccuccuucggccuggggacgcccaaggccaagggcgacgggggcagcgagcgcaaggagcugcccaccucccagaagggcgacgacgggccggacaucgccgacgaggagagccggggccucgaggggaaggccgacacccccggccccgaggacggcggggucaaggcgucccccgugccgagcgaccccgagaagcccggcaccccgggggagggcaugcugagcuccgaccuggaccgcaucagcacggaggagcuccccaagauggaguccaaggaccugcagcagcuguucaaggacgugcucgggagcgagcgggagcagcaccugggcugcggcacccccgggcuggagggcucccgcaccccccuccagcggccguuccugcaggggggccugccccucgggaaccugcccagcuccagccccauggacuccuacccgggccugugccagagccccuuccucgacucccgcgagcggggcggguucuucagccccgagcccggcgagccggacucccccuggaccgggagcggcgggacgacccccuccacccccaccacgccgaccaccgagggcgagggcgacgggcugagcuacaaccagcgcucccugcagcggugggagaaggacgaggagcucggccagcugagcaccaucucccccguccuguacgccaacaucaacuuccccaaccucaagcaggacuaccccgacuggagcagccgcugcaagcagaucaugaagcuguggcggaaggugccggccgccgacaaggcccccuaccugcagaaggcgaaggacaaccgcgccgcccaccggaucaacaaggugcagaagcaggccgagucccagaucaacaagcagacgaaggucggggacaucgcccgcaagaccgaccgccccgcgcuccaccugcggauccccccgcagcccggcgcccuggggagccccccgcccgccgccgcccccaccaucuucaucggcucccccaccacgccggcgggccucagcaccuccgccgacggguuccugaagccccccgccggcagcgugcccgggccggacucccccggcgagcuguuccucaagcugcccccccaggucccggcccaggugcccagccaggaccccuucggccuggcgcccgccuacccgcucgagccccgcuuccccaccgcccccccgaccuacccccccuaccccuccccgacgggggcccccgcccagccccccaugcugggcgcgagcucccggccgggggccggccagcccggggaguuccacaccacccccccgggcaccccccgccaccagcccagcacccccgacccguuccugaagccccggugccccucccucgacaaccuggccgugcccgagagcccgggcgucgggggcgggaaggccuccgagccccugcucagcccccccccguucggcgagucccgcaaggcccuggaggugaagaaggaggagcugggggcgagcucccccagcuacggcccccccaaccucggcuucguggacagcccguccagcgggacgcaccugggcgggcuggagcucaagacccccgacgucuucaaggccccccugaccccccgggccucccagguggagccgcagagccccggccuggggcuccgcccccaggagcccccgcccgcccaggcccuggcgcccucccccccgagccaccccgacaucuuccggcccggcuccuacaccgacccguacgcccagcccccccugacgccccgcccgcagcccccccccccggagagcugcugcgcccuccccccccggucccugcccagcgacccguucucccgcgugcccgccagcccccagucccagagcuccagccaguccccccugaccccgcggccccucagcgccgaggcguucugccccucccccgucaccccgcgcuuccagagccccgaccccuacagccggcccccgucccgcccccagagccgggaccccuucgccccgcugcacaagcccccccgcccccagccgcccgagguggccuucaaggccggcucccuggcgcacaccagccucggggccggcggguuccccgccgcccugcccgccggcccggcgggcgagcugcacgccaaggugcccuccgggcagccccccaacuucguccggagcccgggcacgggggccuucgugggcacccccucccccaugcgcuucaccuucccccaggccgugggggagccgagccucaagccccccgucccccagccgggccugccccccccccacggcaucaacucccacuucgggccgggccccacccuggggaagccccagagcacgaacuacaccguggccaccggcaacuuccaccccuccgggagcccgcucggccccuccagcggcuccaccggggagagcuacggccuguccccccugcggccgcccagcgugcucccccccccggcgcccgacgggucccugcccuaccugagccacggcgccagccagcgcuccgggaucacgagccccgucgagaagcgcgaggacccgggcaccggcaugggguccagccucgccaccgccgagcugcccggcacccaggaccccgggauguccggccugagccagacggagcuggagaagcagcggcagcgccagcggcuccgcgagcugcugauccggcagcagauccagcgcaacacccuccggcaggagaaggagaccgccgcggccgccgccggggcggugggccccccgggcuccuggggggccgagcccagcucccccgccuucgagcagcugagccgcggccagacccccuucgccgggacgcaggacaaguccagccuggugggccucccgcccuccaagcugagcggccccauccuggggcccggcuccuucccgagcgacgaccggcucucccgccccccccccccggccacccccagcagcauggacgucaacucccggcagcugguggggggcagccaggcguucuaccagcgcgcccccuaccccgggucccugccgcuccagcagcagcagcagcagcuguggcagcagcagcaggccaccgccgccaccagcaugcgguucgcgauguccgcccgcuuccccagcacgcccggcccggagcugggccggcaggcccucggguccccccuggccggcaucagcacccgccugcccgggcccggcgagccggugcccgggcccgccggccccgcgcaguucaucgagcuccggcacaacguccagaagggccuggggccgggcgggacccccuuccccggccaggggcccccgcagcgcccccgguucuaccccguguccgaggacccccaccgccuggccccggagggccuccgcggccuggccgugagcgggcugcccccccagaagcccuccgccccgcccgcgcccgagcucaacaacagccugcaccccaccccgcacacgaagggccccacccugcccaccgggcucgagcuggucaaccggccgcccuccagcaccgagcugggccgccccaacccccucgcccuggaggccggcaagcugccgugcgaggaccccgagcucgacgacgacuucgacgcccacaaggcccuggaggacgacgaggagcuggcgcaccucgggcugggcguggacguggccaagggggacgacgagcugggcacgcucgagaaccuggagaccaacgacccccaccuggacgaccuccugaacggggacgaguucgaccugcucgccuacaccgaccccgagcuggacaccggcgacaagaaggacaucuucaacgagcaccugcggcucgucgaguccgccaacgagaaggccgagcgcgaggcgcugcugcggggcguggagccggggccccucggccccgaggagcgccccccgcccgccgccgacgccagcgagccccggcuggccuccgugcugcccgaggucaagccgaagguggaggaggggggccgccaccccagccccugccaguucaccaucgcgacgcccaagguggagccggcccccgccgccaacucccucgggcugggccugaagcccggccagagcaugauggggagccgggacacccgcaugggcaccgggcccuucuccagcuccggccacaccgccgagaaggcgagcuucggggccacgggcggcccgcccgcccaccuccugacccccuccccccugagcgggccgggcggguccagccuccuggagaaguucgagcuggaguccggcgcccucacccugcccgggggccccgcggccagcggcgacgagcuggacaagauggaguccagccucgucgccuccgagcugccgcugcucaucgaggaccugcuggagcacgagaagaaggagcuccagaagaagcagcagcugagcgcccagcugcagcccgcccagcagcagcagcagcagcagcagcagcacucccuccugagcgcgcccgggcccgcccaggccaugucccugccgcacgagggcagcucccccagccucgccgggagccagcagcagcugucccugggccucgccggcgcgcggcagcccgggcugccccagccgcugaugcccacccagccccccgcccacgcccuccagcagcgccuggccccgagcauggccaugguguccaaccagggccacaugcugagcgggcagcacggcgggcaggcgggccucgugccccagcaguccagccagcccguccugucccagaagcccaugggcacgaugccgcccagcaugugcaugaagccccagcagcuggccaugcagcagcagcucgccaacuccuucuuccccgacaccgaccuggacaaguucgccgcggaggacaucaucgacccgaucgccaaggccaagaugguggcccugaaggggaucaagaaggugauggcccagggcagcaucggggucgcgcccggcaugaaccggcagcaggugucccuccuggcccagcgccugagcgggggccccuccagcgaccuccagaaccacguggccgccggcuccgggcaggagcggagcgccggcgaccccucccagccgcgccccaacccccccaccuucgcgcagggggucaucaacgaggccgaccagcggcaguacgaggaguggcuguuccacacccagcagcugcugcagaugcagcucaaggugcuggaggagcagaucggcgugcaccgcaagagccggaaggcccugugcgccaagcagcgcacggccaagaaggcggggcgggaguucccggaggccgacgccgagaagcucaagcuggucaccgagcagcaguccaagauccagaagcagcuggaccaggugcgcaagcagcagaaggagcacaccaaccucauggccgaguaccgcaacaagcagcagcagcagcagcagcagcagcagcagcagcagcagcagcacagcgccgugcuggcgcugagccccucccagagcccccggcuccugaccaagcugccgggccagcuccugcccggccacgggcugcagcccccccagggcccgcccgggggccaggccggcgggcuccgccugacgcccggcgggauggcccugcccggccagccggggggccccuuccucaacaccgcccuggcgcagcagcagcagcagcagcacuccggcggggccggcagccuggccgggcccuccggcggguucuuccccggcaaccucgcccugcggagccugggcccggacucccgccuccugcaggagcggcagcugcagcuccagcagcagcgcaugcagcuggcccagaagcugcagcagcagcagcagcagcagcagcagcagcagcaccuccuggggcaggucgcgauccagcagcagcagcagcagggccccggggugcagaccaaccaggcccugggccccaagccccaggggcucaugccgcccagcucccaccagggccugcugguccagcagcucagcccccagcccccgcagggcccccaggggaugcugggccccgcccagguggccgugcugcagcagcagcaccccggggcccucggcccgcaggggccccaccggcagguccugaugacccagucccgcgugcugagcuccccccagcucgcgcagcagggccagggccugauggggcaccggcuggugacggcccagcagcagcagcagcagcagcagcaccagcagcagggcagcauggccgggcucucccaccugcagcagagccugaugucccacagcggccagcccaagcucuccgcccagccgaugggcagccugcagcagcugcagcagcagcagcagcuccagcagcagcagcagcugcagcagcagcagcagcagcagcugcagcagcagcagcagcuccagcagcagcagcugcagcagcagcagcagcagcagcagcugcagcagcagcagcagcagcagcuccagcagcagcagcagcagcugcagcagcagcagcagcagcagcagcagcaguuccagcagcagcagcagcagcagcagauggggcugcucaaccagagccgcacccugcuguccccccagcagcagcagcagcagcaggucgcccucggccccgggaugccggcgaagccccugcagcacuucagcucccccggcgcccuggggcccacccuccugcugaccggcaaggagcagaacacgguggacccggccgugagcuccgaggccaccgagggccccagcacccaccaggggggcccccucgcgaucgggaccacgcccgaguccauggccaccgagccgggcgaggucaagcccagccuguccggggacagccagcugcuccuggugcagccccagccccagccgcagcccuccagccugcagcuccagcccccccugcggcugccgggccagcagcagcagcaggugucccuccugcacaccgccggcgggggcagccacgggcagcugggcuccgggagcuccagcgaggccuccagcgucccccaccuccuggcccagcccagcgugucccugggcgaccagcccggcagcaugacccagaaccuccuggggccgcagcagcccaugcuggagcgccccaugcagaacaacacgggcccccagccgcccaagcccgggccggugcuccaguccggccaggggcugcccggcgucggcaucaugcccaccguggggcagcugcgggcgcagcuccagggcgugcuggccaagaacccccagcugcgccaccucagcccgcagcagcagcagcagcugcaggcccugcugaugcagcggcagcuccagcagucccaggccguccgccagaccccccccuaccaggagcccgggacccagacgagcccgcugcagggccugcucggcugccagccccagcuggggggcuuccccgggccccagaccggcccgcugcaggagcucggggccggcccccggccccagggccccccgcgccugcccgcgccccccggggcccuguccaccggcccggugcucgggcccgugcaccccacccccccgcccagcuccccccaggagcccaagcggccgagccagcugcccucccccagcucccagcugccgacggaggcccagcucccccccacccaccccggcaccccgaagccccaggggcccacccuggagcccccgcccggccgcgucagccccgccgccgcgcagcuggccgacacccucuucuccaagggccuggggcccugggacccgcccgacaaccuggccgagacgcagaagcccgagcagagcucccucgugcccggccaccuggaccaggugaacgggcaggucgugccggaggccagccagcugagcaucaagcaggagccccgcgaggagcccugcgcgcucggcgcccaguccgugaagcgggaggccaacggggagcccaucggcgccccgggcaccagcaaccaccugcugcucgccgggccccgcuccgaggcgggccaccugcugcuccagaagcugcugcgggccaagaacguccagcucagcaccgggcgcggcuccgagggccugcgggccgagaucaacgggcacaucgacagcaagcuggccggccucgagcagaagcugcaggggacccccuccaacaaggaggacgccgcggcccgcaagccccugacgccgaagcccaagcgggugcagaaggccagcgaccgccucguguccagccggaagaagcugcgcaaggaggacggcguccgggccuccgaggcccugcucaagcagcugaagcaggagcugagccuccugccccugaccgagcccgcgaucaccgccaacuucucccucuucgccccguucgggagcggcugccccgugaacggccagucccagcugcgcggggccuucggcagcggggcccugcccaccggcccggacuacuacucccagcuccugacgaagaacaaccugagcaacccccccacccccccguccagccucccccccacccccccgcccagcgugcagcagaagauggucaacggggugacccccuccgaggagcugggcgagcaccccaaggacgcggccagcgcccgggacuccgagcgcgcccugcgggacacgagcgaggugaagucccucgaccugcuggcggcccucccgacccccccccacaaccagaccgaggacguccgcauggagagcgacgaggacuccgacagccccgacuccaucgugccggccagcucccccgagagcauccugggcgaggaggccccccgguucccccaccugggguccggccgcugggagcaggaggaccgggcccucagcccggugaucccccugaucccccgcgcguccauccccgucuucccggacaccaagcccuacggggcccugggccucgaggugcccgggaagcugccggugacgaccugggagaagggcaagggcagcgaggucuccgugaugcugaccgugagcgccgccgccgcgaagaaccucaacggggucaugguggccguggccgagcugcuguccaugaagauccccaacagcuacgagguccucuuccccgagagccccgcccgggccggcaccgagccgaagaagggggaggcggagggccccgggggcaaggagaagggccuggaggggaagucccccgacacgggccccgacuggcugaagcaguucgacgccgugcucccgggguacacccugaagagccagcuggacauccucucccugcugaagcaggagagccccgcccccgagcccccgacccagcacuccuacaccuacaacgugagcaaccucgacguccgccagcuguccgcccccccccccgaggagccgagccccccccccuccccgcuggcgcccagccccgccucccccccgacggagccccucguggagcugcccaccgagccccuggccgagccgcccguccccagcccgcucccccuggccuccagccccgaguccgcccgccccaagccgcgggcgcgcccccccgaggagggcgaggacagccggcccccgcgccugaagaaguggaagggcgugcgguggaagcgccuccggcugcugcucaccauccagaagggguccggccgccaggaggacgagcgggagguggccgaguucauggagcagcuggggaccgcccugcgccccgacaaggucccccgggacaugcgccggugcugcuucugccacgaggagggcgacggggccacggacggccccgcccgccuccugaaccuggaccucgaccugugggugcaccugaacugcgcgcuguggagcaccgagguguacgagacccagggcggggcccucaugaacgucgagguggcccugcaccggggccugcucaccaagugcucccugugccagcgcacgggggccaccagcagcugcaaccggaugcgcugcccgaacguguaccacuucgccugcgcgauccgggccaagugcauguucuucaaggacaagaccaugcugugccccaugcacaagaucaagggccccugcgagcaggagcucuccagcuucgccgucuuccgccgcguguacaucgagcgggacgaggugaagcagaucgccuccaucauccagcgcggggagcggcugcacauguuccgcgucggcggccugguguuccacgcgaucgggcagcuccugccccaccagauggccgacuuccacagcgccaccgcccuguacccggugggcuacgaggccacgcggaucuacuggucccuccgcaccaacaaccggcgcugcugcuaccggugcagcaucggggagaacaacggccgccccgaguucgucaucaaggugaucgagcaggggcuggaggaccugguguucaccgacgcguccccccaggccgucuggaaccggaucaucgagcccguggccgccaugcgcaaggaggccgacaugcuccggcuguucccggaguaccugaagggcgaggagcucuucggccugaccgugcacgcgguccugcgcaucgccgagagccuccccgggguggaguccugccagaacuaccuguuccgguacggccgccacccccugauggagcucccccugaugaucaacccgaccgggugcgcccggagcgagcccaagauccugacgcacuacaagcgcccccacacccucaacuccaccagcauguccaaggccuaccagagcaccuucacgggcgagaccaacacccccuacuccaagcaguucgugcacagcaaguccagccaguaccggcgccugcggaccgaguggaagaacaacgucuaccuggcccgcucccgcauccagggccucgggcuguacgcggccaaggaccuggagaagcacacgauggugaucgaguacaucggcaccaucauccggaacgagguggccaaccgccgggagaagaucuacgaggagcagaaccgcgggaucuacauguuccggaucaacaacgagcacgucaucgacgccacccucaccggcgggccggcccgcuacaucaaccacagcugcgcgcccaacugcguggccgagguggucacguucgacaaggaggacaagaucaucaucaucagcucccggcgcauccccaagggcgaggagcugaccuacgacuaccaguucgacuucgaggacgaccagcacaagaucccgugccacugcggcgccuggaacugccggaaguggaugaacuga

SEQ ID NO: 32110 - RNA, 5577 nt, Artificial Sequence
  derived and/or modified sequence opt1 from KMT2E__Homo_sapiens__NP_061152
augagcaucgugaucccccugggcguggacaccgccgagaccuccuaccucgagauggccgccgggagcgagcccgaguccguggaggccagccccguggucguggagaaguccaacagcuacccccaccagcuguacaccuccagcucccaccacagccacuccuacaucggccugcccuacgccgaccacaacuacggggcccggcccccgcccacgccgcccgccagcccgccgcccuccgugcucaucuccaagaacgaggucggcaucuucaccacccccaacuucgacgagaccuccagcgccaccaccaucuccaccagcgaggacggguccuacggcaccgacgugacccggugcaucugcggcuucacccacgacgacggguacaugaucugcugcgacaagugcagcguguggcagcacaucgacugcaugggcaucgaccgccagcacauccccgacaccuaccugugcgagcggugccagccccgcaaccuggacaaggagcgggccguccuccugcagcgccggaagcgcgagaacaugagcgacggggacaccuccgccaccgagagcggcgacgaggugcccguggagcuguacaccgccuuccagcacacccccacguccaucacccucaccgcgagccgggucuccaaggugaacgacaagcgccggaagaaguccggggagaaggagcagcacaucuccaagugcaagaaggccuuccgcgagggcagccggaaguccagccgcgugaagggcuccgcccccgagaucgaccccagcuccgacgggagcaacuucggcugggagaccaagaucaaggccuggauggaccgguacgaggaggccaacaacaaccaguacuccgaggggguccagcgcgaggcgcagcggaucgcccugcgccugggcaacggcaacgacaagaaggagaugaacaagagcgaccucaacaccaacaaccugcuguucaagccgcccguggagucccacauccagaagaacaagaagauccucaagagcgccaaggaccugccgcccgacgcccugaucaucgaguaccgggggaaguucaugcuccgcgagcaguucgaggccaacggcuacuucuucaagcggcccuaccccuucgugcuguucuacuccaaguuccacgggcuggagaugugcgucgacgcgcgcaccuucggcaacgaggcccgcuucauccggcgcagcugcacccccaacgccgaggugcggcacgagauccaggacgggaccauccaccucuacaucuacagcauccacuccauccccaagggcacggagaucaccaucgccuucgacuucgacuacggcaacugcaaguacaagguggacugcgccugccugaaggagaaccccgagugccccguccugaagcgcagcuccgagagcauggagaacaucaacuccggguacgagacccggcgcaagaagggcaagaaggacaaggacaucagcaaggagaaggacacccagaaccagaacaucacgcucgacugcgaggggaccaccaacaagaugaagucccccgagaccaagcagcggaagcugagcccccugcgccucuccgugagcaacaaccaggagcccgacuucaucgacgacaucgaggagaagacgcccaucuccaacgagguggagauggagagcgaggagcagaucgcggagcggaagcgcaagaugacccgggaggagcgcaagauggaggccauccugcaggccuucgcccggcuggagaagcgcgagaagcggcgcgagcaggcccucgagcggaucuccaccgcgaagaccgaggucaagacggagugcaaggacacccagaucgugagcgacgccgaggucauccaggagcaggccaaggaggagaacgccagcaagcccacccccgcgaaggugaaccgcaccaagcagcggaaguccuucucccgcagccgcacccacaucggccagcagcggcgccggcaccgcacggugagcaugugcuccgacauccagcccagcucccccgacaucgaggucaccagccagcagaacgacaucgagaacaccgugcugaccaucgagcccgagacggagaccgcccuggccgagaucaucaccgagaccgaggugcccgcccucaacaagugccccacgaaguaccccaagaccaagaagcaccuggucaacgaguggcuguccgagaagaacgagaagaccgggaagcccagcgacggccucuccgagcggccccugcgcaucaccacggaccccgaggugcuggccacccagcucaacagccugcccggccugaccuacagcccccacguguacagcacccccaagcacuacauccgguucacgucccccuuccucagcgagaagcgccggcgcaaggagcccaccgagaacaucuccgggagcugcaagaagcgguggcugaagcaggcgcuggaggaggagaacuccgccauccuccaccgcuucaacagccccugccaggagcggucccgcagccccgccgucaacggcgagaacaagagcccccugcugcucaacgacuccugcagccugcccgaccugaccacgccccugaagaagcggcgcuucuaccagcuccuggacuccguguacagcgagacguccacccccacccccagccccuacgccacccccacgcacaccgacaucacccccauggaccccuccuucgccacgccgccccggaucaagagcgacgacgagacgugccgcaacggguacaagccgaucuacucccccgugacccccgucacccccggcaccccggggaacacgaugcacuucgagaacaucagcucccccgagagcucccccgagaucaagcggcgcaccuacagccaggagggcuacgaccgguccagcaccaugcugacccucggccccuuccgcaacuccaaccugacggagcuggggcuccaggagaucaagaccaucggcuacaccagcccgcgcucccggaccgaggugaaccgccagugccccggggagaaggagcccgugagcgaccugcagcugggccucgacgcggucgagcccaccgcccugcacaagacgcuggagaccccggcccacgaccgggccgagcccaacucccagcucgacagcacccacagcggccgcgggaccauguacuccagcugggugaagucccccgaccggacgggcgugaacuucagcgucaacuccaaccugcgcgaccugacccccagccaccagcucgaggucgggggcggguuccggaucuccgagagcaagugccugaugcaggacgacacccgcggcauguucauggagaccacgguguucugcaccuccgaggacggccuggucagcggguucggccggaccgugaacgacaaccucaucgacgggaacugcaccccgcagaacccgccccagaagaagaaggugucccugcuggaguaccgcaagcggcagcgcgaggcccgcaagagcggcuccaagacggagaacuucccccucaucagcgucuccccgcacgcgagcgggucccugagcaacaacggcgacggcugcgccuccagcaacgacaacggggagcaggucgaccacaccgccagccugccccuccccacccccgccaccguguacaacgcgacguccgaggagaccagcaacaacugcccggucaaggacgccaccgccuccgagaagaacgagcccgaggugcaguggaccgccagcacguccguggagcagguccgcgagcggagcuaccagcgcgcccugcugcucuccgaccaccggaaggacaaggacagcggcggggagucccccugcgugagcugcuccccgagccacgugcaguccagccccuccagccacuccaaccacaucccccagcugcaggcgaagggccccgucccgagcuucuccgagcugauggaggaccccgaccccgagaaccccgagccgaccaccaccaacgagugccccagccccgacacgagccagaacacgugcaagagcccgcccaagaugagcaagcccgggucccccggcagcgugauccccgcccaggcccacggcaagaucuucaccaagcccgacccccagugggacuccaccgugagcgccuccgaggccgagaacgggguccaccucaagacggagcugcagcagaagcagcugagcaacaacaaccaggcgcucuccaagaaccacccgccccagacccacgugcgcaacagcuccgagcagcugagccagaagcugccguccgugcccaccaagcuccacugcccgcccagcccgcaccuggagaacccgcccaaguccagcacgccccacacgccgguccagcacggcuaccugucccccaagcccccgagccagcagcucgggucccccuaccggccccaccacagccagagcccccaggugggcaccccgcagcgcgagccccagcgcaacuucuaccccgccgcccagaaccugcccgccaacacccagcaggccaccuccgggacgcuguucacccagaccccgagcggccaguccagcgcgaccuacucccaguucaaccagcagagccucaacuccaccgcgccgccgcccccgcccccgcccccgcccagcuccagcuacuaccagaaccagcagcccuccgccaacuuccagaacuacaaccagcugaagggcagccugucccagcagacgguguucaccagcgggcccaaccaggcccuccccggcaccaccucccagcagacgguccccgggcaccacgugacccccggccacuuccugcccagccagaacccgaccauccaccaccagaccgcggccgccguggugccgcccccgcccccgcccccgcccgcccccggcccccaccuggugcagcagcccaacucccaccagcagcacagcguggcccacgucguggggcccgugcacgcggucacgcccggcagccacauccacucccagaccgccgggcaccaccucccgcccccgcccccgccgcccggccccgcgccccaccaccacccgccgccccaccccagcaccgggcugcagggccugcaggcccagcaccagcacguggucaacuccgcgcccccgcccccgcccccgccgccgcccagcuccgugcuggccagcggccaccacaccacguccgcccaggcccugcaccacccgccccaccaggggccgccccuguuccccagcuccgcccaccccaccgugccgcccuaccccagccaggccacccaccacaccacgcucggccccgggccccagcaccagcccuccggcaccgggccccacugcccccugcccgucaccggcccccaccuccagccccagggccccaacagcauccccacccccacggcguccggguucugcccccaccccggcagcguggcccucccccacggggugcagggcccccagcaggccucccccguccccgggcagaucccgauccaccgggcccaggugccgcccaccuuccagaacaacuaccacggcagcggcuggcacuga

SEQ ID NO: 32111 - RNA, 1284 nt, Artificial Sequence
  derived and/or modified sequence opt1 from KNG1__Homo_sapiens__NP_000884
augaagcugaucaccauccucuuccugugcagccgccugcuccugucccugacccaggagagccaguccgaggagaucgacugcaacgacaaggaccucuucaaggccguggacgccgcgcugaagaaguacaacagccagaaccaguccaacaaccaguucguccuguaccggaucacggaggccaccaagaccgugggcagcgacaccuucuacuccuucaaguacgagaucaaggagggggacugccccgugcagagcggcaagacguggcaggacugcgaguacaaggacgccgccaaggccgcgaccggggagugcaccgccaccgucggcaagcgcuccagcacgaaguucuccguggccacccagaccugccagaucaccccggccgaggggcccguggucacggcgcaguacgacugccucggcugcgugcaccccaucagcacccagucccccgaccuggagccgauccugcggcacggcauccaguacuucaacaacaacacccagcacagcucccucuucaugcugaacgaggugaagcgcgcccagcggcaggucguggccgggcugaacuuccgcaucaccuacagcaucgugcagacgaacugcuccaaggagaacuuccucuuccugacccccgacugcaagagccuguggaacggcgacaccggggagugcaccgacaacgccuacaucgacauccagcuccggaucgccuccuucagccagaacugcgacaucuaccccggcaaggacuucguccagcccccgacgaagaucugcguggggugcccccgcgacauccccaccaacagccccgagcuggaggagacccugacccacacgaucaccaagcucaacgcggagaacaacgccaccuucuacuucaagaucgacaacgugaagaaggcccggguccaggugguggccggcaagaaguacuucaucgacuucgucgcccgcgagaccacgugcuccaaggagagcaacgaggagcugaccgaguccugcgagaccaagaagcugggccagagccucgacugcaacgcggagguguacguggucccgugggagaagaagaucuaccccaccgugaacugccagccccuggggaugaucucccugaugaagcggcccccgggcuucagccccuuccgcuccagccggaucggggagaucaaggaggagacgaccucccaccuccgcagcugcgaguacaagggccggccgcccaaggccggcgccgagcccgccuccgagcgcgaggugagcuga

SEQ ID NO: 32112 - RNA, 861 nt, Artificial Sequence
  derived and/or modified sequence opt1 from KNSTRN__Homo_sapiens__NP_001136233
auggccgcccccgaggcgccgccccuggaccgcguguuccggaccaccuggcucagcacggagugcgacucccacccccugcccccgagcuaccgcaaguuccuguucgagacccaggccgccgaccucgccggcgggaccaccgucgccgcgggcaaccugcugaacgaguccgagaaggacugcgggcaggaccggcgcgcccccggcgugcagcccugccggcucgugacgaugaccagcgucgugaagaccguguacucccugcagcccccgagcgcccuguccgggggccagcccgccgacacccagacgcgcgcgaccagcaagucccuccugcccguccggagcaaggagguggacguguccaagcagcugcacagcggcgggcccgagaacgacgucaccaagaucaccaagcuccgccgggagaacggccagaugaaggccacggacaccgccacccgccggaacgugcgcaagggguacaagccgcuguccaagcagaaguccgaggaggagcugaaggacaagaaccagcuccuggaggccgugaacaagcagcugcaccagaagcucaccgagacgcagggcgagcugaaggaccugacccagaaggucgagcuccuggagaaguuccgggacaacugccuggccauccucgagagcaaggggcuggaccccgcgcugggcagcgagacccucgccucccgccaggagagcaccacggaccacauggacuccaugcugcugcucgagacccugcaggaggagcugaagcuguucaacgagaccgccaagaagcagauggaggagcuccagaucgccuggaugaaccacggcauccugcaccagauguga

SEQ ID NO: 32113 - RNA, 6630 nt, Artificial Sequence
  derived and/or modified sequence opt1 from KNTC1__Homo_sapiens__NP_055523
auguggaacgacaucgagcuccucaccaacgacgacaccggcuccggguaccuguccgugggcagccgcaaggagcacgggacggcccuguaccaggucgaccuccuggugaagaucuccagcgagaaggccucccugaaccccaagauccaggcgugcagccucuccgacggcuucaucaucguggccgaccagagcgucauccugcuggacuccaucugccggagccuccagcugcaccugguguucgacaccgagguggacgucguggggcucugccaggagggcaaguuccugcuggugggcgagcgcuccgggaaccuccaccugauccacgucaccagcaagcagacccugcucacgaacgccuucgugcagaaggccaacgacgagaaccggcgcaccuaccagaaccuggugaucgagaaggacggcuccaacgaggggaccuacuacaugcugcuccugaccuacagcggcuucuucugcaucacgaaccugcagcuccugaagauccagcaggccaucgagaacgucgacuucuccaccgcgaagaagcugcaggggcagaucaagagcuccuucaucagcaccgagaacuaccacacccucggcugccugucccugguggccggcgaccucgccagcgaggugcccgucaucaucgggggcacggggaacugcgccuucagcaagugggagcccgacuccagcaagaagggcaugaccgugaagaaccugaucgacgcggagaucaucaagggcgccaagaaguuccagcugaucgacaaccuccuguucgugcuggacaccgacaacguccucucccugugggacaucuacacccugacgcccguguggaacuggcccagccuccacguggaggaguuccugcugaccaccgaggccgacucccccagcuccgucaccuggcaggggaucacgaaccucaagcugaucgcccugaccgccagcgcgaacaagaagaugaagaaccucaugguguacucccugcccaccauggagauccuguacagccucgagguguccagcgucuccagccuggugcagaccggcaucuccacggacaccaucuaccugcuggagggggucugcaagaacgaccccaagcucagcgaggacuccgugagcgugcugguccugcggugccucaccgaggcccugcccgagaaccgccugucccggcuccugcacaagcaccgcuucgccgaggccgagagcuucgccauccaguucggccuggacguggagcucguguacaaggucaagagcaaccacauccuggagaagcuggcgcucuccagcguggacgccuccgagcagaccgaguggcagcagcugguggacgacgccaaggagaaccugcacaagauccaggacgacgaguucgucgugaacuacugccucaaggcccaguggaucacguacgagaccacccaggagaugcugaacuacgccaagacccggcugcucaagaaggaggacaagacggcgcugaucuacagcgacgggcugaaggaggugcuccgcgcccacgccaagcugaccaccuucuacggcgccuucggcccggagaaguucuccgggagcuccuggaucgaguuccugaacaacgaggacgaccucaaggacaucuuccugcagcugaaggagggcaaccucgucugcgcccaguaccuguggcugcggcaccgcgcgaacuucgagagccgguucgacgugaagaugcucgagucccugcugaacagcauguccgccagcgugucccuccagaagcugugccccugguucaagaacgacgucauccccuucgugcgccggaccgugcccgaggggcagaucauccuggccaaguggcucgagcaggccgcgcgcaaccuggagcugacggacaaggccaacuggccggagaacggccuccagcuggccgagaucuucuucaccgccgagaagaccgacgagcuggggcucgccagcuccuggcacuggaucagccugaaggacuaccagaacaccgaggaggucugccagcugcggacccucgugaacaaccugcgcgagcugaucacgcuccaccggaaguacaacugcaagcuggcgcuguccgacuucgagaaggagaacaccaccaccaucguguuccgcauguucgacaagguccucgcccccgagcugauccccagcauccuggagaaguucauccggguguacaugcgcgagcacgaccuccaggaggaggagcugcugcuccuguacaucgaggaccugcucaaccgcugcagcuccaagagcacgucccuguucgagaccgccugggaggccaaggccauggcggugaucgccugccugagcgacaccgaccucaucuucgacgccguccugaagaucauguacgccgccguggugcccugguccgcggccgucgagcagcuggugaagcagcaccucgagauggaccacccgaaggugaagcugcugcaggagagcuacaagcucauggagaugaagaagcugcugcggggcuacggcauccgcgaggucaaccuccugaacaaggagaucaugcggguggugcgcuacauccugaagcaggacguccccuccagccucgaggacgcccugaagguggcccaggcguucaugcuguccgacgacgagaucuacagccuccggaucaucgaccugaucgaccgcgagcagggggaggacugccugcuccugcugaagucccugccgcccgccgaggccgagaagaccgccgagcgggugaucaucugggcccgccuggcgcugcaggaggagccggaccacagcaaggagggcaaggccuggcggauguccgucgccaagacgagcguggacauccucaagauccugugcgacauccagaaggacaaccugcagaagaaggacgagugcgaggagaugcucaagcuguucaaggagguggccucccugcaggagaacuucgaggucuuccucagcuucgaggacuacuccaacagcucccugguggccgaccugcgcgagcagcacaucaaggcgcacgagguggcccaggccaagcacaagcccgggagcacccccgagcccaucgccgccgagguccggagcccguccauggagagcaagcugcaccgccaggcgcucgcccugcagauguccaagcaggagcuggaggccgagcucacccugcgggcccugaaggacggcaacaucaagaccgcgcucaagaagugcagcgaccuguucaaguaccacugcaacgccgacacggggaagcuccucuuccugaccugccagaagcugugccagaugcucgccgacaacgugcccgugaccguccccgugggccugaaccugcccuccaugauccacgaccucgccagccaggccgcgaccaucugcuccccggacuuccugcuggacgcccucgagcugugcaagcacacgcugauggccguggagcucagccgccagugccagauggacgacugcggcauccugaugaaggccuccuucgggacccacaaggaccccuacgaggaguggagcuacuccgacuucuucagcgaggacggcaucguccuggagucccagauggugcuccccgugaucuacgagcugaucagcucccuggucccgcucgccgagagcaagcgguacccccuggaguccaccagccugcccuacugcucccucaacgagggggacggccuggugcugcccgucaucaacagcaucagcgcgcuccugcagaaccugcaggaguccagccagugggagcucgcccugcgcuucguggugggcuccuucgggaccugccugcagcacagcgucuccaacuucaugaacgccacgcucagcgagaagcuguucggcgagaccacccuggugaagucccggcacguggucauggagcucaaggagaaggccgugaucuucauccgcgagaacgccaccacgcugcugcacaagguguucaacugccggcucgucgaccuggaccuggcgcucggguacugcacccugcugccgcagaaggacguguucgagaaccucuggaagcugaucgacaaggccuggcagaacuacgacaagauccuggccaucagccucgugggcuccgagcuggccagccuguaccaggagaucgagauggggcucaaguuccgcgagcuguccaccgacgcccaguggggcauccgccugggcaagcucgggaucagcuuccagcccgucuuccggcagcacuuccugaccaagaaggaccugaucaaggcgcucguggagaacaucgacauggacacgucccugauccuggaguacugcagcaccuuccagcucgacugcgacgccgugcugcagcuguucaucgagacccuccugcacaacaccaacgccggccaggggcagggcgacgccuccauggacagcgcgaagcgccggcaccccaagcugcucgccaaggcccuggagauggucccccugcucacguccaccaaggaccuggugaucagccuguccgggauccuccacaagcuggacccguacgacuacgagaugaucgaggugguccugaaggugaucgagcgcgccgacgagaagaucaccaacaucaacaucaaccaggcccucagcauccugaagcaccucaagagcuaccggcgcaucagcccgcccguggaccucgaguaccaguacaugcuggagcacgucaucacccugcccagcgcggcccagacgcggcucccguuccaccugaucuucuucggcaccgcccagaacuucuggaagauccuguccaccgagcucagcgaggaguccuuccccacccugcugcucaucagcaagcugaugaaguucucccuggacacccucuacgugagcacggccaagcacguguucgagaagaagcugaagcccaagcugcucaagcugacccaggccaaguccagcacccugaucaacaaggagaucaccaagaucacgcagaccaucgaguccugccugcucagcaucgucaaccccgagugggcgguggccaucgccaucucccuggcccaggacaucccggagggcagcuucaagaucuccgcccugaaguucugccucuaccuggcggagcgcuggcugcagaacauccccagccaggacgagaagcgggagaaggccgaggcccuccugaagaagcugcacauccaguaccgccgguccgggaccgaggccgugcucaucgcgcacaagcugaacaccgaggaguaccugcgcgucaucggcaagcccgcccaccucaucgugagccuguacgagcaccccuccaucaaccagcggauccagaacagcagcgggacggacuacccggacauccacgccgccgccaaggagaucgcggaggugaacgagaucaaccuggagaaggucugggacaugcuccuggagaaguggcugugccccuccaccaagcccggcgagaagcccagcgagcuguucgagcugcaggaggacgaggcccugcgccgggugcaguaccuccugcugucccgcccgaucgacuacagcucccggaugcuguucguguucgccaccagcaccacgaccacccuggggaugcaccagcugaccuucgcccaccgcacgcgggcccuccagugccuguucuaccuggcggacaaggagaccaucgagucccucuucaagaagcccaucgaggaggucaagagcuaccugcgcugcaucaccuuccuggccuccuucgagacccucaacauccccaucacguacgagcuguucugcagcuccccgaaggagggcaugaucaagggccuguggaagaaccacagccacgaguccauggccgugcggcucgugaccgagcugugccuggaguacaagaucuacgaccuccagcuguggaacgggcugcuccagaagcugcugggcuucaacaugauccccuaccuccgcaagguccugaaggccaucagcuccauccacagccuguggcagguccccuacuucuccaaggccuggcagcgcgugauccagaucccccuccugagcgcguccugcccgcugagccccgaccagcucagcgacugcuccgagagccugaucgccguccuggagugccccguguccggggaccucgaccugaucggcguggcccggcaguacauccagcuggagcuccccgccuucgcgcuggccugccugaugcucaugccgcacagcgagaagcgccaccagcagaucaagaacuuccugggguccugcgacccccaggucauccugaagcagcucgaggagcacaugaacaccggccagcuggccggcuucagccaccagauccggucccugauccucaacaacaucaucaacaagaaggaguucgggauccuggccaagaccaaguacuuccagaugcugaagaugcacgccaugaacacgaacaacaucaccgagcucgugaacuaccuggcgaacgaccugagccucgacgaggccuccgugcugaucaccgaguacagcaagcacugcggcaagcccgugccgcccgacaccgcccccugcgagauccugaagauguuccucuccgggcugagcuga

SEQ ID NO: 32114 - RNA, 1617 nt, Artificial Sequence
  derived and/or modified sequence opt1 from KPNA1__Homo_sapiens__NP_002255
augaccacccccggcaaggagaacuuccgccucaagagcuacaagaacaagucccucaacccggacgagaugcggcgccggcgcgaggaggaggggcugcagcugcggaagcagaagcgcgaggagcagcuguucaagcggcgcaacguggccacggccgaggaggagaccgaggaggaggucaugagcgacggcggguuccacgaggcgcagaucuccaacauggagauggcccccggcggggugaucaccagcgacaugaucgagaugaucuucuccaagagccccgagcagcagcuguccgccacccagaaguuccggaagcugcucagcaaggagcccaacccgcccaucgacgaggugaucuccacgcccggcgucguggcccgcuucguggaguuccugaagcggaaggagaacugcacccugcaguucgagagcgccuggguccucaccaacaucgcguccggcaacagccugcagacccgcaucgugauccaggccggggccgugcccaucuucaucgagcugcucuccagcgaguucgaggacguccaggagcaggccgugugggcgcugggcaacaucgccggggacuccacgaugugccgggacuacgugcuggacugcaacauccucccgccccugcugcagcuguucagcaagcagaaccgccugaccaugacccggaacgccgucugggcccuguccaaccucugccgcggcaagagcccgcccccggaguucgccaaggugucccccugccugaacgugcugagcuggcuccuguucgucagcgacaccgacgugcuggcggacgccugcugggcccucuccuaccugagcgacgggcccaacgacaagauccaggccgugaucgacgccggcgucugccggcgccugguggagcuccugaugcacaacgacuacaagguggucucccccgcgcugcgggccgugggcaacaucgugacgggggacgacauccagacccaggucauccucaacugcagcgcccugcagucccugcuccaccuccugagcuccccgaaggagagcaucaagaaggaggccugcuggaccaucuccaacaucaccgccggcaaccgcgcgcagauccagacggugaucgacgccaacaucuuccccgcccucaucagcauccugcagaccgccgaguuccggacccgcaaggaggccgcgugggccaucaccaacgccacguccgggggcagcgccgagcagaucaaguaccuggucgagcucggcugcaucaagccccugugcgaccugcucaccgugauggacuccaagaucgugcaggucgcgcugaacgggcuggagaacauccuccgccugggcgagcaggaggccaagcggaacgggaccggcaucaaccccuacugcgcccugaucgaggaggccuacgggcuggacaagaucgaguuccuccagagccacgagaaccaggagaucuaccagaaggccuucgaccugaucgagcacuacuucggcaccgaggacgaggacuccagcaucgcgccccagguggaccugaaccagcagcaguacaucuuccagcagugcgaggcccccauggagggcuuccagcucuga

SEQ ID NO: 32115 - RNA, 1590 nt, Artificial Sequence
  derived and/or modified sequence opt1 from KPNA2__Homo_sapiens__NP_001307540
augagcaccaacgagaacgccaacacccccgccgcgcgccugcaccgguucaagaacaagggcaaggacuccacggagaugcgccggcgccggaucgaggugaacgucgagcuccgcaaggccaagaaggacgaccagaugcugaagcggcgcaacgugagcuccuucccggacgacgccaccagcccccugcaggagaaccggaacaaccaggggaccgugaacugguccgucgacgacaucgugaagggcaucaacagcuccaacguggagaaccagcuccaggccacccaggccgcgcgcaagcugcugagccgggagaagcagccgcccaucgacaacaucauccgcgccgggcucauccccaaguucgucuccuuccugggccggacggacugcagccccauccaguucgaguccgccugggcccugaccaacaucgcgagcgggaccuccgagcagaccaaggccgugguggacggcggcgccauccccgccuucaucagccuccuggccagcccccacgcgcacaucuccgagcaggccgucugggcccuggggaacaucgccggcgacggguccguguuccgcgaccucgugaucaaguacggcgccgucgacccgcugcuggcgcuccuggccgugcccgacaugagcucccuggccugcggguaccuccggaaccugacguggacccugagcaaccucugccgcaacaagaaccccgcgcccccgaucgacgccguggagcagauccugcccacccugguccggcuccugcaccacgacgaccccgaggugcuggccgacacgugcugggccaucagcuaccucaccgacggccccaacgagcgcaucggcaugguggucaagaccgggguggugccgcagcuggucaagcugcucggcgccuccgagcugcccaucgugacccccgcccugcgggccaucgggaacaucgugaccggcacggacgagcagacccaggucgugaucgacgcgggcgcccucgccgucuuccccagccugcugaccaacccgaagaccaacauccagaaggaggccacguggaccauguccaacaucaccgcggggcgccaggaccagauccagcaggucgugaaccacggccucgugcccuuccuggugagcgugcuguccaaggccgacuucaagacccagaaggaggccgucugggccgugacgaacuacaccagcgggggcaccguggagcagaucgucuaccucgugcacugcgggaucaucgagccccugaugaaccugcucaccgccaaggacacgaagaucauccuggugauccuggacgcgaucuccaacaucuuccaggccgccgagaagcucggcgagaccgagaagcugagcaucaugaucgaggagugcggcgggcuggacaagaucgaggcccuccagaaccacgagaacgaguccgucuacaaggccagccugucccugaucgagaaguacuucagcguggaggaggaggaggaccagaacgugguccccgagaccaccuccgagggcuacacguuccaggugcaggacggggcgccgggcaccuucaacuucuga

SEQ ID NO: 32116 - RNA, 1566 nt, Artificial Sequence
  derived and/or modified sequence opt1 from KPNA3__Homo_sapiens__NP_002258
auggccgagaaccccagccuggagaaccaccgcaucaaguccuucaagaacaagggccgggacguggagaccaugcgccggcaccgcaacgaggucaccguggagcuccggaagaacaagcgcgacgagcaccuccugaagaagcggaacgugccgcaggaggagagccuggaggacuccgacgucgacgccgacuucaaggcgcagaacgugacgcuggaggccauccugcagaacgccaccagcgacaaccccgugguccagcucuccgccgugcaggccgcgcgcaagcugcugagcuccgaccggaacccgcccaucgacgaccucaucaagagcgggauccugcccauccuggugaagugccucgagcgcgacgacaaccccucccugcaguucgaggccgccugggcccugaccaacaucgcgagcggcaccuccgcccagacgcaggccgucgugcagagcaacgccgugccccucuuccugcggcugcuccgcagcccccaccagaacgucugcgagcaggccgugugggcgcuggggaacaucaucggcgacgggccgcagugccgggacuacgugaucucccugggcgucgugaagccccuccuguccuucaucagccccuccauccccaucaccuuccugcgcaacgugaccugggucaucgugaaccucugccggaacaaggacccgcccccgcccauggagaccgugcaggagauccugcccgcccugugcguccucaucuaccacacggacaucaacauccugguggacaccgugugggcccugagcuaccucaccgacggcgggaacgagcagauccagauggucaucgacuccggcgugguccccuuccuggugccccugcucagccaccaggaggugaagguccagaccgccgcccugcgcgcgguggggaacaucgugacgggcaccgacgagcagacccaggucgugcugaacugcgacgugcucagccacuuccccaaccugcugucccacccgaaggagaagaucaacaaggaggccgucugguuccucagcaacaucaccgccgggaaccagcagcagguccaggccgugaucgacgccggccugauccccaugaucauccaccagcuggcgaagggcgacuucgggacgcagaaggaggccgccugggccaucuccaaccucaccaucagcggccggaaggaccagguggaguaccuggugcagcagaacgugaucccgcccuucugcaaccugcucuccgucaaggacagccagguggugcaggucgugcuggacgggcugaagaacauccucaucauggccggcgacgaggcguccaccaucgccgagaucaucgaggagugcggcgggcuggagaagaucgaggugcugcagcagcacgagaacgaggacaucuacaagcuggccuucgagaucaucgaccaguacuucagcggcgacgacaucgacgaggaccccugccucauccccgaggccacccagggcgggacguacaacuucgaccccaccgcgaaccugcagaccaaggaguucaacuucuga

SEQ ID NO: 32117 - RNA, 1566 nt, Artificial Sequence
  derived and/or modified sequence opt1 from KPNA4__Homo_sapiens__NP_002259
auggccgacaacgagaagcuggacaaccagcgccucaagaacuucaagaacaagggccgggaccuggagaccaugcgccggcagcgcaacgagguggucguggagcugcggaagaacaagcgcgacgagcaccuccugaagcggcgcaacgugccccacgaggacaucugcgaggacagcgacaucgacggggacuaccggguccagaacaccucccuggaggccaucgugcagaacgcgagcuccgacaaccagggcauccagcucagcgccgugcaggccgcccgcaagcugcuguccagcgaccggaacccgcccaucgacgaccucaucaaguccgggauccugcccauccugguccacugccucgagcgcgacgacaaccccagccugcaguucgaggccgcgugggcccugacgaacaucgccuccggcaccagcgagcagacccaggccguggugcaguccaacgcggucccccucuuccugcggcugcuccacagcccccaccagaacgugugcgagcaggccgugugggcccuggggaacaucaucggcgacggcccccagugccgcgacuacgucaucucccuggggguggugaagccccuccugagcuucaucuccccgagcauccccaucaccuuccugcggaacgucacgugggugauggugaaccucugccgccacaaggacccgcccccgcccauggagaccauccaggagauccugcccgcccugugcguccucauccaccacaccgacgugaacauccugguggacaccgucugggcccuguccuaccucacggacgcgggcaacgagcagauccagauggugaucgacagcgggaucgugccccaccuggucccgcugcucucccaccaggaggugaagguccagaccgccgcccugcgggccgugggcaacaucgugaccgggaccgacgagcagacgcaggucgugcugaacugcgacgcccucagccacuuccccgcgcugcugacccaccccaaggagaagaucaacaaggaggccgugugguuccucagcaacaucaccgccggcaaccagcagcagguccaggccgugaucgacgccaaccuggugcccaugaucauccaccuccuggacaagggcgacuucgggacccagaaggaggcggccugggccaucuccaaccugacgaucagcggccgcaaggaccaggucgccuaccugauccagcagaacgugaucccgcccuucugcaaccuccugaccgugaaggacgcccaggucguccagguggugcuggacgggcucuccaacauccugaagauggcggaggacgaggccgagaccaucggcaaccugaucgaggagugcggcgggcuggagaagaucgagcagcuccagaaccacgagaacgaggacaucuacaagcuggccuacgagaucaucgaccaguucuucagcuccgacgacaucgacgaggaccccagccuggugcccgaggccauccagggcgggaccuucggcuucaacuccagcgcgaacgugccgacggagggguuccaguucuga

SEQ ID NO: 32118 - RNA, 1608 nt, Artificial Sequence
  derived and/or modified sequence opt1 from KPNA6__Homo_sapiens__XP_011539462
augaccauggccagccccggcaaggacaacuaccgcaugaaguccuacaagaacaacgcccugaacccggaggagaugcggcgccggcgcgaggaggaggggauccagcuccggaagcagaagcgcgagcagcagcuguucaagcggcgcaacguggagcugaucaacgaggaggcggccauguucgacagccuccugauggacuccuacgugagcuccaccacgggcgagagcgugaucacccgggagaugguggagaugcuguucuccgacgacagcgaccuccagcuggccaccacccagaaguuccgcaagcugcucuccaaggagcccagcccgcccaucgacgaggucaucaacacgccccgggugguggaccgcuucgucgaguuccugaagcggaacgagaacugcacccugcaguucgaggccgccugggcgcucaccaacaucgccuccgggaccagccagcagacgaagaucgugaucgaggccggcgccgugcccaucuucaucgagcugcugaacuccgacuucgaggacguccaggagcaggcggugugggcccucgggaacaucgccggcgacagcuccgugugccgcgacuacguccugaacugcagcauccugaacccccuccugacccugcucaccaaguccacccggcugacgaugacccgcaacgccgugugggcccugagcaaccucugccggggcaagaacccgccgcccgaguucgcgaaggugucccccugccugcccguccugagccgccuccuguucagcuccgacagcgaccugcucgccgacgccugcugggcccuguccuaccugagcgacgggcccaacgagaagauccaggccgugaucgacuccggcgugugccggcgccucgucgagcugcugaugcacaacgacuacaagguggcgagccccgcccuccgggccguggggaacaucgucaccggcgacgacauccagacccaggugauccugaacugcuccgcccugcccugccuccugcaccuccugagcucccccaaggagagcauccgcaaggaggccugcuggacgaucuccaacaucaccgcggggaaccgcgcccagauccaggccgugaucgacgccaacaucuucccgguccugaucgagauccugcagaaggccgaguuccggacccgcaaggaggcggccugggccaucaccaacgccacgagcggcggcacccccgagcagauccgguaccucgugucccuggggugcaucaagccccugugcgaccuccugaccgucauggacagcaagaucguccagguggcgcugaacggccuggagaacauccuccgccugggggagcaggagggcaagcgguccggcagcggggugaaccccuacugcggccugaucgaggaggccuacgggcucgacaagaucgaguuccugcagucccacgagaaccaggagaucuaccagaaggccuucgaccugaucgagcacuacuucggcguggaggacgacgacagcucccucgccccgcaggucgacgagacccagcagcaguucaucuuccagcagcccgaggcccccauggagggguuccagcuguga

SEQ ID NO: 32119 - RNA, 1551 nt, Artificial Sequence
  derived and/or modified sequence opt1 from KPNA7__Homo_sapiens__NP_001139187
augcccacccuggacgccccggaggagcgccggcgcaaguucaaguaccggggcaaggacgugagccuccgccggcagcagcgcauggccgucucccuggagcugcggaaggcgaagaaggacgagcagacccucaagcgccggaacaucacgagcuucugccccgacacccccuccgagaagaccgccaaggggguggccgugagccugacccugggcgagaucaucaagggggucaacuccagcgaccccgugcucugcuuccaggccacgcagaccgcccgcaagaugcugucccaggagaagaacccgccccugaagcucgugaucgaggcgggccugaucccccggauggucgaguuccucaagagcucccuguaccccugccugcaguucgaggccgccugggcccugaccaacaucgcgagcgggaccuccgagcagacgcgcgccgugguggagggcggcgccauccagccgcucaucgagcugcugagcuccagcaacgucgccgugugcgagcaggccgugugggcgcucgggaacaucgccggcgacgggcccgaguuccgggacaacgucaucaccuccaacgccaucccccaccuccuggcccugaucagccccacccugccgaucaccuuccugcgcaacaucacguggacccucuccaaccugugccggaacaagaaccccuaccccugcgacaccgccgugaagcagauccugcccgcgcuccugcaccuccugcagcaccaggacagcgaggugcuguccgacgccugcugggcccugagcuaccucaccgacggcagcaacaagcgcaucgggcaggucgugaacacgggcgugcugccgcggcuggucgugcucaugaccuccagcgagcugaacgugcugacccccucccuccgcaccgucggcaacaucgugacggggaccgacgagcagacccagauggccaucgacgccggcaugcugaacgugcugccccagcuccugcagcacaacaagcccagcauccagaaggaggcggccugggcccuguccaacgucgccgccgggccgugccaccacauccagcagcuccuggcguacgacgugcugccgccccucgucgcccugcugaagaacggcgaguucaaggugcagaaggaggccguguggauggucgccaacuucgcgaccggcgccacgauggaccagcugauccagcucgugcacagcggggugcuggagccccuggucaaccuccugaccgcccccgacgugaagaucgugcugaucauccucgacgucaucuccugcauccugcaggccgccgagaagcggagcgagaaggagaaccugugccuccugaucgaggagcugggcgggaucgaccgcaucgaggcgcuccagcugcacgagaaccggcagaucggccaguccgcccugaacaucaucgagaagcacuucggggaggaggaggacgagagccagacccuccugucccaggugaucgaccaggacuacgaguucaucgacuacgagugccuggccaagaaguga

SEQ ID NO: 32120 - RNA, 2196 nt, Artificial Sequence
  derived and/or modified sequence opt1 from KPNB1__Homo_sapiens__NP_001263382
augaaggagagcacccuggaggccaucggcuacaucugccaggacaucgaccccgagcagcuccaggacaaguccaacgagauccugaccgccaucauccaggggaugcgcaaggaggagccgagcaacaacgugaagcuggcggccacgaacgcccuccugaacucccuggaguucaccaaggccaacuucgacaaggagagcgagcggcacuucaucaugcaggucgugugcgaggccacccagugccccgacacccgcgugcgggucgcggcccuccagaaccuggugaagaucaugucccuguacuaccaguacauggagacguacaugggccccgcccucuucgccaucaccaucgaggcgaugaaguccgacaucgacgagguggcccugcaggggaucgaguucuggagcaacgucugcgacgaggagauggaccuggccaucgaggccagcgaggccgcggagcagggccggcccccggagcacaccuccaaguucuacgccaagggggcccuccaguaccuggugcccauccugacccagacgcucaccaagcaggacgagaacgacgacgacgacgacuggaaccccugcaaggccgccggcgugugccugaugcugcucgcgaccugcugcgaggacgacaucgucccccacgugcugccguucaucaaggagcacaucaagaaccccgacuggcgcuaccgcgacgccgccgugauggccuucggcugcauccuggaggggcccgagcccagccagcucaagccgcuggucauccaggccaugcccacccugaucgagcucaugaaggaccccuccguggugguccgggacacggcggccuggaccgugggccgcaucugcgagcugcugcccgaggccgccaucaacgacguguaccucgccccgcugcugcagugccucaucgaggggcugagcgcggagccccgggucgccuccaacgugugcugggccuucagcucccuggccgaggcggccuacgaggccgccgacguggccgacgaccaggaggagcccgcgaccuacugccucagcuccagcuucgagcugaucguccagaagcugcucgagaccacggaccgccccgacggccaccagaacaaccugcgguccagcgccuacgagagccugauggagaucgugaagaacuccgccaaggacugcuacccggccgugcagaagaccacccucgucaucauggagcgccugcagcagguccugcagauggagagccacauccaguccaccagcgaccggauccaguucaacgaccuccagucccugcugugcgccacgcuccagaacgugcugcgcaaggugcagcaccaggacgcgcugcagaucagcgacguggucauggccucccuccugcggauguuccagagcaccgccggguccggcggcgugcaggaggacgcccugauggccgugagcacccuggucgaggugcucgggggcgaguuccugaaguacauggaggcguucaagcccuuccuggggaucggccucaagaacuacgccgaguaccaggugugccuggccgccgucggccuggugggggaccucugccgcgcgcugcaguccaacaucauccccuucugcgacgaggugaugcagcugcuccuggagaaccugggcaacgagaacguccaccggagcgugaagccccagauccucuccguguucggggacaucgcccuggccaucggcggggaguucaagaaguaccuggaggucgugcucaacacccugcagcaggccagccaggcccagguggacaaguccgacuacgacauggucgacuaccugaacgagcuccgcgagagcugccuggaggcguacacgggcaucgugcagggccugaagggggaccaggagaacgugcacccggacgucaugcucgugcagccccggguggaguucauccuguccuucaucgaccacaucgccggcgacgaggaccacaccgacggggucguggccugcgccgccggccugaucggggaccucugcaccgcguucggcaaggacgugcugaagcuggucgaggcccgccccaugauccacgagcuccugaccgagggccggcgcagcaagacgaacaaggccaagacccuggccaccugggccaccaaggagcuccgcaagcugaagaaccaggcguga

SEQ ID NO: 32121 - RNA, 1740 nt, Artificial Sequence
  derived and/or modified sequence opt1 from KPRP__Homo_sapiens__NP_001020402
augugcgaccagcagcagauccagugccgccugccccuccagcagugcugcgugaagggcccgagcuucugcuccagccagucccccuucgcccagagccaggucguggugcaggcccccugcgagaugcagaucgucgacugccccgcguccugcccggugcaggugugccaggucagcgaccaggcccccugccagucccagaccacccaggugaagugccagagcaagacgaagcaggugaaggggcaggcccagugccaguccaagaccacccaggucaagggccaggccgccagccagucccagaccagcuccgugcagagccaggcgcccugccaguccgaggugagcuacguccagugcgaggccucccagcccgugcagacgugcuucguggagugcgccccggucugcuacaccgagaccugcuacguggagugccccgugcagaacuacguccccugccccgccccgcagcccgugcagauguaccgggggcgccccgcggugugccagccccagggccgguucagcacccagugccaguaccagggguccuacagcagcugcggcccgcaguuccagucccgcgccacgugcaacaacuacaccccccaguuccagcugcggcccagcuacuccagcugcuucccccaguaccgcucccggaccagcuucuccccgugcgucccccagugccagacccagggcagcuacggguccuucacggagcagcaccgcagccgguccaccagccgcugccugccccccccgcggcgccuccagcuguucccccgguccugcagccccccccgccgguucgagccgugcuccagcuccuaccugccccuccgccccagcgagggcuucccgaacuacugcacccccccccggcgcuccgagcccaucuacaacagccggugcccgcgccggcccaucagcuccugcagccagcgccgcgggcccaagugccggaucgagaucuccagccccugcugcccgcgccaggugcccccccagcggugccccguggagaucccgcccauccgccggcgcucccagagcugcggcccccagcccuccuggggggccagcugcccggagcugcggccccacgucgagccccgcccccugccguccuucugccccccccggcgccucgaccagugccccgagagcccgcugcagcggugcccccccccggccccccgcccccggcugcgccccgagccgugcaucucccucgagccccggccccgcccccugccgcggcagcugagcgagcccugccucuaccccgagccccugccggcccugcgccccaccccccggcccgugccgcucccccgccccggccagugcgagauccccgagccgcgccccugccugcagcccugcgagcaccccgagccgugcccccggcccgagcccaucccgcugcccgcgcccugcccgucccccgagcccugccgcgagacguggcggagccccuccccgugcuggggccccaaccccguccccuacccgggggaccucggcugccacgagagcuccccccaccgccuggacaccgaggcccccuacugcgggcccagcagcuacaaccagggccaggaguccggcgccgggugcggcccgggggacguguuccccgagcggcgcggccaggacgggcacggcgaccagggcaacgccuucgccggggugaagggcgaggcgaagagcgccuacuucuga

SEQ ID NO: 32122 - RNA, 1143 nt, Artificial Sequence
  derived and/or modified sequence opt1 from KPTN__Homo_sapiens__NP_001278225
augaugggcgaggccgccguggcggccgggcccugcccgcugcgcgaggacagcuucacccgguucuccagccaguccaacgucuacggccucgccgggggcgccgggggccgcggcgagcugcuggccgcgacccucaaggggaaggugcugggcuuccgguaccaggaccugcgccagaagauccggcccguggccaaggagcuccaguucaacuacauccccgagagcugccugaaccuggagcuccaguucacgcccuuccagcugugccacgccgagguccaggugggggaccagcuggagaccguguuccuccuguccggcaacgacccggccauccaccuguacaaggagaacgaggggcuccaccaguucgaggagcagcccgucgagaaccuguuccccgagcugaccaaccucaccagcuccgugcuguggcuggacgugcacaacuuccccggcacgagccgccggcucuccgcgcugggcugccagagcggguacguccgcguggcccacguggaccagcggucccgcgagguccugcagauguggagcgugcuccaggacggcccgaucucccgggugaucgucuucagccuguccgccgccaaggagaccaaggaccgcccccugcaggacgaguacagcgugcucguggccuccaugcuggagcccgcggucguguaccgggaccugcucaaccgcgggcuggaggaccagcugcuccugcccggcagcgaccaguucgacuccgugcugugcagccucgucaccgacguggaccuggacggccggccggaggugcuggucgccaccuacgggcaggagcuccugugcuacaaguaccgcggccccgagagcgggcugcccgaggcccagcacggcuuccaccuccuguggcagcgguccuucagcagcccccugcucgccauggcccacguggaccugacgggggacggccugcaggagcucgcggucgugucccugaagggcgugcacauccugcagcacucccugauccaggccagcgagcucguccugacccgccugcggcaccagguggagcagcgccggcgccgccuccaggggcuggaggacggcgccggggccggcccggccgagaacgcggccuccuga

SEQ ID NO: 32123 - RNA, 567 nt, Artificial Sequence
  derived and/or modified sequence opt1 from KRAS__Homo_sapiens__NP_004976
augaccgaguacaagcugguggucgugggcgccgggggcgugggcaagagcgcccucaccauccagcugauccagaaccacuucgucgacgaguacgaccccacgaucgaggacuccuaccgcaagcaggucgugaucgacggggagaccugccugcucgacauccuggacaccgcggggcaggaggaguacagcgccaugcgggaccaguacaugcgcaccggcgagggcuuccugugcguguucgccaucaacaacacgaaguccuucgaggacauccaccacuaccgggagcagaucaagcgcgugaaggacagcgaggacgugccgaugguccucguggggaacaagugcgaccugcccucccggaccguggacaccaagcaggcccaggaccuggcccgcagcuacggcauccccuucaucgagaccuccgcgaagacgcggcagggggucgacgacgccuucuacacccucgugcgcgagauccggaagcacaaggagaagaugagcaaggacggcaagaagaagaagaagaaguccaagaccaagugcgugaucauguga

SEQ ID NO: 32124 - RNA, 516 nt, Artificial Sequence
  derived and/or modified sequence opt1 from KRBOX4__Homo_sapiens__NP_001123370
auggccaugagccaggagucccugaccuucaaggacguguucgucgacuucacccucgaggaguggcagcagcuggacagcgcccagaagaaccuguaccgcgacgugaugcucgagaacuacucccaccuggugagcgucggcuaccugguggcgaagcccgacgugaucuuccggcucgggccgggcgaggaguccuggauggccgacgggggcacgcccguccggaccugcgccggggaggaccgccccgagguguggcaggucgacgagcagaucgaccacuacaaggagagccaggacaagcugcccuggcaggccgccuucaucggcaaggagacccugaaggacgaguccggccaggagagccggaccugccgcaaguccaucuaccucagcacggaguucgacuccgugcgccagcggcugccgaaguacuacagcugggagaaggcguucaagaccuccuucaagcugagcugguccaaguggaagcucugcaagaaggagcgcuga

SEQ ID NO: 32125 - RNA, 1377 nt, Artificial Sequence
  derived and/or modified sequence opt1 from KREMEN1__Homo_sapiens__NP_001034659
auggcgcccccggccgcccgccuggcccuccugagcgccgccgcccugacccucgcggcccggcccgcccccucccccggccuggggccgggccccgagugcuucaccgccaacggggcggacuaccgcggcacgcagaacuggaccgcccugcagggcgggaagcccugccucuucuggaacgagaccuuccagcaccccuacaacacccugaaguacccgaacggcgagggcgggcugggggagcacaacuacugccggaaccccgacggcgacgugagccccuggugcuacgucgccgagcacgaggacgggguguacuggaaguacugcgagauccccgccugccagaugccgggcaaccucggcugcuacaaggaccacgggaacccgccgccccugacgggcaccuccaagaccagcaacaagcugaccauccagacgugcaucuccuucugccgcagccagcgguucaaguucgccgggauggaguccggcuacgcgugcuucugcggcaacaaccccgacuacuggaaguacggggaggccgccagcaccgagugcaacuccgugugcuucggcgaccacacccagcccugcgggggcgacgggcgcaucauccucuucgacacccuggucggcgccugcggcgggaacuacagcgccauguccagcgugguguacucccccgacuuccccgacacguacgcgaccggccgggucugcuacuggaccauccgcgugcccggggccagccacauccacuucuccuucccccuguucgacauccgggacagcgccgacaugguggagcuccuggacggcuacacccaccgcguccuggcccgguuccacgggcgcucccggccgccccucagcuucaacgugucccuggacuucgugauccuguacuucuucagcgaccgcaucaaccaggcccagggcuucgcgguccucuaccaggccgugaaggaggagcugccccaggagcggcccgccgugaaccagacggucgccgaggugaucaccgagcaggccaaccugagcguguccgcggcccgcagcuccaagguccucuacgugaucaccaccagccccucccacccgccccagacggugcccggcuggaccgucuacgggcuggccacccugcucauccugaccgugacggccaucguggcgaagauccugcuccacgucaccuucaagagccaccgggugcccgccuccggcgaccugcgcgacugccaccagccggggaccagcggcgagaucugguccaucuucuacaagcccagcaccuccaucagcaucuucaagaagaagcugaaggggcagucccagcaggacgaccggaacccccucgucagcgacuga

SEQ ID NO: 32126 - RNA, 2067 nt, Artificial Sequence
  derived and/or modified sequence opt1 from KRIT1__Homo_sapiens__NP_001013424
augggcaaccccgagaacaucgaggacgccuacguggccgucauccgcccgaagaacaccgcgagccugaacucccgggaguaccgcgccaagagcuacgagauccuccugcacgaggugcccaucgaggggcagaagaagaagcggaagaaggugcugcucgagaccaagcugcagggcaacuccgagaucacgcaggggauccuggacuacgucguggagaccaccaagcccaucagccccgccaaccagggcauccgcgggaagcgggugguccucaugaagaaguucccgcuggacggcgagaagaugggccgcgaggccucccuguucaucgugcccagcguggucaaggacaacaccaaguacacguacacccccgggugccccaucuucuacugccuccaggacaucaugcgggugugcuccgagagcuccacccacuucgccacccugacggcgcgcaugcugaucgcccucgacaaguggcuggacgagcggcacgcccagagccacuucaucccggcccuguuccgccccagcccccucgagcggaucaagaccaacgugaucaaccccgcguacgccaccgaguccggccagaccgagaacucccugcacaugggguacagcgcccuggagaucaaguccaagaugcucgcccuggagaaggccgacacgugcaucuacaacccgcuguucggcagcgaccuccaguacaccaaccgcgucgacaagguggugaucaaccccuacuucgggcugggcgcgcccgacuacuccaagauccagauccccaagcaggagaaguggcagcggagcauguccagcgucaccgaggacaaguacggcaagguggaggccacccgcauccugcucgagaaggggaagugcaacccgaaccugcugaacggccagcucagcuccccgcugcacuucgccgccgggggcggccacgccgagaucgugcagauccugcucaaccaccccgagacggaccggcacaucaccgaccagcaggggcgcagcccccugaacaucugcgaggagaacaagcagaacaacugggaggaggcggccaagcugcucaaggaggccaucaacaagcccuacgagaagguccggaucuaccgcauggacggcuccuaccggagcguggagcugaagcacgggaacaacaccaccgugcagcagaucauggagggcaugcgccugucccaggagacgcagcaguacuucaccaucuggaucugcagcgagaaccucucccugcagcugaagcccuaccacaagccccuccagcacguccgggacuggcccgagauccuggccgagcugaccaaccucgacccgcagcgcgagacgccccagcuguuccugcgccgggacgugcgccucccccuggagguggagaagcagaucgaggacccccuggccauccucauccuguucgacgaggcgcgguacaaccugcugaagggguucuacaccgccccggacgccaagcucaucacccuggccagccugcuccugcagaucgucuacggcaacuacgaguccaagaagcacaagcagggcuuccugaacgaggagaaccucaagagcaucgugcccgucaccaagcugaaguccaaggcgccccacuggaccaaccgcauccugcacgaguacaagaaccucagcacguccgagggggugagcaaggagaugcaccaccuccagcggauguuccugcagaacugcugggagaucccgaccuacggcgccgccuucuucaccgggcagaucuucaccaaggccucccccagcaaccacaaggugauccccgucuacgugggcgugaacaucaaggggcugcaccuccugaacauggagacgaaggcccugcugaucucccugaaguacggcugcuucauguggcagcucggcgacaccgacacgugcuuccagauccacagcauggagaacaagauguccuucaucguccacaccaagcaggcggggcugguggugaagcugcucaugaagcugaacggccagcugaugcccaccgagcgcaacagcuga

SEQ ID NO: 32127 - RNA, 1755 nt, Artificial Sequence
  derived and/or modified sequence opt1 from KRT10__Homo_sapiens__NP_000412
augagcgugcgcuacuccagcuccaagcacuacagcuccagccgguccggcgggggcgggggcgggggcggcugcgggggcgggggcggggucagcucccugcgcaucagcuccagcaagggcucccucggcgggggcuucagcuccgggggcuucagcggcggguccuucagccggggcuccagcgggggcgggugcuucggcggcagcuccgggggcuacgggggccucgggggcuucggcgggggcagcuuccgcggguccuacggcagcuccagcuucgggggcuccuacggcgggagcuucggcgggggcuccuucggcgggggcagcuucgggggcggguccuucggcggcgggggcuucgggggcgggggcuucggcgggggcuucgggggcggguucggcggcgacgggggccugcugagcgggaacgagaaggugaccaugcagaaccugaacgaccggcuggccuccuaccucgacaaggugcgcgcccuggaggagagcaacuacgagcuggagggcaagaucaaggagugguacgagaagcacgggaacucccaccagggcgagccccgggacuacagcaaguacuacaagaccaucgacgaccucaagaaccagauccugaaccugacgaccgacaacgcgaacauccuccugcagaucgacaacgcccgccuggccgccgacgacuuccggcucaaguacgagaacgaggucgcccugcgccaguccguggaggcggacaucaacggccugcggcgcgugcucgacgagcugacccugaccaaggccgaccucgagaugcagaucgagagccugacggaggagcuggccuaccucaagaagaaccacgaggaggagaugaaggaccugcggaacgucuccaccggggacgugaacguggagaugaacgccgcgccgggcgucgaccugacccagcuccugaacaacaugcgcagccaguacgagcagcuggccgagcagaaccggaaggacgccgaggccugguucaacgagaaguccaaggagcucaccacggagaucgacaacaacaucgagcagaucagcagcuacaaguccgagaucaccgagcugcgccggaacgugcaggcccuggagaucgagcuccagagccagcuggcgcugaagcagucccucgaggccagccuggccgagaccgaggggcgcuacugcgugcagcugucccagauccaggcccagaucagcgcccucgaggagcagcugcagcagauccgggcggagaccgagugccagaacacggaguaccagcagcugcucgacaucaagauccgccuggagaacgagauccagaccuaccggucccugcucgagggcgagggcagcuccgggggcgggggccgcgggggcggcagcuucgggggcggguacggcgggggcuccagcggcgggggcuccagcgggggcgggcacggcggcgggcacggcggguccagcggcggcggguacggcgggggcagcuccgggggcggcagcuccgggggcggguacggcgggggcagcuccagcggcgggcacggcggguccagcuccggcggguacggcggcgggagcuccggcgggggcgggggcggcuacgggggcgggagcuccggcggcgggagcuccagcggcgggggcuacgggggcggcuccagcuccgggggccacaagagcagcuccagcggguccgucggcgagagcuccagcaaggggccccgcuacuga

SEQ ID NO: 32128 - RNA, 1485 nt, Artificial Sequence
  derived and/or modified sequence opt1 from KRT12__Homo_sapiens__NP_000214
auggaccugagcaacaacaccaugucccucagcgugcgcacccccggccugucccggcgccugagcucccagagcgucaucgggcggccgcgcggcauguccgccagcuccguggggagcggcuacgggggcuccgccuucggcuucggggcgagcugcggcgggggcuucuccgccgccagcauguucggguccagcuccggcuucggcgggggcagcggguccagcauggccggcggccucggggccggcuacgggcgggcgcugggcgggggcagcuucggcgggcugggcaugggguucggcgggucccccggcggcgggagccucggcauccuguccgggaacgacggcgggcugcucagcggcuccgagaaggagacgaugcagaaccugaacgaccgccuggccagcuaccucgacaaggugcgggcccuggaggaggccaacaccgagcuggagaacaagauccgcgagugguacgagacccggggcaccgggacggcggacgccucccagagcgacuacuccaaguacuacccccucaucgaggaccugcgcaacaagaucaucagcgccuccaucggcaacgcccagcugcuccugcagaucgacaacgcccggcuggcggccgaggacuuccgcaugaaguacgagaacgagcucgcccugcggcagggggucgaggccgacaucaacggccugcgccgggugcucgacgagcugacccugacccgcaccgaccucgagaugcagaucgagagccugaacgaggagcuggccuacaugaagaagaaccacgaggacgagcuccaguccuuccgggugggcgggcccggcgaggucagcguggagauggacgcggccccggggguggaccugacgcgccugcucaacgacaugcgggcccaguacgagaccaucgccgagcagaaccgcaaggacgccgaggcgugguucaucgagaaguccggcgagcugcggaaggagaucagcaccaacaccgagcagcugcaguccagcaaguccgaggucacggaccuccgccgcgccuuccagaaccuggagaucgagcugcagagccagcucgccaugaagaagucccuggaggacagccuggccgaggccgagggggacuacugcgcgcagcucagccaggugcagcagcugaucuccaaccuggaggcccagcuccuccaggugcgggccgacgccgagcgccagaacgucgaccaccagcggcugcugaacgugaaggcgcgccuggagcuggagaucgagaccuaccggcgccugcucgacggcgaggcccagggcgacgggcuggaggagagccuguucgugaccgacuccaagagccaggcccaguccaccgacagcuccaaggaccccacgaagacccggaagaucaagaccgucgugcaggagauggugaacggcgaggucgugagcucccaggugcaggagaucgaggagcucauguga

SEQ ID NO: 32129 - RNA, 1263 nt, Artificial Sequence
  derived and/or modified sequence opt1 from KRT13__Homo_sapiens__NP_002265
augagccugcgccuccaguccagcuccgccagcuacggcgggggcuucgggggcggguccugccagcugggcggcgggcggggcgugagcacgugcuccacccgcuucgucagcgggggcuccgccgggggcuacggcgggggcgugagcugcggguucggcggcggggcgggcuccggguucggcgggggcuacggcgggggccucgggggcggguacggcggcgggcugggcgggggcuucgggggcggcuucgccgggggcuucguggacuucggggccugcgacggcggccugcugaccgggaacgagaagaucaccaugcagaaccucaacgaccggcuggccagcuaccuggagaagguccgcgcccucgaggaggcgaacgccgaccuggaggugaagauccgggacuggcaccugaagcagucccccgccagcccggagcgcgacuacucccccuacuacaagaccaucgaggagcuccgggacaagauccugaccgccacgaucgagaacaaccgcgugauccuggagaucgacaacgcgcggcucgccgccgacgacuuccgccugaaguacgagaacgagcuggcccuccggcagagcgucgaggccgacaucaacggccugcgccgggugcuggacgagcucacccuguccaagaccgaccuggagaugcagaucgagagccucaacgaggagcuggcguacaugaagaagaaccacgaggaggagaugaaggaguucuccaaccagguggucggccaggugaacguggagauggacgccacccccgggaucgaccugacgcgcguccucgccgagaugcgggagcaguacgaggccauggccgagcgcaaccggcgcgacgcggaggagugguuccacgccaagagcgccgagcugaacaaggaggugagcaccaacaccgccaugauccagaccuccaagacggagaucaccgagcugcggcgcacccuccaggggcuggagaucgagcugcagagccagcucuccaugaaggccggccuggagaacaccguggcggagacggagugccgguacgcccugcagcuccagcagauccagggccugaucagcuccaucgaggcccagcugagcgagcuccgcuccgagauggagugccagaaccaggaguacaagaugcugcuggacaucaagacccgccucgagcaggagaucgccaccuaccggagccugcuggaggggcaggacgccaagaagcgccagcccccguga

SEQ ID NO: 32130 - RNA, 1419 nt, Artificial Sequence
  derived and/or modified sequence opt1 from KRT14__Homo_sapiens__NP_000517
augacgaccugcagccgccaguucaccuccagcuccagcaugaagggcuccugcgggaucggcgggggcaucgggggcggcagcucccggaucagcuccgugcuggccgggggcagcugccgcgcccccuccaccuacgggggcgggcucagcguguccagcucccgguucagcuccggcggcgcguacgggcugggcgggggcuacggcgggggcuucagcuccagcagcuccagcuucggguccggcuucgggggcggcuacgggggcgggcugggcgccgggcucggcggcggguucggcgggggcuucgccgggggcgacggccugcugguggggagcgagaaggugaccaugcagaaccucaacgaccgccuggccuccuaccuggacaagguccgggcccucgaggaggcgaacgccgaccuggaggugaagauccgcgacugguaccagcggcagcgcccggccgagaucaaggacuacagccccuacuucaagaccaucgaggaccugcggaacaagauccucacggccaccguggacaacgcgaacguccugcugcagaucgacaacgcccgccucgccgccgacgacuuccggaccaaguacgagaccgagcugaaccugcgcauguccguggaggccgacaucaacggccuccggcgcgugcuggacgagcugacgcucgcgcgggccgaccuggagaugcagaucgagagccugaaggaggagcucgccuaccugaagaagaaccacgaggaggagaugaacgcccugcgcgggcaggucggcggcgacgugaacguggagauggacgccgcgcccggggucgaccucucccggauccugaacgagaugcgcgaccaguacgagaagauggccgagaagaaccggaaggacgccgaggagugguucuucaccaagaccgaggagcugaaccgcgagguggccaccaacagcgagcucgugcaguccggcaagagcgagaucuccgagcugcggcgcacgaugcagaaccuggagaucgagcuccagagccagcuguccaugaaggccagccuggagaacucccucgaggagaccaaggggcgcuacugcaugcagcuggcgcagauccaggagaugaucggcagcgucgaggagcagcuggcccagcuccggugcgagauggagcagcagaaccaggaguacaagauccugcuggacgugaagacccgccucgagcaggagaucgccaccuaccggcgccugcuggagggggaggacgcccaccucuccagcagccaguucuccagcggcucccagagcucccgggacgugacgagcuccagccgccagauccggaccaaggucauggacgugcacgacggcaagguggucuccacccacgagcagguccugcgcaccaagaacuga

SEQ ID NO: 32131 - RNA, 1371 nt, Artificial Sequence
  derived and/or modified sequence opt1 from KRT15__Homo_sapiens__NP_002266
augaccaccacguuccugcagaccagcuccagcaccuucggcgggggcuccacccgcgggggcagccuccuggccgggggcggcggguucggcgggggcucccugagcgggggcggcgggucccggagcaucuccgccagcuccgcgcgcuucgugagcuccggcagcgggggcggcuacgggggcgggaugcgggugugcggcuucgggggcggcgccggguccguguucggcgggggcuucgggggcggcgucgggggcggguucggcgggggcuucggcgggggcgacgggggccuccugagcggcaacgagaagaucacgaugcagaaccugaacgaccgccucgccuccuaccuggacaaggugcgggcccuggaggaggccaacgcggaccucgaggugaagauccacgacugguaccagaagcagacccccaccagcccggagugcgacuacucccaguacuucaagaccaucgaggagcugcgcgacaagaucauggccacgaccaucgacaacagccgggugauccuggagaucgacaacgcccgccucgccgcggacgacuuccggcugaaguacgagaacgagcuggcccuccgccagggggucgaggccgacaucaacggccugcggcgcgugcuggacgagcucacccuggcccggaccgaccuggagaugcagaucgaggggcucaacgaggagcuggccuaccugaagaagaaccacgaggaggagaugaaggaguucagcucccagcucgcgggccaggugaacgucgagauggacgccgcccccgggguggaccugacgcgcgugcuggccgagaugcgggagcaguacgaggccauggcggagaagaaccgccgggacgucgaggccugguucuucagcaagaccgaggagcucaacaaggagguggccuccaacaccgagaugauccagaccagcaagacggagaucaccgaccugcgccggaccaugcaggagcuggagaucgagcuccagucccagcugagcaugaaggccggccuggagaacucccucgccgagaccgagugccgcuacgcgacgcagcugcagcagauccagggccugaucgggggccucgaggcccagcugagcgagcugcggugcgagauggaggcccagaaccaggaguacaagaugcuccuggacaucaagacccgccuggagcaggagaucgccaccuaccgcucccuccuggaggggcaggacgccaagauggcgggcaucgggauccgggaggccagcuccggcggcgggggcagcuccagcaacuuccacaucaacguggaggaguccgucgacgggcaggucgugagcucccacaagcgcgagaucuga

SEQ ID NO: 32132 - RNA, 1422 nt, Artificial Sequence
  derived and/or modified sequence opt1 from KRT16__Homo_sapiens__NP_005548
augacgaccugcagccgccaguucaccuccagcuccagcaugaagggcuccugcgggaucggcgggggcaucgggggcggcagcucccggaucagcuccgugcuggccgggggcagcugccgcgcccccuccaccuacgggggcgggcucagcgucuccagccgguucuccagcggcggcgcgugcgggcugggcgggggcuacggcgggggcuucuccagcuccagcagcuucggguccggcuucgggggcggcuacgggggcgggcugggcgccggguucggcggcgggcucggcgccggguucggcgggggcuucgccggcggggacggccugcugguggggagcgagaaggugaccaugcagaaccucaacgaccgccuggccuccuaccuggacaagguccgggcgcucgaggaggccaacgccgaccuggaggugaagauccgcgacugguaccagcggcagcgcccgagcgagaucaaggacuacucccccuacuucaagaccaucgaggaccugcggaacaagaucaucgccgcgacgaucgagaacgcccagcccauccuccagaucgacaacgcccgccuggccgccgacgacuuccggaccaaguacgagcacgagcuggcgcuccgccagaccguggaggccgacgucaacggccugcggcgcgugcuggacgagcucacccuggcccggacggaccuggagaugcagaucgagggccucaaggaggagcuggccuaccugcgcaagaaccacgaggaggagaugcucgcccugcgggggcagaccggcggggacgugaacgucgagauggacgcggcccccggcguggaccugagccgcauccucaacgagaugcgggaccaguacgagcagauggccgagaagaaccgccgggacgccgagaccugguuccuguccaagaccgaggagcugaacaaggagguggccagcaacuccgagcucguccagagcucccgcagcgaggugacggagcugcgccgggugcugcaggggcucgagaucgagcugcagucccagcugagcaugaaggcgucccucgagaacagccuggaggagaccaagggccgcuacugcaugcagcugucccagauccagggccucaucgggagcgucgaggagcagcuggcccagcugcggugcgagauggagcagcagucccaggaguaccagauccuccuggacgugaagacccgccuggagcaggagaucgccaccuaccggcgccuccuggagggcgaggacgcccaccugagcagccagcaggccuccgggcagagcuacuccagccgggagguguucacguccagcuccagcuccagcucccgccagacccggccgauccucaaggagcagagcuccagcuccuucagccagggccaguccagcuga

SEQ ID NO: 32133 - RNA, 1299 nt, Artificial Sequence
  derived and/or modified sequence opt1 from KRT17__Homo_sapiens__NP_000413
augaccaccagcauccgccaguucacguccagcuccagcaucaagggcuccagcgggcugggcgggggcuccagccggaccuccugccgccucagcgggggccugggcgccggguccugccggcugggcagcgccgggggccucggguccacccugggcggcagcuccuacagcuccugcuacagcuucggguccggcgggggcuacggcagcagcuucgggggcguggacgggcugcucgcgggcggggagaaggccaccaugcagaaccugaacgaccgccuggccuccuaccucgacaagguccgggcccuggaggaggccaacacggagcuggaggugaagauccgcgacugguaccagcggcaggcgcccggcccggcccgcgacuacagccaguacuaccggaccaucgaggagcuccagaacaagauccugaccgccaccguggacaacgccaacauccugcuccagaucgacaacgcgcgccuggccgccgacgacuuccggacgaaguucgagaccgagcaggcccugcgccucuccgucgaggccgacaucaacggccugcggcgcgugcuggacgagcucacccuggcgcgggccgaccuggagaugcagaucgagaaccucaaggaggagcuggccuaccugaagaagaaccacgaggaggagaugaacgcccuccgcgggcaggucggcggggagaucaacguggagauggacgccgcgcccggcguggaccugagccggauccugaacgagaugcgcgaccaguacgagaagauggccgagaagaaccggaaggacgccgaggacugguucuucuccaagaccgaggagcucaaccgcgagguggccacgaacagcgagcugguccaguccggcaagagcgagaucuccgagcugcggcgcaccaugcaggcccucgagaucgagcugcagagccagcuguccaugaaggcgagccucgaggggaaccuggccgagaccgagaaccgcuacugcgugcagcugucccagauccagggccucaucgggagcguggaggagcagcuggcccagcugcggugcgagauggagcagcagaaccaggaguacaagauccuccuggacgucaagacccgccuggagcaggagaucgccacguaccggcgccuccuggagggcgaggacgcccaccugacccaguacaagaaggagcccgugaccacccgccaggugcggacgaucgucgaggaggugcaggacgggaaggugaucuccagccgggagcagguccaccagaccacccgcuga

SEQ ID NO: 32134 - RNA, 1293 nt, Artificial Sequence
  derived and/or modified sequence opt1 from KRT18__Homo_sapiens__NP_000215
augagcuucaccacccgcuccacguucagcaccaacuaccggucccugggcagcgugcaggcccccuccuacggggcccgcccggucagcuccgcggccagcguguacgccggcgccgggggcuccgggagccggaucuccgugagccgcuccaccagcuuccggggcggcaugggguccggcgggcucgccaccggcaucgccgggggccuggcgggcaugggcgggauccagaacgagaaggagacgaugcagagccugaacgaccgccucgccuccuaccuggaccggguccgcagccuggagaccgagaaccggcgccucgaguccaagauccgggagcaccuggagaagaaggggccccaggugcgcgacuggagccacuacuucaagaucaucgaggaccugcgggcccagaucuucgcgaacaccguggacaacgcccgcaucguccuccagaucgacaacgcccggcuggccgccgacgacuuccgcgugaaguacgagaccgagcuggcgaugcggcagagcguggagaacgacauccacggccuccgcaaggucaucgacgacacgaacaucacccggcugcagcuggagaccgagaucgaggcccucaaggaggagcugcuguucaugaagaagaaccacgaggaggaggugaagggccuccaggcccagaucgccuccagcgggcugaccguggaggucgacgcccccaagucccaggaccuggcgaagaucauggccgacauccgcgcccaguacgacgagcucgcccggaagaaccgcgaggagcuggacaaguacuggagccagcagaucgaggaguccacgaccguggugaccacccagagcgccgaggucggcgcggccgagacgacccugaccgagcuccgccggaccgugcagucccuggagaucgaccuggacagcaugcgcaaccucaaggccucccuggagaacagccugcgggagguggaggcccgcuacgcccuccagauggagcagcugaacgggauccugcuccaccuggaguccgagcuggcgcagacgcgggccgagggccagcgccaggcccaggaguacgaggcccuccugaacaucaaggucaagcuggaggcggagaucgccaccuaccggcgccuccuggaggacggggaggacuucaaccugggcgacgcccucgacagcuccaacagcaugcagaccauccagaagaccacgacccggcgcaucguggacggcaagguggucuccgagaccaacgacaccaaggugcugcggcacuga

SEQ ID NO: 32135 - RNA, 1203 nt, Artificial Sequence
  derived and/or modified sequence opt1 from KRT19__Homo_sapiens__NP_002267
augaccagcuacuccuaccgccagagcuccgccaccagcuccuucggcgggcugggcgggggcagcgugcgguucgggcccggcgucgccuuccgcgcgccguccauccacggcgggagcggcgggcggggcguguccgugagcuccgcccgcuucgucagcuccagcuccagcggggccuacggcggcggguacggcggggugcucacggccuccgacggccugcuggccggcaacgagaagcucaccaugcagaaccugaacgaccggcuggcgagcuaccucgacaaggugcgcgcccuggaggccgccaacggggagcuggaggucaagauccgggacugguaccagaagcagggccccgggcccucccgcgacuacagccacuacuacaccaccauccaggaccuccgggacaagauccugggcgcgacgaucgagaacagccgcaucgugcugcagaucgacaacgcccggcucgccgccgacgacuuccgcaccaaguucgagaccgagcaggcccugcggauguccguggaggcggacaucaacgggcugcgccggguccucgacgagcugacccuggcccgcacggaccucgagaugcagaucgagggccugaaggaggagcuggccuaccucaagaagaaccacgaggaggagaucagcacccugcggggccaggucgggggccagguguccguggagguggacagcgcccccgggaccgaccuggccaagauccucuccgacaugcgcagccaguacgaggugauggcggagcagaaccggaaggacgccgaggccugguucaccucccgcacggaggagcugaaccgggaggucgccggccacaccgagcagcugcagaugagccgcuccgaggugaccgaccuccgccggacccugcaggggcuggagaucgagcuccagagccagcuguccaugaaggccgcgcuggaggacacgcucgccgagaccgaggcccgcuucggcgcccagcuggcccacauccaggcgcugaucagcggcaucgaggcccagcucggggacgugcgggccgacuccgagcgccagaaccaggaguaccagcggcugauggacaucaagagccgccuggagcaggagaucgccaccuaccggucccuccuggagggccaggaggaccacuacaacaaccugagcgcguccaagguccucuga

SEQ ID NO: 32136 - RNA, 1935 nt, Artificial Sequence
  derived and/or modified sequence opt1 from KRT1__Homo_sapiens__NP_006112
augagccgccaguucuccagccgguccggcuaccgcagcgggggcggguucuccagcggcuccgccgggaucaucaacuaccagcggcgcaccaccagcuccagcacgcggcgcuccggcggcgggggcgggcgguucagcuccugcggcgggggcggcgggagcuucggcgccgggggcggcuucgggucccgcagccuggugaaccucggcggguccaagagcaucuccaucagcgucgcgcggggcgggggccgcggcagcggguucggcgggggcuacgggggcggcggguucggcgggggcggguucggcggcgggggcuucgggggcggcgggaucggcgggggcggguucggcggcuucggguccggcgggggcggguucggcggcgggggcuucgggggcgggggcuacggcgggggcuacgggcccgugugcccgcccggcgggauccaggaggugaccaucaaccagagccugcugcagccccucaacgucgagaucgaccccgagauccagaaggugaagucccgggagcgcgagcagaucaagagccugaacaaccaguucgccuccuucaucgacaaggugcgguuccuggagcagcagaaccagguccuccagaccaagugggagcugcugcagcaggucgacaccagcacgcgcacccacaaccucgagccguacuucgaguccuucaucaacaaccugcggcgccggguggaccagcucaagagcgaccagucccgccuggacagcgagcugaagaacaugcaggacaugguggaggacuaccggaacaaguacgaggacgagaucaacaagcgcaccaacgccgagaacgaguucgugaccaucaagaaggacguggacggcgccuacaugacgaaggucgaccugcaggccaagcucgacaaccugcagcaggagaucgacuuccugaccgcgcucuaccaggccgagcugucccagaugcagacccagaucagcgagaccaacgugauccuguccauggacaacaaccggagccucgaccuggacuccaucaucgccgaggugaaggcccaguacgaggacaucgcgcagaaguccaaggccgaggccgagagccuguaccagagcaaguacgaggagcuccagaucacggccggccgccacggggacuccguccgcaacagcaagaucgagaucagcgagcugaaccgggugauccagcgccugcgguccgagaucgacaacgugaagaagcagaucagcaaccuccagcaguccaucagcgacgccgagcagcgcggcgagaacgcgcugaaggacgccaagaacaagcugaacgaccucgaggacgcccugcagcaggccaaggaggaccuggcccggcuccugcgcgacuaccaggagcugaugaacaccaagcucgcgcuggaccuggagaucgccaccuaccggacccuccuggagggggaggagucccgcaugagcggcgagugcgcccccaacgucuccgugagcguguccacgagccacaccaccaucuccggcgggggcagccgcgggggcgggggcggcggguacggcuccgggggcagcuccuacgggagcggcggcggguccuacggcagcgggggcgggggcggcgggggccgggggagcuacggcuccggcgggagcuccuacggcagcgggggcggguccuacggcagcggcgggggcgggggcgggcacggcuccuacggcagcggguccagcuccggcggguaccggggcgggagcggcggcgggggcgggggcuccagcgggggccgcggcuccgggggcgggagcuccggcggcagcaucgggggccggggguccagcagcggcggggucaaguccagcggcggcuccagcuccgugaaguucgugagcaccacguacuccggggucacccgcuga

SEQ ID NO: 32137 - RNA, 1275 nt, Artificial Sequence
  derived and/or modified sequence opt1 from KRT20__Homo_sapiens__NP_061883
auggacuucagccgccgguccuuccaccgcagccuguccagcucccuccaggcccccguggucagcaccgugggcaugcagcggcuggggaccacgccguccguguacggcggggccggcgggcgcggcauccggaucagcaacucccgccacaccgucaacuacggcagcgaccugaccgggggcggggaccucuucgugggcaacgagaagauggcgaugcagaaccugaacgaccggcuggccuccuaccucgagaaggugcgcacccuggagcagagcaacuccaagcuggagguccagaucaagcagugguacgagacgaacgcgccccgggccgggcgcgacuacagcgccuacuaccggcagaucgaggagcuccgcucccagaucaaggacgcccagcugcagaacgcccggugcgugcugcagaucgacaacgccaagcucgccgcggaggacuuccgccugaaguacgagaccgagcggggcauccgccugaccguggaggccgaccuccagggccugaacaaggucuucgacgaccugacccuccacaagacggaccuggagauccagaucgaggagcugaacaaggaccucgcccugcugaagaaggagcaccaggaggagguggacgggcuccacaagcaccugggcaacaccgugaacgucgagguggacgccgcccccgggcugaaccucggcgugaucaugaacgagaugcggcagaaguacgaggucauggcgcagaagaaccugcaggaggccaaggagcaguucgagcgccagaccgccgugcugcagcagcaggucaccgugaacacggaggagcucaagggcaccgaggugcagcugaccgagcugcggcgcaccagccagucccucgagaucgagcugcagagccaccuguccaugaaggagagccucgagcacacgcuggaggagaccaaggcccgguacagcucccagcuggccaaccuccagagccugcuguccagccucgaggcgcagcugaugcagauccgcuccaacauggagcgccagaacaacgaguaccacauccugcucgacaucaagacccggcuggagcaggagaucgccaccuaccgccggcugcucgagggggaggacgugaagacgaccgaguaccagcugagcacccuggaggagcgcgacaucaagaagacccggaagaucaagacggucgugcaggagguggucgacggcaagguggucuccagcgaggugaaggagguggaggagaacaucuga

SEQ ID NO: 32138 - RNA, 1269 nt, Artificial Sequence
  derived and/or modified sequence opt1 from KRT23__Homo_sapiens__NP_056330
augaacagcggccacuccuucagccagacccccuccgccagcuuccacggggccggcgggggcugggggcgcccgcgguccuucccccgcgcgcccaccgugcacggcggcgccgggggcgcccggaucagccuguccuucacgacccgcagcugcccgccgcccgggggcuccugggggagcggccgguccagcccccuccugggcgggaacggcaaggccaccaugcagaaccugaacgaccgccucgccuccuaccuggagaagguccgggcgcuggaggaggccaacaugaagcucgagagccgcauccugaaguggcaccagcagcgggaccccggguccaagaaggacuacagccaguacgaggagaacaucacccaccuccaggagcagaucguggacggcaagaugacgaacgcccagaucauccugcugaucgacaacgcccgcauggcgguggacgacuucaaccugaaguacgagaacgagcacuccuucaagaaggaccucgagaucgaggucgagggccugcggcgcacccuggacaaccucaccaucgugaccacggaccuggagcaggagguggaggggaugcggaaggagcugauccucaugaagaagcaccacgagcaggagauggagaagcaccacguccccagcgacuucaacgugaacgugaaggucgacaccggcccccgcgaggaccugaucaaggugcuggaggacaugcggcaggaguacgagcucaucaucaagaagaagcaccgcgaccuggacaccugguacaaggagcaguccgccgccaugagccaggaggccgccagccccgcgaccgugcagucccggcagggggacauccacgagcugaagcgcacguuccaggcccucgagaucgaccugcagacccaguacagcaccaaguccgcccuggagaacaugcucagcgagacccagucccgguacagcugcaagcugcaggacaugcaggagaucaucucccacuacgaggaggagcugacgcagcuccgccacgagcuggagcggcagaacaacgaguaccagguccugcucggcaucaagacccaccuggagaaggagaucaccaccuaccgccgccugcucgagggggagagcgagggcacgcgggaggaguccaagagcuccaugaaggugagcgccacccccaagaucaaggccaucacccaggagaccaucaacggccgccuggugcugugccaggucaacgagauccagaagcacgcguga

SEQ ID NO: 32139 - RNA, 1920 nt, Artificial Sequence
  derived and/or modified sequence opt1 from KRT2__Homo_sapiens__NP_000414
augagcugccagaucuccugcaagagccgcggccgcgggggcgggggcgggggcuuccggggcuucuccagcggguccgccguggucagcggcgggucccggcgcagcaccuccagcuucuccugccugagccggcacggcgggggcggcgggggcuucgggggcggcggguucggcucccgcagccucguggggcugggcgggaccaaguccaucagcaucuccguggccggcggcgggggcggguucggcgcggccgggggcuucggcgggcggggcgggggcuucgggggcggcagcuccuucgggggcgggagcggcuucagcggcgggggcuucgggggcgggggcuucggcgggggccgcuucgggggcuucgggggccccggcggggucggcgggcugggcgggccgggcggcuucgggcccggcggguaccccggcgggauccacgagguguccgugaaccagagccuccugcagccccugaacgucaagguggacccggagauccagaacgugaaggcccaggagcgggagcagaucaagacgcucaacaacaaguucgccuccuucaucgacaagguccgcuuccuggagcagcagaaccaggugcugcagaccaagugggagcuccugcagcagaugaacgugggcacccggcccaucaaccuggagcccaucuuccagggcuacaucgacagccucaagcgcuaccuggacgggcugaccgccgagcggacgucccagaacagcgagcucaacaacaugcaggaccuggucgaggacuacaagaagaaguacgaggacgagaucaacaagcgcaccgcggccgagaacgacuucgugacccugaagaaggacguggacaacgccuacaugaucaaggucgagcuccaguccaagguggaccugcugaaccaggagaucgaguuccucaaggugcuguacgacgccgagaucagccagauccaccaguccgucaccgacacgaacgugauccugagcauggacaacucccggaaccucgaccuggacagcaucaucgcggaggugaaggcccaguacgaggagaucgcccagcgcuccaaggaggaggccgaggcccuguaccacagcaaguacgaggagcuccaggucaccgugggccggcacggggacucccugaaggagaucaagaucgagaucagcgagcugaaccgcgugauccagcggcuccagggcgagaucgcgcacgucaagaagcagugcaagaacgugcaggacgccaucgccgacgccgagcagcgcggcgagcacgcccugaaggacgcgcggaacaagcugaacgaccucgaggaggcccugcagcaggccaaggaggaccuggcccgccuccugcgcgacuaccaggagcugaugaacgucaagcucgcccuggacguggagaucgcgaccuaccggaagcugcucgagggggaggagugccgcauguccggcgaccugagcuccaacgugaccgucagcgugacgagcuccaccaucagcuccaacguggccagcaaggccgccuucgggggcuccgggggccggggcagcuccagcgggggcggguacuccagcggcuccagcuccuacgggagcggcggccgccaguccgggagccggggcggguccggcgggggcggcagcaucagcgggggcggguacggcuccggcgggggcagcgggggccgcuacggguccggcggcgggagcaagggcggguccaucagcggcgggggcuacggcuccgggggcgggaagcacagcuccggcgggggcagccggggcggguccagcuccggcgggggcuacgggagcggcggcgggggcuccagcuccgucaaggggagcuccggcgaggccuucggcagcagcgugaccuucuccuuccgcuga

SEQ ID NO: 32140 - RNA, 1251 nt, Artificial Sequence
  derived and/or modified sequence opt1 from KRT31__Homo_sapiens__NP_002268
augcccuacaacuucugccugccgagccucuccugccgcaccagcugcuccagccggcccugcgugccgcccuccugccacagcugcacccugcccggcgccugcaacauccccgccaacgucuccaacugcaacugguucugcgaggggagcuucaacggcuccgagaaggagacgaugcaguuccugaacgaccgccucgcgagcuaccuggagaaggugcggcagcuggagcgcgacaacgccgagcucgagaaccugauccgggagcgcucccagcagcaggagccccugcucugccccagcuaccaguccuacuucaagaccaucgaggagcugcagcagaagauccugugcaccaagagcgagaacgcccggcucgugguccagaucgacaacgccaagcuggccgcggacgacuuccgcaccaaguaccagacggagcugucccuccggcagcugguggagagcgacaucaacgggcugcgccggauccucgacgagcugacccugugcaaguccgaccucgaggcccagguggagagccugaaggaggagcugcucugccugaaguccaaccacgagcaggaggucaacacccugcgcugccagcucggcgaccggcugaacguggagguggacgccgccccgaccgucgaccugaaccgcgugcucaacgagacgcggagccaguacgaggcgcugguggagaccaaccgccgggaggucgagcagugguucaccacccagacggaggagcugaacaagcaggucgugagcuccagcgagcagcuccaguccuaccaggccgagaucaucgagcugcgccggaccgugaacgcccuggagaucgagcuccaggcccagcacaaccugcgcgacagccuggagaacacccucaccgaguccgaggcccgguacagcucccagcugagccaggugcagucccugaucacgaacguggagagccagcucgcggagauccgcuccgaccuggagcgccagaaccaggaguaccagguccugcucgacgugcgggcccgccuggagugcgagaucaacaccuaccggagccugcucgaguccgaggacugcaaccugcccagcaaccccugcgccaccaccaacgccugcuccaagcccaucgggccgugccugagcaaccccugcacguccugcgugccgcccgcccccugcacccccugcgcgccccgcccccggugcggcccgugcaacagcuucguccgcuga

SEQ ID NO: 32141 - RNA, 1347 nt, Artificial Sequence
  derived and/or modified sequence opt1 from KRT32__Homo_sapiens__NP_002269
augaccagcuccugcugcgugaccaacaaccugcaggccagccucaaguccugcccccgcccggccagcgucugcuccagcggcgugaacugccggcccgagcugugccugggguacgugugccagcccauggcgugccuccccuccgucugccugccgacgaccuuccgccccgccagcugccuguccaagaccuaccucagcuccagcugccaggccgccuccggcaucagcggguccaugggccccgggagcugguacuccgagggcgccuucaacggcaacgagaaggagaccaugcaguuccugaacgaccggcuggcgagcuaccucacgcgcgugcggcagcuggagcaggagaacgccgagcuggagucccgcauccaggaggccagccacagccaggugcucaccaugacccccgacuaccagucccacuuccggaccaucgaggagcugcagcagaagauccugugcacgaaggccgagaacgcgcgcauggucgugaacaucgacaacgccaagcucgccgccgacgacuuccgggccaaguacgaggcggagcuggccaugcgccagcugguggaggccgacaucaacgggcuccggcgcauccuggacgaccugacccucugcaaggccgaccuggaggcccaggucgagagccugaaggaggagcucaugugccugaagaagaaccacgaggaggaggugggcucccugcggugccagcucggggaccgccugaacaucgagguggacgcggccccgcccgucgaccugacccgggugcucgaggagaugcgcugccaguacgaggccaugguggaggccaaccggcgcgacgucgaggagugguucaacaugcagauggaggagcugaaccagcaggucgccaccagcuccgagcagcugcagaacuaccagagcgacaucaucgaccuccggcgcacggugaacacccuggagaucgagcugcaggcgcagcacucccuccgggacagccuggagaacacccugaccgaguccgaggcccgcuacagcucccagcucgcccagaugcagugcaugaucacgaacguggaggcccagcuggccgagauccgcgcggaccuggagcggcagaaccaggaguaccaggugcuccuggacgugcgcgcccggcuggagggcgagaucaacaccuaccgcagccuccuggagaacgaggacugcaagcugcccugcaaccccugcuccaccccgagcugcaccacgugcguccccucccccugcgugccccggaccgugugcgucccgcgcaccguggggaugcccugcagccccugcccccagggccgguacuga

SEQ ID NO: 32142 - RNA, 1311 nt, Artificial Sequence
  derived and/or modified sequence opt1 from KRT34__Homo_sapiens__NP_066293
augcuguacgccaagcccccgcccaccaucaacggcaucaaggggcuccagcgcaaggagcggcugaagcccgcccacauccaccuccagcagcugaccugcuucagcaucacgugcuccagcaccauguccuacagcugcugccugcccucccugggcugccgcaccagcugcuccagccggccgugcgugccgcccuccugccacggguacacccuccccggcgcgugcaacauccccgccaacgucagcaacugcaacugguucugcgagggguccuucaacggcagcgagaaggagacgaugcaguuccugaacgaccgccuggccuccuaccucgagaaggugcggcagcuggagcgcgacaacgccgagcuggagaagcucauccaggagcggagccagcagcaggagccccugcugugccccuccuaccagagcuacuucaagaccaucgaggagcuccagcagaagauccugugcgccaaggcggagaacgcccgccugguggucaacaucgacaacgccaagcucgccuccgacgacuuccggagcaaguaccagaccgagcagucccugcgccugcucguggagagcgacaucaacagcauccggcgcauccuggacgagcugacccucugcaaguccgaccuggagagccagguggagucccugcgggaggagcucaucugccugaagaagaaccacgaggaggaggucaacacgcugcgcagccagcucggcgaccggcugaacguggagguggacaccgcgcccaccgucgaccugaaccaggugcucaacgagacccgcucccaguacgaggcccugguggagaucaaccggcgcgaggucgagcagugguucgccacgcagaccgaggagcugaacaagcaggucgugagcuccagcgagcagcuccaguccugccaggccgagaucaucgagcugcggcgcaccgugaacgcccuggagaucgagcuccaggcgcagcacaaccugcgggacagccuggagaacacccucacggaguccgaggcccacuacagcucccagcugagccaggugcagucccugaucaccaacguggagagccagcucgccgagauccgcugcgaccuggagcgccagaaccaggaguaccagguccugcucgacgugcgggcccgccuggagugcgagaucaacaccuaccggucccugcuggagagcgaggacugcaagcucccgugcaaccccugcgccaccacgaacgcguccgggaacagcugcggccccugcgggaccagccagaagggcugcugcaacuga

SEQ ID NO: 32143 - RNA, 1368 nt, Artificial Sequence
  derived and/or modified sequence opt1 from KRT35__Homo_sapiens__NP_002271
auggccagcaagugccugaaggccggcuucuccagcgggucccucaagagccccggcggggcguccggcgggagcacccgcguguccgccauguacagcuccagcuccugcaagcugccgagccugucccccgucgcccggagcuucuccgccugcagcgugggccucggccgcuccagcuaccgggccaccuccugccugcccgcgcugugccuccccgccgggggcuucgccacgagcuacagcgggggcgggggcugguucggcgaggggauccugaccggcaacgagaaggagaccaugcagucccugaacgaccgccucgccggguaccuggagaaggugcggcagcuggagcaggagaacgcgagccucgagucccgcauccgggaguggugcgagcagcaggucccguacaugugccccgacuaccagagcuacuuccgcaccaucgaggagcugcagaagaagacgcugugcuccaaggccgagaacgcccggcucgugguggagaucgacaacgccaagcuggccgcggacgacuuccgcaccaaguacgagaccgaggucagccugcggcagcucguggaguccgacaucaacggccugcgccggauccuggacgaccucacccugugcaagagcgaccuggaggcccagguggagucccucaaggaggagcugcugugccucaagaagaaccacgaggaggaggucaacagccugcgcugccagcugggcgaccggcucaacguggagguggacgccgccccgcccgucgaccugaaccgcgugcuggaggagaugcggugccaguacgagacgcucguggagaacaaccgccgggacgccgaggacuggcuggacacccaguccgaggagcugaaccagcaggucgugagcuccagcgagcagcuccaguccugccaggcggagaucaucgagcugcgccggaccgugaacgcccuggagaucgagcuccaggcccagcacagcaugcgcgacgcccuggaguccacccuggccgagacggaggcgcgcuacagcucccagcucgcccagaugcagugcaugaucaccaacgucgaggcccagcuggccgagauccgggccgaccuggagcgccagaaccaggaguaccaggugcuccuggacgugcgggcgcgccuggagugcgagaucaacaccuaccgggggcuccuggagagcgaggacagcaagcugcccugcaaccccugcgcccccgacuacucccccagcaaguccugccugccgugccuccccgccgccagcugcggccccuccgcggcccgcaccaacugcagcccccggccgaucugcguccccugccccgggggccgcuucuga

SEQ ID NO: 32144 - RNA, 1887 nt, Artificial Sequence
  derived and/or modified sequence opt1 from KRT3__Homo_sapiens__NP_476429
augagccgccaggccuccaagaccagcggcgggggcucccagggguucagcggccgguccgccguggucagcggguccagccgcauguccugcguggcgcacagcggcggcgccgggggcggggccuacggcuuccgguccggggccggcggcuucgggagccgcucccuguacaaccucggcgggaacaagagcaucuccaucagcguggccgcgggcggcucccgggccgggggcuucgggggcgggcgcagcuccugcgccuucgccggcggcuacgggggcggguucggcagcggguacggcggcggguucggcgggggcuucgggggcggccgggggaugggcgggggcuucggcggggcgggcggguucggcggggccggcggcuucgggggcgccgggggcuucgggggccccggcggguucggcgggagcggcggguucggcggcccggggucccugggcagccccgggggcuucgggcccggcggcuuccccgggggcauccaggaggucaccaucaaccagucccugcuccagccgcugaacguggagaucgacccccagaucggccaggugaaggcccaggagcgcgagcagaucaagacgcugaacaacaaguucgccagcuucaucgacaagguccgguuccucgagcagcagaacaaggugcuggagaccaaguggaaccugcuccagcagcaggggaccuccagcaucuccggcaccaacaaccuggagccccuguucgagaaccacaucaacuaccuccgcagcuaccuggacaacauccugggggagcggggccgccucgacuccgagcugaagaacauggaggaccugguggaggacuucaagaagaaguacgaggacgagaucaacaagcggacggcggccgagaacgaguucgucacccucaagaaggacguggacagcgccuacaugaacaagguggagcugcaggccaaggucgacgcccugaucgacgagaucgacuuccuccgcacccuguacgacgcggagcugucccagaugcagagccacaucuccgacaccagcguggugcucuccauggacaacaaccggagccuggaccuggacuccaucaucgccgagguccgcgcccaguacgaggacaucgcccagcggagcaaggccgaggcggaggcccucuaccagacgaagcugggggagcugcagaccaccgccggccgccacggggacgaccuccggaacaccaaguccgagaucaucgagcugaaccgcaugauccagcggcugcgcgccgagaucgagggcgugaagaagcagaacgccaaccuccagacggcgaucgccgaggccgagcagcacggcgagauggcccugaaggacgcgaacgccaagcugcaggagcuccaggccgcccugcagcaggccaaggacgaccuggcgcgccuccugcgggacuaccaggagcugaugaacgugaagcucgcccuggacgucgagaucgccaccuaccgcaagcugcucgagggggaggaguaccggaugagcggcgagugccccagcgccguguccaucagcguggucuccagcuccaccaccagcgccuccgcgggcggguacgggggcggcuacgggggcgggaugggcgggggccugggcgggggcuucagcgccgggggcggcuccgggagcggcuucgggcgcggcgggggcggcgggaucggcgggggcuucgggggcggcuccagcggguucuccggcgggagcggcuucggguccaucagcggcgcccgguacggcguguccgggggcggguucagcagcgccuccaaccgcggcgggagcaucaaguucucccagagcucccagagcucccagcgguacagccgcuga

SEQ ID NO: 32145 - RNA, 1563 nt, Artificial Sequence
  derived and/or modified sequence opt1 from KRT4__Homo_sapiens__NP_002263
augaucgcccgccagcagugcgugcggggcgggccccgcggcuucagcugcggguccgccaucgucggcgggggcaagcggggcgcguucagcuccgugagcauguccgggggcgccgggcgcugcagcuccggcggguucggcagccggucccuguacaaccuccgcggcaacaagagcaucuccaugagcguggccgggucccggcagggcgccugcuucgggggcgccggcggguucggcaccgggggcuucgggggcggcuucgggggcagcuucuccgggaagggcgggccgggcuuccccgucugccccgcgggcgggauccaggaggugaccaucaaccagagccugcugacgccccuccacguggagaucgacccggagauccagaagguccgcaccgaggagcgggagcagaucaagcugcugaacaacaaguucgccuccuucaucgacaaggugcaguuccucgagcagcagaacaaggugcuggagaccaaguggaaccugcuccagcagcagaccacgaccaccagcuccaagaaccuggagccccuguucgagaccuaccucagcguccugcgcaagcagcuggacacgcucggcaacgacaaggggcggcugcagagcgagcugaagaccaugcaggacuccguggaggacuucaagaccaaguacgaggaggagaucaacaagcgcaccgccgccgagaacgacuucgugguccucaagaaggacguggacgcggccuaccugaacaagguggagcuggaggccaaggucgacagccucaacgacgagaucaacuuccugaaggugcuguacgacgccgagcucucccagaugcagacgcacgugagcgacaccuccgucgugcugagcauggacaacaaccggaaccuggaccucgacuccaucaucgccgaggugcgcgcgcaguacgaggagaucgcccagcggagcaaggccgaggccgaggcccuguaccagaccaagguccagcagcugcagaucuccguggaccagcacggcgacaaccucaagaacaccaagagcgagaucgcggagcugaaccgcaugauccagcggcugcgcgccgagaucgagaacaucaagaagcagugccagacgcuccagguguccgucgccgacgccgagcagcgcggggagaacgcccugaaggacgcgcacagcaagcggguggagcuggaggccgcccuccagcaggccaaggaggagcuggcccggaugcugcgcgaguaccaggagcucauguccgucaagcuggcgcuggacaucgagaucgccaccuaccgcaagcuccuggagggcgaggaguaccggaugagcggcgagugccaguccgccgugagcaucuccguggucagcggguccaccagcaccggcgggaucagcggcggccugggguccggcagcggguucggccucuccagcggguucggcuccggcagcggguccggcuucggguucggcgggagcguguccggcagcuccagcuccaagaucaucagcacgaccacccugaacaagcgccgguga

SEQ ID NO: 32146 - RNA, 1773 nt, Artificial Sequence
  derived and/or modified sequence opt1 from KRT5__Homo_sapiens__NP_000415
augagccgccaguccagcguguccuuccggagcggcgggucccgcagcuucuccaccgccagcgccaucacccccuccgucagccggacguccuucaccagcgugucccgcagcggcgggggcgggggcggcggguucggccgggugucccuggcgggggccugcggcgucgggggcuacggcagccgcucccucuacaaccucgggggcagcaagcggaucuccaucagcaccagcgggggcuccuuccgcaaccgguucggcgccggggccggcgggggcuacggguucggcggcggggccggcagcggguucggcuucgggggcggcgccgggggcggguucggccucgggggcggcgcgggguucggcgggggcuucggcgggccgggcuuccccgugugcccgcccgggggcauccaggaggugaccgucaaccagucccugcugacgccccugaaccugcagaucgaccccagcauccagcgcgugcggaccgaggagcgcgagcagaucaagacccugaacaacaaguucgccuccuucaucgacaaggugcgguuccuggagcagcagaacaagguccucgacaccaaguggacgcugcugcaggagcaggggaccaagaccgugcgccagaaccucgagccccuguucgagcaguacaucaacaaccugcggcgccagcucgacagcaucgugggcgagcggggccgccuggacuccgagcugcggaacaugcaggaccucgucgaggacuucaagaacaaguacgaggacgagaucaacaagcgcaccacggccgagaacgaguucgugaugcugaagaaggacguggacgcggccuacaugaacaaggucgagcuggaggccaagguggacgcccucauggacgagaucaacuucaugaagauguucuucgacgccgagcugagccagaugcagacccacguguccgacaccagcgucgugcuguccauggacaacaaccggaaccucgaccuggacagcaucaucgcggaggugaaggcccaguacgaggagaucgccaaccgcucccgcaccgaggccgagagcugguaccagacgaaguacgaggagcugcagcagaccgccgggcggcacggcgacgaccuccgcaacaccaagcacgagaucuccgagaugaaccggaugauccagcgccugcgggcggagaucgacaacgucaagaagcagugcgccaaccugcagaacgccaucgccgacgccgagcagcgcggggagcucgcgcugaaggacgcccggaacaagcuggccgagcucgaggaggcccugcagaaggccaagcaggacauggcgcgccugcuccgggaguaccaggagcugaugaacaccaagcuggcccucgacguggagaucgccacguaccgcaagcugcuggagggcgaggagugccggcucagcggggagggcgugggccccgucaacaucuccguggucaccagcuccgugagcagcggguacggcuccgggagcggcuacgggggcggccucgggggcgggcugggcgggggccugggcgggggccuggccgggggcuccagcggcuccuacuacagcuccagcuccgggggcguggggcugggcgggggccucagcgucggcggguccggcuucagcgcguccagcgggcgcggccugggggugggcuucggcuccgggggcgggagcuccagcagcgugaaguucgucuccaccaccagcuccagccggaaguccuucaagagcuga

SEQ ID NO: 32147 - RNA, 1695 nt, Artificial Sequence
  derived and/or modified sequence opt1 from KRT6A__Homo_sapiens__NP_005545
auggccagcaccuccaccacgauccgcagccacuccagcucccggcgcggcuucagcgccaacuccgcgcggcugcccggggugagccgcuccggcuucagcuccgugagcgugucccggagccgcggguccggcgggcucggcggcgccugcgggggcgccggguucggcagccggucccuguacgggcugggcggcagcaagcgcaucuccaucgggggcgggagcugcgccaucagcggcggcuacgggucccgggccggcgggagcuacggcuucgggggcgcgggcuccggguucggcuucgggggcggggccggcaucggcuucgggcucggcgggggcgccgggcuggccggcggcuucgggggcccgggguuccccgugugcccgcccggcggcauccaggaggucaccgugaaccagagccugcucacgccccugaaccugcagaucgaccccaccauccagcgcgugcgggcggaggagcgcgagcagaucaagacccucaacaacaaguucgccuccuucaucgacaagguccgguuccuggagcagcagaacaaggugcuggagaccaaguggacccuccugcaggagcaggggaccaagacggugcgccagaaccuggagccccucuucgagcaguacaucaacaaccugcggcgccagcuggacagcaucgucggcgagcgggggcgccucgacuccgagcugcggggcaugcaggaccugguggaggacuucaagaacaaguacgaggacgagaucaacaagcgcaccgccgccgagaacgaguucgugacccucaagaaggacgucgacgccgcguacaugaacaagguggagcugcaggccaaggccgacacccugacggacgagaucaacuuccuccgggcccuguacgacgccgagcugagccagaugcagacccacaucuccgacaccagcgugguccucuccauggacaacaaccgcaaccuggaccuggacagcaucaucgcggaggugaaggcccaguacgaggagaucgcccagcgcucccgggccgaggccgagagcugguaccagaccaaguacgaggagcuccaggugacggcggggcgccacggcgacgaccugcggaacaccaagcaggagaucgccgagaucaaccgcaugauccagcggcugcgcuccgagaucgaccacgucaagaagcagugcgccaaccuccaggccgccaucgcggacgccgagcagcggggcgagauggcccugaaggacgccaagaacaagcuggaggggcucgaggacgcgcugcagaaggccaagcaggaccuggcccgccuccugaaggaguaccaggagcugaugaacgugaagcucgcccuggacguggagaucgccaccuaccggaagcugcucgagggcgaggagugccgccugaacggggagggcgucggccaggugaacaucagcgugguccaguccaccgugagcuccggguacggcggggcgagcggcgucgggagcggccuggggcucggcggcggguccagcuacuccuacggcagcgggcugggcgucgggggcggcuucuccagcuccagcgggcgggccaucggcgggggccuguccagcgugggcgggggcuccagcacgaucaaguacaccaccaccuccagcuccagccgcaaguccuacaagcacuga

SEQ ID NO: 32148 - RNA, 1695 nt, Artificial Sequence
  derived and/or modified sequence opt1 from KRT6B__Homo_sapiens__NP_005546
auggccagcaccuccaccacgauccgcagccacuccagcucccggcgcggcuucagcgccaacuccgcgcggcugcccggggugagccgcuccggcuucagcuccaucagcgucucccggagccgcggguccggcgggcugggcggcgccugcgggggcgccggguucggcagccggucccuguacgggcugggcggcagcaagcgcaucuccaucgggggcgggagcugcgccaucagcggcggcuacgggucccgggccggcgggagcuacggcuucgggggcgcgggcuccggguucggcuucgggggcggggccggcaucggcuucgggcucggcgggggcgccgggcuggccggcggcuucgggggcccgggguuccccgugugcccgcccggcggcauccaggaggugaccgucaaccagagccugcucacgccccugaaccugcagaucgaccccgcgauccagcgcgugcgggccgaggagcgcgagcagaucaagacccucaacaacaaguucgccuccuucaucgacaaggugcgguuccuggagcagcagaacaagguccuggacaccaaguggacccuccugcaggagcaggggaccaagaccgugcgccagaaccuggagccccucuucgagcaguacaucaacaaccugcggcgccagcuggacaacaucgugggcgagcgggggcgccucgacagcgagcugcggaacaugcaggaccuggucgaggaccucaagaacaaguacgaggacgagaucaacaagcgcacggccgccgagaacgaguucgugacccugaagaaggacguggacgcggccuacaugaacaaggucgagcugcaggccaaggccgacacccucaccgacgagaucaacuuccugcgggcccuguacgacgcggagcucucccagaugcagacgcacaucagcgacaccuccguggugcugagcauggacaacaaccgcaaccuggaccucgacuccaucaucgccgaggucaaggcccaguacgaggagaucgcccagcgcagccgggccgaggcggaguccugguaccagaccaaguacgaggagcugcagaucaccgccggccgccacggggacgaccugcggaacacgaagcaggagaucgccgagaucaaccgcaugauccagcggcuccgcagcgagaucgaccacgugaagaagcagugcgccaaccugcaggccgcgaucgccgacgccgagcagcggggcgagauggcccugaaggacgcgaagaacaagcucgagggccuggaggacgcccugcagaaggccaagcaggaccucgcccgccugcugaaggaguaccaggagcucaugaacgugaagcuggcccuggacgucgagaucgcgaccuaccggaagcuccuggagggggaggagugccgccugaacggcgagggggugggccaggugaacaucuccgucgugcagagcaccguguccagcggguacggcggcgccuccggggucggcagcgggcucggccucgggggcggcagcuccuacagcuacggguccggccugggggugggcgggggcuucagcuccagcuccggccgggccaccgggggcgggcugagcuccgucggcggcgggagcuccacgaucaaguacaccaccaccagcuccagcucccgcaagagcuacaagcacuga

SEQ ID NO: 32149 - RNA, 1695 nt, Artificial Sequence
  derived and/or modified sequence opt1 from KRT6C__Homo_sapiens__NP_775109
auggccagcaccuccaccacgauccgcagccacuccagcucccggcgcggcuucagcgccaacuccgcgcggcugcccggggugagccgcuccggcuucagcuccaucagcgucucccggagccgcggguccggcgggcugggcggcgccugcgggggcgccggguucggcagccggucccuguacgggcugggcggcagcaagcgcaucuccaucgggggcgggagcugcgccaucagcggcggcuacgggucccgggccggcgggagcuacggcuucgggggcgcgggcuccggguucggcuucgggggcggggccggcaucggcuucgggcucggcgggggcgccgggcuggccggcggcuucgggggcccgggguuccccgugugcccgcccggcggcauccaggaggugaccgucaaccagagccugcucacgccccugaaccugcagaucgaccccgcgauccagcgcgugcgggccgaggagcgcgagcagaucaagacccucaacaacaaguucgccuccuucaucgacaaggugcgguuccuggagcagcagaacaagguccuggacaccaaguggacccuccugcaggagcaggggaccaagaccgugcgccagaaccuggagccccucuucgagcaguacaucaacaaccugcggcgccagcuggacagcaucgugggcgagcgggggcgccucgacuccgagcugcggaacaugcaggaccuggucgaggaccucaagaacaaguacgaggacgagaucaacaagcgcacggccgccgagaacgaguucgugacccugaagaaggacguggacgcggccuacaugaacaaggucgagcugcaggccaaggccgacacccucaccgacgagaucaacuuccugcgggcccuguacgacgcggagcucagccagaugcagacgcacaucuccgacaccagcguggugcuguccauggacaacaaccgcaaccuggaccucgacagcaucaucgccgaggucaaggcccaguacgaggagaucgcccagcgcucccgggccgaggcggagagcugguaccagaccaaguacgaggagcuccaggugaccgccggccgccacggggacgaccugcggaacacgaagcaggagaucgccgagaucaaccgcaugauccagcggcugcgcuccgagaucgaccacgugaagaagcagugcgccagccugcaggccgcgaucgccgacgccgagcagcggggcgagauggcccugaaggacgcgaagaacaagcucgagggccuggaggacgcccugcagaaggccaagcaggaccucgcccgccugcugaaggaguaccaggagcucaugaacgucaagcuggcccuggacguggagaucgcgaccuaccggaagcuccuggagggggaggagugccgccugaacggcgagggggugggccaggucaacguguccgugguccagagcaccaucuccagcggguacggcggcgccagcggggugggcuccgggcucggccucgggggcggcagcuccuacagcuacggguccggccuggggaucggcgggggcuucagcuccagcuccggccgggccaucgggggcgggcugagcuccgucggcggcgggagcuccaccaucaaguacacgaccaccagcuccagcucccgcaagagcuacaagcacuga

SEQ ID NO: 32150 - RNA, 1572 nt, Artificial Sequence
  derived and/or modified sequence opt1 from KRT71__Homo_sapiens__NP_258259
augagccgccaguucacgugcaaguccggcgccgccgcgaagggcggguucagcgggugcuccgccgugcugagcggcggguccagcuccagcuuccgggccggcuccaagggccucagcgggggcuucgggucccgcagccuguacucccugggcgggguccggagccucaacguggccuccggcagcggcaaguccgggggcuacggguucggccgcggccgggccagcggguucgcgggcuccauguucgggagcguggcccugggccccgucugcccgaccgugugcccgcccgggggcauccaccaggugaccgucaacgagagccugcucgcgccccugaacguggagcuggaccccgagauccagaaggugcgcgcccaggagcgggagcagaucaaggcccucaacaacaaguucgccuccuucaucgacaagguccgcuuccuggagcagcagaaccaggugcuggagaccaagugggagcuccugcagcagcuggaccucaacaacugcaagaacaaccuggagcccauccuggagggcuacaucagcaaccuccggaagcagcuggagacccuguccggggaccgcgugcggcucgacagcgagcugcgcaacguccgggacgugguggaggacuacaagaagcgcuacgaggaggagaucaacaagcggaccgccgccgagaacgaguucguccugcucaagaaggacguggacgccgcguacgccaacaagguggagcugcaggccaaggucgaguccauggaccaggagaucaaguucuuccgcugccuguucgaggccgagaucacgcagauccagagccacaucuccgacaugagcgugauccucuccauggacaacaaccggaaccuggaccuggacagcaucaucgacgaggugcgcacccaguacgaggagaucgcccucaaguccaaggcggaggccgaggcccuguaccagaccaaguuccaggagcugcagcucgccgccggccggcacggggacgaccugaagaacaccaagaacgagaucagcgagcugacgcgccucauccagcggauccgcuccgagaucgagaacgucaagaagcaggcgagcaaccuggagaccgccaucgccgacgccgagcagcgcggcgacaacgcccugaaggacgcgcgggccaagcucgacgagcuggagggggcccugcaccaggccaaggaggagcucgcgcgcaugcugcgggaguaccaggagcugaugucccucaagcuggcccuggacauggagaucgccaccuaccgcaagcuccuggagagcgaggagugccggauguccggcgaguuccccagccccguguccaucagcaucaucagcuccaccagcggcggguccguguacggcuuccgcccgagcauggucuccgggggcuacguggccaacagcuccaacugcaucagcggggucugcuccgugcggggcggcgaggggcgcagccggggcuccgccaacgacuacaaggacacgcuggggaagggcagcucccugagcgcgcccuccaagaagaccagccgcuga

SEQ ID NO: 32151 - RNA, 1410 nt, Artificial Sequence
  derived and/or modified sequence opt1 from KRT72__Homo_sapiens__NP_001139698
augagccgccagcugacccacuucccccggggcgagcgccucggguucuccggcugcagcgccgugcuguccgggggcaucgggagcuccagcgccuccuuccgggcgcgcgucaagggcagcgccuccuucggcagcaagucccugagcugccucgggggcucccggagccuggcccuguccgccgccgcgcgccgcgggggcgggcggcucggcggcuucguggggaccgccuucggcagcgccgggcugggcccgaagugccccuccgugugcccgcccggcgggaucccccaggucacggugaacaagagccugcucgcgccccugaacguggagauggaccccgagauccagcggguccgcgcccaggagcgggagcagaucaaggcccugaacaacaaguucgccuccuucaucgacaaggugcgcuuccucgagcagcagaaccaggugcuggagaccaaguggaaccugcuccagcagcuggaccugaacaacugccggaagaaccucgagcccaucuacgagggcuacaucagcaaccugcagaagcagcuggagaugcucagcggggacggcguccgccuggacuccgagcugcggaacaugcaggaccucguggaggacuacaagaagcgcuacgagguggagaucaaccggcgcaccgccgccgagaacgaguucgucgugcugaagaaggacguggacgcggccuacaugaacaaggucgagcugcaggccaagguggacagccucaccgacgagaucaaguucuucaagugccuguacgagggggagaucacgcagauccagucccacaucagcgacaccuccaucgugcugagcauggacaacaaccgggaccucgaccuggacuccaucaucgccgagguccgcgcccaguacgaggagaucgcgcucaagagcaaggccgaggccgagacccuguaccagaccaagugcgccgaccuggagacggccaucgcggacgccgagcagcggggcgacugcgcccugaaggacgcccgcgccaagcucgacgagcuggagggcgcgcugcaccaggccaaggaggagcucgcccgcaugcugcgggaguaccaggagcuggugucccucaagcuggcccuggacauggagaucgcgaccuaccgcaagcuccuggagagcgaggagugccggauguccggggaguacccgaacagcguguccaucagcgucaucuccagcaccaacgccggcgccgggggcgccggguucuccaugggcuucggcgccagcuccagcuacagcuacaagaccgcggccgccgacgugaagacgaagggguccugcggcagcgagcugaaggacccccucgccaagaccuccgggagcuccugcgccaccaagaaggcgagccgcuga

SEQ ID NO: 32152 - RNA, 1590 nt, Artificial Sequence
  derived and/or modified sequence opt1 from KRT74__Homo_sapiens__XP_011536204
augagccgccagcugaacaucaaguccagcggcgacaaggggaacuucuccgugcacagcgccgucgugccccggaaggccgugggcucccucgcgagcuacugcgccgccgggcgcggcgccggggccggcuucggcucccggagccuguacucccucgggggcaaccgccggaucagcuucaacgucgccgggggcggggugcgcgccggcggcuacggguuccggccgggcuccggguacggcggcgggcgcgccagcggcuucgccggguccauguucggcagcguggcgcucgggcccgccugccuguccgucugcccgcccggcggcauccaccaggugaccgugaacaagagccugcucgccccgcugaacgucgagcuggaccccgagauccagaaggugcgggcccaggagcgcgagcagaucaaggugcucaacgacaaguucgccuccuucaucgacaagguccgguuccuggagcagcagaaccaggugcuggagaccaagugggagcuccugcagcagcuggaccugaacaacugcaagaagaaccuggagcccauccuggagggguacaucagcaaccuccgcaagcagcuggagacgcuguccggcgaccgggugcgccucgacagcgagcugcggagcaugcgcgaccuggucgaggacuacaagaagcgguacgagguggagaucaaccgccggaccaccgcggagaacgaguucgugguccucaagaaggacgcggacgccgccuacgccgugaagguggagcugcaggcgaaggucgacucccuggacaaggagaucaaguuccucaagugccuguacgacgccgagaucgcccagauccagacccacgccagcgagacguccgugauccugagcauggacaacaaccgcgaccucgaccuggacuccaucaucgccgaggugcggaugcacuacgaggagaucgcgcucaagagcaaggccgaggccgaggcccuguaccagaccaagauccaggagcugcagcuggccgcgucccgccacggggacgaccucaagcacacccgcagcgagauggucgagcugaaccggcugauccagcgcauccggugcgagaucggcaacgugaagaagcagcgcgccucccucgagaccgccaucgccgacgcggagcagcgcggggacaacgcccugaaggacgcccaggccaagcuggacgagcucgagggcgcccugcaccaggcgaaggaggagcuggcccggaugcuccgggaguaccaggagcugaugagccugaagcucgcccuggacauggagaucgccacguaccgcaagcugcuggagggcgaggagugccggauguccggggagaaccccagcuccgucagcaucuccgugaucagcuccagcuccuacagcuaccaccaccccagcuccgccggcguggaccucggggcgagcgccgucgccggcuccagcggguccacccagagcggccagaccaagaccacggaggcccgcggcggggaccugaaggacacccagggcaaguccacccccgccagcauccccgcgcggaaggccacccgcuga

SEQ ID NO: 32153 - RNA, 1656 nt, Artificial Sequence
  derived and/or modified sequence opt1 from KRT75__Homo_sapiens__NP_004684
augagccgccagagcagcaucaccuuccaguccggcagccggcgcggguucuccaccacgagcgccaucacccccgccgcgggccggucccgcuucagcuccgugagcgucgcccgguccgccgccgggagcggcgggcugggccgcaucuccagcgccggcgcguccuucgggagccggucccucuacaaccugggcggggccaagcgcgugagcaucaacggcugcggguccagcugccggagcggcuucggcgggcgcgccuccaaccgguucggcgugaacagcggguucggcuacggcgggggcgucgggggcggguucuccggcccgagcuuccccgugugcccgcccggcgggauccaggaggugaccgucaaccagucccugcucacgccccugcaccuccagaucgaccccaccauccagcgcgugcgggccgaggagcgcgagcagaucaagacccugaacaacaaguucgcgagcuucaucgacaaggugcgguuccuggagcagcagaacaagguccuggagaccaagugggcccuccugcaggagcagggcucccgcaccgugcggcagaaccuggagccccucuucgacagcuacacguccgagcugcgccggcagcuggagagcaucaccaccgagcgcgggcggcucgaggccgagcugcgcaacaugcaggacguggucgaggacuucaaggugcgcuacgaggacgagaucaacaagcggaccgccgccgagaacgaguucguggcgcugaagaaggacgucgacgccgccuacaugaacaagguggagcucgaggccaaggugaagucccugcccgaggagaucaacuucauccacagcgucuucgacgccgagcugucccagcuccagacccaggugggcgacacgagcgugguccuguccauggacaacaaccgcaaccuggaccucgacagcaucaucgcggaggugaaggcccaguacgaggacaucgccaaccggucccgcgccgaggccgagagcugguaccagaccaaguacgaggagcuccaggugaccgcggggcggcacggcgacgaccugcgcaacacgaagcaggagaucuccgagaugaaccggaugauccagcgccugcgggccgagaucgacagcgucaagaagcagugcagcucccugcagaccgccaucgccgacgccgagcagcgcggcgagcuggcgcucaaggacgcccgggccaagcugguggaccuggaggaggcccuccagaaggcgaagcaggacauggcccgccugcugcgggaguaccaggagcucaugaacaucaagcuggcccuggacgucgagaucgccaccuaccgcaagcuccuggagggggaggagugccggcugagcggcgaggggguguccccggugaacaucagcgucgugaccuccacgcucagcuccggcuacgggagcggcuccagcaucggcgggggcaaccuggggcugggcggcggguccggcuacagcuucaccaccuccgggggccacagccucggggccggccugggcggguccggcuucagcgcgaccuccaaccgcgggcugggcgggagcggcagcuccgugaaguucgucagcacgaccuccagcucccagaaguccuacacccacuga

SEQ ID NO: 32154 - RNA, 1917 nt, Artificial Sequence
  derived and/or modified sequence opt1 from KRT76__Homo_sapiens__NP_056932
augaaccgccaggugugcaagaaguccuucagcggccggagccagggguucuccggccgcagcgccgucguguccgggagcucccggaugagcugcguggcccgcuccggcggggcgggcggcggggccugcggcuuccggagcggggccggcuccuucgggagccgcucccuguacaaccucggcagcaacaaguccaucagcaucuccgucgccgccggcagcucccgggccgggggcuucgggggcggccgcagcagcugcggguucgcgggcggguacggcgggggcuucggcggguccuacggcgggggcuucgggggcggccgcggggugggcagcggguucggcggggccggcggcuucgggggcgccgggggcuucggcgggcccggcguguucgggggcccgggguccuucggcggccccgggggcuucgggcccggcggguuccccggcggcauccaggaggucaucgugaaccagagccugcugcagccgcucaacguggagaucgacccccagaucgggcaggucaaggcgcaggagcgggagcagaucaagacccugaacaacaaguucgccuccuucaucgacaaggugcgguuccuggagcagcagaacaaggugcucgagaccaagugggagcugcugcagcagcagacgaccggcagcgggcccuccagccucgagcccugcuucgaguccuacaucagcuuccugugcaagcagcuggacucccuccugggcgagcgcgggaaccuggagggcgagcucaagagcaugcaggaccuggucgaggacuucaagaagaaguacgaggacgagaucaacaagcggaccgccgccgagaacgaguucgugggccugaagaaggacguggacgccgcguucaugaacaaggucgagcuccaggccaagguggacucccugaccgacgaggugagcuuccugcgcacgcucuacgagauggagcugucccagaugcagagccacgccuccgacaccagcgucgugcuguccauggacaacaaccggugccucgaccuggggagcaucaucgccgaggugcgcgcccaguacgaggagaucgcgcagcggagcaaguccgaggccgaggcccuguaccagaccaagcucggcgagcugcagaccacggccgggcgccacggcgacgaccugcggaacaccaagagcgagaucauggagcucaaccgcaugauccagcggcugcgcgccgagaucgagaacgucaagaagcagaacgcgaaccugcagaccgccaucgccgaggccgagcagcgcggggagauggcccucaaggacgcgaacgccaagcugcaggaccugcagaccgcccuccagaaggccaaggacgaccuggcgcggcugcuccgcgacuaccaggagcugaugaacgugaagcuggcccucgacguggagaucgccacguaccggaagcugcuggagggcgaggagugccgcauguccggcgagugccagagcgccgucugcaucuccguggucagcaacgugaccuccaccagcggguccagcggcuccagccgcgggguguucggcggcgucuccgggagcggcuccgggggcuacaagggcgggagcuccagcagcuccagcuccggcuacggggugagcggcggguccggcagcggguacggcggcguguccagcggguccaccggcgggcggggcagcuccgggagcuaccaguccagcuccagcggcucccggcucggcggggccggcagcaucuccgucagccacagcgggaugggcuccagcuccggcagcauccagacguccgggggcagcggguacaaguccggcgggggcggcagcaccuccauccgcuucagccagaccaccuccagcucccagcacagcuccacgaaguga

SEQ ID NO: 32155 - RNA, 1233 nt, Artificial Sequence
  derived and/or modified sequence opt1 from KRT78__Homo_sapiens__NP_001287743
auggagggccacgaggccagccccgcccagguggggcagggcgaccgcgggaagguccgguuccuggagcagcagaacaaggugcucgagaccaaguggcaccuccugcagcagcagggccuguccgggagccagcagggccuggagccgguguucgaggcgugccuggaccagcuccgcaagcagcuggagcagcugcagggcgagcgcggggcccucgacgccgagcugaaggccugccgggaccaggaggaggaguacaaguccaaguacgaggaggaggcccaccggcgcgcgacccuggagaacgacuucgucgugcucaagaaggacguggacggcgucuuccugagcaagauggagcuggaggggaagcucgaggcccugcgggaguaccuguacuuccucaagcaccugaacgaggaggagcugggccagcuccagacgcaggccuccgacaccagcguggugcuguccauggacaacaaccgcuaccuggacuucagcuccaucaucaccgagguccgggcccgcuacgaggagaucgcgcggagcuccaaggccgaggccgaggcccucuaccagaccaaguaccaggagcuccaggugagcgcccagcugcacggggaccgcaugcaggagacgaaggugcagaucucccagcugcaccaggagauccagcggcugcagagccagaccgagaaccugaagaagcagaacgcgucccuccaggccgccaucaccgacgccgagcagcgcggcgagcuggcccugaaggacgcgcaggccaaggucgacgagcucgaggccgcccugcggauggccaagcagaaccuggcgcgccuccugugcgaguaccaggagcugaccagcacgaagcucucccuggacguggagaucgccaccuaccggcgccugcucgagggcgaggagugccggaugagcggggagugcaccucccaggugaccaucagcagcgucggcggguccgccgugaugagcggcggcgucgggggcgggcugggcuccacgugcgggcugggcagcggcaaggggucccccggcagcugcugcaccuccaucgugaccgggggcagcaacaucauccucggguccggcaaggaccccgugcuggacagcugcuccgugagcggcuccagcgccggguccagcugccacaccauccugaagaagacggucgaguccagccucaagaccuccaucaccuacuga

SEQ ID NO: 32156 - RNA, 1410 nt, Artificial Sequence
  derived and/or modified sequence opt1 from KRT7__Homo_sapiens__NP_005547
augagcauccacuucuccagccccguguucaccucccgcagcgccgccuucuccggccgcggggcgcagguccggcugagcuccgcccggccgggcgggcucggcagcuccagccuguacgggcugggcgccucccgcccccggguggccgugcgcagcgccuacggcgggcccgucggcgcggggauccgggaggugaccaucaaccagucccuccuggcgccccugcgccucgacgccgacccgagccugcagcgggugcgccaggaggaguccgagcagaucaagacgcugaacaacaaguucgccagcuucaucgacaagguccgguuccucgagcagcagaacaagcugcuggagaccaaguggacccuccugcaggagcagaaguccgccaagagcucccgccugcccgacaucuucgaggcccagaucgccggccuccgggggcagcuggaggcccuccagguggacggcggccgccuggaggccgagcugcggagcaugcaggacguggucgaggacuucaagaacaaguacgaggacgagaucaaccaccgcaccgcggccgagaacgaguucguggugcugaagaaggacgucgacgccgccuacaugagcaagguggagcucgaggccaagguggacgcgcugaacgacgagaucaacuuccugcggacgcucaacgagaccgagcugaccgagcugcagucccagaucagcgacaccuccgucgugcucagcauggacaacucccgcagccuggaccuggacgggaucaucgccgaggugaaggcccaguacgaggagauggccaagugcucccgggccgaggcggaggccugguaccagacgaaguucgagacccuccaggcccaggccggcaagcacggggacgaccugcgcaacacccggaacgagaucagcgagaugaaccgcgccauccagcgccugcaggcggagaucgacaacaucaagaaccagcgggccaagcucgaggccgccaucgcggaggccgaggagcgcggcgagcuggcccugaaggacgcccgggccaagcaggaggagcucgaggcggcccugcagcgcggcaagcaggacauggcccggcagcugcgcgaguaccaggagcucauguccgucaagcuggcccuggacaucgagaucgccaccuaccggaagcuccuggagggggaggagagccgccuggcgggcgacggggugggcgccgugaacaucuccgucaugaacagcaccgggggcuccagcuccggcgggggcaucgggcucacgcugggcgggaccaugggcagcaacgcccuguccuucagcuccagcgccggccccgggcuccugaaggccuacagcauccggaccgcguccgccagccgccgguccgcccgcgacuga

SEQ ID NO: 32157 - RNA, 1269 nt, Artificial Sequence
  derived and/or modified sequence opt1 from KRT80__Homo_sapiens__NP_001074961
auggccugccgcagcugcguggucggcuucuccagccuguccagcugcgaggugacccccgugggguccccgcggcccggcaccagcgggugggacuccugccgcgcccccggccccggguucagcucccggagccucacgggcugcugguccgcgggcaccaucagcaaggucaccgugaacccggggcugcuggugccccucgacgucaagcuggaccccgccgugcagcagcugaagaaccaggagaaggaggagaugaaggcccucaacgacaaguucgccucccugaucggcaaggugcaggcccuggagcagcgcaaccagcuccuggagacccgguggagcuuccugcaggggcaggacuccgcgaucuucgaccucggccaccuguacgaggaguaccaggggcgccugcaggaggagcuccggaaggucagccaggagcgcggccagcuggaggccaaccugcuccaggugcuggagaagguggaggaguuccggauccgcuacgaggacgagaucuccaagcggacggacauggaguucaccuucguccagcugaagaaggaccucgacgccgagugccugcaccgcaccgagcuggagaccaagcucaagagccuggaguccuucguggagcugaugaagacgaucuacgagcaggagcucaaggaccuggccgcccaggugaaggacgucagcgugaccgugggcauggacagccggugccacaucgaccuguccgggaucgucgaggaggugaaggcgcaguacgacgccguggccgcccgcagccucgaggaggcggaggccuacucccggagccagcuggaggagcaggccgcccgcuccgccgaguacggcagcucccugcagagcucccggagcgagaucgcggaccucaacguccgcauccagaagcugcggucccagauccugagcgugaagucccacugccucaagcuggaggagaacaucaagaccgccgaggagcagggggagcuggccuuccaggacgccaagaccaagcucgcccagcuggaggcggcccugcagcaggccaagcaggacauggcccgccagcuccggaaguaccaggagcugaugaacgugaagcuggcccucgacaucgagaucgcgacguaccgcaagcuggucgagggcgaggagggccgcauggacagccccuccgccaccguggucagcgccgugcagucccggugcaagaccgccccgagccugcccuacccccucugcucccuguga

SEQ ID NO: 32158 - RNA, 1518 nt, Artificial Sequence
  derived and/or modified sequence opt1 from KRT81__Homo_sapiens__XP_011536636
augaccugcggcagcggguucggcgggcgcgccuucuccugcaucagcgccugcggcccccggccggggcgcugcugcaucaccgcggcccccuaccggggcaucuccugcuaccgcggccugaccgggggcuucgggagccacuccgugugcggcggguuccgggccggcagcugcggccgcuccuucggguaccggagcggcggggucugcggccccuccccgcccugcaucaccaccgugagcgugaacgagucccuccugacgccccugaaccucgagaucgaccccaacgcccagugcgucaagcaggaggagaaggagcagaucaagagccugaacucccgcuucgccgcguucaucgacaaggugcgguuccuggagcagcagaacaagcuccuggagacgaagcugcaguucuaccagaaccgcgagugcugccagagcaaccucgagccccuguucgagggcuacaucgagacccugcggcgcgaggccgagugcguggaggccgacuccgggcggcucgccagcgagcugaaccacguccaggaggugcuggagggcuacaagaagaaguacgaggaggaggugucccuccgcgcgaccgccgagaacgaguucgucgcccugaagaaggacguggacugcgccuaccugcgcaagagcgaccucgaggccaacguggaggcgcugauccaggagaucgacuuccugcggcggcucuacgaggaggagauccugauccugcagucccacaucagcgacaccagcgucguggugaagcucgacaacucccgcgaccugaacauggacugcaucaucgccgagaucaaggcccaguacgacgacaucgucacgcggagccgcgccgaggccgaguccugguaccggagcaagugcgaggagaugaaggcgaccgugauccgccacggggagacccugcgccggaccaaggaggagaucaacgagcucaaccgcaugauccagcggcugacggccgagguggagaacgccaagugccagaacuccaagcuggaggccgccgucgcgcagagcgagcagcagggcgaggccgcccucuccgacgcccgcugcaagcuggccgagcuggagggggcgcuccagaaggccaagcaggacauggccugccugauccgggaguaccaggaggugaugaacagcaagcugggccucgacaucgagaucgccaccuaccgccggcugcuggagggcgaggagcagcgccucugcgaggggaucggcgcggugaacgucugcguguccagcucccgcgggggcguggucugcggggaccugugcgugagcggcucccggccggucaccggcagcgugugcuccgcccccugcaacgggaacguggccgucagcaccggccugugcgcccccugcgggcagcucaacacgaccugcggcgggggcuccugcggcguggggagcugcggcaucuccagccugggggugggcagcugcggcuccagcugccggaagugcuga

SEQ ID NO: 32159 - RNA, 1542 nt, Artificial Sequence
  derived and/or modified sequence opt1 from KRT82__Homo_sapiens__NP_149022
augagcuaccacuccuuccagcccggcagccgcugcgggucccagagcuucuccagcuacuccgccgugaugccgcggauggucacccacuacgccgugagcaagggccccugccgccccgggggcgggcggggccugcgcgcgcucggcugccuggggucccggagccugugcaacgugggcuucgggcgcccccgggucgccucccgcugcggcgggacccucccgggcuucggcuaccggcugggggccacgugcggccccagcgccugcaucacccccgugaccaucaacgagucccugcucgugccccuggcccuggagaucgacccgaccguccagcgcgugaagcgggacgagaaggagcagaucaagugccucaacaaccgcuucgcgagcuucaucaacaaggugcgguuccuggagcagaagaacaagcugcucgagacgaaguggaacuucaugcagcagcagcgcugcugccagaccaacaucgagcccaucuucgagggguacaucuccgcccugcggcgccagcuggacugcgucagcggcgaccgggugcgccucgaguccgagcugugcagccugcaggccgcccucgagggcuacaagaagaaguacgaggaggagcugucccugcggcccugcguggagaacgaguucgucgcgcucaagaaggacguggacaccgccuuccugaugaaggccgaccuggagaccaacgccgaggcccucgugcaggagaucgacuuccucaagagccuguacgaggaggagaucugccugcugcagagccagaucuccgagacgagcgucaucgugaagauggacaacucccgcgagcuggacguggacgggaucaucgcggagaucaaggcccaguacgacgacaucgccagccgguccaaggccgaggccgaggcgugguaccagugccgcuacgaggagcuccgcgucaccgccggcaaccacugcgacaaccugcggaaccgcaagaacgagauccuggagaugaacaagcucauccagcggcugcagcaggagaccgagaacgugaaggcccagcgcugcaagcuggagggggccaucgccgaggcggagcagcagggcgaggccgcccucaacgacgccaagugcaagcuggccgggcuggaggaggcgcuccagaaggccaagcaggacauggccugccugcugaaggaguaccaggaggugaugaacagcaagcucggccuggacaucgagaucgccaccuaccggcgccugcucgagggcgaggagcaccggcugugcgaggggaucggccccgucaacaucuccgugagcuccagcaagggggcguuccuguacgagccgugcggcguguccacgcccguccucagcaccggggugcugcgcuccaacggcggcugcagcaucgucgggaccggcgagcuguacgugcccugcgagccccaggggcugcucuccugcggcagcgggcggaaguccagcaugacccugggcgccggcggguccagcccgagccacaagcacuga

SEQ ID NO: 32160 - RNA, 1482 nt, Artificial Sequence
  derived and/or modified sequence opt1 from KRT83__Homo_sapiens__NP_002273
augaccugcggcuucaacagcaucgggugcggcuuccgccccgggaacuucuccugcgugagcgccugcggcccgcggcccucccgcugcugcaucaccgccgcgcccuaccgggggaucagcugcuaccgcggccugacgggcggguucggcucccacagcgucugcgggggcuuccgggccggguccugcggccgcagcuucggcuaccgguccgggggcgugugcgggcccagcccgcccugcaucaccaccguguccgucaacgagagccuccugacgccccugaaccucgagaucgaccccaacgcccagugcgugaagcaggaggagaaggagcagaucaagucccugaacagccgcuucgccgccuucaucgacaaggugcgguuccuggagcagcagaacaagcuccuggagaccaagcugcaguucuaccagaaccgcgagugcugccaguccaaccucgagccgcuguucgcgggcuacaucgagacccugcggcgcgaggccgagugcgucgaggccgacagcggccggcucgccuccgagcugaaccacgugcaggaggugcuggagggguacaagaagaaguacgaggaggaggucgcgcuccgcgccaccgccgagaacgaguucguggcccugaagaaggacguggacugcgccuaccugcgcaagagcgaccucgaggcgaacgucgaggcccugauccaggagaucgacuuccugcggcggcucuacgaggaggagauccgcauccugcagucccacaucagcgacaccagcgugguggucaagcuggacaacucccgggaccucaacauggacugcaucguggccgagaucaaggcccaguacgacgacaucgccacgcgcagccgggcggaggccgaguccugguaccgcagcaagugcgaggagaugaaggccaccgugauccgccacggcgagacccugcggcgcaccaaggaggagaucaacgagcugaaccggaugauccagcgccucacggccgaggucgagaacgccaagugccagaacuccaagcuggaggcggccguggcccagagcgagcagcagggggaggccgcccuguccgacgcgcggugcaagcucgccgagcuggagggcgcccugcagaaggccaagcaggacauggcgugccucauccgcgaguaccaggaggugaugaacagcaagcuggggcuggacaucgagaucgccaccuaccggcgccuccuggagggcgaggagcagcggcugugcgagggcgucgaggccgugaacgugugcgucuccagcucccgcgggggcguggucugcggggaccucugcgugagcggcucccggcccgugaccgggagcgucugcuccgcccccugcaacggcaaccugguggugagcaccggccugugcaagcccugcgggcagcucaacacgaccugcggcgggggcuccugcgggcagggccgccacuga

SEQ ID NO: 32161 - RNA, 888 nt, Artificial Sequence
  derived and/or modified sequence opt1 from KRT85__Homo_sapiens__NP_001287739
augguguucaagguccaguuccugagcucccgccccagccucucccacacccaggacguggacugcgccuaccugcgcaagagcgaccuggaggccaacguggaggcgcucgucgaggaguccagcuuccugcggcggcuguacgaggaggagauccgcgugcuccaggcccacaucuccgacaccagcgugaucgucaagauggacaacucccgggaccugaacauggacugcaucaucgccgagaucaaggcccaguacgacgacguggccagccgcucccgggcggaggccgagagcugguaccgcuccaagugcgaggagaugaaggccacggugauccggcacggcgagacccugcgccggaccaaggaggagaucaacgagcucaaccgcaugauccagcggcugaccgccgagaucgagaacgcgaagugccagcgcgccaagcuggaggccgccgucgccgaggcggagcagcagggggaggccgcccucagcgacgcccggugcaagcuggccgagcuggagggcgcgcuccagaaggccaagcaggacauggccugccugcugaaggaguaccaggaggugaugaacuccaagcucgggcuggacaucgagaucgccacguaccgccggcugcucgagggcgaggagcaccgccugugcgagggggugggcagcgucaacgugugcguguccagcucccggggcggggucagcugcggcgggcugagcuacuccaccaccccgggccgccagaucaccagcgggcccuccgccaucggcggcagcaucacggugguggcgcccgacuccugcgcccccugccagccgcggagcuccagcuucuccugcgggagcucccgcagcguccgcuucgccuga

SEQ ID NO: 32162 - RNA, 1692 nt, Artificial Sequence
  derived and/or modified sequence opt1 from KRT86__Homo_sapiens__XP_005268923
augugcgaggagcugaaggccaccgugcagaagcacacccagagccucaagcccuccaaggaggaccugaaccgccugaaccaggccauccaguggcucacggucgaggugggcagcgcggagucccaggccuaccgcggggccagcuccgagcggcugaccccgcggccccugugcagccccuucggccgccuccacccccagaaccugcuguccagcccgaaguccaccaugaccugcgggagcuacugcggcgggcgggccuucuccugcaucagcgccugcggcccccgccccggccggugcugcaucacggcggcccccuaccgcgggaucuccugcuaccggggccucaccgggggcuucgggagccacuccgugugcggcggcuuccgcgccgggagcugcggccgguccuucggguaccgcagcggcggcgucugcgggccguccccgcccugcaucaccaccgugagcgugaacgagagccugcugacgccccucaaccuggagaucgaccccaacgcccagugcgucaagcaggaggagaaggagcagaucaagucccugaacagccgguucgcggccuucaucgacaaggugcgcuuccucgagcagcagaacaagcugcuggagaccaagcuccaguucuaccagaaccgggagugcugccaguccaaccuggagccccuguucgagggcuacaucgagacccuccgccgggaggccgagugcguggaggccgacagcgggcgccuggccuccgagcugaaccacguccaggaggugcucgagggcuacaagaagaaguacgaggaggaggugagccugcgggcgaccgccgagaacgaguucgucgcccugaagaaggacguggacugcgccuaccuccgcaaguccgaccuggaggccaacguggaggcgcugauccaggagaucgacuuccuccggcgccuguacgaggaggagauccgcguccugcagagccacaucuccgacacgagcgugguggucaagcucgacaacucccgggaccugaacauggacugcaucaucgccgagaucaaggcccaguacgacgacaucgugacccgcagccgggccgaggccgaguccugguaccgcagcaagugcgaggagaugaaggcgaccgugauccggcacggggagacccugcgccggacgaaggaggagaucaacgagcucaaccgcaugauccagcggcugaccgccgaggucgagaacgccaagugccagaacuccaagcuggaggccgccguggcgcagagcgagcagcagggcgaggccgcccucuccgacgcccgcugcaagcuggcggagcuggagggcgcccuccagaaggccaagcaggacauggccugccugauccgggaguaccaggaggugaugaacagcaagcuggggcucgacaucgagaucgccaccuaccgccggcugcuggagggcgaggagcagcgccucugcgagggggucggcuccgugaacgucugcgugagcagcucccgcgggggcguggucugcggcgaccugugcgcgagcaccacggcccccgugguguccacccgggucagcuccgugcccagcaacuccaacguggucguggggaccaccaacgccugcgccccgagcgcccgggugggcgucugcgggggcuccugcaagcgcugcuga

SEQ ID NO: 32163 - RNA, 1536 nt, Artificial Sequence
  derived and/or modified sequence opt1 from KRT8__Homo_sapiens__NP_001243211
augaacggcgugagcuggucccaggaccugcaggaggggaucagcgccugguucgggcccccggccuccacccccgcgagcaccauguccauccgcgucacgcagaaguccuacaaggugagcaccagcgggccccgggccuucuccagccgcuccuacaccagcggccccgggucccggaucagcuccagcuccuucagccgcgugggcuccagcaacuuccggggcgggcucggcgggggcuacgggggcgccagcggcaugggcggcaucaccgccgucacggugaaccagucccugcugagcccgcucgugcuggaggucgaccccaacauccaggccgugcgcacccaggagaaggagcagaucaagacccugaacaacaaguucgcguccuucaucgacaaggugcgguuccucgagcagcagaacaagaugcuggagaccaaguggagccugcuccagcagcagaagacggcccgcuccaacauggacaacauguucgagagcuacaucaacaaccugcggcgccagcuggagacccucgggcaggagaagcugaagcuggaggccgagcucggcaacaugcagggccuggucgaggacuucaagaacaaguacgaggacgagaucaacaagcggaccgagauggagaacgaguucgugcugaucaagaaggacguggacgaggccuacaugaacaaggucgagcucgagucccgccuggaggggcugaccgacgagaucaacuuccuccggcagcuguacgaggaggagauccgcgagcugcagagccagaucuccgacacgagcguggugcucuccauggacaacagccggucccuggacauggacagcaucaucgcggaggucaaggcccaguacgaggacaucgccaaccgcucccgggccgaggccgagagcauguaccagaucaaguacgaggagcugcagucccucgcgggcaagcacggggacgaccugcgccggaccaagaccgagaucagcgagaugaaccgcaacaucucccggcugcaggccgagaucgagggccucaaggggcagcgcgccagccuggaggccgccaucgcggacgccgagcagcgcggcgagcuggccaucaaggacgccaacgccaagcucagcgagcuggaggcggcccugcagcgggccaagcaggacauggcccgccagcuccgggaguaccaggagcugaugaacgugaagcuggcccucgacaucgagaucgcgaccuaccgcaagcugcuggagggcgaggagucccggcucgagagcgggaugcagaacauguccauccacacgaagaccaccagcggcuacgccgggggccuguccagcgccuacgggggccugaccucccccggccucagcuacucccuggggagcuccuucggcagcggggccggcuccagcuccuucagccgcacguccagcagccgggcgguggucgugaagaagaucgagacccgcgacgggaagcugguguccgagagcuccgacguccuccccaaguga

SEQ ID NO: 32164 - RNA, 1872 nt, Artificial Sequence
  derived and/or modified sequence opt1 from KRT9__Homo_sapiens__NP_000217
augagcugccgccaguucuccagcuccuaccugagccgguccggcgggggcgggggcgggggccucggcagcgggggcuccauccgcagcuccuacagccgguucuccagcuccgggggcgggggcggcgggggccgcuucagcuccagcuccggguacggcggcgggagcucccgggugugcggccgcgggggcgggggcagcuucggcuacagcuacgggggcggguccggcgggggcuucagcgccuccagccugggcgggggcuucgggggcgggucccggggcuucggcggggccagcggcgggggcuacuccagcuccggcggguucggcgggggcuucgggggcggcagcgggggcggguucggcgggggcuacggcuccggguucggcggguucggcggguucggcggcggggcgggcgggggcgacgggggcauccugaccgccaacgagaaguccaccaugcaggagcucaacagccgccuggccagcuaccuggacaagguccaggcccucgaggaggccaacaacgaccuggagaacaagauccaggacugguacgacaagaagggccccgcggccauccagaagaacuacuccccguacuacaacacgaucgacgaccugaaggaccagaucguggaccucaccguggggaacaacaagacccugcuggacaucgacaacacccggaugacgcucgacgacuuccgcaucaaguucgagauggagcagaaccugcggcagggcgucgacgccgacaucaacgggcugcgccaggugcucgacaaccugaccauggagaaguccgaccuggagaugcaguacgagacccuccaggaggagcugauggcccugaagaagaaccacaaggaggagaugagccagcucaccggccagaacagcggcgacgugaacgucgagaucaacguggcgcccgggaaggaccugacgaagacccugaacgacaugcggcaggaguacgagcagcucaucgccaagaaccgcaaggacaucgagaaccaguacgagacccagaucacccagaucgagcacgagguguccagcagcggccaggagguccaguccagcgccaaggaggugacgcagcugcggcacggggugcaggagcuggagaucgagcuccagucccagcugagcaagaaggccgcccuggagaagucccucgaggacaccaagaaccgcuacugcggccagcugcagaugauccaggagcagaucagcaaccuggaggcgcagaucaccgacguccggcaggagaucgagugccagaaccaggaguacucccuccugcugagcaucaagaugcgccucgagaaggagaucgagaccuaccacaaccugcuggagggcgggcaggaggacuucgaguccagcggcgccgggaagaucggccucgggggccgcgggggcuccggcgggagcuacggccgggggucccggggcgggagcggcggcuccuacgggggcgggggcagcggcgggggcuacgggggcggguccggcagccgcggcgggagcggcggguccuacggcgggggcagcggcuccgggggcgggagcggcgggggcuacggcgggggcuccgggggcgggcacagcggcggcuccgggggcgggcacagcggcggcuccgggggcaacuacgggggcgggagcggcuccggcgggggcagcgggggcggguacggcggcggguccggcagccgcgggggcuccgggggcagccacggcgggggcuccggguucggcggggagagcggcggcuccuacgggggcggggaggaggccagcggcagcggcgggggcuacgggggcggguccggcaagagcucccacagcuga

SEQ ID NO: 32165 - RNA, 492 nt, Artificial Sequence
  derived and/or modified sequence opt1 from KRTAP11-1__Homo_sapiens__NP_787054
augagcuucaacugcuccacccgcaacugcagcucccggcccaucggcgggcgcugcaucgugccggucgcccaggugaccacgaccagcaccaccgacgccgacugccugggcgggaucugccuccccuccagcuuccagacgggcuccuggcugcuggaccacugccaggagaccugcugcgagcccaccgcgugccagccgaccugcuaccggcgcacgagcugcguguccaaccccugccaggugaccugcagccggcagacgaccugcaucuccaaccccugcagcaccaccuacucccgcccccucaccuucgugagcuccgggugccagccccugggcggcaucagcuccgugugccagccggucgggggcaucagcaccgugugccagcccgucgggggcgucuccacggugugccagcccgccugcggggugagccggaccuaccagcagagcugcgucuccagcugccgccggaccugcuga

SEQ ID NO: 32166 - RNA, 837 nt, Artificial Sequence
  derived and/or modified sequence opt1 from KRTAP5-1__Homo_sapiens__NP_001005922
augggcugcugcgggugcagcggcgggugcggcuccagcugcgggggcugcggcuccgggugcggcgggugcggcagcgggugcggcggcugcggguccggcugcgggggcagcggcuccagcugcugcgugcccgucugcugcugcaagccggugugcugccgcgugccgaccugcuccugcagcuccugcgggaagggcgggugcggcagcuccgggggcagcaagggcgggugcggcuccugcgggggcugcaagggcgggugcggcagcugcgggggcuccaagggcgggugcgggagcugcggcggcuccaagggcgggugcgggagcugcggcggcagcaagggcgggugcggguccggcugcgggggcugcggcagcuccugcugcguccccgugugcugcugcaagcccaugugcugcugcgugcccgccugcagcugcuccagcugcgggaagggcgggugcggcuccugcgggugcagcaagggcgccugcggcuccugcgggggcagcaagggcgggugcggguccugcggcggcugcaagggcgggugcgggagcugcggcggguccaagggcggcugcgggagcggcugcgggggcugcggcuccgggugcggcguccccgugugcugcugcagcugcuccagcugcggguccugcgcgggcagcaagggcgggugcggcagcuccugcagccagugcuccugcugcaagcccugcugcugcagcuccgggugcggcagcuccugcugccagagcuccugcugcaagcccugcugcagccaguccagcugcugcgugccggucugcugccagugcaagaucuga

SEQ ID NO: 32167 - RNA, 510 nt, Artificial Sequence
  derived and/or modified sequence opt1 from KRTAP5-9__Homo_sapiens__NP_005544
augggcugcugcgggugcagcggcgggugcggcuccagcugcgggggcugcgacuccagcugcggcuccugcgggagcggcugccgcgggugcggccccuccugcugcgccccgguguacugcugcaagcccgucugcugcugcgugcccgccugcagcugcuccagcugcgggaagcggggcugcggcuccugcgggggcagcaagggcgggugcggcuccugcgggugcagccagugcuccugcugcaagcccugcugcugcagcuccggcugcgggagcuccugcugccagugcagcugcugcaagccguacugcagccagugcuccugcugcaagcccugcugcagcuccagcggccgcggguccagcugcugccaguccagcugcugcaagcccugcugcuccagcuccggcugcggcagcuccugcugccagagcuccugcugcaagcccugcugcagccagucccggugcugcgugccggucugcuaccagugcaagaucuga

SEQ ID NO: 32168 - RNA, 2787 nt, Artificial Sequence
  derived and/or modified sequence opt1 from KSR1__Homo_sapiens__XP_006722214
auggaccgcgccgcccugcgggcggccgccaugggcgagaagaaggagggcggcgggggcggggacgccgccgcggccgagggcggcgccggggccgcggccagccgcgcccuccagcagugcggccagcugcagaagcugaucgacaucuccaucgggagccuccggggccugcgcaccaagugcgccguguccaacgaccugacccagcaggagauccggacgcucgaggccaagcugguccgcuacaucugcaagcagcggcagugcaagcugagcguggcgcccggggagcgcaccccggagcucaacuccuacccccgguucagcgacuggcuguacaccuucaacgugcgccccgaggucgugcaggagaucccccgggaccugacccucgacgcccugcuggagaugaacgaggccaaggugaaggagacgcuccgccggugcggcgccuccggcgacgagugcgggcgccugcaguacgcccugaccugccuccggaaggucaccggccucgggggcgagcacaaggaggacagcuccuggagcucccuggacgcgcgccgggagagcggcuccgggccgagcaccgacacgcuguccgccgccagccugcccuggccgcccggcuccagccagcuggggcgcgccggcaacuccgcccaggggccccggagcaucagcguguccgcgcuccccgccagcgacucccccacccccagcuucuccgagggccugagcgacacgugcaucccgcugcacgccuccggccgccucacgccccgggcccugcacagcuucaucaccccgcccaccacgccccagcugcgccgccacaccaagcucaagccgccccggacgccgcccccgcccucccgcaagguguuccagcugcugcccagcuuccccacccucacccgguccaagagccacgagucccagcuggggaaccgcaucgacgacgucagcuccaugcgguucgaccugagccacgggagcccccagauggugcgccgggacaucgggcucuccgugacccaccgcuucuccaccaaguccuggcugagccaggucugccacgugugccagaaguccaugaucuucggcgugaagugcaagcacugccggcugaagugccacaacaagugcaccaaggaggcccccgcgugccgcaucagcuuccucccccugacccggcugcgccggaccgagagcguccccagcgacaucaacaaccccguggaccgcgccgccgagccccacuucgggacccucccgaaggcccugaccaagaaggagcacccgcccgcgaugaaccaccuggacuccagcuccaaccccagcuccaccaccagcuccacgcccagcucccccgcccccuuccccaccagcuccaacccgagcuccgccaccaccccgcccaaccccagccccggccagcgggacagccgcuucaacuuccccgccgccuacuucauccaccaccggcagcaguucaucuuccccgacaucuccgcguucgcccacgccgcgccccucccggaggccgccgacggcacgcgccuggacgaccagcccaaggccgacgugcuggaggcccacgaggccgaggccgaggagcccgaggcgggcaagagcgaggccgaggacgacgaggacgaggucgacgaccuccccuccagccggcgcccguggcgcgggcccaucucccggaaggccagccagaccuccguguaccugcaggagugggacauccccuucgagcaggucgagcugggggagcccaucggccaggggcgcuggggccgggugcaccgcggccgguggcacggggagguggccauccgccugcucgagauggacggccacaaccaggaccaccugaagcuguucaagaaggaggugaugaacuaccggcagacccgccacgagaacgucguccucuucaugggggcgugcaugaacccgccccaccuggccaucaucaccagcuucugcaagggccggacgcugcacuccuucgugcgcgaccccaagaccagccucgacaucaacaagacccggcagaucgcccaggagaucaucaagggcaugggguaccugcacgccaagggcaucgugcacaaggaccugaaguccaagaacguguucuacgacaacgggaaggucgugaucaccgacuucggccucuucgggaucagcggcgugguccgcgagggccggcgcgagaaccagcugaagcugucccacgacuggcucugcuaccuggccccggagaucgugcgggagaugacccccgggaaggacgaggaccagcugcccuucagcaaggcggccgacguguacgccuucggcacggucugguacgagcuccaggcccgcgacuggccccugaagaaccaggccgcggaggccuccaucuggcagaucgggagcggcgaggggaugaagcgggugcugaccuccgugagccucggcaaggaggucuccgagauccugagcgccugcugggccuucgaccugcaggagcgcccgagcuucucccuccugauggacaugcuggagaagcuccccaagcugaaccggcgccugagccaccccggccacuucuggaaguccgccgaccgguggcgcagccgcuacuacgggaagggccgguacgggcaccccgacuucaaguccagcugcccgauccucgaggaguacaucaacuccagcaagguggugccccgcuucgagcgguucggccuggggguccuggaguccagcaaccccaagauguga

SEQ ID NO: 32169 - RNA, 2766 nt, Artificial Sequence
  derived and/or modified sequence opt1 from KSR2__Homo_sapiens__NP_775869
augaucgaccugagcaucuccaaccucgagggccugcgcaccaagugcgccaccagcaacgaccugacgcagaaggagauccggacccucgaguccaagcuggugaaguacuucagccgccagcuguccugcaagaagaaggucgcccuccaggagcggaacgcggagcuggacggguucccccagcugcgccacugguuccggaucguggacgugcgcaaggagguccucgaggagaucagcccgggccagcugucccuggaggaccuccuggagaugaccgacgagcaggugugcgagaccguggagaaguacggggccaaccgggaggagugcgcccgccugaacgccagccucuccugccugcggaacguccacaugagcggcgggaaccuguccaagcaggacuggacgauccaguggcccaccaccgagaccggcaaggagaacaaccccgugugccccccggagcccacgcccuggauccgcacccaccucagccaguccccccgggugccgagcaagugcguccagcacuacugccacaccucccccacccccggcgcccccguguacacgcacguggaccgccugaccgucgacgcguacccggggcugugccccccccccccgcucgagagcggccaccggucccugccccccagcccccgccagcggcacgccgugcgcaccccgccccggacccccaacaucgugacgaccgucacccccccggggaccccccccaugcgcaagaagaacaagcugaagcccccgggcacgccccccccguccagccggaagcucauccaccugauccccggguucaccgcccugcaccgcagcaagucccacgaguuccagcucggccaccggguggacgaggcccacacccccaaggcgaagaagaagagcaagccccugaaccugaagauccacuccagcgugggcuccugcgagaacaucccgagccagcagcgcuccccccuccugagcgagcgcucccugcggagcuucuucgucgggcacgcccccuuccuccccuccaccccgcccgugcacacggaggccaacuucagcgccaacacccuguccgugccccgcuggagcccccagaucccgcggcgcgaccugggcaacuccaucaagcaccgguucagcaccaaguacuggaugucccagaccugcacggucugcgggaagggcaugcucuucggccugaagugcaagaacugcaagcugaagugccacaacaagugcaccaaggaggccccccccugccaccuccugaucauccaccgcggggaccccgcgcggcuggugcgcaccgagagcgugccgugcgacaucaacaacccccuccggaagcccccccgcuacuccgaccugcacaucagccagacccugccgaagacgaacaagaucaacaaggaccacauccccguccccuaccagcccgacagcuccagcaacccguccagcaccaccuccagcacccccuccagccccgccccgccccucccccccuccgccacgccgcccagcccccugcaccccuccccgcagugcacccggcagcagaagaacuucaaccugcccgccagccacuacuacaaguacaagcagcaguucaucuuccccgacgugguccccgugccggagacccccacccgcgccccccaggugauccuccaccccgucaccuccaacccgauccuggagggcaacccccugcugcagaucgagguggagcccacgagcgagaacgaggaggugcacgacgaggcggaggaguccgaggacgacuucgaggagaugaaccucagccugcuguccgcccggagcuucccccgcaaggccagccagaccuccaucuuccuccaggagugggacaucccguucgagcagcuggagaucggggagcugaucggcaaggggcgguucggccaggucuaccacggccgcuggcacggggagguggccauccggcucaucgacaucgagcgcgacaacgaggaccagcugaaggccuucaagcgggaggugauggcguaccgccagacccgccacgagaacgucgugcuguucaugggcgccugcaugagccccccccaccucgccaucaucaccucccugugcaaggggcggacgcuguacagcgugguccgcgacgccaagaucgugcucgacgugaacaagacccggcagaucgcccaggagaucgucaagggcaugggguaccugcacgcgaagggcauccugcacaaggaccucaaguccaagaacguguucuacgacaacggcaagguggucaucaccgacuucgggcuguucagcaucuccggcgugcugcaggccgggcgccgggaggacaagcuccgcauccagaacggcuggcugugccaccuggcccccgagaucauccggcagcucagcccggacaccgaggaggacaagcugcccuucuccaagcacagcgacguguucgcccuggggacgaucugguacgagcuccacgcgcgcgaguggcccuucaagacccagcccgccgaggccaucaucuggcagaugggcaccggcaugaagccgaaccugucccagaucgggaugggcaaggagaucagcgacauccugcucuucugcugggccuucgagcaggaggagcggcccaccuucacgaagcugauggacaugcuggagaagcuccccaagcgcaaccggcgccugucccacccggggcacuucuggaagagcgccgagcuguga

SEQ ID NO: 32170 - RNA, 4074 nt, Artificial Sequence
  derived and/or modified sequence opt1 from KTN1__Homo_sapiens__NP_001072989
auggaguucuacgagagcgccuacuucaucgugcugauccccuccaucgucaucaccgugaucuuccucuucuucuggcuguucaugaaggagacccuguacgacgaggugcucgccaagcagaagcgcgagcagaagcugaucccgacgaagaccgacaagaagaaggcggagaagaagaagaacaagaagaaggagauccagaacggcaaccugcacgagagcgacuccgagagcgucccccgggacuucaagcucuccgacgcccuggccguggaggacgaccagguggcccccgucccccugaacgugguggagaccagcuccagcguccgcgagcggaagaagaaggagaagaagcagaagccggugcucgaggagcaggucaucaaggaguccgacgccagcaagauccccgggaagaagguggagcccgugcccgugaccaagcagccgacgccgcccuccgaggcggccgccagcaagaagaagcccggccagaagaaguccaagaacgggagcgacgaccaggacaagaaggucgagacccugauggugcccuccaagcgccaggaggcccugccccuccaccaggagaccaagcaggagagcggcuccgggaagaagaaggcgagcuccaagaagcagaagaccgagaacguguucgucgacgagccccugauccacgccacgaccuacaucccccugauggacaacgccgacagcagcccggugguggacaagcgggaggucaucgaccuccugaagcccgaccagguggagggcauccagaaguccggcaccaagaagcugaagaccgagacggacaaggagaacgccgaggugaaguucaaggacuuccuccugagccugaagaccaugauguucuccgaggacgaggcccucugcgucguggaccugcugaaggagaaguccggggucauccaggacgcgcucaagaaguccagcaagggcgagcugaccacccugauccaccagcuccaggagaaggacaagcugcuggccgccgugaaggaggacgccgccgcgacgaaggaccgcugcaagcagcucacccaggagaugaugaccgagaaggagcggagcaacguggucaucacccgcaugaaggaccggaucgggacgcuggagaaggagcacaacguguuccagaacaagauccacgugagcuaccaggagacccagcagaugcagaugaaguuccagcagguccgcgagcagauggaggccgagaucgcccaccugaagcaggagaacggcauccuccgggacgccguguccaacaccaccaaccagcuggagagcaagcaguccgccgagcugaacaagcuccgccaggacuacgcgcggcuggugaacgagcugacggagaagaccgggaagcuccagcaggaggagguccagaagaagaacgccgagcaggccgccacccagcugaaggugcagcugcaggaggccgagcgccggugggaggaggugcagagcuacauccgcaagcggaccgcggagcacgaggccgcccagcaggaccuccaguccaaguucgucgccaaggagaacgaggugcagagccugcacuccaagcugacggacacccucgugagcaagcagcagcuggagcagcgccugaugcagcucauggaguccgagcagaagcgggucaacaaggaggagagccugcagaugcagguccaggacauccuggagcagaacgaggcgcugaaggcccagauccagcaguuccacucccagaucgccgcccagaccagcgccagcgugcucgcggaggagcugcacaaggugaucgccgagaaggacaagcagaucaagcagaccgaggacucccuggccagcgagcgcgaccggcucacguccaaggaggaggagcugaaggacauccagaacaugaacuuccugcucaaggccgaggugcagaagcugcaggcccuggcgaacgagcaggccgccgccgcccacgagcucgagaagaugcagcagagcguguacgucaaggacgacaagauccgccugcuggaggagcagcuccagcacgagaucuccaacaagauggaggaguucaagauccugaacgaccagaacaaggcgcucaagagcgaggugcagaagcuccagacccugguguccgagcagcccaacaaggacgucguggagcagauggagaagugcauccaggagaaggacgagaagcugaagaccguggaggagcuccuggagaccggccugauccaggucgccacgaaggaggaggagcucaacgccauccgcaccgagaacagcucccugaccaaggaggugcaggaccugaaggccaagcagaacgaccaggugagcuucgcgucccucgucgaggagcugaagaaggugauccacgagaaggacggcaagaucaagagcguggaggagcugcucgaggccgagcugcugaaggucgccaacaaggagaagaccgugcaggaccucaagcaggagaucaaggcccugaaggaggagaucgggaacgugcagcuggagaaggcccagcagcucuccaucaccagcaagguccaggagcugcagaaccugcucaagggcaaggaggagcagaugaacacgaugaaggcggugcuggaggagaaggagaaggaccuggccaacaccgggaaguggcuccaggaccugcaggaggagaacgagucccugaaggcccacgugcaggaggucgcccagcacaaccucaaggaggccagcuccgcgagccaguucgaggagcuggagaucgugcugaaggagaaggagaacgagcucaagcggcuggaggccaugcugaaggagcgcgagagcgaccucuccagcaagacccagcugcugcaggacgugcaggacgagaacaagcuguucaagucccagaucgagcagcugaagcagcagaacuaccagcaggccagcuccuucccgccccacgaggagcugcucaaggucaucagcgagcgggagaaggagaucuccggccuguggaacgagcuggacagccucaaggacgccguggagcaccagcgcaagaagaacaacgaccugcgggagaagaacugggaggccauggaggcgcuggccuccaccgagaagaugcuccaggacaaggugaacaagacgagcaaggagcgccagcagcaggucgaggccguggagcuggaggccaaggaggugcugaagaagcuguuccccaaggucuccgugcccagcaaccucuccuacggcgaguggcugcacggguucgagaagaaggcgaaggagugcauggccggcaccagcggguccgaggaggugaagguccucgagcacaagcugaaggaggccgacgagaugcacacccugcuccagcuggagugcgagaaguacaagagcgugcuggccgagaccgagggcauccuccagaagcugcagcgguccgucgagcaggaggagaacaaguggaaggugaagguggacgagagccacaagacgaucaagcagaugcaguccagcuucaccagcuccgagcaggagcuggagcgccuccggagcgagaacaaggacaucgagaaccugcgccgggagcgcgagcaccuggagauggagcucgagaaggccgagauggagcgguccaccuacgucaccgaggugcgcgagcugaaggaccugcucacggagcugcagaagaagcuggacgacagcuacuccgaggcggugcggcagaacgaggagcucaaccugcugaaggcccagcucaacgagacccugaccaagcugcgcaccgagcagaacgagcggcagaaggucgccggggaccuccacaaggcccagcagagccuggagcugauccaguccaagaucgugaaggccgcgggcgacacgaccgugaucgagaacagcgacgucucccccgagaccgagagcuccgagaaggagaccaugagcgugucccucaaccagacggugacccagcugcagcagcugcugcaggccgucaaccagcagcucaccaaggagaaggagcacuaccaggugcuggaguga

SEQ ID NO: 32171 - RNA, 924 nt, Artificial Sequence
  derived and/or modified sequence opt1 from KYNU__Homo_sapiens__NP_001028170
auggagcccagcucccuggagcucccggccgacaccgugcagcgcaucgccgcggagcugaagugccaccccaccgacgagcgggucgcccugcaccucgacgaggaggacaagcugcgccacuuccgggagugcuucuacauccccaagauccaggaccugcccccgguggaccucagccuggugaacaaggacgagaacgccaucuacuuccugggcaacucccucgggcugcagcccaagauggucaagacguaccuggaggaggagcucgacaagugggccaagaucgccgcguacggccacgagguggggaagcgccccuggaucaccggcgacgagagcaucguggggcugaugaaggacaucgucggcgccaacgagaaggagaucgcccugaugaacgcccucaccgugaaccugcaccuccugaugcuguccuucuucaagcccaccccgaagcgguacaagauccugcucgaggcgaaggccuuccccagcgaccacuacgccaucgagucccagcugcagcugcacggccucaacaucgaggagagcaugcgcaugaucaagccccgggagggggaggagacgcugcgcaucgaggacauccuggaggugaucgagaaggagggcgacuccaucgccgucauccucuucagcggggugcacuucuacaccggccagcacuucaacauccccgccaucaccaaggcggggcaggccaagggcugcuacgugggcuucgaccuggcccacgccgucgggaacguggagcuguaccuccacgacuggggcguggacuucgccugcuggugcuccuacaaguaccugaacgcgggggccggcggcaucgccggggccuucauccacgagaagcacgcccacaccaucaagccggcgcggagcgaguucuucaacuga

SEQ ID NO: 32172 - RNA, 3774 nt, Artificial Sequence
  derived and/or modified sequence opt1 from L1CAM__Homo_sapiens__NP_000416
augguggucgcccugcgcuacguguggccccuccugcugugcagcccgugccuccugauccagauccccgaggaguacgagggccaccacgugauggagccgcccgucaucaccgagcagagcccccggcgccuggugguguuccccaccgacgacaucucccucaagugcgaggccuccgggaagcccgagguccaguuccgguggacgcgcgacggcgugcacuucaagcccaaggaggagcugggggugaccgucuaccagagcccgcacuccggcagcuucaccaucaccgggaacaacuccaacuucgcgcagcgguuccagggcaucuaccgcugcuucgccagcaacaagcugggcacggccaugucccacgagauccggcucauggccgagggggcccccaaguggcccaaggagaccgugaagcccguggaggucgaggagggcgagagcguggugcugccgugcaacccgccgcccuccgcggagccccugcgcaucuacuggaugaacagcaagauccuccacaucaagcaggacgagcgggucaccauggggcagaacggcaaccuguacuucgccaacgugcugaccuccgacaaccacagcgacuacaucugccacgcccacuuccccgggacgcgcaccaucauccagaaggagcccaucgaccuccgggugaaggccaccaacuccaugaucgaccgcaagccccggcugcuguuccccaccaacagcuccagccaccucgucgcgcugcagggccagccccuggugcucgagugcaucgccgagggcuuccccacgcccaccaucaaguggcugcgcccguccgggcccaugcccgccgaccgggugaccuaccagaaccacaacaagacccugcagcuccugaaggucggcgaggaggacgacggggaguaccgcugccuggccgagaacagccucggcagcgcccggcacgcguacuacgugacgguggaggccgcccccuacuggcugcacaagccgcagucccaccuguacggccccggggagaccgcccgccucgacugccagguccagggccggccccagccggaggugaccuggcgcaucaacgggauccccgucgaggagcuggccaaggaccagaaguaccggauccagcgcggcgcgcugauccucagcaacgugcagcccuccgacaccauggugacgcagugcgaggcccgcaaccggcacgggcugcugcucgccaacgccuacaucuacgucgugcagcugcccgccaagauccugaccgcggacaaccagaccuacauggccgugcagggcagcaccgccuaccuccugugcaaggccuucggcgccccgguccccuccgugcaguggcuggacgaggacgggacgaccgugcuccaggacgagcgcuucuuccccuacgcgaacggcacccuggggauccgggaccugcaggccaacgacaccggccgcuacuucugccucgccgccaacgaccagaacaacgucacgaucauggcgaaccugaaggugaaggacgccacccagaucacccaggggccccggagcaccaucgagaagaagggcucccgcgugacguucacgugccaggccagcuucgacccgucccugcagcccagcaucaccuggcggggcgacgggcgcgaccuccaggagcugggcgacuccgacaaguacuucaucgaggacgggcggcuggucauccacagccuggacuacuccgaccagggcaacuacagcugcguggccuccaccgagcucgacguggucgagagccgcgcccagcugcuggugguggggucccccggccccgucccgcggcucgugcugagcgaccugcaccuccugacgcagucccaggugcgcgucagcuggagccccgcggaggaccacaacgcccccaucgagaaguacgacaucgaguucgaggacaaggagauggcccccgagaagugguacucccugggcaaggugccggggaaccagaccagcaccacccucaagcugucccccuacgugcacuacaccuuccgggucacggccaucaacaaguacggccccggggagcccagcccgguguccgagaccguggucacccccgaggccgcgcccgagaagaaccccguggacgugaagggcgagggcaacgagaccacgaacauggucaucaccuggaagccgcugcgcuggauggacuggaacgcgccccaggugcaguaccgggugcaguggcgcccccaggggacccggggcccguggcaggagcagaucgucagcgaccccuuccucgugguguccaacaccagcacguucguccccuacgagaucaaggugcaggccgugaacucccaggggaagggccccgagccgcaggucaccaucggguacagcggcgaggacuacccccaggccauccccgagcuggagggcaucgagauccugaacuccagcgccgugcucgugaaguggcgccccgucgaccuggcccaggugaaggggcaccuccggggcuacaacgugaccuacuggcgcgaggggucccagcgcaagcacagcaagcggcacauccacaaggaccacgucguggugccggccaacaccacguccgucauccugagcggccugcgccccuacuccagcuaccaccuggaggugcaggccuucaacgggcggggcagcggccccgccuccgaguucaccuucagcacccccgagggggugccgggccaccccgaggcgcuccaccuggagugccaguccaacaccagccugcuccugcgcuggcagccgccccugucccacaacgggguccucacgggcuacgugcugagcuaccacccccuggacgagggcgggaagggccagcucuccuucaaccugcgggaccccgagcugcgcacccacaaccucaccgaccugagcccccaccuccgguaccgcuuccagcugcaggccaccacgaaggaggggcccggcgaggccaucguccgggagggcgggaccauggcccuguccgggaucagcgacuucggcaacaucuccgccaccgcgggcgagaacuacagcgugguguccugggucccgaaggaggggcagugcaacuuccgcuuccacauccuguucaaggcccucggcgaggagaagggcggggccagccugagcccccaguacguguccuacaaccaguccagcuacacccagugggaccugcagcccgacacggacuacgagauccaccucuucaaggagcggauguuccgccaccagauggccgugaagaccaacggcaccgggcggguccgccugcccccggccggcuucgcgaccgaggggugguucaucggcuucguguccgccaucauccugcuccugcuggugcuccugauccugugcuucaucaagcggagcaagggcgggaaguacagcgucaaggacaaggaggacacccagguggacuccgaggcccgccccaugaaggacgagaccuucggcgaguaccggagccucgaguccgacaacgaggagaaggccuucgggagcucccagcccagccugaacggcgacaucaagccccugggguccgacgacagccucgccgacuacggcggguccguggacguccaguucaacgaggacggcagcuucaucggccaguacuccgggaagaaggagaaggaggcggccggcgggaacgacagcuccggcgccaccagcccgaucaaccccgccguggcgcuggaguga

SEQ ID NO: 32173 - RNA, 1392 nt, Artificial Sequence
  derived and/or modified sequence opt1 from L2HGDH__Homo_sapiens__XP_005268132
auggugcccgcccugcgcuaccucgucggcgccugcgggcgggcgcgcggccuguucgccgggggcagcccgggggccugcggcuucgccuccggccggccccgcccccugugcgggggcagccgguccgccagcaccuccagcuucgacaucgugaucgucgggggcgggaucgugggccucgcguccgcccgcgcccugauccugcggcaccccagccucuccaucggcgugcuggagaaggagaaggaccuggccgugcaccagaccgggcacaacagcggcgucauccacuccgggaucuacuacaagccggagagccucaaggcgaagcugugcgugcagggcgccgcccugcucuacgaguacugccagcagaagggcaucuccuacaagcagugcgggaagcugaucguggccgucgagcaggaggagaucccccgccugcaggcccucuacgagaagggccugcagaacggggugcccggccugcggcucauccagcaggaggacaucaagaagaaggagcccuacugccgcgggcugauggcgaucgacugcccgcacacgggcaucguggacuaccggcaggucgcccugagcuucgcccaggacuuccaggaggccggcggguccgugcucaccaacuucgaggugaagggcaucgagauggccaaggagagccccucccgcagcaucgacgggaugcaguaccccaucgucaucaagaacaccaagggcgaggagauccggugccaguacguggugaccugcgcggggcuguacuccgaccgcaucagcgagcugagcggcugcacgcccgacccgcggaucguccccuuccgcggcgacuaccuccugcugaagcccgagaagugcuaccucgugaaggggaacaucuaccccgugccggacucccgguuccccuuccugggcguccacuucacgccccgcauggacgggagcaucuggcugggccccaacgccgugcucgccuucaagcgggagggguaccgcccguucgacuucuccgccaccgacgugauggacaucaucaucaacagcggccugaucaagcuggccucccagaacuucagcuacggcgucaccgagauguacaaggcgugcuuccucggggccaccgugaaguaccugcagaaguucauccccgagaucaccaucuccgacauccugcggggccccgccgggguccgcgcccaggcccucgaccgcgacggcaaccugguggaggacuucguguucgacgcgggcgucggggacaucggcaaccggauccugcacgugcgcaacgcccccagcccggccgccaccuccagcaucgcgaucuccgggaugaucgccgacgaggugcagcagcgguucgagcucuga

SEQ ID NO: 32174 - RNA, 2319 nt, Artificial Sequence
  derived and/or modified sequence opt1 from L3MBTL1__Homo_sapiens__NP_056293
augcgccggcgcgagggccacgggaccgacagcgagaugggccaggggcccgugcgggagucccagagcuccgacccgcccgcccugcaguuccgcaucagcgaguacaagccccucaacauggccggcgucgagcagcccccgucccccgagcugcggcaggagggggugaccgaguacgaggacggcggcgcgcccgccggggacggcgaggccgggccccagcaggccgaggaccacccgcagaacccccccgaggaccccaaccaggacccgcccgaggacgacagcacgugccagugccaggccugcggcccccaccaggcggccgggcccgaccugggcuccagcaacgacggcugcccgcagcucuuccaggagcgcuccgugaucgucgagaacagcuccgggagcaccuccgccagcgagcugcugaagcccaugaagaagcggaagcgccgggaguaccagucccccagcgaggaggaguccgagcccgaggccauggagaagcaggaggagggcaaggacccggaggggcagcccaccgcgagcacccccgaguccgaggaguggagcagcucccagcccgccacgggcgagaagaaggagugcuggagcugggaguccuaccucgaggagcagaaggccaucaccgccccggugagccuguuccaggacucccaggccgugacccacaacaagaacggcuucaagcuggggaugaagcucgagggcaucgacccccagcaccccagcauguacuucauccugaccgucgcggaggugugcggguaccgccugcggcuccacuucgacggcuacuccgagugccacgacuucugggugaacgccaacagccccgacauccacccggccgggugguucgagaagacgggccacaagcugcagccccccaagggcuacaaggaggaggaguucuccuggagccaguaccugcgcuccacccgggcccaggccgcgccgaagcaccucuucgucagccagucccacagcccccccccccugggguuccaggugggcaugaagcuggaggccguggaccgcaugaacccgucccucgucugcguggccagcgugaccgacgucguggacucccgguuccuggugcacuucgacaacugggacgacaccuacgacuacuggugcgaccccagcucccccuacauccaccccgucggguggugccagaagcagggcaagccgcugacgcccccccaggacuaccccgacccggacaacuucugcugggagaaguaccucgaggagaccggggccagcgccgugcccaccugggcguucaaggugcgccccccccacagcuuccuggucaacaugaagcuggaggccguggaccggcgcaacccggcccucauccggguggccuccgucgaggacguggaggaccaccgcaucaagauccacuucgacggcuggagccacggcuacgacuucuggaucgacgccgaccaccccgacauccaccccgcgggguggugcuccaagaccggccacccccugcagccgccccuggggccccgggagcccagcuccgccagcccgggcgggugccccccccucuccuaccgcagccugccgcacacgcgcaccuccaaguacagcuuccaccaccggaagugccccacccccggcugcgacggcuccgggcacgucaccggcaaguucacggcccaccacugccugagcgggugcccccucgccgagcgcaaccagucccggcugaaggcggagcugagcgacuccgaggccagcgcccgcaagaagaaccucuccggcuucagcccgcggaagaagccccgccaccacggccggaucgggcgcccccccaaguaccggaagaucccgcaggaggacuuccagacccugacccccgacguggugcaccagagccuguucauguccgcccucagcgcccaccccgaccgcucccugagcgucugcugggagcagcacugcaagcugcuccccggcguggcggggaucuccgccagcaccguggccaaguggacgaucgacgaggucuucggcuucgugcagacccugaccgggugcgaggaccaggcccggcuguucaaggacgaggcccgcaucgugcgggucacccacguguccggcaagacgcucguguggaccgucgcgcagcugggcgaccuggugugcagcgaccaccuccaggaggggaagggcauccuggagaccggggugcacucccugcucugcagccugccgacccaccugcuggccaagcucuccuucgccagcgacucccaguacuga

SEQ ID NO: 32175 - RNA, 2118 nt, Artificial Sequence
  derived and/or modified sequence opt1 from L3MBTL2__Homo_sapiens__NP_113676
auggagaagccccgcagcaucgaggagaccccguccagcgagcccauggaggaggaggaggacgacgaccuggagcuguucggcggguacgacuccuuccggagcuacaacuccagcgugggcuccgagagcuccagcuaccuggaggaguccagcgaggccgagaacgaggaccgcgaggccggggagcugcccaccagcccccuccaccuccuguccccgggcacgccccggucccucgacgggagcggcuccgagcccgcggucugcgagaugugcggcaucguggggacccgcgaggccuucuucagcaagaccaagcgguucugcuccgugagcugcagccgcuccuacagcuccaacagcaagaaggccuccauccuggcccggcugcagggcaagcccccgaccaagaaggccaagguccuccacaaggcggccuggagcgccaagaucggggccuuccugcacucccagggcacggggcagcuggcggacggcacccccaccggccaggacgcccucgugcugggguucgacuggggcaaguuccugaaggaccacagcuacaaggccgcccccguguccugcuucaagcacgucccccucuacgaccagugggaggacgugaugaaggggaugaagguggagguccugaacagcgacgccgugcugccgucccgcguguacuggaucgcgagcgucauccagaccgccggcuaccgggugcuccugcgcuacgagggcuucgagaacgacgccucccacgacuucuggugcaaccuggggacgguggacguccaccccaucggcuggugcgccaucaacagcaagauccucgugccgccccggaccauccacgccaaguucaccgacuggaagggguaccugaugaagcgccuggugggcucccggacccuccccgucgacuuccacaucaagaugguggagagcaugaaguaccccuuccgccaggggaugcggcuggagguggucgacaagucccaggugagccgcacgcggauggcgguggucgacaccgugaucggcggccgccugcggcuccuguacgaggacggggacuccgacgacgacuucuggugccacauguggagcccccugauccaccccgucggcuggagccgccggguggggcacggcaucaagauguccgagcgccgcagcgacauggcccaccacccgaccuuccggaagaucuacugcgacgccgugcccuaccucuucaagaagguccgcgccguguacaccgagggcgggugguucgaggagggcaugaagcuggaggccaucgacccccugaaccucgggaacaucugcguggcgacggucugcaaggugcugcuggacggcuaccucaugaucugcguggacgggggccccuccaccgacgggcuggacugguucugcuaccacgccagcucccacgccaucuucccggccaccuucugccagaagaacgacaucgagcugaccccgcccaagggcuacgaggcccagacguucaacugggagaacuaccucgagaagaccaagagcaaggcggcccccucccggcuguucaacauggacugccccaaccacggcuucaaggucgggaugaagcuggaggccguggaccucauggagccccgccugaucugcguggccaccgucaagcggguggugcaccgccugcucagcauccacuucgacggcugggacuccgaguacgaccagugggucgacugcgagagccccgacaucuacccggugggguggugcgagcugaccggcuaccagcugcagccgcccguggcggccgagcccgccacgccccucaaggccaaggaggccaccaagaagaagaagaagcaguucggcaagaagcggaagcgcaucccgcccaccaagacccggccccugcgccagggguccaagaagccccugcuggaggacgacccccagggcgcgcggaagaucagcuccgagcccguccccggggagaucaucgccgugcgcgugaaggaggagcaccucgacgucgccagcccggacaaggccuccagccccgagcugcccguguccguggagaacaucaagcaggagacggacgacuga

SEQ ID NO: 32176 - RNA, 2268 nt, Artificial Sequence
  derived and/or modified sequence opt1 from L3MBTL3__Homo_sapiens__NP_001007103
augaccgagagcgccuccagcaccuccggccaggaguucgacguguucagcgucauggacuggaaggacggggugggcacgcugcccggguccgaccucaaguuccgcgugaacgaguucggcgcccuggaggucaucaccgacgagaacgagauggagaacgugaagaaggcgaccgccaccacgaccuggauggugccgaccgcccaggaggucuucagcgagaagaccgggaugcccuuccggcugaaggaccccgugaagguggagggccuccaguucugcgagaacugcugccaguacggcaacgucgacgagugccuguccgggggcaacuacugcagccagaacugcgcccgccacaucaaggacaaggaccagaaggaggagcgggacguggaggaggacaacgaggaggaggaccccaagugcucccgcaagaagaagccgaagcugagccucaaggccgacacgaaggaggacggggaggagcgggacgacgagauggagaacaagcaggacgugcgcauccugcggggcucccagcgcgcgcggcgcaagcggcgcggggacagcgccguccugaagcagggccucccgcccaagggcaagaaggccuggugcugggccuccuaccuggaggaggagaaggcgguggccgugcccgccaagcuguucaaggagcaccagagcuuccccuacaacaagaacggguucaaggucggcaugaagcucgaggggguggaccccgagcaccaguccguguacugcguccugaccguggccgaggugugcggcuaccggaucaagcugcacuucgacggcuacagcgacugcuacgacuucugggucaacgccgacgcgcucgacauccaccccgugggguggugcgagaagaccggccacaagcugcacccgcccaagggguacaaggaggaggaguucaacuggcagaccuaccugaagacgugcaaggcccaggccgcccccaagucccucuucgagaaccagaacaucaccgugauccccagcggcuuccgcgucgggaugaagcuggaggccguggacaagaagaaccccuccuucaucugcgucgcgaccgugaccgacaugguggacaaccgguuccugguccacuucgacaacugggacgagagcuacgacuacuggugcgaggccagcuccccgcacauccaccccgugggcuggugcaaggagcaccgccggacgcucaucaccccgcccggcuaccccaacgugaagcacuucagcugggacaaguaccuggaggagaccaacucccugcccgcccccgcccgcgccuucaaggucaagcccccgcacggguuccagaagaagaugaagcucgaggugguggacaagcggaaccccauguucauccgcgucgcgaccguggccgacacggacgaccaccgggugaagguccacuucgacggcuggaacaacugcuacgacuacuggaucgacgccgacagccccgacauccaccccgugggguggugcuccaagaccggccacccgcugcagccgccccugagcccccucgagcugauggaggccuccgagcacgggggcugcagcacccccggcugcaaggggaucggccacuucaagcgcgcccgccaccuggggccccacuccgcggccaacugccccuacagcgagaucaaccucaacaaggaccggaucuucccggaccgccuguccggcgagaugccgcccgccagccccuccuucccccggaacaagcgcaccgacgccaacgagagcuccagcucccccgagauccgggaccagcacgcggacgacgugaaggaggacuucgaggagcgcacggagagcgagaugcggaccucccacgaggcccgcggggcccgggaggagcccaccguccagcaggcccagcgccggagcgccguguuccugagcuucaagucccccaucccgugccucccccugcgcugggagcagcagagcaagcugcuccccaccguggcgggcauccccgccuccaaggucagcaagugguccacggacgaggugagcgaguucauccagucccugccgggcugcgaggagcacgggaagguguucaaggacgagcagaucgacggcgaggccuuccugcucaugacccagaccgacaucgucaagaucaugagcaucaagcuggggcccgcccugaagaucuucaacuccauccucauguucaaggccgcggagaagaacagccacaacgagcuguga

SEQ ID NO: 32177 - RNA, 1872 nt, Artificial Sequence
  derived and/or modified sequence opt1 from L3MBTL4__Homo_sapiens__NP_775735
augaagcagcccaaccgcaagcggaagcugaacauggacagcaaggagcgccucgaccaggacggccggcuggagcaggccgaggaggagaagaagccgaaggacuccaccacgccccugagccacgugcccuccgccgcggcccagggggccuggagcugggagugguaccucaaggagcagaaggccgucgccgcgcccguggagcuguucuccaaggaccagagcuucccggagcacgagaacggcuuccagaucgggaugcgccuggagggcaucgacccccggcaccccuccguguucugcguccucagcguggccgaggugugcggguaccgccugcggcugcacuucgacggcuaccucuccugcuacgacuucuggaccaacgccggcagccccgacauccacccggucggguggugcgagaagaccaagcacgagcugcacauccccaagggcuaccgcaaggacaaguucguguggauggacuaccugaaggccugcaagcuccagaacgcgcccaagaagcuguuccggaaccgcucccccaacgggccgaugagcaaggaguuccaggugggcaugaagcuggaggccgucgaccggaagaaccccucccucgugugcguggccaccaucgccgacaucgucgaggaccgccugcuggugcacuucgacaacugggacgacagcuacgacuacuggugcgacgugaacucccccuacguccagcccgugggguggugccaggagaacggccggacccucaucgccccgcagggcuaccccaaccccgagaacuucagcuggacggaguaccuggaggcgacccagaccaacgccgugcccgccaaggucuucaagaugcgccugccgcacggguuccuccccaacaugaagcuggaggugguggacaagcggaacccccgccugauccgggucgccaccaucguggacguggacgaccagcgcgucaaggugcacuucgacggcugggaccacaaguacgacuacugggucgaggccgacucccccgacauccacccgaucggguggugcgacgugacgggccacccccucgaggugccccagcggaccaacgaccugaagauccugcccggccaggcggucugcccgacccccgggugccgcggcaucgggcacauccggggcccccgcuacagcgggcaccacuccgccuucggcugcccguacagcgacaugaaccucaagaaggaggccacccugcacgaccgccugcgggagcagacgcaggccaaccucgagagcgacuccagccacuccaagagcaagucccugugcagccugaacuucaacggcaagcacgagaaggugaacucccagccccgccucgugcagcaggccaagugccugaagaucaaggggaaggaggacaucgaccuggacaaccucuuccggguccuggugcugcacccccgcggccucgaguacagcguggagcaggcgcagcagguccugcaccaguccgugagcauguccaccgugagcgcccaccccuuccgggaccugccgcucgggcgcgagcagcacugcaagcugcugcccggcgucgccgacauccgggccucccagguggcccgcuggaccguggacgaggucgcggaguucgugcagagccuccuggggugcgaggagcacgccaagugcuucaagaaggagcagaucgacggcaaggccuuccugcuccugacccagacggacaucgugaaggucaugaagaucaagcugggccccgcccugaagaucuacaacuccauccucauguuccggcacagccaggagcugcccgaggaggacaucgcguccgggcaggaggugcgcggcuga

SEQ ID NO: 32178 - RNA, 1293 nt, Artificial Sequence
  derived and/or modified sequence opt1 from LACC1__Homo_sapiens__XP_006719829
auggccgaggccgugcugaucgaccucuucggccugaagcugaacagccagaagaacugccaccagacccuccugaagacccugaacgcgguccaguaccaccacgccgccaaggccaaguuccucugcaucaugugcugcuccaacaucagcuacgagcgcgacggggagcaggacaacugcgagaucgagacguccaacggccugagcgcccugcucgaggaguucgagaucguguccugccccagcauggcggccacccuguacaccaucaagcagaagaucgacgagaagaaccuguccagcaucaaggugaucgucccgcggcaccgcaagacccucaugaaggccuucaucgaccagcuguucacggacguguacaacuucgaguucgaggaccuccaggugaccuuccgcgggggccucuucaagcaguccaucgagaucaacgucaucaccgcccaggagcugcgggggauccagaacgagaucgagaccuuccugcggagccuccccgcgcugcgcggcaagcugacgaucaucaccuccagccucauccccgacaucuucauccacggcuucaccacccggaccgggggcaucuccuacauccccacgcugagcuccuucaaccuguucagcuccagcaagcgccgggacccgaagguggugguccaggagaaccuccgccggcuggccaacgccgccggguucaacguggagaaguucuaccgcaucaagacccaccacuccaacgacaucuggaucaugggccggaaggagcccgacagcuacgacgggaucaccacgaaccagcgcggcgugaccaucgccgcgcugggcgccgacugcauccccaucgucuucgccgaccccgugaagaaggccugcgggguggcccacgcgggcuggaaggggacccuccugggcgucgccauggccaccgugaacgccaugaucgccgaguacggcugcagccuggaggacaucguggucgugcucgggccguccgugggccccugcugcuucacgcugccccgggagagcgcggaggccuuccacaaccugcaccccgccugcguccagcuguucgacuccccgaaccccugcaucgacauccgcaaggccacccggauccugcuggagcagggcgggauccucccccagaacauccaggaccagaaccaggaccugaaccugugcaccagcugccaccccgacaaguucuucucccacgugcgcgacgggcucaacuucggcacccagaucggcuucaucagcaucaaggaguga

SEQ ID NO: 32179 - RNA, 1446 nt, Artificial Sequence
  derived and/or modified sequence opt1 from LACE1__Homo_sapiens__NP_660358
auggccgccagcuggucccugcucgugacccugcgcccccuggcgcagagcccgcuccggggccgcugcgucgggugcggcgccugggccgccgcccuggcgccccuggccaccgcccccgggaagcccuucuggaaggccuacacggugcagaccuccgagagcaugaccccgaccgcgacguccgagaccuaccucaaggcccuggccgugugccacggcccccuggaccacuacgacuuccucaucaaggcccacgagcugaaggacgacgagcaccagcggcgcgucauccagugccugcagaagcuccacgaggaccugaagggguacaacaucgaggccgagggccuguucagcaagcuguucucccggagcaagccgccccgcggccucuacguguacggggacgugggcaccgggaagaccauggucauggacauguucuacgcguacguggagaugaagcggaagaagcgcgugcacuuccacggcuucaugcuggacguccacaagcggauccaccgccucaagcagucccugcccaagcggaagcccggguucauggccaagagcuacgaccccaucgcccccaucgccgaggagaucuccgaggaggccugccugcucugcuucgacgaguuccaggugacggacaucgcggacgccaugauccugaagcagcuguucgagaaccucuucaagaacggcguggucgugguggccaccagcaaccgcccgcccgaggaccuguacaagaacggccugcagcgggccaacuucguccccuucaucgccgugcucaaggaguacugcaacaccgugcagcuggacuccgggaucgacuaccgcaagcgggagcugcccgcggccggcaagcucuacuaccugaccagcgaggccgacgucgaggccgugauggacaagcuguucgacgagcucgcccagaagcagaacgaccugacgcgcccgcggauccugaaggugcaggggcgcgagcuccggcugaacaaggcgugcggcaccgucgccgacugcaccuucgaggagcugugcgagcgcccccucggcgccuccgacuaccuggagcugagcaagaacuucgacaccaucuuccuccggaacaucccccaguucacgcuggccaaccgcacccaggggcgccgguucaucacccugaucgacaacuucuacgaccucaaggugcgcaucaucugcuccgcgagcacccccaucuccagccuguuccugcaccagcaccacgacagcgagcucgagcagucccggauccugauggacgaccugggccugagccaggacuccgccgaggggcucagcauguucacgggcgaggaggagaucuucgccuuccagcgcaccaucucccggcugaccgagaugcagaccgagcaguacuggaacgagggggaccgcacgaagaaguga

SEQ ID NO: 32180 - RNA, 417 nt, Artificial Sequence
  derived and/or modified sequence opt1 from LACRT__Homo_sapiens__NP_150593
augaaguucaccacccuccuguuccuggccgccguggcgggcgcccuggucuacgccgaggacgccagcuccgacagcacgggggccgaccccgcgcaggaggccggcaccuccaagccgaacgaggagaucagcgggcccgccgagcccgccagcccgcccgagaccaccacgaccgcgcaggagaccagcgccgccgccgugcagggcaccgccaaggugacguccagccgccaggagcucaacccccugaaguccaucgucgagaaguccauccugcucaccgagcaggcgcuggccaaggccgggaagggcaugcacggcggggugcccggcgggaagcaguucaucgagaacggcuccgaguucgcccagaagcugcucaagaaguucagccugcugaagcccugggccuga

SEQ ID NO: 32181 - RNA, 1644 nt, Artificial Sequence
  derived and/or modified sequence opt1 from LACTB__Homo_sapiens__NP_116246
auguaccgccugaugagcgccgugaccgcccgggcggccgcccccggcgggcucgccuccagcugcggccgccgcgggguccaccagcgggccggccugccgccccuggggcacggcugggugggcgggcucggccuggggcugggccucgcgcugggggugaagcuggccggcggccuccgcggggccgcccccgcgcagucccccgccgccccggaccccgaggccagcccccuggccgagcccccgcaggagcagucccuggcgcccuggagcccccagacccccgccccgcccugcucccggugcuucgcccgggccaucgagagcucccgcgaccuccugcaccggaucaaggacgaggucggcgcccccgggaucguggugggcgucagcguggacggcaaggaggugugguccgaggggcugggcuacgcggacgucgagaaccgcgugcccugcaagccggagacggugaugcggaucgccagcaucuccaagagccucaccauggucgcccuggccaagcugugggaggccgggaagcucgaccuggacauccccgugcagcacuacgugcccgaguuccccgagaaggaguacgagggcgagaaggucuccgugaccacccgccugcucaucagccaccuguccgggauccggcacuacgagaaggacaucaagaaggugaaggaggagaaggcguacaaggcccugaagaugaugaaggagaacgucgccuucgagcaggagaaggagggcaagagcaacgagaagaacgacuucacgaaguucaagaccgagcaggagaacgaggccaagugccgcaacuccaagccgggcaagaagaagaacgacuucgagcagggggagcucuaccugcgggagaaguucgagaacagcaucgagagccugcgccucuucaagaacgacccccuguucuucaagcccggcucccaguuccuguacagcaccuucggguacacccuccuggccgcgaucguggagcgggccuccggcugcaaguaccuggacuacaugcagaagaucuuccacgaccucgacaugcugacgaccgugcaggaggagaacgagcccgucaucuacaaccgcgcccgguucuacguguacaacaagaagaagcgccuggugaacaccccguacgucgacaacagcuacaagugggccgggggcggcuuccucuccaccgugggggaccugcugaaguucggcaacgcgaugcucuacggguaccaggucggccuguucaagaacagcaacgagaaccugcuccccggguaccugaagcccgagacgauggugaugauguggacccccgugccgaacaccgagauguccugggacaaggagggcaaguacgccauggccuggggcgucguggagcggaagcagaccuacgggagcugccgcaagcagcgccacuacgccucccacacgggcggggccgugggcgcgagcuccguccugcucgugcugcccgaggagcuggacaccgagaccaucaacaacaaggugcccccgcggggcaucaucgucagcaucaucugcaacaugcaguccguggggcucaacagcaccgcccugaagaucgcccuggaguucgacaaggaccgcuccgacuga

SEQ ID NO: 32182 - RNA, 1554 nt, Artificial Sequence
  derived and/or modified sequence opt1 from LAD1__Homo_sapiens__NP_005549
auggccgugagccgcaaggacugguccgcccugagcucccucgcgcggcagcgcacccuggaggacgaggaggagcaggagcgggagcgccggcgccggcaccgcaaccugagcuccaccacggacgacgaggcgccccggcucagccagaacggcgaccgccaggccuccgccagcgagcggcugccguccgucgaggaggccgaggugcccaagccccugcccccggccagcaaggacgaggacgaggacauccaguccauccuccgcacccggcaggagcgccggcagcgccgccagguggucgaggccgcccaggcccccauccaggagcggcuggaggcggaggaggggcggaacagccugucccccgugcaggccacccagaagccccucgugagcaagaaggagcuggagaucccgccccgccggcgccugucccgcgagcagcggggccccugggcccucgaggaggagagccuggucgggcgcgagcccgaggagcggaagaagggcgugccggagaagucccccgugcuggagaaguccagcaugcccaagaagaccgcccccgagaagucccucgucagcgacaagacgagcaucagcgagaaggugcuggccuccgagaagaccagccuguccgagaagaucgcggugagcgagaagcgcaacuccagcgagaagaaguccguccucgagaagaccagcguguccgagaagucccuggccccggggauggcccugggcagcggccggcgccucgugagcgagaaggccuccaucuucgagaaggcccuggcgagcgagaagucccccaccgccgacgccaagcccgcccccaagcgggccacggcgagcgagcagccgcuggcccaggagccgcccgccuccgggggcagccccgccaccaccaaggagcagcgcgggcgggcccuccccggcaagaaccugcccagccuggcgaagcagggggccuccgacccgcccaccgucgccagccgccucccgcccgugacgcuccaggugaagauccccuccaaggaggaggaggccgacaugagcucccccacccagcggaccuacagcuccagccugaagcgcuccagcccccggaccaucuccuuccgcaugaagcccaagaaggagaacagcgagacgacccugacccgguccgcgagcaugaagcugcccgacaacaccgucaagcugggcgagaagcucgagcgcuaccacacggccauccggcgcuccgagagcgugaagucccggggccugccgugcaccgagcuguucguggcccccgucgggguggccagcaagcgccaccucuucgagaaggagcuggccggccagagccgcgcggagcccgccuccagccggaaggagaaccugcgccucuccgggguggucaccagccggcugaaccuguggaucucccgcacccaggagagcggcgaccaggacccccaggaggcccagaaggccuccagcgccacggagcggacccaguggggccagaaguccgacagcucccucgacgcggagguguga

SEQ ID NO: 32183 - RNA, 1578 nt, Artificial Sequence
  derived and/or modified sequence opt1 from LAG3__Homo_sapiens__NP_002277
augugggaggcccaguuccugggccuccuguuccugcagccccucuggguggccccggucaagccccugcagcccggggcggaggugcccguggucugggcccaggagggcgccccggcccagcugcccugcagccccaccaucccccuccaggaccugucccugcuccgccgggccggggugaccuggcagcaccagccggacagcggcccgcccgcggccgcccccgggcacccccuggcccccggcccccaccccgcggccccguccagcuggggcccccgcccccggcgcuacacggugcuguccgucgggcccggcgggcuccggagcggccgccugccgcugcagccccgggugcagcucgacgagcgcgggcggcagcgcggcgacuucucccuguggcugcggcccgcccgccgggccgacgccggcgaguaccgcgcggccgugcaccuccgggaccgcgcccugagcugccggcugcgccuccggcuggggcaggccuccaugaccgccagcccgcccggcucccugcgcgcgagcgacugggucauccucaacugcuccuucagccggcccgaccgccccgccuccgugcacugguuccgcaaccgggggcagggccgcgugcccguccgggagagcccgcaccaccaccuggccgaguccuuccuguuccucccccaggugagccccauggacuccggcccgugggggugcauccugaccuaccgcgacggcuucaacgugagcaucauguacaaccugaccguccucgggcuggagccgcccacgccccugaccguguacgccggcgccgggagccgggugggccuccccugccgccugcccgcgggcgucgggacccgguccuuccugaccgccaaguggacgccgcccggcgggggccccgaccuccuggugaccggggacaacggcgacuucacccugcgccucgaggacgugagccaggcccaggccggcaccuacacgugccacauccaccuccaggagcagcagcugaacgccaccgucacccuggcgaucaucaccgugacgcccaaguccuucgggagccccggcucccuggggaagcugcucugcgaggugacccccgucagcggccaggagcgguucgugugguccagccuggacaccccgucccagcgcagcuucuccgggcccuggcuggaggcccaggaggcccagcuccugagccagcccuggcagugccagcuguaccagggcgagcggcugcucggcgccgcggucuacuucaccgagcuguccagccccggggcccagcgcuccggccgggccccgggggcccugcccgccggccaccuccugcuguuccucauccugggcgugcugagccuccugcugcucgugacgggggcguucggcuuccaccuguggcgccggcaguggcgcccccggcgcuucuccgcccuggagcaggggauccacccgccccaggcccagagcaagaucgaggagcucgagcaggagcccgagcccgagcccgagccggagcccgagcccgagccggagcccgagcccgagcagcuguga

SEQ ID NO: 32184 - RNA, 843 nt, Artificial Sequence
  derived and/or modified sequence opt1 from LAIR1__Homo_sapiens__NP_001275955
auggagcgcgagauggugcugugccucgcccagaccauccacacccaggaggaccugccccggccgagcaucuccgccgagcccggcacggucaucccccuggggagccacgugaccuucgugugccgcggccccgucggggugcagaccuuccggcucgagcgcgacucccggagcaccuacaacgacacggaggacgugucccaggcgagcccguccgagagcgaggcccgcuuccggaucgacuccguccgcgagggcaacgccgggcuguaccggugcaucuacuacaagccgcccaaguggagcgagcaguccgacuaccuggagcuccuggugaaggagagcuccggcggccccgacagccccgacaccgagcccggguccagcgccggccccacccagcgccccuccgacaacagccacaacgagcacgccccggcgucccaggggcugaaggccgagcaccucuacauccugaucggcgugagcgucguguuccuguucugccuccugcugcucgugcuguucugccugcaccggcagaaccagaucaagcaggggccgccccgcagcaaggacgaggagcagaagccccagcagcggcccgaccucgccgucgacgugcuggagcgcaccgccgacaaggcgacggugaacggccugcccgagaaggaccgggagaccgacaccuccgcccucgccgccggcagcucccaggaggucaccuacgcccagcuggaccacugggcgcugacgcagcgcaccgcccgggccgugagcccccaguccaccaagcccauggccgagagcaucaccuacgccgcgguggcccgccacuga

SEQ ID NO: 32185 - RNA, 459 nt, Artificial Sequence
  derived and/or modified sequence opt1 from LAIR2__Homo_sapiens__NP_002279
augagcccccaccugaccgcccuccugggccuggugcucugccuggcccagaccauccacacgcaggagggggcgcugccgcgccccuccaucagcgccgagcccggcaccgucaucucccccgggagccacgugaccuucaugugccggggcccgguggggguccagaccuuccgccucgagcgggaggaccgcgccaaguacaaggacuccuacaacguguuccggcugggccccagcgaguccgaggcccgcuuccacaucgacagcguguccgagggcaacgccgggcuguaccggugccucuacuacaagccgcccggcuggagcgagcacuccgacuuccuggagcugcucgucaaggagagcuccgggggccccgacagccccgacacggagcccggguccagcgcgggcaccgugcccggcaccgaggccuccggguucgacgccccguga

SEQ ID NO: 32186 - RNA, 462 nt, Artificial Sequence
  derived and/or modified sequence opt1 from LALBA__Homo_sapiens__XP_011536644
auggaggaccugcaguuccucggcguggccaagaugcgcuucuucgucccccuguuccugguggggauccucuucccggccauccuggcgaagcaguucaccaagugcgagcugagccagcuccugaaggacaucgacggcuacgggggcaucgcccugcccgagcucaucugcaccauguuccacacguccggguacgacacccaggccaucguggagaacaacgagagcaccgaguacggccuguuccagaucuccaacaagcuguggugcaagagcucccaggucccccagagccggaacaucugcgacaucuccugcgacaaguuccucgacgacgacaucaccgacgacaucaugugcgccaagaagauccuggacaucaagggcaucgacuacuggcuggcccacaaggcgcucugcacggagaagcuggagcaguggcugugcgagaagcucuga

SEQ ID NO: 32187 - RNA, 9228 nt, Artificial Sequence
  derived and/or modified sequence opt1 from LAMA1__Homo_sapiens__NP_005550
augcggggcggggugcugcuggugcugcugcucugcguggccgcccagugccggcagcggggccuguuccccgccauccugaaccucgccagcaacgcccacaucagcaccaacgcgaccugcggggagaagggccccgagauguucugcaagcugguggagcacgugcccgggcggcccgugcgcaacccccagugccggaucugcgacggcaacagcgccaacccccgcgagcggcaccccaucagccacgcgaucgacggcaccaacaacugguggcagagccccagcauccagaacgggcgcgaguaccacugggugaccaucacccuggaccuccggcaggucuuccagguggccuacgugaucaucaaggccgccaacgcgccccgccccggcaacuggauccuggagcggagccuggacgggaccaccuucucccccuggcaguacuacgccgucagcgacuccgagugccucagccgcuacaacaucacgccccggcgcgggccgcccaccuaccgggccgacgacgaggugaucugcaccuccuacuacagccgccuggugccccuggagcacggggagauccacaccucccucaucaacggccggcccagcgccgacgaccugucccccaagcugcucgaguucaccagcgcccgcuacauccggcugcgccugcagcggauccgcacccucaacgcggaccugaugacccugucccaccgcgagcccaaggagcucgaccccaucgucacgcggcgcuacuacuacagcaucaaggacaucuccgugggcgggaugugcaucugcuacggccacgccagcagcugccccugggacgagaccaccaagaagcugcagugccagugcgagcacaacacgugcggggaguccugcaaccggugcugccccggcuaccaccagcagccguggcgccccggcacggugagcuccgggaacacgugcgaggccugcaacugccacaacaaggccaaggacugcuacuacgacgagagcgucgccaagcagaagaagucccugaacaccgcgggccaguuccgcggcggcggggugugcaucaacugccuccagaacaccauggggaucaacugcgagacgugcaucgacggcuacuaccgcccccacaaggugagccccuacgaggacgagccgugccggcccugcaacugcgaccccgucgggucccugagcuccgugugcaucaaggacgaccugcacagcgaccuccacaacggcaagcagcccgggcagugcccgugcaaggagggcuacaccggggagaagugcgaccgcugccagcugggcuacaaggacuacccgaccugcguguccugcggcugcaaccccgucgggagcgccuccgacgagccgugcaccggccccugcgugugcaaggagaacguggaggggaaggccugcgaccggugcaagcccggcuucuacaaccugaaggagaagaacccccgcgggugcagcgagugcuucugcuucggcgucuccgacgugugcagcucccucagcuggccggucggccaggugaacuccaugagcggguggcuggugacggaccugaucagcccccggaagauccccucccagcaggacgcccucggcgggcgccaccaggucagcaucaacaacaccgccgugaugcagcggcuggcgcccaaguacuacugggccgccccggaggccuaccugggcaacaagcucaccgccuucggcggguuccugaaguacaccguguccuacgacauccccgucgagacgguggacagcaaccugaugucccacgcggacgugaucaucaagggcaacgggcucacccugagcacccaggccgagggccugucccuccagcccuacgaggaguaccugaacgucgugcgccuggugcccgagaacuuccaggacuuccacagcaagcggcagaucgaccgcgaccagcucaugaccguccuggccaacgugacgcaccuccugauccgggccaacuacaacuccgcgaagauggcccucuaccgccuggagagcgugucccuggacaucgccagcuccaacgccaucgaccucgucguggccgcggacguggagcacugcgagugcccgcagggguacaccggcaccagcugcgaguccugccugagcggcuacuaccgggucgacgggauccuguucggcgggaucugccagcccugcgagugccacggccacgccgccgagugcaacgugcacggggugugcaucgccugcgcccacaacaccacgggcguccacugcgagcagugccuccccggcuucuacggggagcccucccgcggcaccccgggggacugccagcccugcgcgugcccccugaccaucgccagcaacaacuucagcccgaccugccaccugaacgacggcgacgagguggugugcgacuggugcgccccgggguacuccggcgccuggugcgagcgcugcgccgacggcuacuacgggaaccccaccguccccggcgagagcugcgugcccugcgacugcuccgggaacguggacccgagcgaggcgggccacugcgacuccgucacgggggagugccucaagugccugggcaacaccgacggcgcccacugcgagcggugcgccgacggguucuacggcgacgccgugaccgcgaagaacugccgcgccugcgagugccacgugaaggggagccacuccgccgucugccaccuggagaccggccucugcgacugcaagcccaacgugacgggccagcagugcgaccagugccugcacggguacuacggccuggacagcgggcacggcugccggcccugcaacugcuccguggccgggagcgucuccgacggcugcaccgacgagggccagugccacugcgugccggggguggccggcaagcgcugcgaccggugcgcgcacggguucuacgccuaccaggacggcagcugcacccccugcgacugcccccacacccagaacacgugcgaccccgagaccggggagugcgucugcccgccccacacccagggcgugaagugcgaggagugcgaggacggccacuggggguacgacgccgaggugggcugccaggccugcaacugcucccucgucgggagcacccaccaccgcugcgacguggugacgggccacugccagugcaaguccaaguucgggggccgggccugcgaccagugcagccugggcuaccgcgacuuccccgacugcguccccugcgacugcgaccugcgggggaccuccggcgacgcgugcaaccucgagcaggggcugugcggcugcguggaggagaccggcgccugcccgugcaaggagaacguguucgggccccagugcaacgagugccgcgagggcaccuucgcccugcgggccgacaacccccucgggugcagccccugcuucugcuccggccugagccaccugugcagcgagcucgaggacuacguccgcacgccggugacccugggguccgaccagccccugcuccggguggucagccaguccaaccugcgcggcaccaccgagggcguguacuaccaggcccccgacuuccugcucgacgcggccacggugcggcagcacauccgcgccgagcccuucuacuggcggcugccgcagcaguuccagggggaccagcugauggccuacggcgggaagcucaaguacagcgucgcguucuacucccuggacggcguggggaccagcaacuucgagccccagguccugaucaagggcggccgcauccggaagcaggucaucuacauggacgcccccgcccccgagaacggggugcgccaggagcaggaggucgccaugcgggagaacuucuggaaguacuucaacuccgugagcgagaagccggugacccgcgaggacuucauguccguccucagcgacaucgaguacauccugaucaaggccuccuacggccaggggcugcagcagagccgcaucuccgacaucagcauggaggugggccggaaggcggagaagcuccaccccgaggaggagguggccucccugcuggagaacugcgucugcccgcccgggaccgugggcuucagcugccaggacugcgccccgggcuaccaccgcgggaagcuccccgccggcuccgaccgggggccccgcccccugguggccccgugcguccccugcagcugcaacaaccacuccgacacgugcgaccccaacaccggcaagugccugaacugcggggacaacaccgcgggcgaccacugcgacgugugcaccagcggcuacuacgggaaggugacgggcagcgccuccgacugcgcccucugcgccugcccgcacuccccgcccgccuccuucagcccgaccugcguccuggagggggaccacgacuuccggugcgacgcgugccugcucggcuacgagggcaagcacugcgagcgcugcuccagcuccuacuacgggaacccgcagacccccggcgggagcugccagaagugcgacugcaacccccacggcuccgugcacggggacugcgaccggaccagcggccagugcgugugccgccugggcgccuccgggcugcggugcgacgagugcgagccccgccacauccucauggagacggacugcgucagcugcgacgacgagugcgugggcgugcugcugaacgaccucgacgagaucggggacgccguccugucccugaaccucaccggcaucaucccggugcccuacgggauccugagcaaccuggagaacaccaccaaguaccuccaggagucccugcugaaggagaacaugcagaaggaccucggcaagaucaagcuggagggcguggccgaggagacggacaaccugcagaagaagcucacccggaugcuggccagcacccagaaggucaaccgcgcgaccgagcggaucuucaaggagucccaggaccuggccaucgccaucgagcgccuccagaugagcaucaccgagaucauggagaagacgacccugaaccagacccuggacgaggacuuccuccugcccaacuccacccugcagaacaugcagcagaacgggacgagccuccuggagaucaugcagauccgggacuucacccagcugcaccagaacgccacccucgagcugaaggcggccgaggaccugcucagccagauccaggagaacuaccagaagccccuggaggagcuggaggugcucaaggaggccgccucccacgugcugagcaagcacaacaacgagcugaaggccgcggaggcccucguccgcgaggccgaggccaagaugcaggaguccaaccaccuccugcucauggugaacgccaaccugcgggaguucagcgacaagaagcugcacgugcaggaggagcagaaccucaccuccgagcugaucguccagggccgcgggcugaucgacgcggccgccgcccagacggacgccgugcaggacgcgcuggagcaccucgaggaccaccaggacaagcugcugcucuggagcgccaagauccggcaccacaucgacgaccuggugaugcacaugucccagcgcaacgccgucgaccugguguaccgcgccgaggaccacgcggccgaguuccagcggcucgccgacgugcuguacagcggccuggagaacauccgcaacgucucccucaacgccaccagcgccgcguacgugcacuacaacauccagucccugaucgaggagagcgaggagcuggcccgggacgcccaccgcaccgugaccgagacgucccuccugagcgagucccuggucagcaacgggaaggccgccgugcagcgguccagccgcuuccucaaggagggcaacaaccugucccggaagcugccgggcaucgcgcucgagcugagcgagcugcgcaacaagaccaaccgguuccaggagaacgccguggagaucacccgccagaccaacgagagccuccugauccugcgggccauccccaaggggauccgcgacaagggcgccaagacgaaggagcucgccaccuccgcgagccaguccgccgucagcacccugcgggacguggccgggcugucccaggagcuccugaacaccagcgccucccugagccgcgugaacacgacccuccgggagacccaccagcugcugcaggacuccaccauggcgacgcuccuggccggccgcaaggucaaggacguggagauccaggccaaccugcuguucgaccggcugaagccccugaagaugcucgaggagaaccugagccgcaaccuguccgagaucaagcuccugaucagccaggcccggaagcaggccgcguccaucaagguggccgucagcgccgaccgcgacugcauccgggccuaccagccccagaucuccagcaccaacuacaacacccugacccucaacgugaagacgcaggagccggacaaccugcuguucuaccucggguccagcaccgccuccgacuuccuggcgguggagaugcgccgcggccgggucgccuuccugugggaccucggcagcgggagcacccgccuggaguuccccgacuuccccaucgacgacaaccgguggcacuccauccacguggcccgcuucggcaacaucgggagccuguccgucaaggagaugagcuccaaccagaagucccccaccaagacguccaagagcccgggcaccgccaacgugcucgacgugaacaacuccacccugauguucgucggcgggcugggcgggcagaucaagaagucccccgccgugaaggugacccacuucaagggcugccucggggaggcguuccugaacggcaaguccaucggccuguggaacuacaucgagcgggaggggaagugccgcggcugcuucgggagcucccagaacgaggaccccagcuuccacuucgacggcuccggguacagcgucguggagaagucccuccccgccacggugacccagaucaucaugcuguucaacaccuucagcccgaacggccugcuccuguaccugggcagcuacgggaccaaggacuuccucuccaucgagcuguuccggggccgcgucaaggugaugaccgaccuggggagcggccccaucacgcuccugaccgaccggcgcuacaacaacgggaccugguacaagaucgccuuccagcggaaccgcaagcagggcgugcuggccgucaucgacgccuacaacaccuccaacaaggagacgaagcagggcgagacccccggggcgagcuccgaccucaaccggcuggacaaggaccccaucuacgugggcgggcugccgcgcagccgggugguccgccggggcgugaccaccaaguccuucgugggcugcaucaagaaccucgagaucagccgcuccacguucgaccugcugcggaacagcuacgggguccgcaagggcugccuccuggagcccauccgcuccgugagcuuccugaagggcggcuacaucgagcugccgcccaagucccugagccccgaguccgaguggcuggugaccuucgccaccaccaacagcuccgggaucauccucgccgcccugggcggcgacgucgagaagcgcggcgaccgcgaggaggcgcacgugcccuucuucagcgugaugcugaucggcgggaacaucgagguccacgugaaccccggcgacgggacgggccuccggaaggcccugcugcacgcccccaccgggaccugcuccgacgggcaggcccacagcaucagccucgugcgcaaccggcgcaucaucaccguccagcuggacgagaacaaccccguggagaugaagcugggcacgcucguggagucccggaccaucaacgucagcaaccuguacgucgggggcauccccgagggggagggcaccucccugcucaccaugcgccggagcuuccacggcugcaucaagaaccugaucuucaaccuggagcuccuggacuucaacuccgccguggggcacgagcaggucgaccuggacacgugcuggcugagcgagcgccccaagcucgcgccggacgccgaggacuccaagcugcugcccgagccccgggccuuccccgagcagugcgugguggacgccgcccucgaguacgucccgggcgcgcaccaguucgggcugacccagaacagccacuucauccugcccuucaaccaguccgccgugcgcaagaagcucagcguggagcuguccauccggaccuucgccagcuccggccugaucuacuacauggcccaccagaaccaggccgacuacgcgguccuccagcugcacgggggccgccugcacuucauguucgaccucggcaaggggcggaccaaggugagccaccccgcccugcuguccgacggcaaguggcacacggugaagaccgacuacgucaagcgcaagggguucaucaccguggacggccgggagagccccauggugaccgucgugggcgacgggacgaugcucgacguggagggccuguucuaccucgggggccucccgucccaguaccaggcccgcaagaucgggaacaucacccacagcauccccgccugcaucggcgacgucaccgugaacuccaagcagcuggacaaggacagccccgugagcgcguucaccgucaaccggugcuacgccguggcccaggagggcacguacuucgacggguccggcuacgccgcccuggucaaggagggguacaaggugcagagcgacgugaacaucacccucgaguuccgcaccuccagccagaacggcguccugcuggggaucuccaccgcgaagguggacgccaucggccucgagcugguggacggcaagguccuguuccacgugaacaacggggccggccggaucacggccgccuacgagcccaagaccgcgaccgugcucugcgacgggaaguggcacacccugcaggccaacaagagcaagcaccgcaucacgcugaucgucgacggcaacgccgugggggccgaguccccgcacacccagagcaccuccguggacaccaacaaccccaucuacgucggcggcuaccccgccggggugaagcagaagugccuccgcagccagaccuccuuccggggcugccugcgcaagcuggcgcucaucaagagcccccaggugcaguccuucgacuucagccgggccuucgagcugcacggggucuuccugcacuccugcccgggcacggagagcuga

SEQ ID NO: 32188 - RNA, 9369 nt, Artificial Sequence
  derived and/or modified sequence opt1 from LAMA2__Homo_sapiens__NP_000417
augcccggcgccgccggggugcugcuccugcugcuccuguccggcgggcugggcggggugcaggcccagcgcccccagcagcagcggcagucccaggcccaccagcagcgcggccucuuccccgccgugcugaaccuggccuccaacgcccucaucaccaccaacgcgaccugcggcgagaaggggcccgagauguacugcaagcugguggagcacgugcccggccagcccgugcggaacccccagugccgcaucugcaaccagaacuccagcaaccccaaccagcggcaccccaucaccaacgccaucgacgggaagaacaccugguggcaguccccgagcaucaagaacggcaucgaguaccacuacgugaccaucacccuggaccuccagcaggucuuccagaucgccuacgugaucgugaaggccgccaacagcccccggcccgggaacuggauccuggagcggagccuggacgacgucgaguacaagcccuggcaguaccacgccgugaccgacaccgagugccucacccuguacaacaucuacccccgcaccgggccgcccuccuacgccaaggacgacgaggugaucugcaccagcuucuacuccaagauccacccccuggagaacggcgagauccacaucagccucaucaacgggcggccguccgccgacgaccccagccccgagcugcuggaguucaccuccgcccgcuacauccggcuccgcuuccagcggauccgcacccugaacgcggaccugaugauguucgcccacaaggacccccgggagaucgacccgaucgucacccgccgguacuacuacagcgugaaggacaucuccgugggcgggaugugcaucugcuacggccacgcccgcgccugcccccucgaccccgccaccaacaagagccggugcgagugcgagcacaacacgugcggcgacuccugcgaccagugcugccccggguuccaccagaagccguggcgcgcgggcaccuuccugaccaagaccgagugcgaggccugcaacugccacgggaaggccgaggagugcuacuacgacgagaacgucgcccggcgcaaccugagccucaacauccgcggcaaguacaucgggggcggcgugugcaucaacugcacccagaacaccgccgggaucaacugcgagacgugcaccgacggcuucuuccggcccaagggggugagccccaacuacccccgcccgugccagcccugccacugcgaccccaucggcucccugaacgaggucugcgugaaggacgagaagcacgcgcggcgcgggcuggccccgggcagcugccacugcaagaccggcuucgggggcguguccugcgaccggugcgcccgcggguacaccggcuaccccgacugcaaggccugcaacugcagcgggcucggcuccaagaacgaggaccccugcuucggccccugcaucugcaaggagaacgucgagggcggcgacugcagccggugcaaguccggguucuucaaccugcaggaggacaacuggaagggcugcgacgagugcuucugcagcggcguguccaaccgcugccagagcuccuacuggacguacgggaagauccaggacaugagcggcugguaccugaccgaccucccggggcggauccgcguggcgccccagcaggacgaccuggacagcccccagcagaucuccaucuccaacgccgaggcccggcaggcccugccccacagcuacuacugguccgccccggcgcccuaccucggcaacaagcugcccgccgucgggggccagcugaccuucaccaucagcuacgaccucgaggaggaggaggaggacacggagcgcgugcugcagcugaugaucauccucgagggcaacgaccuguccaucagcaccgcccaggacgaggucuaccugcaccccagcgaggagcacaccaacgugcuccugcugaaggaggaguccuucaccauccacgggacgcacuucccggugcggcgcaaggaguucaugaccguccucgccaaccugaagcgggugcugcugcagaucaccuacagcuucggcauggacgccaucuuccgccucuccagcgugaaccuggaguccgcggucagcuaccccaccgacggguccaucgccgccgccguggaggugugccagugcccgcccggcuacacggggagcuccugcgagagcugcuggccgcggcaccgccgggucaacggcaccaucuucggcgggaucugcgagcccugccagugcuucggccacgccgaguccugcgacgacgugaccggggagugccugaacugcaaggaccacaccggcgggcccuacugcgacaagugccuccccggcuucuacggcgagccgaccaaggggacgagcgaggacugccagcccugcgcgugcccccugaacauccccuccaacaacuucagcccgaccugccaccuggaccgcucccucggccugaucugcgacgggugccccgugggcuacaccgggccccgcugcgagcggugcgccgagggcuacuucggccagccgagcguccccgggggcuccugccagcccugccagugcaacgacaaccuggacuucagcauccccgggagcugcgacucccucagcggcuccugccugaucugcaagccgggcaccacggggcgcuacugcgagcugugcgccgacggcuacuucggggacgccguggacgccaagaacugccagcccugccggugcaacgcgggcgggagcuucuccgaggugugccacagccagaccggccagugcgagugccgcgccaacguccagggccagcggugcgacaagugcaaggccgggaccuucggccuccaguccgcccgcgggugcgugcccugcaacugcaacagcuucggcuccaagagcuucgacugcgaggaguccgggcagugcuggugccagcccggcgugaccggcaagaagugcgaccggugcgcgcacggguacuucaacuuccaggagggcgggugcacggccugcgagugcagccaccugggcaacaacugcgacccgaagaccgggcgcugcaucugcccgcccaacaccaucggcgagaagugcuccaagugcgcccccaacaccuggggccacagcaucacgaccgggugcaaggccugcaacugcuccaccgucggcagccuggacuuccagugcaacgugaacaccgggcagugcaacugccacccgaaguucuccggcgccaagugcacggagugcagccggggccacuggaacuacccccgcugcaaccucugcgacugcuuccugcccgggaccgacgcgacgaccugcgacuccgagacgaagaagugcagcugcagcgaccagaccggccagugcacgugcaaggugaacgucgaggggauccacugcgaccggugccgccccggcaaguucgggcuggacgccaagaacccgcucggcugcuccagcugcuacugcuucggcaccacgacccagugcuccgaggccaaggggcugauccggaccugggugacccugaaggccgagcagacgauccucccccugguggacgaggcccugcagcacaccaccaccaagggcaucgucuuccagcaccccgagaucguggcgcacauggaccucaugcgcgaggaccugcaccuggagcccuucuacuggaagcucccggagcaguucgaggggaagaagcugauggccuacggcgggaagcugaaguacgccaucuacuucgaggcccgggaggagacgggcuucagcaccuacaacccccaggugaucauccgcggcgggacccccacccacgcccggaucaucguccgccacauggcggcgccccucaucggccagcugacgcggcacgagaucgagaugaccgagaaggaguggaaguacuacggggacgacccgcgcgugcaccggaccgugacccgcgaggacuuccuggacauccucuacgacauccacuacauccugaucaaggccaccuacggcaacuucaugcgccagucccggaucagcgagaucuccauggaggucgccgagcaggggcgcggcacgaccaugacgccgcccgcggaccugaucgagaagugcgacugcccccucggcuacagcgggcuguccugcgaggccugccugccgggcuucuaccggcuccgcagccagcccgggggccggacccccgggccgacgcuggggaccugcgugcccugccagugcaacggccacuccagccugugcgaccccgagaccuccaucugccagaacugccagcaccacaccgccggggacuucugcgagcgcugcgcccucggcuacuacgggaucgugaagggccugcccaacgacugccagcagugcgccugcccgcugaucagcuccagcaacaacuucucccccagcugcgucgcggagggccucgacgacuaccggugcacggccugcccccgcggguacgagggccaguacugcgagcggugcgcccccggguacaccggcuccccggggaaccccggcggcagcugccaggagugcgagugcgaccccuacgggagccugcccgugccgugcgaccccgugaccggcuucugcacgugccgccccggggccacgggccggaagugcgacgggugcaagcacuggcacgcccgcgagggcugggagugcgucuucugcggcgacgagugcaccgggcugcuccugggcgaccuggcgcggcucgagcagauggugauguccaucaaccugaccgggccccugccggcccccuacaagaugcucuacggccuggagaacaugacccaggagcugaagcaccuccugagcccccagcgcgcccccgagcggcugauccagcucgccgaggggaaccugaacacgcuggugaccgagaugaacgagcuccugacccgcgccaccaaggucacggcggacggcgagcagaccggccaggacgccgagcggaccaacacccgcgccaagucccugggggaguucaucaaggagcucgcccgggacgccgaggcggugaacgagaaggccaucaagcugaacgagacgcugggcacccgcgacgaggccuucgagcgcaaccucgaggggcugcagaaggagaucgaccagaugaucaaggagcugcggcgcaagaaccucgagacccagaaggagaucgccgaggacgagcugguggcggccgaggcccugcucaagaaggucaagaagcuguucggcgagagccgcggcgagaacgaggagauggagaaggaccugcgcgagaagcucgccgacuacaagaacaagguggacgacgccugggaccugcugcgggaggcgaccgacaagauccgcgaggccaaccgccucuucgccgugaaccagaagaacaugacggcccuggagaagaagaaggaggccgucgaguccggcaagcgccagaucgagaacacccugaaggagggcaacgacauccucgacgaggcgaaccggcuggccgacgagaucaacagcaucaucgacuacguggaggacauccagaccaagcugccgcccauguccgaggagcucaacgacaagaucgacgaccugagccaggagaucaaggaccgcaagcuggccgagaaggugucccaggccgagagccacgccgcgcagcucaacgacuccagcgccguccuggacgggauccuggacgaggccaagaacaucuccuucaacgccaccgcggccuucaaggccuacagcaacaucaaggacuacaucgacgaggccgagaagguggccaaggaggcgaaggaccucgcccacgaggccacgaagcuggccaccggcccccgggggcugcugaaggaggacgccaagggcugccuccagaaguccuuccgcauccugaacgaggcgaagaagcuggccaacgacgugaaggagaacgaggaccaccucaacggccugaagacccggaucgagaacgccgacgcccgcaacggggaccugcuccggacccugaacgacacgcugggcaagcucagcgccauccccaacgacaccgcggccaagcugcaggccgucaaggacaaggcccgccaggcgaacgacaccgccaaggacgugcuggcccagaucaccgagcuccaccagaaccuggacgggcugaagaagaacuacaacaagcucgccgacuccgucgccaagaccaacgcgguggugaaggacccgagcaagaacaagaucaucgccgacgccgacgccacggucaagaaccuggagcaggaggccgaccggcugaucgacaagcucaagcccaucaaggagcuggaggacaaccugaagaagaacaucuccgagaucaaggagcucaucaaccaggcgcgcaagcaggccaacagcaucaaggugagcguguccagcggcggggacugcauccggaccuacaagcccgagaucaagaagggcuccuacaacaacaucgucgugaacgugaagaccgccgucgccgacaaccugcuguucuaccucggcagcgccaaguucaucgacuuccuggcgaucgagaugcgcaaggggaagguguccuuccugugggacgugggcagcggggucggccggguggaguaccccgaccucaccaucgacgacuccuacugguaccgcaucguggccagccgcacggggcggaacggcaccaucuccguccgcgcccuggacggcccgaaggccagcaucgugcccuccacccaccacagcaccagcccgcccggguacacgauccuggacguggacgccaacgcgaugcuguucgucggcgggcugaccggcaagcugaagaaggccgacgccgugcgggugaucaccuucaccgggugcaugggcgagacguacuucgacaacaagcccaucggccucuggaacuuccgcgagaaggagggggacugcaagggcugcaccgucagcccccagguggaggacuccgaggggaccauccaguucgacggcgagggcuacgcccuggugagccggcccauccgcugguaccccaacaucuccaccgucauguucaaguuccggacguucagcuccagcgcgcugcucauguaccuggccacccgcgaccugcgggacuucaugagcguggagcucaccgacgggcacaucaagguguccuacgaccugggcagcgggauggccuccgucgugagcaaccagaaccacaacgacggcaaguggaaguccuucacccugagccgcauccagaagcaggccaacaucuccaucguggacaucgacacgaaccaggaggagaacaucgccaccagcuccagcgggaacaacuucggccucgaccugaaggcggacgacaagaucuacuucggcgggcugcccacccuccggaaccuguccaugaaggcccgccccgaggucaaccugaagaaguacagcggcugccucaaggacaucgagaucucccggacccccuacaacauccugagcuccccggacuacgugggggugacgaagggcugcagccuggagaacgucuacaccguguccuuccccaagcccggguucguggagcucagccccgucccgaucgacgugggcaccgagaucaaccuguccuucagcaccaagaacgagagcggcaucauccugcucggguccggcgggacgcccgcgccgccccggcggaagcgccggcagaccggccaggccuacuacgugauccugcugaaccgcgggcggcucgagguccaccugagcaccggcgcccgcaccaugcgcaagaucgugauccggccggagcccaaccuguuccacgacggccgcgagcacuccgugcacgucgagcggacgcgcgggaucuucaccguccagguggacgagaaccggcgcuacaugcagaaccucaccgucgagcagcccaucgaggugaagaagcuguucgugggcggggcgcccccggaguuccagcccagcccccugcggaacaucccgcccuucgagggcugcaucuggaaccucgucaucaacuccgugcccauggacuucgcccgccccgugagcuucaagaacgccgacaucgggcggugcgcccaccagaagcugcgcgaggacgaggacggcgccgcgcccgccgagaucgucauccagcccgagcccgugcccaccccggccuuccccacgcccacccccguccugacccacggcccgugcgccgcggaguccgagcccgcccuccugaucgggagcaagcaguucggccugucccggaacagccacaucgccaucgccuucgacgacaccaaggugaagaaccgccucacgaucgagcuggaggugcggaccgaggccgaguccgggcuccucuucuacauggcgcgcaucaaccacgccgacuucgccaccguccagcugcggaacggccugcccuacuucagcuacgaccucggcuccggggacacccacaccaugauccccacgaagaucaacgacggccaguggcacaagaucaagaucaugcgcagcaagcaggaggggauccuguacguggacggcgccuccaaccggaccaucagcccgaagaaggccgacauccuggacguggucgggaugcucuacgugggcggccugcccaucaacuacaccacccgccggaucgggcccgugacguacuccaucgacggcugcguccgcaaccugcacauggcggaggcccccgccgaccucgagcagccgaccagcagcuuccacguggggaccugcuucgccaacgcccagcggggcaccuacuucgacgggacgggcuucgcgaaggccgugggcggguucaaggucggccuggaccugcucguggaguucgaguuccgcaccaccaccacgaccggggugcugcugggcaucuccagccagaagauggacgggaugggcaucgagaugaucgacgagaagcucauguuccacgucgacaacggcgccgggcgcuucaccgccguguacgacgcgggcgugcccgggcaccugugcgacggccaguggcacaaggucaccgccaacaagaucaagcaccggaucgagcugacgguggacggcaaccagguggaggcccagucccccaaccccgccagcaccuccgccgacaccaacgacccggucuucgucgggggcuuccccgacgaccucaagcaguucgggcugaccacgagcauccccuuccgcggcugcauccggucccugaagcucaccaaggggaccggcaagccccuggaggugaacuucgcgaaggcccuggagcuccgcggcguccagccggugagcugccccgccaacuga

SEQ ID NO: 32189 - RNA, 5175 nt, Artificial Sequence
  derived and/or modified sequence opt1 from LAMA3__Homo_sapiens__NP_000218
augcccccggccgugcgccggagcgccugcagcaugggcuggcuguggaucuucggggcggcccugggccagugccugggguacagcucccagcagcagcgcguccccuuccugcagccgcccggccagagccagcugcaggccuccuacguggaguuccggccgagccaggggugcucccccggcuacuaccgcgaccacaagggccuguacaccgggcggugcgugcccugcaacugcaacggccacagcaaccagugccaggacggguccggcaucugcgucaacugccagcacaacaccgccggggagcacugcgagcgcugccaggagggcuacuacggcaacgccgugcacgggagcugccgggcgugccccugcccgcacacgaacuccuucgccaccggcugcguggucaacgggggcgacgugcgcugcagcugcaaggccggcuacaccgggacccagugcgagcggugcgcccccggcuacuucgggaacccccagaaguucggcggguccugccagcccugcagcugcaacuccaacggccagcugggcagcugccacccgcucacgggggacugcaucaaccaggagcccaaggacuccagccccgcggaggagugcgacgacugcgacuccugcgugaugacccugcugaacgaccucgccaccaugggcgagcagcugcgccuggucaagagccagcuccaggggcugagcgccuccgccggccugcucgagcagaugcggcacauggagacccaggccaaggaccugcgcaaccagcugcucaacuaccggagcgcgaucuccaaccacgggagcaagaucgagggccuggagcgcgagcugacggaccucaaccaggaguucgagacccugcaggagaaggcccaggugaacucccggaaggcccagacccugaacaacaacgugaaccgcgccacccagagcgccaaggagcucgacgucaagaucaagaacgugauccggaacgugcacauccugcugaagcagaucuccggcacggacggggagggcaacaacguccccagcggggacuucucccgcgagugggcggaggcccagcggaugaugcgcgagcuccggaaccgcaacuucggcaagcaccuccgcgaggccgaggccgacaagcgggagagccagcugcuccugaaccgcauccggaccuggcagaagacccaccagggggagaacaacggccuggccaacuccauccgcgacagccucaacgaguacgaggcgaagcuguccgaccugcgggcccgccuccaggaggccgccgcccaggcgaagcaggccaacggccugaaccaggagaacgagcgggcccugggggccauccagcgccaggugaaggagaucaacagccuccaguccgacuucaccaaguaccugacgaccgcggacagcucccugcuccagaccaacaucgcccugcagcugauggagaagucccagaaggaguacgagaagcucgccgccucccugaacgaggcccggcaggagcugagcgacaaggugcgcgagcucagccgguccgcgggcaagaccagccuggucgaggaggccgagaagcacgcccgcucccugcaggagcuggccaagcagcucgaggagaucaagcggaacgccagcggggacgagcuggugcgcugcgcgguggacgccgccacggccuacgagaacauccugaacgccaucaaggcggccgaggacgccgccaaccgggcggccuccgccagcgaguccgcccuccagaccgucaucaaggaggaccugccgcgcaaggccaagacccugagcuccaacagcgacaagcuccugaacgaggcgaagaugacccagaagaagcugaagcaggaggugucccccgcccucaacaaccugcagcagacgcugaacaucgugaccguccagaaggaggugaucgacaccaaccucaccacgcugcgggacggccugcacggcauccagcgcggggacaucgacgccaugaucagcuccgccaagagcaugguccggaaggccaacgacaucaccgacgaggugcucgacggccugaaccccauccagaccgacguggagcgcaucaaggacaccuacgggcgcacgcagaacgaggacuucaagaaggcgcugaccgacgccgacaacuccgucaacaagcucaccaacaagcugcccgaccuguggcggaagaucgagagcaucaaccagcagcuccugccgcugggcaacaucuccgacaacauggaccgcauccgggagcucauccagcaggcccgcgacgccgccagcaagguggcggugcccaugcgguucaacgggaaguccggcgucgaggugcgccugcccaacgaccuggaggaccucaagggcuacaccucccugagccuguuccuccagcggcccaacucccgcgagaacgggggcacggagaacauguucgugauguaccuggggaacaaggacgccagccgggacuacaucggcauggccgucguggacgggcagcugaccugcguguacaaccucggcgaccgcgaggccgagcugcaggucgaccagauccugaccaaguccgagaccaaggaggcggugauggaccgggugaaguuccagcgcaucuaccaguucgcccggcucaacuacaccaagggcgccacgagcuccaagccggagacccccggggucuacgacauggacggccgcaacagcaacacccugcugaaccucgaccccgagaacgugguguucuacgucgggggcuacccgcccgacuucaagcugcccucccggcugagcuucccgcccuacaaggggugcaucgagcucgacgaccugaacgagaacgugcugucccucuacaacuucaagaagaccuucaaccugaacacgaccgagguggagcccugccgccggcgcaaggaggagagcgacaagaacuacuucgagggcaccggcuacgcccggguccccacccagccccacgcccccauccccacguucgggcagaccauccagaccaccguggaccgcggccugcuguucuucgcggagaacggggaccgguucaucucccugaacaucgaggacggcaagcugauggugcgcuacaagcucaacagcgagcugcccaaggagcgcggggucggcgacgccaucaacaacggccgggaccacuccauccagaucaagaucgggaagcugcagaagcgcauguggaucaacguggacgugcagaacacgaucaucgacggcgaggucuucgacuucagcaccuacuaccucgggggcauccccaucgccauccgggagcgcuucaacaucuccaccccggccuuccggggcugcaugaagaaccugaagaagaccagcgggguggugcgccugaacgacacggucggcgugaccaagaagugcuccgaggacuggaagcucgugcggagcgccagcuucucccgcgggggccagcugagcuucaccgaccuggggcugccgcccaccgaccaccuccaggcguccuucggcuuccagacguuccagcccagcggcauccugcucgaccaccagaccuggacccggaaccugcaggucacccuggaggacggguacaucgagcucuccacgagcgacuccggcgggccgaucuucaagagcccccagaccuacauggacggccugcugcacuacguguccgugaucagcgacaacuccgggcuccgccugcugaucgacgaccagcuccugcggaacagcaagcgccugaagcacaucuccagcucccggcagagccuccgccugggcggcuccaacuucgaggggugcaucagcaacgucuucgugcagcggcugucccucagccccgaggugcuggaccugaccagcaacucccucaagcgcgacgucagccugggcgggugcucccugaacaagcccccguuccucaugcugcugaagggcagcacccgguucaacaagacgaagaccuuccgcaucaaccagcuccugcaggacacccccguggccagcccccggagcgugaaggucuggcaggacgccugcagcccccugccgaagacccaggccaaccacggggcccuccaguucggcgacauccccacgagccaccuccuguucaagcucccccaggagcugcugaagccccgcucccaguucgcgguggacaugcagaccaccagcucccgcggccugguguuccacaccgggacgaagaacagcuucauggcccucuaccuguccaagggccggcuggucuucgcccucgggaccgacggcaagaagcugcgcaucaagagcaaggagaagugcaacgacggcaaguggcacaccgugguguucgggcacgacggcgagaaggggcggcuggucguggacggccuccgcgcccgggaggggucccugccgggcaacagcaccaucuccauccgcgcccccguguaccugggcagcccgcccuccgggaagcccaagagccuccccaccaacagcuucgucggcugccugaagaacuuccagcuggacuccaagccccucuacacgcccagcuccagcuucgggguguccagcugccugggcgggccccuggagaagggcaucuacuucuccgaggagggcgggcacgucgugcucgcgcacagcgugcugcugggccccgaguucaagcucgucuucuccauccggccccgcagccugaccgggauccugauccacaucggcucccagccggggaagcaccucugcguguaccuggaggccggcaaggugaccgccagcauggacuccggcgccgggggcaccagcacguccgucacccccaagcagagccugugcgacgggcaguggcacuccguggcggugaccaucaagcagcacauccuccaccuggagcuggacaccgacagcuccuacacggccggccagauccccuucccgcccgccagcacccaggagccccuccaccucgggggcgcccccgccaaccugaccacccuccggauccccgucuggaaguccuucuucggcugccugcgcaacauccacgugaaccacaucccggugcccgucacggaggcgcuggaggugcaggggcccgugucccucaacggcugccccgaccaguga

SEQ ID NO: 32190 - RNA, 5472 nt, Artificial Sequence
  derived and/or modified sequence opt1 from LAMA4__Homo_sapiens__NP_001098676
auggcccugagcagcgccuggcgcagcgugcucccccuguggcugcucugguccgccgccugcagccgggccgccuccggcgacgacaacgccuuccccuucgacaucgaggggagcuccgcggugggccgccaggacccgcccgagaccagcgagccccggguggcccuggggcgccugccgcccgccgccgagaagugcaacgcgggcuucuuccacacccucuccggggagugcgugcccugcgacugcaacggcaacagcaacgagugccuggacggcuccggguacugcgugcacugccagcggaacacgaccggcgagcacugcgagaagugccuggacggguacaucggcgacagcauccgcggggcgccccaguucugccagcccugccccugcccccucccccaccuggccaacuucgccgaguccugcuaccggaagaacggcgccgugcgcugcaucugcaacgagaacuacgcgggccccaacugcgagcggugcgcccccggguacuacggcaacccccugcucaucggguccacgugcaagaagugcgacugcuccggcaacagcgaccccaaccugaucuucgaggacugcgacgaggugaccggccagugccgcaacugccugcggaacaccaccggguucaagugcgagcgcugcgcccccggcuacuacggggacgcccggaucgccaagaacugcgcggugugcaacugcggcgggggccccugcgacuccgugaccggcgagugccucgaggagggguucgagccgcccaccggcauggacugcccgacgaucagcugcgacaagugcgugugggaccugaccgacgaccugcgccucgccgcccuguccaucgaggagggcaagagcggcguccugagcguguccagcggggccgccgcgcaccggcacgugaacgagaucaacgccaccaucuaccuccugaagaccaagcuguccgagcgcgagaaccaguacgcccuccggaagauccagaucaacaacgccgagaacacgaugaagucccugcuguccgacgucgaggagcucguggagaaggagaaccaggccagccgcaagggccagcuggugcagaaggaguccauggacaccaucaaccacgcgagccagcuggucgagcaggcccacgacaugcgggacaagauccaggagaucaacaacaagaugcucuacuacggcgaggagcacgagcugucccccaaggagaucagcgagaagcuggugcucgcccagaagaugcuggaggagauccgcucccggcagcccuucuucacccagcgcgagcugguggacgaggaggccgacgaggcguacgagcuccugagccaggccgaguccuggcagcgccugcacaacgagacccggacccuguuccccgucgugcuggagcagcuggacgacuacaacgccaagcucagcgaccugcaggaggcccuggaccaggcccucaacuacgugcgcgacgcggaggacaugaaccgggccaccgccgcccgccagcgggaccacgagaagcagcaggagcgcguccgggagcagauggagguggugaacaugucccugagcaccuccgccgacagccugaccacgccgcgccucacccuguccgagcuggacgacaucaucaagaacgcgagcgggaucuacgccgagaucgacggcgccaagagcgagcugcaggucaagcucuccaaccugagcaaccugucccacgaccucgugcaggaggccaucgaccacgcccaggaccugcagcaggaggcgaacgagcugagccggaagcuccacuccagcgacaugaacgggcugguccagaaggcccuggacgccuccaacguguacgagaacaucgugaacuacgucagcgaggccaacgagaccgcggaguucgcccucaacaccacggaccgcaucuacgacgccguguccggcaucgacacccagaucaucuaccacaaggacgagagcgagaaccugcugaaccaggcccgggagcuccaggccaaggcggaguccagcuccgacgaggccguggccgacaccagccgccgggucgggggcgcccuggcccgcaaguccgcgcugaagacccggcucagcgacgccgugaagcagcugcaggccgccgagcgcggcgacgcccagcagcggcuggggcagucccgccucaucacggaggaggcgaaccggaccaccauggaggugcagcaggccaccgcccccauggccaacaaccugacgaacuggagccagaaccugcagcacuucgacagcuccgcguacaacaccgccgucaacagcgcccgcgacgccgugcgcaaccucaccgagguggucccccagcugcuggaccagcuccggaccguggagcagaagcgccccgccuccaacgugagcgcguccauccagcggauccgcgagcugaucgcccagacgcggagcgucgccuccaagauccaggugagcaugauguucgacggccaguccgccguggagguccacagccgcaccuccauggacgaccugaaggccuucaccagccucucccuguacaugaagccgcccgugaagcggcccgagcugaccgagaccgcggaccaguucauccucuaccuggggagcaagaacgccaagaaggaguacaugggccuggccaucaagaacgacaaccucguguacgucuacaaccugggcacgaaggacguggagaucccgcuggacuccaagcccgugagcuccuggcccgccuacuucagcaucgucaagaucgagcgcguggggaagcacggcaagguguuccucaccguccccucccugagcagcaccgccgaggagaaguucaucaagaagggggaguucuccggcgacgacagccugcucgaccuggacccggaggacaccguguucuacgucggcgggguccccuccaacuucaagcugcccacgagccucaaccugcccggguucguggggugccuggagcucgcgacccugaacaacgacgugaucucccuguacaacuucaagcacaucuacaacauggacccgagcaccuccguccccugcgcccgggacaagcucgccuucacccagagccgcgccgccuccuacuucuucgacggcagcggguacgcgguggugcgggacaucacgcgccggggcaaguucgggcaggucacccgcuucgacaucgaggugcggacccccgccgacaacggccugauccugcucauggugaacggcuccauguucuuccgccuggagaugcggaacggguaccugcacgucuucuacgacuucggcuucagcgggggccccgugcaccucgaggacacccugaagaaggcccagaucaacgacgccaaguaccacgagaucuccaucaucuaccacaacgacaagaagaugauccugguggucgaccgccggcacgucaagagcauggacaacgagaagaugaagaucccguucacggacaucuacaucgggggcgcgccgcccgagauccuccagucccgcgcccugcgggcccaccucccccucgacaucaacuuccgcggcugcaugaagggguuccaguuccagaagaaggacuucaaccugcuggagcagaccgagacccucggcgugggguacggcugcccggaggacagccugaucucccgccgggccuacuucaacgggcagagcuucaucgccuccauccagaagaucagcuucuucgacggcuucgagggcggguucaacuuccgcacccugcagcccaacggccuccuguucuacuacgcgagcggguccgacgucuucagcaucucccuggacaacggcacggugaucauggacgugaagggcaucaagguccagagcguggacaagcaguacaacgacgggcucucccacuucgugaucagcuccgucagccccacccgguacgagcugaucguggacaagucccgcgucggcagcaagaaccccaccaaggggaagaucgagcagacccaggccuccgagaagaaguucuacuucggcgggagcccgaucuccgcccaguacgccaacuucacgggcugcaucagcaacgccuacuucacccggguggaccgcgacguggaggucgaggacuuccagcgguacaccgagaaggugcacaccucccuguacgagugccccaucgagagcagcccccucuuccugcugcacaagaagggcaagaaccucagcaagcccaaggcgucccagaacaagaagggcgggaaguccaaggacgccccgagcugggaccccguggcccugaagcugcccgagcgcaacacgccgcggaacucccacugccaccucagcaacagcccccgcgccaucgagcacgccuaccaguacgggggcaccgcgaacagccggcaggaguucgagcaccugaagggggacuucggcgccaagucccaguucagcauccgccugcggacccgcuccagccacggcaugaucuucuacgucuccgaccaggaggagaacgacuucaugacccucuuccuggcccacgggcggcugguguacauguucaacgugggccacaagaagcucaagauccgcagccaggagaaguacaacgacgggcuguggcacgacgucaucuucauccgggagcgcuccagcggccggcuggugaucgacgggcuccgcgugcuggaggagucccugccgcccacggaggccaccuggaagaucaagggcccgaucuaccucggcggggucgcgcccggcaaggccgugaagaacgugcagaucaacagcaucuacuccuucagcgggugccuguccaaccugcagcucaacggcgccagcaucaccuccgccagccagaccuucagcgucacgcccugcuucgagggccccauggagaccgggaccuacuucuccaccgagggcggguacguggugcuggacgagagcuucaacaucggccugaaguucgagaucgccuucgagguccgcccgcgguccagcuccgggacgcuggugcacggccacagcgugaacggcgaguaccucaacguccacaugaagaacggccaggugaucgugaaggucaacaacggcauccgcgacuucuccaccagcgugacccccaagcagucccugugcgacgggcgguggcaccgcaucaccgugauccgggacagcaacgucgugcagcuggacguggacuccgaggucaaccacguggugggcccccucaaccccaagccgaucgaccaccgcgagcccgucuucgucggcggggugcccgagagccugcugacgccccggcucgcgccguccaagcccuucacggggugcauccgccacuucgucaucgacgggcaccccgugagcuucuccaaggccgcccuggugagcggcgccgucuccaucaacagcugccccgccgcguga

SEQ ID NO: 32191 - RNA, 11088 nt, Artificial Sequence
  derived and/or modified sequence opt1 from LAMA5__Homo_sapiens__NP_005551
auggccaagcgccugugcgccggcagcgcgcucugcgugcgggggccccgcggcccggccccccugcugcucgucgggcuggcccugcucggcgccgcccgggcgcgcgaggaggccgggggcggcuucucccugcacccccccuacuucaaccuggccgagggggcccggaucgcggccagcgccaccugcggcgaggaggccccggcccgcggguccccccggcccaccgaggaccucuacugcaagcuggugggcgggcccguggcgggcggcgacccgaaccagacgauccgcgggcaguacugcgacaucugcaccgccgccaacagcaacaaggcccaccccgccuccaacgcgaucgacggcaccgagcggugguggcagagccccccccugucccgcgggcucgaguacaacgaggucaacgugacccuggaccugggccagguguuccacgucgccuacgugcucaucaaguucgccaacagcccgcggcccgaccugugggugcuggagcgcuccauggacuucggccggacguaccagcccuggcaguucuucgccagcuccaagcgcgacugccucgagcgguucgggccccagacccuggagcgcaucacccgggacgacgccgcgaucugcaccacggaguacagccgcaucgucccgcuggagaacggcgagaucguggugucccucgucaacgggcggcccggcgccaugaacuucagcuacuccccccugcugcgcgaguucaccaaggccaccaacgugcggcuccgcuuccugcgcaccaacacgcugcucgggcaccugaugggcaaggcccugcgggaccccaccgugacccgccgguacuacuacagcaucaaggacaucuccaucggcgggcgcugcgucugccacggccacgccgacgcgugcgacgccaaggacccgaccgaccccuuccggcuccagugcacgugccagcacaacaccugcgggggcaccugcgaccgcugcugccccggguucaaccagcagcccuggaagccggccaccgccaacagcgcgaacgagugccaguccugcaacugcuacggccacgccacggacugcuacuacgaccccgagguggaccggcgccgggccagccagagccuggacggcaccuaccaggggggcggggugugcaucgacugccagcaccacaccaccggcgucaacugcgagcgcugccugcccggguucuaccggucccccaaccacccgcucgacagcccccacgugugccgccggugcaacugcgaguccgacuucacggacggcaccugcgaggaccugaccggccgcugcuacugccggcccaacuucagcggggagcgcugcgacgugugcgccgagggcuucaccggguucccguccugcuaccccacgcccagcuccagcaacgacacccgggagcagguccugcccgccggccagaucgugaacugcgacugcuccgcggccggcacccaggggaacgccugccgcaaggacccgcgggugggccgcugccucugcaagcccaacuuccaggggacccacugcgagcugugcgcccccggcuucuacgggcccggcugccagccgugccagugcagcucccccggcgucgccgacgaccgcugcgaccccgacacggggcagugccggugccgcgugggcuucgagggggcgaccugcgaccggugcgcccccggcuacuuccacuucccgcugugccagcucugcgggugcagccccgccggcacccugcccgagggcugcgacgaggccgggcgcugccugugccagcccgaguucgccggcccgcacugcgaccggugccgccccggguaccacggcuuccccaacugccaggcgugcaccugcgacccccggggggcccucgaccagcugugcggcgccggcgggcugugccgcugccggccgggcuacacggggaccgccugccaggagugcucccccggcuuccacggguuccccagcugcguccccugccacugcuccgcggagggcagccuccacgccgccugcgacccgcgcuccggccagugcagcugccggccccgcgugaccgggcugcggugcgacaccugcgugcccggcgccuacaacuucccguacugcgaggccggguccugccaccccgcgggccuggcccccgucgaccccgcccucccggaggcccaggugcccugcaugugccgcgcccacguggagggccccagcugcgaccggugcaagcccggguucuggggccugagcccguccaaccccgaggggugcacccgcugcagcugcgaccugcggggcacgcuggggggcgucgcggagugccagcccggcaccgggcagugcuucugcaagccccacgugugcggccaggccugcgccuccugcaaggacggguucuucggccucgaccaggccgacuacuucgggugccgcagcugccggugcgacaucggcggcgcccuggggcaguccugcgagccgcgcaccggcgugugccggugccgccccaacacccaggggcccacgugcagcgagcccgcgcgcgaccacuaccugccggaccuccaccaccugcggcuggagcucgaggaggccgccacccccgagggccacgccguccgcuucggguucaacccccuggaguucgagaacuucuccuggcggggcuacgcgcagauggcccccgugcagccgcgcaucguggcccggcugaaccucaccagccccgaccuguucuggcuggucuuccgcuacgugaaccggggcgccauguccgugagcgggcgcgucuccgugcgggaggagggccgcagcgccaccugcgcgaacugcacggcccagucccagcccguggccuuccccccgagcaccgagcccgccuucaucaccgucccccagcggggguucggcgagcccuucgugcucaacccgggcaccugggcccugcgcguggaggcggaggggguccugcucgacuacguggugcugcugcccuccgccuacuacgaggccgcccuccugcagcugcgggucacggaggccugcaccuaccgccccagcgcgcagcaguccggcgacaacugccuccuguacacccaccugccgcucgacggguuccccagcgccgccggccuggaggcccugugccggcaggacaacagccucccccgccccugcccgaccgagcagcugucccccagccaccccccccugaucacgugcaccggguccgacguggacgugcagcuccaggucgccgugccgcagcccggccgguacgcgcugguggucgaguacgccaacgaggacgcccgccaggaggugggcguggccguccacaccccccagcgggcgccccagcaggggcugcucagccugcacccgugccuguacuccacccucugccgcggcacggcccgcgacacccaggaccaccuggccguguuccaccuggacagcgaggccuccgugcggcucaccgccgagcaggcgcgcuucuuccugcacggggucacccuggugcccaucgaggaguucagccccgaguucguggagccccgggucuccugcaucagcucccacggcgccuucgggccgaacagcgccgccugccuccccucccgcuuccccaagcccccgcagcccaucauccugcgggacugccaggugaucccccugcccccgggccucccccugacgcacgcccaggaccugacccccgcgaugagccccgccggcccgcgcccccggcccccgaccgccguggaccccgacgccgagcccacccuccugcgcgagccccaggccacggucguguucaccacccacgugccgacccuggggcgguacgcguuccuccugcacggcuaccagcccgcccaccccacguuccccgucgaggugcugaucaacgccgggcgcguguggcagggccacgccaacgcguccuucugcccgcacggguacggcugccggacccucgucgugugcgagggccaggcccugcuggacgugacccacagcgagcucaccgucacggugcgcguccccaaggggcgguggcuguggcuggacuacgugcucgugguccccgagaacguguacuccuucggcuaccugcgcgaggagccccuggacaagagcuacgacuucaucucccacugcgccgcccagggguaccacaucagcccgagcuccagcucccucuucugccggaacgccgcggccagccugucccuguucuacaacaacggcgcccgccccugcgggugccacgaggugggcgccaccggccccaccugcgagcccuucgggggccagugcccgugccacgcccacgucaucgggcgggacugcagccgcugcgcgaccggcuacuggggcuuccccaacugccggcccugcgacugcggggcccgccucugcgacgagcugaccggccagugcaucugccccccgcggacgaucccccccgacugccugcucugccagccccagaccuucgggugccacccgcuggugggcugcgaggagugcaacugcuccgggcccggcauccaggagcugaccgaccccaccugcgacacggacagcggccagugcaagugccgcccgaacgugaccgggcgccggugcgacaccugcucccccggcuuccacggguacccccgcugccggcccugcgacugccacgaggccggcaccgccccgggggucugcgacccccucacgggccagugcuacugcaaggagaacgugcagggccccaagugcgaccagugcagccuggggaccuucucccuggacgccgcgaaccccaagggcugcacccgcugcuucugcuucggggccaccgagcggugccgcagcuccagcuacacgcggcaggaguucguggacauggagggcuggguccuccuguccaccgaccgccagguggugccgcacgagcggcagcccgggaccgagaugcugcgcgccgaccuccggcacguccccgaggccgugcccgaggcguucccggagcuguacuggcaggccccccccagcuaccugggcgaccgcguguccagcuacggcgggacccuccgguacgagcugcacuccgagacgcagcgcggcgacgucuucgugcccauggagagccggccggacgugguccugcaggggaaccagaugagcaucaccuuccucgagcccgccuaccccacccccggccacgugcaccgcgggcagcugcagcugguggagggcaacuuccggcacaccgagacgcgcaacaccgucucccgggaggagcucaugauggugcuggccagccuggagcagcuccagauccgcgcccuguucucccagaucagcuccgcgguguuccugcgccgggucgcccucgagguggccagcccggccggccagggggcccuggcguccaacguggagcugugccugugccccgccagcuaccgcggcgacuccugccaggagugcgcccccggguucuaccgggacgucaagggccucuuccugggccgcugcgugcccugccagugccacgggcacagcgaccggugccugccgggcuccggggugugcgucgacugccagcacaacaccgagggcgcccacugcgagcgcugccaggccggguucgugagcucccgggacgaccccagcgcgcccugcguguccugccccugcccgcucagcguccccuccaacaacuucgccgagggcugcgugcugcgcggcgggcggacccagugccugugcaagcccggcuacgccggggccagcugcgagcgcugcgccccgggcuucuucgggaacccccucgugcugggcuccagcugccagcccugcgacugcagcggcaacggggaccccaaccugcucuucuccgacugcgacccgcugacgggcgcgugccgggggugccugcgccacaccaccggcccccggugcgagaucugcgcccccggguucuacggcaacgcccuccugcccggcaacugcacccgcugcgacugcacgccgugcgggaccgaggccugcgacccccacagcggccacugccugugcaaggcgggggucaccggccggcgcugcgaccggugccaggagggccacuucggguucgacggcugcgggggcugccgccccugcgccugcgggcccgccgccgagggcuccgagugccacccgcagagcggccagugccacugccggcccgggaccaugggcccccagugccgcgagugcgcccccggguacuggggccucccggagcaggggugccggcgcugccagugccccggcggccgcugcgacccccacacggggcggugcaacugccccccgggccuguccggggagcgcugcgacaccugcagccagcagcaccaggugcccgugcccggcgggcccgucggccacuccauccacugcgaggugugcgaccacugcgugguccugcuccuggacgaccuggagcgggcgggcgcccuccugccggccauccacgagcagcugcgcgggaucaacgccagcuccauggccugggcgcggcuccaccgccugaacgccagcaucgccgaccugcagucccagcuccggagcccccugggcccccgccacgagaccgcccagcagcuggaggugcucgagcagcaguccaccagccuggggcaggacgcccggcgccugggcgggcaggcggugggcacgcgggaccaggccucccagcuccuggccggcaccgaggccacccuggggcacgcgaagacccuccuggccgccauccgcgccgucgaccggacccugagcgagcucaugucccagacgggccaccuggggcuggccaacgcgagcgcccccuccggcgagcagcuccugcgcacccuggccgagguggagcggcuccugugggagaugcgcgcccgggaccugggcgccccgcaggcggccgccgaggccgagcucgccgcggcccagcgccugcuggcccgggugcaggagcagcucagcagccugugggaggagaaccaggcccuggcgacccagacccgcgaccgccucgcccagcacgaggccgggcugauggaccugcgggaggcccucaaccgcgccgucgacgcgacgcgggaggcccaggagcugaacucccgcaaccaggagcggcuggaggaggcccuccagcgcaagcaggagcugagccgggacaacgccacccugcaggccacccuccacgcggcccgcgacacccuggccuccguguuccggcugcuccacagccuggaccaggccaaggaggagcuggagcgccucgccgcgucccuggacggcgcccggacgccccugcuccagcgcaugcagaccuucagccccgccggguccaagcugcggcuggucgaggccgccgaggcgcacgcccagcagcucggccagcuggcccugaaccucagcuccaucauccuggacgugaaccaggaccgccugacccagcgggccaucgaggcgagcaacgccuacucccgcauccuccaggccgugcaggccgccgaggacgcggccgggcaggcccugcagcaggccgaccacaccugggccacggucgugcggcagggccugguggaccgcgcgcagcagcuccuggccaacagcaccgcccuggaggaggccaugcuccaggagcagcagcggcugggccuggucugggccgcgcuccagggggcccgcacccagcugcgggacgugcgcgccaagaaggaccagcuggaggcccacauccaggcggcccaggccaugcucgccauggacaccgacgagacguccaagaagaucgcccacgcgaaggccguggccgccgaggcccaggacaccgcgacccgcguccagagccagcugcaggccaugcaggagaacguggagcgguggcagggccaguacgaggggcugcgcggccaggaccucgggcaggccgugcuggacgccggccacuccgucagcacccuggagaagacgcucccgcagcugcuggccaagcuguccauccucgagaaccggggcgugcacaacgcgagccuggcccuguccgccagcaucgggcgcgugcgggagcucaucgcccaggcccgcggcgcggccagcaaggucaaggugcccaugaaguucaacgggcgguccggcgugcagcugcgcaccccccgggaccuggccgaccucgccgcguacaccgcccugaaguucuaccugcaggggcccgagccggagcccggccagggcaccgaggaccgcuucgucauguacauggggagccggcaggccacgggcgacuacaugggggugucccuccgcgacaagaaggugcacugggucuaccagcugggcgaggccggccccgccgugcugagcaucgacgaggacaucggggagcaguucgcggccgugucccucgaccggacccugcaguucggccacaugagcgucaccguggagcgccagaugauccaggagaccaagggggacacgguggcccccggcgccgaggggcugcucaaccugcggccggacgacuucgucuucuacgugggcggcuaccccuccaccuucaccccccccccgcugcuccgcuuccccggguaccggggcugcaucgagauggacacccugaacgaggagguggucagccuguacaacuucgagcgcacguuccagcucgacaccgccguggaccggcccugcgcgcgcuccaagagcaccggggaccccuggcugaccgacggcuccuaccuggacgggacgggcuucgcccgcaucagcuucgacucccagaucagcaccaccaagcgguucgagcaggagcuccgccugguguccuacagcggcguccuguucuuccucaagcagcagucccaguuccugugccuggccgugcaggaggggagccucgugcugcuguacgacuucggcgccgggcucaagaaggccgucccgcugcagcccccccccccgcugaccagcgcguccaaggccauccagguguuccuccugggcgggagccggaagcgcgugcugguccggguggagcgcgccacgguguacuccgucgagcaggacaacgaccucgagcuggccgacgcguacuaccugggcggcgugccccccgaccagcuccccccgagccugcggcgccuguuccccaccgggggcuccgugcgggggugcgucaagggcaucaaggcccucgggaaguacguggaccugaagcgccugaacaccaccggcgugagcgccggcugcaccgccgaccuccuggucgggcgggccaugacguuccacggccacggguuccugcgccucgcgcuguccaacguggccccccugaccggcaacguguacagcggcuucggguuccacuccgcccaggacagcgcccuccuguacuaccgggccucccccgacggccugugccaggucagccuccagcaggggcgcgugucccugcagcugcuccggaccgaggucaagacccaggcgggcuucgccgacggggccccgcacuacguggccuucuacagcaacgccacgggcguguggcuguacgucgacgaccagcugcagcagaugaagccccaccgcggccccccgcccgagcuccagccccagcccgaggggccgccccggcugcugcucggcgggcugcccgaguccggcaccaucuacaacuucagcgggugcaucuccaacguguucgugcagcgccugcucggcccccagcgggucuucgaccugcagcagaaccugggcagcgugaacguguccaccgggugcgcgccggcccuccaggcccagacccccggccuggggccccgcggccugcaggccacggcgcggaaggccagccgccgcagccggcagcccgcccgccacccggccugcaugcuccccccccaccugcggaccacccgcgacuccuaccaguucgggggcagccuguccagccaccucgaguucgucggcauccuggcccggcaccgcaacuggcccucccugagcaugcacgugcucccgcgguccagccgcgggcugcugcucuucaccgcgcggcugcgccccggcucccccagccuggcccucuuccuguccaacgggcacuucguggcccagauggagggccugggcacgcggcuccgcgcccagagccggcagcgcucccggcccgggcgcuggcacaaggucagcgugcggugggagaagaaccgcauccugcuggugaccgacggcgcccgggcguggucccaggaggggccgcaccgccagcaccagggcgccgagcacccccagccccacacccucuucgucgggggccugcccgccagcucccacagcuccaagcugccggugaccgugggcuucagcgggugcgucaagcgccuccggcugcacggccgcccccugggggcccccacgcggauggccggcgugaccccgugcauccuggggccccucgaggcgggccuguucuuccccggcagcgggggcgugaucacccuggaccuccccggggccacccugccggacgucggccuggagcucgaggugcgcccccuggccgugacggggcugaucuuccaccucggccaggcccggaccccccccuaccugcagcugcaggucaccgagaagcaggugcuccugcgcgccgacgacggcgcgggggaguucuccaccagcgugacgcggccguccguccugugcgacggccaguggcaccgccucgccgugaugaagagcgggaacgugcugcggcuggaggucgacgcccaguccaaccacaccgugggcccccuccuggccgcggccgccggggcccccgccccccuguaccucggcggccugccggagcccauggcggugcagcccuggcccccggccuacugcgggugcaugcgccggcuggccgucaaccgcagccccguggccaugacccgguccguggagguccacggcgccgugggggcgagcggcugccccgccgccuga

SEQ ID NO: 32192 - RNA, 5361 nt, Artificial Sequence
  derived and/or modified sequence opt1 from LAMB1__Homo_sapiens__NP_002282
augggccugcuccagcugcuggcguucagcuuccucgcccugugccgcgcgcgggugcgcgcccaggagcccgaguucuccuacgggugcgccgagggcagcugcuaccccgccaccggggaccugcucaucggccgggcccagaagcuguccgucaccagcacgugcgggcugcacaagcccgagcccuacugcaucgugucccaccuccaggaggacaagaagugcuucaucugcaacagccaggaccccuaccacgagacccugaacccggacucccaccugaucgagaacguggucaccaccuucgcgcccaaccgccucaagaucugguggcagagcgagaacggcguggagaacgugaccauccagcuggaccuggaggccgaguuccacuucacccaccucaucaugaccuucaagaccuuccggcccgccgccaugcugaucgagcgcuccagcgacuucggcaagacguggggcguguaccgguacuucgcguacgacugcgaggccuccuuccccggcaucagcaccgggccgaugaagaagguggacgacaucaucugcgacucccgcuacagcgacaucgagcccuccaccgagggcgaggugaucuuccgggcccuggaccccgccuucaagaucgaggaccccuacagcccgcgcauccagaaccuccugaagaucaccaaccugcggaucaaguucgucaagcuccacacgcugggggacaaccugcucgacucccgcauggagauccgggagaaguacuacuacgccguguacgacauggugguccgcggcaacugcuucugcuacggccacgcgagcgagugcgcccccguggacggguucaacgaggagguggagggcaugguccacgggcacugcaugugccggcacaacaccaagggccugaacugcgagcugugcauggacuucuaccacgaccuccccuggcgccccgccgagggccggaacuccaacgccugcaagaagugcaacugcaacgagcacagcaucagcugccacuucgacauggccguguaccuggcgaccgggaacguguccggcggggucugcgacgacugccagcacaacaccaugggccgcaacugcgagcagugcaagccguucuacuaccagcaccccgagcgggacauccgcgaccccaacuucugcgagcggugcacgugcgaccccgccgggagccagaacgagggcaucugcgacuccuacaccgacuucagcaccggccugaucgccgggcagugccgcugcaagcucaacguggagggcgagcacugcgacgugugcaaggagggguucuacgaccuguccagcgaggacccguucggcugcaaguccugcgccugcaacccccuggggaccauccccggcggcaaccccugcgacagcgagacggggcacugcuacugcaagcgccucgucaccggccagcacugcgaccagugccugccggagcacugggggcuguccaacgaccucgacggcugccggcccugcgacugcgaccugggcggggcccugaacaacagcugcuucgcggaguccgggcagugcagcugccgcccccacaugaucgggcggcagugcaacgagguggagcccggcuacuacuucgccacccucgaccacuaccuguacgaggccgaggaggccaaccuggggccgggcguguccaucgucgagcgccaguacauccaggaccggauccccagcuggaccggcgccggguucgugcgcguccccgagggcgcguaccucgaguucuucaucgacaacaucccguacuccauggaguacgacauccugauccgguacgagccccagcugcccgaccacugggagaaggccgugaucacggugcagcgccccgggcggaucccgaccagcucccgcugcggcaacaccauccccgacgacgacaaccaggucgugagccucucccccgggagccgguacgugguccugccccgcccggugugcuucgagaagggcaccaacuacacggugcggcuggagcucccccaguacaccagcuccgacagcgacgucgagucccccuacacccugaucgacagccuggugcugaugcccuacugcaagucccucgacaucuucaccgugggcgggagcggcgacggggucgugacgaacuccgccugggagaccuuccagcgcuaccggugccuggagaacagccgcuccguggucaagaccccgaugaccgacgugugccggaacaucaucuucagcaucuccgcccugcuccaccagacgggccuggcgugcgagugcgacccccaggggagccuguccagcgugugcgaccccaacggcggccagugccagugccgccccaacgucguggggcggaccugcaaccgcugcgccccgggcaccuucggguucggccccuccgggugcaagcccugcgagugccaccuccagggcagcgugaacgccuucugcaaccccgucaccggccagugccacugcuuccaggggguguacgcccgccagugcgaccggugccugccgggccacuggggguuccccuccugccagcccugccagugcaacggccacgccgacgacugcgaccccgugaccggggagugccugaacugccaggacuacacgaugggccacaacugcgagcgcugccucgcgggcuacuacggggacccgaucaucggcagcggggaccacugccggcccugccccugcccggacggccccgacagcggccgccaguucgcccgguccugcuaccaggaccccgucacccugcagcuggccugcgugugcgaccccggguacaucggcagccgcugcgacgacugcgccuccggguacuucggcaacccgagcgaggucggcggguccugccagcccugccagugccacaacaacaucgacaccaccgaccccgaggccugcgacaaggagacggggcggugccucaagugccuguaccacaccgagggggagcacugccaguucugccgcuucggcuacuacggggacgcgcugcagcaggacugccggaagugcgucugcaacuaccucggcaccgugcaggagcacugcaacgggagcgacugccagugcgacaaggccaccggccagugccugugccugcccaacgugaucggccagaacugcgaccgcugcgccccgaacacguggcagcucgccuccgggaccggcugcgaccccugcaacugcaacgccgcgcacagcuucgggcccuccugcaacgaguucaccggccagugccagugcaugcccggguucggcggccggaccugcagcgagugccaggagcuguucuggggcgacccggacgucgagugccgcgccugcgacugcgacccccggggcaucgagacgccccagugcgaccaguccaccgggcagugcgugugcguggagggcgucgagggcccccgcugcgacaagugcacccggggguacagcggcguguucccggacugcacccccugccaccagugcuucgcccugugggacgugaucaucgccgagcucacgaaccgcacccaccgguuccuggagaaggcgaaggcccugaagaucuccggggucaucggccccuaccgcgagaccguggacagcguggagcggaaggucuccgagaucaaggacauccucgcccagagccccgccgccgagccgcugaagaacaucgggaaccuguucgaggaggcggagaagcucaucaaggacgugaccgagaugauggcccagguggaggucaagcuguccgacacgaccagccaguccaacagcaccgccaaggagcuggacagccuccagaccgaggccgagucccuggacaacacggugaaggagcuggccgagcagcucgaguucaucaagaacagcgacauccgcggcgcgcuggacuccaucaccaaguacuuccagaugagccuggaggccgaggagcgggugaacgccuccaccaccgagcccaacagcacggucgagcaguccgcccucaugcgcgaccgcguggaggacgugaugauggagcgggagagccaguucaaggagaagcaggaggagcaggcccgccugcuggacgagcucgcgggcaagcugcagucccuggaccucagcgccgccgccgagaugaccugcgggacgccgcccggcgcguccugcagcgagaccgagugcgggggcccgaacugccggacggacgagggggagcgcaagugcggcggccccgggugcggcgggcuggucaccguggcccacaacgccuggcagaaggccauggaccuggaccaggacgugcucuccgcccuggcggaggucgagcagcugagcaagaugguguccgaggccaagcuccgggccgacgaggccaagcagagcgccgaggacauccugcugaagaccaacgcgaccaaggagaagauggacaaguccaacgaggagcuccgcaaccugaucaagcagauccggaacuuccugacgcaggacagcgccgaccucgacuccaucgaggccgucgccaacgaggugcugaagauggagaugcccagcacgccccagcagcugcagaaccucaccgaggacauccgcgagcggguggagagccugucccaggucgaggugauccugcagcacagcgccgcggacaucgcccgcgccgagaugcuccuggaggaggccaagcgggccuccaagagcgcgaccgacgugaaggucaccgccgacauggugaaggaggcccuggaggaggccgagaaggcccagguggccgccgagaaggccaucaagcaggccgacgaggacauccagggcacccagaaccuccugaccuccaucgagagcgagaccgcggccuccgaggagacccuguucaacgccagccagcgcaucuccgagcucgagcggaacgucgaggagcugaagcgcaaggccgcccagaacagcggggaggcggaguacaucgagaaggugguguacacggucaagcaguccgccgaggacgugaagaagacccuggacggcgagcucgacgagaaguacaagaagguggagaaccugaucgccaagaagaccgaggagagcgccgacgcccggcgcaaggcggagaugcugcagaacgaggccaagacccuccuggcccaggccaacuccaagcugcagcuccugaaggaccuggagcggaaguacgaggacaaccagcgcuaccucgaggacaaggcgcaggagcuggcccggcuggagggcgagguccgcagccuccugaaggacaucucccagaagguggccguguacagcacgugccuguga

SEQ ID NO: 32193 - RNA, 5397 nt, Artificial Sequence
  derived and/or modified sequence opt1 from LAMB2__Homo_sapiens__NP_002283
auggagcugaccagccgcgagcggggccgcgggcagccccugccgugggagcugcggcugggccuccugcuguccgugcucgccgccacccuggcccaggcccccgcccccgacgugcccgggugcagccgcggcuccugcuacccggccaccggggaccugcucgugggccgggccgaccgccugaccgccagcuccacgugcggccugaacgggccccagcccuacugcaucgugagccaccuccaggacgagaagaagugcuuccugugcgacucccggcgccccuucagcgcccgggacaacccgcacucccaccgcauccagaacgucgugaccagcuucgcgccccagcggcgcgccgcgugguggcaguccgagaacggcauccccgccgugaccauccagcuggaccucgaggccgaguuccacuucacccaccugaucaugaccuucaagaccuuccggcccgccgccaugcuggucgagcgcagcgcggacuucgggcggacguggcacguguaccgcuacuucuccuacgacugcggcgccgacuucccgggggugccccucgccccgccccggcacugggacgacgucgugugcgagagccgcuacuccgagaucgagcccagcaccgagggcgaggugaucuaccggguccuggaccccgccauccccauccccgacccguacuccagccgcauccagaaccugcucaagaucaccaaccugcgggugaaccugacccgccuccacacgcugggcgacaaccugcucgacccccgccgggagauccgcgagaaguacuacuacgcccuguacgagcuggugguccgggggaacugcuucugcuacggccacgcguccgagugcgcccccgcccccggggccccggcccacgcggagggcauggugcacggcgccugcaucugcaagcacaacacccgcgggcucaacugcgagcagugccaggacuucuaccgggaccugcccuggcgccccgccgaggacggccacagccacgccugccggaagugcgagugccacgggcacacccacagcugccacuucgacauggccguguaccuggcguccggcaacgucagcgggggcgugugcgacggcugccagcacaacaccgccgggcgccacugcgagcucugccggcccuucuucuaccgcgacccgacgaaggaccugcgggaccccgccgugugccgcuccugcgacugcgaccccaugggcagccaggacgggggccggugcgacucccacgacgacccggcccuggggcucgucagcggccagugccgcugcaaggagcacguggugggcacccggugccagcagugccgcgacggguucuucggccuguccaucagcgaccggcuggggugccgccggugccagugcaacgcgcgcggcaccguccccggguccacccccugcgaccccaacagcggcuccugcuacugcaagcgccucgugacgggccgggggugcgaccgcugccugccgggccacugggggcugagccacgaccuccugggcugccggcccugcgacugcgacgucggcggggcccuggacccccagugcgacgagggcaccgggcagugccacugccgccagcacauggugggccggcgcugcgagcagguccagcccggguacuuccggccguuccucgaccaccugaucugggaggccgaggacacccgcggccagguccuggacgugguggagcggcucgucacccccggcgagacgcccuccuggaccgggagcggcuucgugcgccugcaggaggggcagacccuggaguuccugguggccuccguccccaaggccauggacuacgaccuccugcugcggcucgagccccaggugcccgagcagugggcggagcuggagcugaucgugcagcgccccggccccgucccggcccacagccucugcgggcaccuggugcccaaggacgaccggauccagggcacccugcagccccacgcccgcuaccucaucuuccccaacccggugugccuggagcccggcaucuccuacaagcugcaccucaagcugguccggaccggcgggagcgcccagcccgagacccccuacuccgggccggggcugcucaucgacagccuggugcugcucccccgcgugcugguccuggagauguucagcgggggcgacgccgcggcccucgagcggcaggccaccuucgagcgcuaccagugccacgaggagggccuggugcccuccaagaccagcccguccgaggccugcgcgccccugcucaucagccuguccacgcugaucuacaacggggcgcuccccugccagugcaacccccagggcagccuguccagcgagugcaacccgcacgggggccagugccugugcaagcccgggguggucggccggcgcugcgaccucugcgcccccggcuacuacggguucggccccaccgggugccaggccugccagugcucccacgagggcgcccugagcucccugugcgagaagaccagcggccagugccucugccggaccggggcguucggccugcgcugcgaccgcugccagcgggggcaguggggcuucccguccugccgccccugcgugugcaacgggcacgccgacgagugcaacacgcacaccggcgccugccugggcugccgggaccacaccgggggcgagcacugcgagcgcugcaucgccggguuccacggcgacccccggcuccccuacgggggccagugccgcccgugccccugccccgagggccccgggagccagcggcacuucgccaccuccugccaccaggacgaguacagccagcagaucgugugccacugccgcgcgggcuacaccgggcugcggugcgaggccugcgccccgggccacuucggggaccccucccgccccggcggccggugccagcugugcgagugcagcgggaacaucgaccccauggacccggacgccugcgacccccacacgggccagugccuccgcugccugcaccacaccgaggggccccacugcgcccacugcaagcccggcuuccacggccaggcggcccggcagagcugccaccgcugcacgugcaaccugcucgggaccaacccgcagcagugccccucccccgaccagugccacugcgaccccagcuccggccagugcccgugccugcccaacguccaggggcccagcugcgaccggugcgccccgaacuucuggaaccugacguccggccacgggugccagcccugcgccugccaccccagccgcgcccggggcccgaccugcaacgaguucaccggccagugccacugccgcgcgggguucggcgggcggaccugcuccgagugccaggagcuccacuggggcgacccggggcugcagugccacgccugcgacugcgacagccgcggcaucgacacgccccagugccaccgcuucaccggccacugcuccugccggcccggggugagcggcgugcgcugcgaccagugcgcccggggguucuccggcaucuuccccgccugccacccgugccacgcgugcuucggggacugggaccgcgucgugcaggaccuggccgcccggacccagcgccucgagcagcgggcccaggagcugcagcagaccggcgugcugggcgccuucgagagcuccuucuggcacaugcaggagaagcucgggaucguccagggcaucgugggggcgcgcaacacgagcgccgccuccaccgcccagcugguggaggccaccgaggagcugcggcgcgagaucggcgaggcgaccgagcaccucacgcagcuggaggccgaccugaccgacguccaggacgagaacuucaacgccaaccacgcccucagcgggcuggagcgggaccgccuggcccucaaccugacccugcggcagcucgaccagcaccuggaccugcucaagcacuccaacuuccugggcgcguacgacagcauccgccacgcccacucccagagcgccgaggccgagcggcgcgccaacaccagcgcgcuggccgugcccucccccgugagcaacuccgccagcgcccggcaccgcacggaggcgcucauggacgcccagaaggaggacuucaacuccaagcacauggccaaccagcgggcccugggcaagcugagcgcccacacccacacccucucccugaccgacaucaacgagcuggucugcggggcgcccggcgacgccccgugcgccacgagccccugcgggggcgccggcugccgcgacgaggacgggcagccccggugcggcgggcucuccugcaacggcgccgcggccaccgccgaccuggcccuggggcgcgcccgccacacccaggcggagcuccagcgggcccuggccgagggcggcagcauccugucccgcguggccgagacccggcgccaggcgagcgaggcccagcagcgggcccaggccgcccucgacaaggcgaacgccucccgcggccagguggagcaggccaaccaggagcugcaggagcugauccagagcgucaaggacuuccucaaccaggagggcgccgaccccgacuccaucgagaugguggccacgcgggugcuggagcugagcaucccggcguccgccgagcagauccagcaccucgccggggccaucgccgagcgcguccggagccuggcggacguggacgccauccuggcccgcaccgugggcgacguccggcgcgccgagcagcuccugcaggacgcgcggcgcgcccgguccugggccgaggacgagaagcagaaggccgagaccgugcaggccgcgcuggaggaggcccagcgcgcccaggggaucgcccagggcgccauccggggcgcgguggccgacacccgcgacacggagcagacccucuaccagguccaggagcggauggccggggccgagcgcgcccugagcagcgcgggcgagcgcgcccggcagcuggacgcccugcucgaggcccugaagcugaagcgcgccgggaacucccucgcggccagcaccgccgaggagaccgccggcuccgcgcaggggcgggcccaggaggccgagcagcugcugcgcggcccccucggcgaccaguaccagacggugaaggcccuggccgagcggaaggcgcagggggugcuggccgcccaggcccgcgccgagcagcuccgggacgaggcgcgcgaccugcugcaggccgcccaggacaagcuccagcggcugcaggagcuggagggcaccuacgaggagaacgagcgcgcccucgagagcaaggccgcgcagcuggacgggcuggaggcccggaugcgcuccguccuccaggccaucaaccuccaggugcagaucuacaacacgugccaguga

SEQ ID NO: 32194 - RNA, 3519 nt, Artificial Sequence
  derived and/or modified sequence opt1 from LAMB3__Homo_sapiens__NP_001121113
augcgccccuucuuccugcucugcuucgcccugccgggccugcuccacgcccagcaggcgugcagccgcggggccugcuacccgcccgugggcgaccugcuggucgggcggacccgguuccuccgcgccuccagcacgugcggccugaccaagcccgagaccuacugcacccaguacggggaguggcagaugaagugcugcaagugcgacucccggcagccccacaacuacuacagccaccgcguggagaacguggccuccagcuccggccccaugcggugguggcagagccagaacgacgucaaccccgugucccugcagcucgaccuggaccgccgguuccagcugcaggaggugaugauggaguuccagggccccaugccggccgggaugcucaucgagcgcagcuccgacuucggcaagaccuggcgggucuaccaguaccuggcggccgacugcacgagcaccuucccccgcgugcggcaggggcgcccccaguccuggcaggacgugcggugccagagccugccccagcgcccgaacgcccggcucaacggcgggaagguccagcugaaccugauggaccucguguccggcauccccgccacccagagccagaagauccaggaggugggcgagaucaccaaccugcgcgucaacuucacgcggcuggcgcccgugccccagcgcggguaccacccgcccuccgccuacuacgccgugagccagcuccggcugcagggcuccugcuucugccacgggcacgccgaccgcugcgcccccaagcccggcgcgagcgccggcccgagcaccgccguccaggugcacgacgugugcgucugccagcacaacaccgccgggcccaacugcgagcgcugcgcccccuucuacaacaaccggcccuggcgcccggcggagggccaggacgcccacgagugccagcggugcgacugcaacgggcacuccgagaccugccacuucgaccccgccguguucgccgccagccagggcgcguacgggggcgugugcgacaacugccgcgaccacacggagggcaagaacugcgagcggugccagcugcacuacuuccgcaaccggcgccccggggccuccauccaggagaccugcaucagcugcgagugcgaccccgacggcgccgucccgggggcccccugcgaccccgugaccggccagugcgugugcaaggagcacguccagggggagcggugcgaccucugcaagccgggcuucaccggccugacguacgccaacccccaggggugccaccgcugcgacugcaacauccugggcucccggcgcgacaugcccugcgacgaggagagcgggcggugccucugccugcccaacguggucggcccgaagugcgaccagugcgcgcccuaccacuggaagcuggccuccgggcagggcugcgagcccugcgccugcgacccccacaacagccucuccccgcagugcaaccaguucaccggccagugccccugccgcgagggguucggcgggcugaugugcagcgccgcggccauccggcagugccccgaccgcaccuacggcgacguggccaccggcugccgggccugcgacugcgacuuccgcgggacggagggccccgggugcgacaaggccuccggccggugccugugccgcccggggcucaccggcccccgcugcgaccagugccagcggggcuacugcaaccgcuaccccgugugcgucgcgugccaccccugcuuccagaccuacgacgccgaccugcgggagcaggcccugcgcuucgggcggcuccgcaacgccaccgccagccugugguccggcccggggcuggaggaccggggccucgcgagccgcauccuggacgccaaguccaagaucgagcagauccgggccgugcugagcucccccgccgugacggagcaggaggucgcccagguggcgagcgccauccucucccugcgccggacccugcaggggcuccagcuggaccugccccucgaggaggagacccugagccugccccgcgaccuggagagccucgaccgguccuucaacggccugcugaccauguaccagcgcaagcgggagcaguucgagaagaucagcuccgccgacccgagcggcgccuuccgcaugcucuccacggcguacgagcagagcgcccaggccgcccagcaggucuccgacagcucccggcugcuggaccagcuccgcgacagccggcgcgaggccgagcggcuggugcgccaggccgggggcgggggcgggaccggcucccccaagcugguggcccuccgccuggagaugagcucccugcccgaccucacccccaccuucaacaagcugugcggcaacagccggcagauggccugcacgccgaucuccugccccggggagcugugcccccaggacaacggcaccgccugcgggagccgcugccggggcgugcucccgcgcgccgggggcgcguuccugauggccggccaggucgccgagcagcugcggggguucaacgcccagcuccagcgcacccggcagaugauccgcgccgcggaggaguccgccagccagauccagagcuccgcccagcggcuggagacccaggugagcgccucccgcagccagauggaggaggacgugcggcgcacgcggcugcucauccagcagguccgcgacuuccugaccgaccccgacaccgacgcggccaccauccaggagguguccgaggccgugcuggcccucuggcugcccaccgacagcgccacgguccugcagaagaugaacgagauccaggcgaucgccgcccggcuccccaacguggaccuggugcugucccagaccaagcaggacaucgcccgcgcccggcgccuccaggcggaggccgaggaggcccggagccgcgcccacgccgucgagggccagguggaggacguggucgggaaccugcgccagggcaccguggcgcugcaggaggcccaggacaccaugcagggcacgucccggagccuccgccugauccaggaccggguggccgagguccagcagguccugcgcccggccgagaagcucgugaccuccaugaccaagcagcugggggacuucuggacccggauggaggagcugcgccaccaggcccggcagcagggcgcggaggccgugcaggcccagcagcucgccgagggggcgagcgagcaggcccuguccgcccaggagggcuucgagcgcaucaagcagaaguacgccgagcugaaggaccggcucgggcagagcuccaugcugggcgagcagggcgcccgcauccagagcgugaagacggaggcggaggagcuguucggggagaccauggagaugauggaccggaugaaggacauggagcucgagcugcugcgcggcucccaggccaucaugcuccggagcgccgaccugaccgggcuggagaagcgcguggagcagauccgggaccacaucaacggccgcguccucuacuacgcgaccugcaaguga

SEQ ID NO: 32195 - RNA, 5286 nt, Artificial Sequence
  derived and/or modified sequence opt1 from LAMB4__Homo_sapiens__NP_031382
augcaguuccagcugacccucuuccugcaccugggcuggcucagcuacagcaaggcccaggacgacugcaaccgcggggccugccaccccaccacgggcgaccugcugguggggcggaacacccagcucauggccagcagcacgugcggccugagccgcgcccagaaguacugcauccuguccuaccucgagggggagcagaagugcuucaucugcgacagccgguuccccuacgaccccuacgaccagcccaacucccacaccaucgagaacgugaucgugagcuucgagcccgaccgcgagaagaagugguggcaguccgagaacggccuggaccacgugagcauccggcuggaccucgaggcccuguuccgcuucucccaccugauccucaccuucaagaccuuccggccggccgccaugcuggucgagcgcagcaccgacuacggccacaacuggaagguguucaaguacuucgcgaaggacugcgccaccuccuuccccaacaucacgagcgggcaggcccagggcgugggggacaucgucugcgacuccaaguacagcgacaucgagcccuccaccggcggggagguggugcugaagguccucgaccccagcuucgagaucgagaacccguacucccccuacauccaggaccuggugacccugaccaaccuccggaucaacuucacgaagcugcacacccugggcgacgcccuccugggccgccggcagaacgacagccuggacaaguacuacuacgcgcucuacgagaugaucgugcgcgggagcugcuucugcaacggccacgccuccgagugccggcccaugcagaagaugcgcggggacgucuucuccccgcccggcauggugcacggccagugcgugugccagcacaacaccgacgggcccaacugcgagcggugcaaggacuucuuccaggacgcccccuggcgccccgccgccgaccugcaggacaacgcgugccgguccugcagcugcaacucccacagcucccgcugccacuucgacaugaccacguaccuggccagcggcgggcucuccggcggggucugcgaggacugccagcacaacaccgagggccagcacugcgaccggugccgcccgcuguucuaccgggacccccugaagaccaucagcgaccccuacgccugcauccccugcgagugcgacccggacggcaccaucuccgggggcaucugcgugagccacuccgaccccgcccucgggagcguggccggccagugccugugcaaggagaacgucgagggggcgaagugcgaccagugcaagcccaaccacuacggccuguccgccacggacccccucggcugccagccgugcgacugcaacccccuggggagccugcccuuccugaccugcgacguggacaccggccagugccugugccuguccuacgugaccggggcccacugcgaggagugcacggucggcuacugggggcucggcaaccaccuccacggcugcagccccugcgacugcgacaucgggggcgccuacuccaacgugugcagcccgaagaacgggcagugcgagugccgcccccacgugaccggccgcagcugcuccgagcccgccccgggcuacuucuucgcgccccugaacuucuaccucuacgaggccgaggaggccaccacccugcaggggcuggcgccccugggcagcgagacguucgggcagucccccgccguccacgugguccugggcgagccggugcccgggaaccccgugaccuggaccggccccggcuucgcgcggguccugccgggggccggccugcgcuucgccgugaacaacauccccuuccccguggacuucaccaucgccauccacuacgagacgcagagcgcggccgacuggaccguccagaucguggugaacccgcccgggggcuccgagcacugcauccccaagacccuccagagcaagccccaguccuucgcccugcccgccgccacccggaucaugcugcucccgacgcccaucugccuggagcccgacguccaguacagcaucgacguguacuucucccagccccugcagggggagagccacgcgcacucccacgugcucgucgacagccugggccugaucccgcagaucaacucccucgagaacuucugcagcaagcaggaccuggacgaguaccagcugcacaacugcguggagaucgccuccgccaugggcccccaggugcuccccggggccugcgagcgccugaucaucagcauguccgccaagcugcacgacggcgcggucgccugcaagugccacccccaggggagcgugggcagcuccugcagccggcucgggggccagugccagugcaagccgcugguggucggccgcugcugcgaccggugcuccaccgggagcuacgaccugggccaccacgggugccaccccugccacugccacccccagggcuccaaggacaccgugugcgaccaggugaccgggcagugcccgugccacggcgaggucagcggccgccggugcgaccgcugccucgccggguacuucggcuuccccuccugccaccccugccccugcaaccgguucgccgagcugugcgacccggagaccgggagcugcuucaacugcggcggcuucacgaccgggcgcaacugcgagcggugcaucgacggcuacuacgggaaccccuccagcggccagcccugccgccccugccugugcccggacgaccccuccagcaaccaguacuucgcccacuccugcuaccagaaccucuggagcuccgacgugaucugcaacugccugcagggguacaccggcacccagugcggcgagugcagcacgggguucuacggcaacccccggaucuccggggcgcccugccagccgugcgccugcaacaacaacaucgacgugaccgaccccgagagcugcucccgcgucaccggcgagugccugcggugccuccacaacacccagggggccaacugccagcugugcaagcccggccacuacggcagcgcccugaaccagacgugccgccggugcagcugccacgcguccggggugagccccauggagugcccgcccggcgggggcgccugccucugcgaccccgugaccggggccugccccugccugccgaacgucaccggccuggccugcgaccgcugcgccgacggcuacuggaaccucgugcccgggcgcggcugccaguccugcgacugcgacccccggaccagccaguccagccacugcgaccagcugacggggcagugccccugcaagcugggcuacggcgggaagcgcugcuccgagugccaggagaacuacuacggcgacccgcccgggcggugcauccccugcgacugcaaccgcgcgggcacccagaagcccaucugcgacccggacaccgggaugugccggugccgcgagggcgugagcggccagcggugcgaccgcugcgcccgggggcacucccaggaguucccgaccugccuccagugccaccugugcuucgaccagugggaccacacgaucagcucccugagcaaggccguccagggccucaugcgccuggccgccaacauggaggacaagcgggagacccugcccgugugcgaggcggacuucaaggaccuccgcgggaacguguccgagaucgagcggauccugaagcacccggucuuccccagcggcaaguuccugaaggugaaggacuaccacgacuccgugcgccggcagaucaugcagcucaacgagcagcugaaggccgucuacgaguuccaggaccugaaggacaccaucgagcgcgccaagaacgaggccgaccuccugcuggaggaccuccaggaggagaucgaccugcagagcuccgugcugaacgccagcaucgcggacuccagcgagaacaucaagaaguacuaccacaucagcuccagcgccgagaagaagaucaacgagaccuccagcacgaucaacaccuccgccaacacccggaacgaccuccugaccauccuggacacgcucaccagcaaggggaaccugucccuggagcgccucaagcagaucaagauccccgacauccagauccugaacgagaaggugugcggcgaccccggcaacgucccgugcgugccccugcccugcgggggcgcccucugcaccgggcggaagggccaccgcaagugccgggggcccggcugccacggcagccugacccuguccacgaacgcgcuccagaaggcccaggaggccaagagcaucauccgcaaccuggacaagcagguccgcgggcugaagaaccagaucgaguccaucagcgagcaggccgaggucuccaagaacaacgcccuccagcugcgggagaagcugggcaacauccgcaaccagagcgacuccgaggaggagaacaucaaccucuucaucaagaaggugaagaacuuccugcuggaggagaacgugccgcccgaggacaucgagaaggucgcgaacggggugcucgacauccaccuccccauccccagccagaaccugaccgacgagcucgugaagauccagaagcacaugcagcugugcgaggacuaccggaccgacgagaaccgccugaacgaggaggccgacggcgcccagaagcuccuggucaaggccaaggccgcggagaaggccgccaacauccugcucaaccuggacaagacccugaaccagcuccagcaggcccagaucacgcaggggcgggccaacuccaccaucacccagcugaccgcgaacaucacgaagaucaagaagaacgugcugcaggccgagaaccagacccgcgagaugaaguccgagcucgagcuggccaagcagcgguccggccuggaggacggccucagccugcugcagaccaagcuccagcgccaccaggaccacgccgugaacgccaagguccaggcggagagcgcccagcaccaggccgggucccuggagaaggaguucguggagcugaagaagcaguacgccauccugcagcggaagaccagcaccacgggccucaccaaggagacccuggggaaggucaagcagcugaaggacgcggccgagaagcucgccggcgacaccgaggccaagauccgccggaucacggaccuggagcgcaagauccaggaccugaaccucucccggcaggccaaggcggaccagcugcgcauccuggaggaccaggugguggccaucaagaacgagaucgucgagcaggagaagaaguacgcccggugcuacagcuga

SEQ ID NO: 32196 - RNA, 4830 nt, Artificial Sequence
  derived and/or modified sequence opt1 from LAMC1__Homo_sapiens__NP_002284
augcgcggcagccaccgggccgcccccgcgcugcgcccgcgggggcgccucuggcccgugcuggccguccuggccgccgccgcggccgccggcugcgcccaggcggccauggacgagugcaccgacgagggcgggcggccccagcgcugcaugcccgaguucgugaacgccgccuucaacgugaccgucguggccacgaacacgugcgggaccccgcccgaggaguacugcgugcagaccggcgucaccggcgugaccaaguccugccaccucugcgacgcggggcagccccaccuccagcacggcgccgccuuccugaccgacuacaacaaccaggccgacaccacgugguggcagagccagaccaugcuggccggggugcaguaccccuccagcaucaaccugacccugcaccucggcaaggcguucgacaucaccuacguccggcugaaguuccacacgucccgcccggagagcuucgccaucuacaagcggacccgcgaggacgggcccuggauccccuaccaguacuacuccggcagcugcgagaacaccuacuccaaggccaaccggggcuucauccgcaccgggggcgacgagcagcaggcccugugcacggacgaguucagcgacaucagcccccucaccgggggcaacguggccuucuccacccuggagggccggccguccgcguacaacuucgacaacagccccgugcugcaggagugggucaccgccacggacauccgcgugacccucaaccggcugaacaccuucggggacgagguguucaacgaccccaagguccugaaguccuacuacuacgccaucagcgacuucgccgugggcgggcgcugcaagugcaacggccacgccuccgagugcaugaagaacgaguucgacaagcucgugugcaacugcaagcacaacaccuacggggucgacugcgagaagugccugcccuucuucaacgaccggccguggcgccgggcgacggccgagagcgccuccgagugccugcccugcgacugcaacggccgcagccaggagugcuacuucgaccccgagcucuaccggagcaccggccacgggggccacugcaccaacugccaggacaacaccgacggggcccacugcgagcgcugccgcgagaacuucuuccggcugggcaacaacgaggcgugcuccagcugccacugcucccccguggggagccuguccacgcagugcgacagcuacggccgcugcuccugcaagccgggcgugaugggggacaagugcgaccggugccagcccggcuuccacagccucaccgaggccgggugccgccccugcuccugcgaccccagcggcuccaucgacgagugcaacaucgagaccgggcggugcgucugcaaggacaacguggagggcuucaacugcgagcgcugcaagccgggcuucuucaaccuggagagcuccaacccccgggggugcacccccugcuucugcuucggccacagcuccgugugcacgaacgccgucggguacagcguguacuccaucagcuccaccuuccagaucgacgaggacggcuggcgcgccgagcagcgggacggcagcgaggccagccuggagugguccagcgagcgccaggacaucgcggucaucuccgacagcuacuucccccgguacuucaucgccccggccaaguuccucgggaagcagguccuguccuacggccagaaccugagcuucuccuuccgcguggaccggcgcgacacccggcucagcgccgaggaccuggugcuggagggggccggccuccgcguguccgugccccugaucgcgcaggggaacagcuaccccuccgagaccacggucaaguacguguuccggcugcacgaggccaccgacuacccguggcgccccgcccucacccccuucgaguuccagaagcugcugaacaaccucaccagcaucaagauccggggcaccuacuccgagcgcagcgccggcuaccuggacgacgugacgcuggccuccgcgcgccccgggccgggcguccccgccaccuggguggagagcugcacgugccccgugggguacggcgggcaguucugcgagaugugccucuccggcuaccggcgcgagacccccaaccugggcccguacagccccugcguccugugcgccugcaacgggcacagcgagaccugcgaccccgagaccggcgugugcaacugccgggacaacaccgccgggccccacugcgagaagugcuccgacggcuacuacggggacagcaccgcgggcacguccagcgacugccagccgugccccugccccggcggguccagcugcgccgugguccccaagaccaaggagguggugugcaccaacugcccgaccggcacgaccgggaagcgcugcgagcucugcgacgacggcuacuucggggacccccugggccggaacggccccguccgccugugccggcucugccagugcuccgacaacaucgaccccaacgccguggggaacugcaaccgccugaccggcgagugccugaagugcaucuacaacaccgccggguucuacugcgaccggugcaaggacggcuucuucggcaacccgcuggcccccaaccccgcggacaagugcaaggccugcaacugcaaccucuacgggacgaugaagcagcagagcuccugcaaccccgugaccggccagugcgagugccugccgcacgucaccgggcaggacugcggcgccugcgaccccggguucuacaaccugcagagcggccagggcugcgagcgcugcgacugccacgcccucggguccaccaacggccagugcgacauccggacggggcagugcgagugccagcccggcaucaccgggcagcacugcgagcgcugcgaggugaaccacuucggcuucggcccggaggggugcaagcccugcgacugccaccccgagggcagccugucccugcagugcaaggacgacgggcggugcgagugccgcgagggcuucguggggaaccggugcgaccagugcgaggagaacuacuucuacaaccgcagcuggcccggcugccaggagugcccggccugcuaccggcucgucaaggacaagguggcggaccaccgcgugaagcugcaggagcuggagucccucaucgccaaccugggcaccggggacgagauggucaccgaccaggccuucgaggaccggcugaaggaggccgagcgcgaggugauggaccuccugcgggaggcccaggacgugaaggacgucgaccagaaccugauggaccgccuccagcgcgugaacaacacgcugagcucccagaucagccggcugcagaacauccgcaacaccaucgaggagaccggcaaccucgcggagcaggcccgggcccacguggagaacaccgagcgccugaucgagaucgccucccgggagcuggagaaggcgaaggucgccgccgccaacgugagcgugacgcagcccgagagcaccggggaccccaacaacaugacccuccuggccgaggaggcgcgcaagcuggccgagcggcacaagcaggaggccgacgacaucguccgcguggccaagaccgccaacgacacguccaccgaggcguacaaccuccugcugcggacccucgccggcgagaaccagaccgccuucgagaucgaggagcugaaccgcaaguacgagcaggccaagaacaucagccaggaccuggagaagcaggccgcgcgggugcacgaggaggccaagcgcgccggcgacaaggccgucgagaucuacgccuccguggcgcagcucagcccccuggacuccgagacgcuggagaacgaggccaacaacaucaagauggaggccgagaaccucgagcagcugaucgaccagaagcugaaggacuacgaggaccuccgggaggacaugcgcgggaaggagcuggaggugaagaaccugcucgagaagggcaagaccgagcagcagaccgccgaccagcugcuggcgcgggccgacgccgccaaggcccucgcggaggaggccgccaagaaggggcgcgacacccugcaggaggccaacgacauccugaacaaccucaaggacuucgaccggcgcgucaacgacaacaagaccgccgcggaggaggcccugcggaagaucccggccaucaaccagacgaucaccgaggccaacgagaagacccgcgaggcccagcaggcgcugggcagcgccgccgccgacgcgaccgaggccaagaacaaggcccacgaggccgagcgcaucgccuccgcggugcagaagaacgccacgagcaccaaggccgaggccgagcggaccuucgccgaggugaccgaccucgacaacgaggucaacaacaugcugaagcagcugcaggaggcggagaaggagcucaagcgcaagcaggacgacgccgaccaggacaugaugauggccgggauggccucccaggccgcgcaggaggccgagaucaacgcccggaaggccaagaacagcgugacgucccugcugagcaucaucaacgaccuccuggagcagcugggccagcucgacaccguggaccugaacaagcugaacgagaucgagggcacccucaacaaggcgaaggacgagaugaaggucuccgaccuggaccgcaaggugagcgaccuggagaacgaggccaagaagcaggaggccgccaucauggacuacaaccgggacaucgaggagaucaugaaggacauccgcaaccucgaggacauccggaagacccugcccuccgggugcuucaacacgcccagcaucgagaagcccuga

SEQ ID NO: 32197 - RNA, 3582 nt, Artificial Sequence
  derived and/or modified sequence opt1 from LAMC2__Homo_sapiens__NP_005553
augcccgcccuguggcucggcugcugccugugcuucagccugcuccugcccgccgcgcgcgccaccucccggcgcgaggugugcgacugcaacggcaagagccggcagugcaucuucgaccgcgagcugcaccggcagaccggcaacggguuccgcugccucaacugcaacgacaacacggacggcauccacugcgagaagugcaagaacggguucuaccggcaccgcgagcgggaccgcugccugcccugcaacugcaacuccaagggcagccuguccgcccggugcgacaacagcggccgcugcuccugcaagcccggggucaccggcgcccggugcgaccgcugccuccccggguuccacaugcugaccgacgccggcugcacccaggaccagcggcugcucgacagcaagugcgacugcgacccggcggggaucgccggccccugcgacgccggccgcugcgugugcaagcccgccgugacgggggagcggugcgaccgcugccgguccggcuacuacaaccuggacgggggcaaccccgagggcugcacccagugcuucugcuacgggcacagcgcguccugccgcagcuccgccgaguacagcguccacaagaucaccuccaccuuccaccaggacguggacggcuggaaggccgugcagcggaacgggagcccggccaagcugcaguggucccagcgccaccaggacgucuucagcuccgcccagcgccucgaccccguguacuucguggcgcccgccaaguuccugggcaaccagcaggucagcuacgggcagagccuguccuucgacuaccggguggaccgcggcggccggcaccccagcgcccacgacgugauccucgagggggccggccugcgcaucacggccccgcugaugccccucgggaagacccugcccugcggccugaccaagaccuacacguuccggcucaacgagcaccccuccaacaacuggagcccgcagcuguccuacuucgaguaccgccggcugcuccgcaaccugaccgcgcugcggauccgcgccaccuacggggaguacagcaccggcuacaucgacaacgucacgcucaucuccgcccggcccgugagcggcgcccccgcccccuggguggagcagugcaucugcccggucggguacaagggccaguucugccaggacugcgcguccggguacaagcgcgacagcgcccggcugggccccuucgggaccugcauccccugcaacugccagggcggcggggccugcgaccccgacaccggcgacugcuacuccggggacgagaacccggacaucgagugcgccgacugccccaucggcuucuacaacgacccccacgacccccgcagcugcaagccgugccccugccacaacggcuucuccugcagcgugaugcccgagaccgaggagguggucugcaacaacugcccgcccggggugacgggcgcccggugcgagcugugcgcggacggguacuucggcgaccccuucggggagcacggccccgugcgcccgugccagcccugccagugcaacaacaacgucgaccccuccgccagcggcaacugcgaccggcucaccgggcgcugccugaagugcauccacaacaccgccggcaucuacugcgaccagugcaaggccggguacuucggcgacccccuggcgccgaaccccgccgacaagugccgggccugcaacugcaaccccaugggguccgagcccgugggcugccgcagcgacgggaccugcgugugcaagccgggguucggcgggcccaacugcgagcacggcgccuucuccugccccgccugcuacaaccaggucaagauccagauggaccaguucaugcagcagcuccagcgcauggaggcgcugaucagcaaggcccagggcggggacggcgugguccccgacacggagcuggaggggcggaugcagcaggccgagcaggcccuccaggacauccugcgcgacgcccagaucagcgagggcgcgucccggagccuggggcuccagcuggccaaggugcgcucccaggagaacagcuaccagucccggcuggacgaccucaagaugaccguggagcgcguccgggcccugggcagccaguaccagaaccgcgugcgggacacccaccgccugaucacccagaugcagcucucccuggccgagagcgaggccucccuggggaacacgaacaucccggcgagcgaccacuacgugggccccaacggcuucaagucccuggcccaggaggccacccggcucgccgagagccacgucgaguccgcgagcaacauggagcagcugacccgcgagaccgaggacuacuccaagcaggcccugagccucgugcggaaggcccugcacgagggggugggcuccgggagcggcagccccgacggcgccgucgugcaggggcugguggagaagcucgagaagacgaagucccuggcccagcagcugacccgcgaggcgacccaggccgagaucgaggccgaccggagcuaccagcacucccuccgccugcuggacagcgucucccggcuccagggcgugagcgaccaguccuuccagguggaggaggccaagcgcaucaagcagaaggccgacagccuguccagccuggucacccggcacauggacgaguucaagcgcacgcagaagaaccucgggaacuggaaggaggaggcgcagcagcugcugcagaacggcaaguccgggcgggagaaguccgaccagcuccugagccgcgccaaccuggccaagagccgcgcccaggaggcccucuccaugggcaacgcgaccuucuacgagguggagagcauccugaagaaccugcgggaguucgaccuccagguggacaaccgcaaggccgaggccgaggaggccaugaagcggcuguccuacaucagccagaaggucuccgacgcgagcgacaagacccagcaggccgagcgcgcccugggcagcgccgccgcggacgcccagcgggccaagaacggggccggcgaggcccucgagaucuccagcgagaucgagcaggagaucgggucccugaaccuggaggcgaacgugaccgccgacggcgcccucgccauggagaaggggcuggccagccugaaguccgagaugcgcgagguggagggcgagcucgagcggaaggagcuggaguucgacaccaacauggacgcgguccagauggugaucacggaggcccagaagguggacacccgcgccaagaacgccggcgucaccauccaggacacccugaacacgcucgacgggcugcugcaccucauggaccagccccugagcguggacgaggagggccuggugcuccuggagcagaagcugucccgggccaagacccagaucaacagccagcuccgcccgaugauguccgagcuggaggagcgggcgcgccagcagcgggggcaccuccaccuccuggagaccagcaucgacggcauccuggccgacgucaagaaccuggagaacauccgcgacaaccugccgcccgggugcuacaacacccaggcccuggagcagcaguga

SEQ ID NO: 32198 - RNA, 4728 nt, Artificial Sequence
  derived and/or modified sequence opt1 from LAMC3__Homo_sapiens__NP_006050
auggccgccgcggcccugcuccugggccuggcccuccuggccccccgcgccgcgggggccggcaugggggccugcuacgacggcgccgggcggccgcagcgcugccugcccguguucgagaacgcggccuucggccggcucgcccaggccagccacaccugcggcuccccccccgaggacuucugcccgcacgucggggccgcgggcgccggggcccacugccagcgcugcgacgccgccgacccccagcggcaccacaacgcgagcuaccugaccgacuuccacucccaggacgagagcacgugguggcagucccccagcauggccuucggcgugcaguaccccaccuccgugaacaucacccugcgccucgggaaggccuacgagaucaccuacguccggcugaaguuccacacgagccgcccggaguccuucgccaucuacaagcggagccgcgccgacggccccugggagcccuaccaguucuacuccgcgagcugccagaagaccuacggccggcccgaggggcaguaccugcgcccgggcgaggacgagcggguggccuucugcaccuccgaguucagcgacaucuccccccucagcgggggcaacguggccuucuccacccuggagggccgccccagcgccuacaacuucgaggagucccccgggcugcaggagugggucacgagcaccgagcuccugaucagccuggaccggcucaacaccuucggcgacgacaucuucaaggacccgaaggugcugcaguccuacuacuacgccgugagcgacuucuccgucgggggccgcugcaagugcaacgggcacgcgagcgagugcggccccgacguggccggccagcuggccugccggugccagcacaacaccacggggaccgacugcgagcgcugccuccccuucuuccaggaccggcccugggcccgcggcaccgcggaggccgcccacgagugccugccgugcaacugcuccgggcggagcgaggagugcaccuucgaccgcgagcuguuccgcuccacgggccacgggggccggugccaccacugccgcgaccacaccgccggcccccacugcgagcggugccaggagaacuucuaccacugggacccccgcaugcccugccagccgugcgacugccagagcgccgggucccuccaccugcagugcgacgacaccggcaccugcgcgugcaagcccacggugaccggguggaagugcgaccggugccugcccggcuuccacagccucuccgaggggggcugccgccccugcaccugcaacccggccggcagccuggacaccugcgacccccgguccgggcgcugccccugcaaggagaacgucgagggcaaccugugcgaccggugccgcccggggacguucaaccuccagccccacaaccccgccggcugcagcuccugcuucugcuacggccacagcaaggugugcgccuccaccgcccaguuccaggugcaccacauccugagcgacuuccaccagggggcggagggcuggugggcccgguccgucgggggcagcgagcaccccccgcaguggagccccaacggggugcugcucucccccgaggacgaggaggagcugaccgcccccgagaaguuccugggcgaccagcgcuucagcuacggccagccgcucauccugaccuuccgggugccccccggggacuccccccugccgguccagcuccgccuggagggcacggggcuggcccucagccugcggcacuccagccuguccggcccccaggacgccgggcacccccgcgagguggagcuccgguuccaccugcaggagaccagcgaggacguggcgcccccgcugccccccuuccacuuccagcgccuccuggccaaccugaccucccugcggcuccgcgucagccccggcccgucccccgccggccccguguuccugaccgaggugcgccugacgagcgcccggcccgggcucuccccgcccgcgagcugggucgagaucugcuccugccccaccggcuacaccgggcaguucugcgagagcugcgccccgggcuacaagcgcgagaugccccaggggggccccuacgccuccugcgugcccugcaccugcaaccagcacggcacgugcgacccgaacaccgggaucugcgucugcagccaccacaccgagggccccagcugcgagcggugccugcccggguucuacggcaaccccuucgccgggcaggccgacgacugccagccgugccccugccccggccaguccgcgugcaccaccauccccgagagccgcgagguggugugcacgcacugcccgcccggccagcgggggcgccggugcgaggucugcgacgacggcuucuucggggacccccugggccucuucggccacccccagccgugccaccagugccagugcuccgggaacguggaccccaacgccgugggcaacugcgacccccugagcgggcacugccugcgcugccuccacaacaccaccggcgaccacugcgagcacugccaggagggguucuacggcuccgcccuggccccccggccggccgacaagugcaugcccugcagcugccacccccagggcuccgucagcgagcagaugcccugcgacccggugaccgggcagugcuccugccugccccacgugacggcgcgcgacugcagccggugcuaccccggcuucuucgaccuccagcccgggcgcggcugccgguccugcaagugccacccgcuggggagccaggaggaccagugccaccccaagaccggccagugcaccugccgccccggcgucaccgggcaggccugcgaccggugccagcugggcuucuucggguucuccaucaagggcugccgcgccugccggugcagcccgcucggggccgccuccgcgcagugccacgagaacggcacgugcgugugccgccccggcuucgagggguacaagugcgaccggugccacgacaacuucuuccugaccgccgacggcacccacugccagcagugccccagcugcuacgcccuggugaaggaggaggccgcgaagcucaaggcccgccugacccugacggagggguggcuccagggcuccgacugcggcagccccugggggccgcuggacauccugcucggcgaggccccccggggggacgucuaccagggccaccaccugcugcccggggcccgcgaggccuuccucgagcagaugaugucccuggagggcgcggugaaggccgcccgcgagcagcugcagcggcucaacaagggcgcccgcugcgcccaggcggggagccagaagaccugcacccagcuggccgaccuggaggccgugcucgagagcuccgaggaggagauccugcacgccgccgcgauccuggccagccucgagaucccccaggagggcccgucccagcccaccaaguggagccaccuggccacggaggcccgggcccuggcgcgcucccaccgggacaccgccaccaagaucgccgccaccgcguggcgcgcccuccuggccagcaacacguccuacgcccugcucuggaaccugcuggaggggcgggucgcccucgagacccagcgcgaccuggaggaccgguaccaggaggugcaggcggcccagaaggcccugcgcaccgccguggccgagguccuccccgaggcggagagcgugcuggccaccgugcagcaggucggcgccgacacggcccccuaccuggcccuccuggcguccccgggggcccugccccagaagagccgggccgaggaccucggccugaaggccaaggcgcuggagaagaccguggccuccuggcagcacauggccaccgaggccgcccgcacccuccagacggcggcccaggccacccugcggcagaccgagccccugaccaagcuccaccaggaggcccgcgccgcgcugacgcaggccagcuccagcgugcaggccgccaccgucaccgugaugggcgcccggacccugcucgcggaccuggaggggaugaagcugcaguucccccgcccgaaggaccaggccgcccuccagcggaaggccgacuccgugagcgaccgccugcuggcggacacgcggaagaagaccaagcaggccgagcgcaugcucggcaacgccgccccccuguccagcuccgccaagaagaaggggcgcgaggcggagguccuggccaaggacagcgccaagcucgccaaggcccugcugcgggagcgcaagcaggcgcaccggcgcgccagccggcucaccucccagacccaggccacccugcagcaggccagccagcaggugcuggccuccgaggcgcgccggcaggagcucgaggaggccgagcgcgugggcgccgggcugagcgagauggagcagcagauccgggagucccgcaucagccuggagaaggacaucgagacgcucuccgagcugcuggcccggcucggcagccuggacacccaccaggcccccgcgcaggcccugaacgagacccagugggcccucgagcgccugcggcugcagcucggcucccccgggagccugcagcgcaagcugucccuccuggagcaggagagccagcagcaggagcugcagauccagggcuucgaguccgaccuggccgagauccgggcggacaagcagaaccucgaggccauccugcacagccugccggagaacugcgccuccuggcaguga

SEQ ID NO: 32199 - RNA, 1254 nt, Artificial Sequence
  derived and/or modified sequence opt1 from LAMP1__Homo_sapiens__NP_005552
auggccgcccccggcagcgcgcgccggccgcugcuccugcugcuccugcugcuccugcuggggcucaugcacugcgccuccgccgccauguucauggugaagaacggcaacgggaccgccugcaucauggcgaacuucagcgccgccuucuccgucaacuacgacaccaagagcggccccaagaacaugacguucgaccugcccuccgacgccaccguggugcugaaccgcagcuccugcgggaaggagaacaccagcgaccccucccucgucaucgcguucggccggggccacacccugacgcugaacuucacccgcaacgccacccgguacagcgugcagcucauguccuucguguacaaccugagcgacacccaccuguucccgaacgccuccagcaaggagaucaagacggucgaguccaucaccgacauccgcgccgacaucgacaagaaguaccggugcgugagcgggacccaggugcacaugaacaacgucaccgugacgcuccacgacgccaccauccaggcguaccuguccaacagcuccuucagccgcggcgagacccggugcgagcaggaccgccccagccccaccacggcgcccccggccccgcccucccccagccccucccccgugcccaagagccccuccgucgacaaguacaacgugagcgggaccaacgggaccugccugcucgccuccauggggcugcagcugaaccucaccuacgagcggaaggacaacacgaccgugacccgccugcugaacaucaacccgaacaagaccagcgccuccggcagcugcggcgcccaccucgucacgcuggagcugcacuccgaggggaccaccgugcuccuguuccaguucggcaugaacgccagcuccagccgguucuuccugcaggggauccagcucaacaccauccugcccgacgcccgcgaccccgccuucaaggccgcgaacggcucccugcgggcccuccaggccacggugggcaacagcuacaagugcaacgccgaggagcacguccgcgugaccaaggccuucuccgugaacaucuucaaggucugggugcaggcguucaagguggagggcggccaguucgggagcgucgaggagugccugcuggacgagaacuccaugcucauccccaucgccgugggcggggcccuggccggccugguccucaucgugcugaucgcguaccuggugggccggaagcgcagccacgccggguaccagaccaucuga

SEQ ID NO: 32200 - RNA, 1236 nt, Artificial Sequence
  derived and/or modified sequence opt1 from LAMP2__Homo_sapiens__NP_001116078
auggugugcuuccgccuguuccccgucccgggcagcgggcucgugcuggugugccugguccucggcgccgugcgguccuacgcccuggagcugaaccucaccgacagcgagaacgcgaccugccuguacgccaaguggcagaugaacuucacggugcgcuacgagaccaccaacaagaccuacaagacggucaccaucuccgaccacgggaccgugaccuacaacggcagcaucugcggggacgaccagaacggccccaagaucgccgugcaguucggccccggguucuccuggaucgccaacuucacgaaggccgcgagcaccuacuccaucgacagcgucuccuucagcuacaacaccggcgacaacaccacguuccccgacgccgaggacaaggggauccugaccguggacgagcuccuggccauccggaucccgcugaacgaccucuuccgcugcaacucccugagcacccuggagaagaacgacgugguccagcacuacugggacgugcucgugcaggccuucguccagaacggcaccguguccacgaacgaguuccugugcgacaaggacaagaccagcaccguggcgcccaccauccacacgaccguccccucccccaccaccacgccgacccccaaggagaagcccgaggccgggaccuacagcgugaacaacggcaacgacacgugccugcucgccaccaugggccugcagcugaacaucacccaggacaagguggccuccgucaucaacaucaaccccaacaccacccacagcacgggguccugccggagccacaccgcccuccugcgccugaacagcuccaccaucaaguaccucgacuucguguucgcggugaagaacgagaaccgguucuaccugaaggaggucaacaucagcauguaccuggugaacggcuccgucuucagcaucgccaacaacaaccucuccuacugggacgccccgcuggggagcuccuacaugugcaacaaggagcagaccgugagcguguccggcgccuuccagaucaacacguucgaccugcgcguccagcccuucaacgugacccagggcaaguacagcaccgccgaggagugcuccgcggacagcgaccucaacuuccugauccccguggccgucgggguggcccugggcuuccucaucaucguggucuucaucuccuacaugaucgggcggcgcaagagccggaccggcuaccaguccguguga

SEQ ID NO: 32201 - RNA, 1251 nt, Artificial Sequence
  derived and/or modified sequence opt1 from LAMP3__Homo_sapiens__NP_055213
augccccgccagcugagcgccgccgcggcccucuucgccucccuggccgugauccugcacgacggcagccagaugcgggccaaggcguucccggagacccgcgacuacucccagcccaccgccgccgccacgguccaggacaucaagaagcccgugcagcagcccgcgaagcaggccccgcaccagacccucgccgcccgguucauggacgggcacaucaccuuccagaccgccgcgacggugaagauccccaccaccacccccgccacgaccaagaacaccgccaccacgagccccaucaccuacacccuggucaccacgcaggccaccccgaacaacucccacaccgccccgcccgugaccgaggugacggucggccccagccuggcgcccuacucccucccgcccaccaucaccccgcccgcccacaccacggggaccagcuccagcaccgugucccacaccacgggcaacaccacccagcccagcaaccagaccacgcugcccgccacccuguccaucgcccuccacaagagcaccaccgggcagaagcccgugcagcccacgcacgcccccggcaccaccgcggccgcccacaacaccacccgcacggccgcccccgcguccaccguccccggcccgacccuggcgccccagcccagcuccgugaagaccgggaucuaccaggugcugaacggcagccggcucugcaucaaggccgagauggggauccagcugaucguccaggacaaggaguccguguucagcccccgccgguacuucaacaucgacccgaacgccacgcaggccagcggcaacugcgggacccgcaaguccaaccugcuccugaacuuccagggcggcuucgugaaccugaccuucaccaaggacgaggagagcuacuacaucuccgaggucggggccuaccucacggugagcgaccccgagaccaucuaccagggcaucaagcacgccguggucauguuccagaccgccguggggcacuccuucaagugcgugagcgagcagucccugcagcugagcgcccaccuccaggucaagaccacggacgugcagcugcaggcguucgacuucgaggacgaccacuucggcaacguggacgagugcuccagcgacuacaccaucguccugcccgugaucggcgccaucgucguggggcucugccugaugggcauggggguguacaagauccggcugcgcugccaguccagcggcuaccagcggaucuga

SEQ ID NO: 32202 - RNA, 486 nt, Artificial Sequence
  derived and/or modified sequence opt1 from LAMTOR1__Homo_sapiens__NP_060377
augggcugcugcuacagcuccgagaacgaggacagcgaccaggaccgcgaggagcggaagcugcuccuggaccccuccagcccgcccaccaaggcccugaacggggccgagcccaacuaccacucccuccccagcgcgcgcaccgacgagcaggcccugcuguccagcauccucgccaagacggccuccaacaucaucgacgugagcgccgcggacucccagggcauggagcagcacgaguacauggaccgggcccgccaguacagcacccggcuggccguccuguccagcucccucacccacuggaagaagcugccgccccugcccagccucaccucccagccccaccaggugcuggccagcgagccgauccccuucuccgaccugcagcaggucagccgcaucgcggccuacgccuacagcgcccucucccagauccggguggacgccaaggaggagcugguggugcaguucgggauccccuga

SEQ ID NO: 32203 - RNA, 288 nt, Artificial Sequence
  derived and/or modified sequence opt1 from LAMTOR2__Homo_sapiens__NP_001138736
augcugcgccccaaggcccucacccaggugcugagccaggccaacaccggcgggguccaguccacgcugcuccugaacaacgagggcagccugcucgcguacuccggguacggcgacaccgacgcccgggugaccgccgccaucgccagcaacaucugggcggccuacgaccgcaacgggaaccaggccuucaacgaggacaaccugaaguucauccugauggacugcauggcccaggcgcucgugcaguaccuggaggagccgcugacccaggucgccgccuccuga

SEQ ID NO: 32204 - RNA, 375 nt, Artificial Sequence
  derived and/or modified sequence opt1 from LAMTOR3__Homo_sapiens__NP_068805
auggccgacgaccugaagcgcuuccucuacaagaagcugcccagcguggagggccugcacgccaucgucguguccgaccgggacggggugccggucaucaagguggcgaacgacaacgcccccgagcacgcccuccgccccggcuuccugagcaccuucgcccuggccaccgaccagggguccaagcucggccugagcaagaacaaguccaucaucugcuacuacaacacguaccaggugguccaguucaaccggcugccccucguggugagcuucaucgcguccagcuccgccaacaccgggcugaucgucagccuggagaaggagcucgccccgcuguucgaggagcugcgccaggugguggaggucuccuga

SEQ ID NO: 32205 - RNA, 1200 nt, Artificial Sequence
  derived and/or modified sequence opt1 from LANCL1__Homo_sapiens__NP_001130047
auggcccagcgcgccuuccccaacccguacgcggacuacaacaagagccuggccgagggcuacuucgacgccgccgggcggcucacccccgaguucucccagcgccugaccaacaagauccgggagcugcuccagcagauggagcgcggccucaagagcgccgacccccgggacgggacgggcuacaccgggugggcgggcaucgccgugcuguaccugcaccuguacgacgucuucggcgaccccgccuaccugcagcucgcccacggguacgugaagcagucccugaacugccugaccaagcgcagcaucaccuuccucugcggcgacgcggggccgcuggccguggccgccguccuguaccacaagaugaacaacgagaagcaggccgaggacugcaucacgcggcucauccaccugaacaagaucgacccccacgcgcccaacgagaugcuguacggccgcaucggguacaucuacgcccuccuguucgugaacaagaacuucggcguggagaagaucccccagucccacauccagcagaucugcgagaccauccugaccagcggcgagaaccucgcccggaagcgcaacuucaccgccaaguccccgcugauguacgagugguaccaggaguacuacgucggggccgcgcacggccuggccgggaucuacuacuaccucaugcagcccagccuccaggugucccagggcaagcugcacagccuggugaagcccuccgucgacuacgugugccagcugaaguuccccagcggcaacuacccgcccugcaucggggacaaccgggaccugcucgugcacuggugccacggcgcccccggggucaucuacaugcugauccaggccuacaagguguuccgcgaggagaaguaccugugcgacgccuaccagugcgcggacgugaucuggcaguacggccuccugaagaagggguacggccugugccacggcuccgccgggaacgccuacgccuuccucacgcuguacaaccugacccaggacaugaaguaccucuaccgggccugcaaguucgcggaguggugccuggaguacggcgagcacgggugccgcacccccgacaccccguucagccuguucgagggcauggccgggacgaucuacuuccucgccgaccugcugguccccaccaaggcccgguuccccgcguucgagcucuga

SEQ ID NO: 32206 - RNA, 1353 nt, Artificial Sequence
  derived and/or modified sequence opt1 from LANCL2__Homo_sapiens__NP_061167
augggcgagaccaugagcaagcgccugaagcuccaccucgggggcgaggccgagauggaggagcgggccuucgugaaccccuucccggacuacgaggcggccgccggggcccugcuggccuccggcgcggccgaggagaccgggugcguccgcccgcccgccacgaccgacgagcccggccugcccuuccaccaggacggcaagaucauccacaacuucauccggcgcauccagaccaagaucaaggaccugcuccagcagauggaggaggggcugaagaccgccgacccccacgacugcagcgcguacacgggcuggaccgggaucgcccugcucuaccugcagcuguaccgggugaccugcgaccagaccuaccuccugcgcucccuggacuacgugaagcggacgcuccgcaaccugaacggccggcgcgucaccuuccugugcggggacgccggcccccucgccgugggcgccgugaucuaccacaagcugcggagcgacugcgagucccaggagugcgucaccaagcugcuccagcugcagcgcagcguggugugccaggaguccgaccugcccgacgagcuccuguacgggcgggcgggcuaccuguacgcccuccuguaccugaacaccgagaucgggccgggcacggucugcgagagcgccaucaaggagguggugaacgccaucaucgaguccggcaagacccucagccgcgaggagcggaagaccgagcgcugcccccugcuguaccaguggcaccggaagcaguacgucggggccgcgcacggcauggccgggaucuacuacaugcucaugcagcccgccgccaagguggaccaggagacccugacggagauggugaagcccuccaucgacuacguccgccacaagaaguuccggagcggcaacuacccguccagccuguccaacgagaccgaccgccucgugcacuggugccacggggcccccggcgugauccacaugcugaugcaggcguacaaggucuucaaggaggagaaguaccugaaggaggccauggagugcagcgacgugaucuggcagcggggccuccugcgcaagggguacggcaucugccacgggaccgccggcaacggguacuccuuccugagccucuaccgccugacccaggacaagaaguaccuguaccgggccugcaaguucgccgaguggugccucgacuacggcgcgcacggcugccgcauccccgaccggcccuacucccuguucgaggggauggccggcgccauccacuuccugagcgacgugcucgggccggagacgagccgcuuccccgccuucgagcuggacuccagcaagcgggacuga

SEQ ID NO: 32207 - RNA, 1560 nt, Artificial Sequence
  derived and/or modified sequence opt1 from LAP3__Homo_sapiens__NP_056991
auguuccugcucccccugccggccgccggccgcguggucgugcggcgccuggcggugcggcgcuucgggagccggucccucagcaccgccgacaugaccaagggccugguccuggggaucuacuccaaggagaaggaggacgacgugccccaguucacgagcgccggcgagaacuucgacaagcuccuggccgggaagcugcgcgagacccucaacaucuccggcccgccccugaaggccggcaagacccggaccuucuacgggcugcaccaggacuuccccagcgugguccucgugggccuggggaagaaggcggccggcaucgacgagcaggagaacuggcacgaggggaaggagaacauccgcgccgccguggcggccggcugccggcagauccaggaccuggagcucuccagcgucgagguggaccccugcggcgacgcccaggccgccgcggagggggccgugcugggccuguacgaguacgacgaccucaagcagaagaagaagauggccgucuccgccaagcuguacgggagcggcgaccaggaggccuggcagaagggcgugcuguucgcguccgggcagaaccucgcccgccagcugauggagacgcccgccaacgagaugacccccacccgguucgccgagaucaucgagaagaaccucaagagcgccuccagcaagaccgaggugcacauccgcccgaaguccuggaucgaggagcaggcgaugggcagcuuccucuccgucgccaaggggagcgacgagccgcccguguuccuggagauccacuacaagggcucccccaacgccaacgagccgccccugguguucgucgggaagggcaucacguucgacagcggcgggaucagcaucaaggccuccgccaacauggaccucaugcgggcggacaugggcggggccgccaccaucugcagcgccaucguguccgcggccaagcugaaccugcccaucaacaucaucggccucgcgccccugugcgagaacaugcccagcgggaaggccaacaagcccggcgacgugguccgcgccaagaacggcaagaccauccagguggacaacaccgacgccgaggggcggcugauccucgccgacgcccugugcuacgcccacacguucaaccccaaggugauccugaacgccgcgacccucaccggcgccauggacgucgcccugggguccggcgccaccgggguguucacgaacagcuccuggcuguggaacaagcuguucgaggccagcaucgagaccggcgaccgcgucuggcggaugccccuguucgagcacuacacccgccaggugguggacugccagcuggcggacgucaacaacaucggcaaguaccgguccgccggggccugcaccgccgcggccuuccucaaggaguucgugacgcacccgaagugggcccaccuggacaucgccggcgugaugaccaacaaggacgagguccccuaccugcgcaaggggaugaccggccggcccacccgcacgcucaucgaguuccugcugcgcuucagccaggacaacgccuga

SEQ ID NO: 32208 - RNA, 954 nt, Artificial Sequence
  derived and/or modified sequence opt1 from LAPTM4B__Homo_sapiens__NP_060877
augaccagccgcacccgggugacguggcccuccccgccccgcccccugcccguccccgccgccgcggccguggccuucggcgccaaggggaccgaccccgccgaggcgcggagcucccgcggcaucgaggaggccgggccccgggcccacggccgcgccgggcgggagcccgagcgccggcgcagccggcagcagcgccggggcggccuccaggcgcgccgguccacccugcugaagaccugcgcccgcgcccgggccacggcccccggggcgaugaagaugguggcccccuggacccgcuucuacagcaacuccugcugccucugcugccacguccggaccggcaccauccugcugggggugugguaccucaucaucaacgccgugguccugcugauccuccugagcgcccuggccgaccccgaccaguacaacuucuccagcuccgagcucggcggggacuucgaguucauggacgacgcgaacaugugcaucgccaucgccaucagccugcugaugauccucaucugcgccauggccacguacggcgcguacaagcagcgcgccgccuggaucauccccuucuucugcuaccagaucuucgacuucgcccugaacaugcugguggccaucaccgugcucaucuaccccaacuccauccaggaguacauccggcagcugccgcccaacuuccccuaccgcgacgacgucaugagcgugaaccccacgugccuggugcucaucauccugcuguucaucuccaucauccucaccuucaagggcuaccugaucagcugcgucuggaacugcuaccgcuacaucaacgggcggaacuccagcgacgugcugguguacgucaccuccaacgacaccaccgugcuccugccgcccuacgacgacgcgaccgugaacggcgccgccaaggagccgccgccgcccuacgucagcgccuga

SEQ ID NO: 32209 - RNA, 2271 nt, Artificial Sequence
  derived and/or modified sequence opt1 from LARGE__Homo_sapiens__XP_005261889
augcugggcaucugccgcgggcggcgcaaguuccucgccgccagccugucccugcucugcauccccgcgaucaccuggaucuaccuguucagcggcuccuucgaggacgggaagccggugagccugagcccccucgagucccaggcccacagcccccgguacaccgccuccucccagcgcgagcgggagagccuggagguccgcaugcgggagguggaggaggagaaccgcgcccugcggcgccagcucucccuggcccagggccgggcgcccagccaccgccgggggaaccacuccaagacguacagcauggaggagggcaccggcgacuccgagaaccugcgcgccgggaucguggccggcaacagcuccgagugcgggcagcagccggucguggagaagugcgagaccauccacguggccaucgucugcgcgggcuacaacgccagccgggacguggugacccucgucaaguccgugcuguuccaccgccggaacccccugcacuuccaccucaucgccgacagcaucgccgagcagauccuggccacgcuguuccagaccuggauggugcccgcgguccgcguggacuucuacaacgccgacgagcucaagagcgagguguccuggauccccaacaagcacuacagcgggaucuacggccugaugaagcugguccucaccaagacccugccggccaaccuggagcgggugaucgugcucgacacggacaucaccuucgccaccgacaucgccgagcugugggcggucuuccacaaguucaagggccagcagguccuggggcucguggagaaccaguccgacugguaccugggcaaccuguggaagaaccaccgccccuggcccgcccucgggcggggcuacaacaccggcgugauccugcugcuccuggacaagcugcgcaagaugaagugggagcagauguggcgccucacggccgagcgggagcugauggggaugcugagcaccucccucgccgaccaggacaucuucaacgccgugaucaagcagaaccccuuccugguguaccagcugccgugcuucuggaacguccagcucagcgaccacacccgcuccgagcagugcuaccgggacgugagcgaccugaaggucauccacuggaacucccccaagaagcugcgcgugaagaacaagcacguggaguucuuccggaaccucuaccugaccuuccuggaguacgacggcaaccuccugcgccgggagcuguucgggugccccagcgaggcggacgucaacuccgagaaccugcagaagcagcucagcgagcuggacgaggacgaccugugcuacgaguuccgccgggagcgcuucacggugcaccggacccaccucuacuuccugcacuacgaguacgagcccgccgccgacuccaccgacgugacccuggucgcccagcucagcauggaccgccugcagaugcuggaggccaucugcaagcacugggagggcccgaucucccucgcgcuguaccugagcgacgccgaggcccagcaguuccuccgguacgcccagggguccgaggugcugaugagccgccacaacgugggcuaccacaucgucuacaaggagggccaguucuaccccgugaaccugcuccggaacguggcgaugaagcacaucuccacgcccuacauguuccugagcgacaucgacuuccugcccauguacgggcucuacgaguaccugcgcaagagcgucauccagcuggaccucgccaacaccaagaaggccaugaucgugccggccuucgagacccugcgguaccgccuguccuuccccaagagcaaggccgagcuccuguccaugcuggacaugggcacccucuucacguuccgguaccacguguggaccaaggggcacgcgcccaccaacuucgccaaguggcgcaccgccacgacccccuaccgcgucgagugggaggccgacuucgagccguacguggugguccggcgcgacugccccgaguacgaccggcgcuucgugggcuucggguggaacaagguggcccacaucauggagcuggacguccaggaguacgaguucaucgugcugcccaacgcguacaugauccacaugccccacgccccgagcuucgacaucaccaaguuccgguccaacaagcaguaccgcaucugccucaagacccugaaggaggaguuccagcaggacaugagccggcgcuacggcuucgccgcccugaaguaccucacggccgagaacaacuccuga

SEQ ID NO: 32210 - RNA, 3060 nt, Artificial Sequence
  derived and/or modified sequence opt1 from LARP1__Homo_sapiens__NP_056130
augcuguggcgcgugcuccugagcaagcggcccccguucccccaccccgagcuggacuuccaggaggcccccaucccguccugccccggccgccuccccgggcggaagaacagcgucgcccuggcggccgcgccccgcaaggagccgaccggcgaccgggagaagccccugcccuuccccgugcucgccccguucuccaaccccgagcacagcgcccccgccaaggugguccgcgccgccgugcccaagcagcggaagggguccaaggugggcgacuucggggacgccaucaacuggccgacccccggcgagaucgcgcacaagagcguccagccccagucccacaagccccagccgacgcgcaagcugccgcccaagaaggacaugaaggagcaggagaagggcgaggggagcgacuccaaggagagccccaagaccaaguccgacgagagcggcgaggagaagaacggggacgaggacugccagcggggcgggcagaagaagaagggcaacaagcacaagugggugccccugcagaucgacaugaagcccgaggugccccgcgagaagcucgccucccggcccacccgcccgcccgagccccggcacaucccggccaaccgcggcgagaucaaggggagcgaguccgccaccuacguccccguggccccgcccacgcccgcguggcagcccgagaucaagcccgagcccgccuggcacgaccaggacgagaccagcuccgucaagagcgacggcgccgggggcgcccgggccuccuuccgcggccgggggcgcggccgggggcgcggccgggggcgcggccgcggcgggacccggacccacuucgacuaccaguucggcuaccgcaaguucgacggggucgagggcccgcggacgcccaaguacaugaacaacaucaccuacuacuucgacaacgugagcagcaccgagcuguacuccguggaccaggagcugcucaaggacuacaucaagcgccagaucgaguacuacuucagcgucgacaaccuggagcgggacuucuuccugcgccggaagauggacgcggacggguuccuccccaucacccugaucgccuccuuccaccgcgugcaggcccugacgaccgacaucagccucaucuucgccgcccugaaggacuccaaggugguggagaucguggacgagaaggugcggcgccgggaggagcccgagaaguggccccugccgcccaucgucgacuacagccagaccgacuucucccagcuccugaacugccccgaguucgugccccgccagcacuaccagaaggagaccgagagcgcgcccggcagcccccgggccgugacgcccgucccgaccaagaccgaggagguguccaaccugaagacccuccccaagggccuguccgccagccugcccgaccucgacuccgagaacuggaucgaggucaagaagcgcccccggccgagccccgcccgccccaagaaguccgaggagagccgguucucccaccugacgagccugccgcagcagcuccccucccagcagcugaugagcaaggaccaggacgagcaggaggagcuggacuuccucuucgacgaggagauggagcagauggacgggcgcaagaacaccuucaccgccuggagcgacgaggaguccgacuacgagaucgacgaccgggacgugaacaagauccugaucgugacccagacgccccacuacaugcgccgccaccccggcggggaccggaccggcaaccacaccagccgcgcgaagauguccgccgagcuggccaaggucaucaacgacggccucuucuacuacgagcaggaccugugggccgagaaguucgagccggaguacagccagaucaagcaggagguggagaacuucaagaaggugaacaugaucucccgggagcaguucgacacccugacgcccgagccgcccgucgaccccaaccaggaggugccgcccgggccgccccgcuuccagcagguccccaccgacgcgcucgccaacaagcuguucggcgcccccgagcccagcaccaucgcccggucccugcccaccacggugcccgagagccccaacuaccgcaacacccggacgccccgcaccccgcggacgccccagcucaaggacuccagccagaccucccgcuucuaccccguggugaaggaggggcggacccuggacgccaagaugccccgcaagcggaagacccgccacagcuccaacccgccccuggagagccacgucggcugggugauggacucccgggagcaccgcccccggaccgcgagcaucuccagcagccccuccgaggggaccccgaccgugggcagcuacggcugcacgccccagucccuccccaaguuccagcacccgagccacgagcugcugaaggagaacggguucacccagcacgucuaccacaaguaccgccggcgcugccucaacgagcggaagcgccugggcaucgggcagucccaggagaugaacacccuguuccgcuucuggagcuucuuccugcgggaccacuucaacaagaagauguacgaggaguucaagcagcucgcccuggaggacgccaaggagggcuaccgcuacgggcuggagugccucuuccgguacuacuccuacggccuggagaagaaguuccgccuggacaucuucaaggacuuccaggaggagaccgugaaggacuacgaggccggccagcucuacgggcuggagaaguucugggccuuccugaaguacagcaaggcgaagaaccucgacaucgaccccaagcugcaggaguaccugggcaaguuccggcgccucgaggacuuccggguggacccgcccaugggggaggagggcaaccacaagcgccacuccgucguggccgggggcggcgggggcgaggggcggaagcgcugccccagccaguccagcucccggcccgccgccaugaucagccagccgcccaccccgcccaccggccagcccgugcgcgaggacgccaaguggacgucccagcacagcaacacccagacccuggggaaguga

SEQ ID NO: 32211 - RNA, 1749 nt, Artificial Sequence
  derived and/or modified sequence opt1 from LARP4__Homo_sapiens__NP_001164274
augcuccuguucguggagcaggucgccagcaagggcaccgggcugaaccccaacgccaagguguggcaggagaucgcgccgggcaacaccgacgccacgcccgugacccacgggaccgaguccagcuggcacgagaucgccgccaccuccggcgcccaccccgaggggaacgcggagcugagcgaggacaucugcaaggaguacgaggucauguacuccagcuccugcgagacgacccgcaacaccaccggcaucgaggagagcacggacggcaugauccucgggcccgaggaccuguccuaccagaucuacgacgugagcggcgaguccaacagcgccguguccaccgaggaccugaaggagugccucaagaagcagcuggaguucugcuucagccgggagaaccuguccaaggaccucuaccugaucagccagauggacuccgaccaguucaucccgaucuggaccgucgccaacauggaggagaucaagaagcugaccacggaccccgaccucauccuggaggugcugcgcagcucccccauggugcaggucgacgagaagggggagaaggugcggcccagccacaagcgcugcaucgugauccuccgggagaucccggagaccacccccaucgaggaggucaagggccuguucaagagcgagaacugccccaaggugaucuccugcgaguucgcccacaacagcaacugguacaucaccuuccaguccgacacggacgcgcagcaggccuucaaguaccugcgcgaggaggugaagaccuuccaggggaagcccaucauggccccguuccccaacggcagcuucgucaacggcuucaacucccccgggagcuacaagaccaacgccgccgcgaugaacaugggccggcccuuccagaagaaccgccggacccucuuccgcgggcggcgccggcgcgaggacgaccggaucucccgcccgcaccccagcacggccgaguccaaggcccccacccccaaguucgaccugcuggccagcaacuucccgccccuccccggcuccagcucccggaugcccggcgagcuggugcuggagaaccgcaugagcgacguggucaaggggguguacaaggagaaggacaacgaggagcucaccaucuccugcccggugcccgccgacgagcagaccgagugcacgagcgcgcagcagcugaacauguccaccagcucccccugcgccgccgagcugaccgcccucagcaccacgcagcaggagaaggaccugaucgaggacagcuccguccagaaggacggccugaaccagaccaccauccccgugagcccgcccuccaccacgaagcccagccgggccuccaccgcgagcccgugcaacaacaacaucaacgccgccaccgccguggcccuccaggagccccgcaagcuguccuacgcggaggucugccagaagccgcccaaggagcccagcuccgugcugguccagccccuccgggagcugcgcagcaacguggugucccccaccaagaacgaggacaacggggcccccgagaacagcgucgagaagccgcacgagaagcccgaggcccgcgccuccaaggacuacagcggcuuccgggggaacaucaucccccgcggcgcggccggcaagauccgggagcagcgccggcaguucucccaccgcgccaucccccagggggugacgcggcgcaacggcaaggagcaguacgugccgccccggagccccaaguga

SEQ ID NO: 32212 - RNA, 1476 nt, Artificial Sequence
  derived and/or modified sequence opt1 from LARP6__Homo_sapiens__NP_060827
auggcccagagcggcggggaggcccgccccggcccgaagaccgcggugcagauccgggucgccauccaggaggccgaggacguggacgagcuggaggacgaggaggagggggccgagacccgcggcgccggggaccccgcgcgguaccucucccccggcuggggcagcgccuccgaggaggagcccagccgcgggcacuccggcacgaccgccagcgggggcgagaacgagcgggaggaccuggagcaggaguggaagccgcccgacgaggagcugaucaagaagcucguggaccagaucgaguucuacuucuccgacgagaaccuggagaaggacgccuuccugcucaagcacguccgccggaacaagcugggguacgugagcgugaagcugcucaccuccuucaagaaggucaagcaccugacccgcgacuggcggacgaccgcgcacgcccugaaguacagcguggugcucgagcugaacgaggaccaccgcaagguccggcgcaccacccccgugccccuguucccgaacgagaaccuccccuccaagaugcugcugguguacgaccucuaccugagccccaagcugugggcccucgccacgccccagaagaacggccggguccaggagaaggugauggagcaccuccugaagcuguucggcaccuucggggugaucuccagcguccgcauccugaagccgggccgggagcugccgcccgacauccgccggaucuccagccgcuacucccagguggggacccaggagugcgccaucguggaguucgaggaggucgaggcggccaucaaggcccacgaguucaugaucaccgagagccagggcaaggagaacaugaaggccgugcucaucggcaugaagccgcccaagaagaagcccgccaaggacaagaaccacgacgaggagcccacggcguccauccaccugaacaagagccugaacaagcggguggaggagcuccaguacaugggggacgagagcuccgccaacagcuccagcgaccccgaguccaaccccaccagccccauggccggccgccggcacgccgccaccaacaagcugucccccagcgggcaccagaaccuguuccucucccccaacgcgagcccgugcaccucccccuggagcagcccccuggcccagcgcaagggcgucucccgcaagagcccccuggccgaggaggggcggcucaacugcuccacguccccggagaucuuccgcaagugcauggacuacagcuccgacagcagcgugacccccuccggcagccccugggugcggcgccggcgccaggccgagaugggcacccaggagaaguccccggggaccagcccccugcugucccggaagaugcagacggccgacggccuccccgucggggugcugcgccugccccggggcccggacaacacccgcggguuccacggccacgagcggagccgcgcgugcgucuga

SEQ ID NO: 32213 - RNA, 1770 nt, Artificial Sequence
  derived and/or modified sequence opt1 from LARP7__Homo_sapiens__NP_001253968
augauccccaacaucgagggcauggagaccgagagcgggaaccaggagaaggugauggaggaggaguccaccgagaagaagaaggaggucgagaagaagaagcgcagccgggugaagcagguccuggccgacaucgccaagcaggucgacuucugguucggcgacgcgaaccuccacaaggaccgcuuccugcgggagcagaucgagaagucccgcgacggguacguggacaucagccugcucguguccuucaacaagaugaagaagcugacgaccgacggcaagcugaucgcccgggcccuccgcagcuccgccgugguggagcuggaccuggaggggacccggauccgccggaagaagccgcucggcgagcgccccaaggacgaggacgagcggaccguguacgucgagcugcugcccaagaacgugaaccacagcuggaucgagcgcguguucggcaagugcgggaacgucguguacaucuccaucccccacuacaagagcacgggcgacccgaagggguucgccuucguggaguucgagaccaaggagcaggcggccaaggccaucgaguuccucaacaacccgcccgaggaggcgccccggaagcccggcaucuuccccaagaccgucaagaacaagcccauccccgcccugcgcgugguggaggagaagaagaagaagaagaagaagaaggggcggaugaagaaggaggacaacauccaggccaaggaggagaacauggacaccuccaacacgagcaucuccaagaugaagcgcagccggccgaccuccgagggcagcgacaucgaguccaccgagccccagaagcagugcagcaagaagaagaagaagcgcgaccgggucgaggccuccagccugcccgaggugcgcaccggcaagcggaagcgcagcuccagcgaggacgccgagucccucgcgccccgcagcaaggugaagaagaucauccagaaggacaucaucaaggaggccuccgaggccagcaaggagaaccgggacaucgagaucuccacggaggaggagaaggacaccggggaccugaaggacagcucccugcucaagaccaagcgcaagcacaagaagaagcacaaggagcggcacaagaugggcgaggaggucaucccgcugcgcgugcugagcaaguccgaguggauggaccucaagaaggaguaccuggcccugcagaaggccagcauggccucccucaagaagaccaucagccagaucaaguccgagagcgagauggagacggacuccggggugccccagaacaccggcaugaagaacgagaagaccgcgaaccgggaggagugccgcacccaggagaaggucaacgccacgggcccccaguucgugagcggggucaucgugaagaucaucuccaccgagccccugccgggccggaagcagguccgcgacacccuggccgccaucagcgaggugcucuacguggaccugcuggagggggacaccgagugccacgcccgguucaagacgcccgaggacgcgcaggccgugaucaacgccuacaccgagaucaacaagaagcacugcuggaagcucgagauccugagcggcgaccacgagcagcgcuacuggcagaagauccuggucgaccggcaggccaagcucaaccagccccgcgagaagaagcgggggaccgagaagcugaucaccaaggccgagaagauccgccuggcgaagacgcagcaggccuccaagcacauccgguucagcgaguacgacuga

SEQ ID NO: 32214 - RNA, 2712 nt, Artificial Sequence
  derived and/or modified sequence opt1 from LARS2__Homo_sapiens__NP_056155
auggccagcguguggcagcgccugggcuucuacgccucccuccugaagcggcagcugaacgggggccccgacgucaucaagugggagcgccgggugaucccggggugcacccgcagcaucuacuccgcgaccggcaaguggacgaaggaguacacccuccagacccggaaggacguggagaagugguggcaccagcgcaucaaggagcaggccagcaagaucuccgaggccgacaagagcaagcccaaguucuacguccuguccauguuccccuaccccagcgggaagcugcacaugggccacgugcggguguacaccaucuccgacacgaucgcccgcuuccagaagaugcggggcaugcaggucaucaacccgauggggugggacgccuucggccuccccgcggagaacgccgccguggagcgcaaccugcacccccagagcuggacccaguccaacaucaagcacaugcggaagcagcuggaccgccucgggcugugcuucagcugggaccgggagaucacgaccugccugcccgacuacuacaaguggacccaguaccucuucaucaagcuguacgaggccggccuggcguaccagaaggaggcccucgugaacugggacccggucgaccagaccgugcuggccaacgagcaggucgacgagcacgggugcuccuggcgcagcggcgccaagguggagcagaaguaccugcggcagugguucaucaagaccaccgccuacgcgaaggccaugcaggacgcccucgccgaccugcccgagugguacggcaucaaggggaugcaggcccacuggaucggcgacugcguggggugccaccuggacuucacgcucaaggugcacggccaggcgaccggcgagaagcugaccgccuacaccgccacgcccgaggccaucuacgggaccucccacgucgccaucagccccucccaccgccugcuccacggccacagcucccugaaggaggcgcugcggauggcccucgugccggggaaggacugccugacccccgugauggccgucaacaugcugacccagcaggaggugcccguggucauccucgccaaggccgaccuggagggcagccuggacagcaagaucgggauccccuccacgagcuccgaggacaccauccucgcgcagacccugggccuggccuacagcgaggugaucgagacccucccggacggcacggagcgccuguccagcuccgccgaguucaccgggaugacccggcaggacgccuuccuggcgcucacccagaaggcccgcggcaagcgggucgggggcgacgugacgagcgacaagcugaaggacuggcugaucucccgccagcgcuacugggggacccccauccccaucgugcacugccccgucugcggcccgacccccgugccccucgaggaccugcccgugacccugccgaacaucgccagcuucacgggcaagggcgggccgccccucgccauggccuccgagugggucaacugcagcugcccccggugcaagggggcggccaagcgcgagaccgacaccauggacaccuucguggacuccgccugguacuacuuccgguacacggacccccacaacccccacagccccuucaacaccgccguggccgacuacuggaugccggucgaccuguacaucggcgggaaggagcacgcggugaugcaccuguucuacgcccgcuucuucucccacuucugccacgaccagaagauggugaagcaccgggagcccuuccacaagcuccuggcccagggccugaucaagggccagaccuuccgccugcccagcgggcaguaccuccagcgggaggaggucgaccugaccggcuccgugcccgugcacgccaagaccaaggagaagcuggaggucacgugggagaagaugagcaaguccaagcacaacgggguggacccggaggagguggucgagcaguacggcaucgacaccauccgccucuacauccuguucgccgcgccgcccgagaaggacauccugugggacgugaagaccgacgcccuccccggcgugcugcgguggcagcagcgccuguggacccucacgacccgguucaucgaggcccgcgccagcggcaagagcccccagccccagcugcuguccaacaaggagaaggcggaggcccggaagcucugggaguacaagaacagcgucaucucccaggugaccacccacuucacggaggacuucagccugaacuccgccaucagccagcugauggggcucuccaacgcccugagccaggccucccagagcgugauccugcacucccccgaguucgaggacgcgcucugcgcccugauggucauggccgcgccccuggccccgcacgugaccagcgagaucugggccgggcucgcccuggugccccgcaagcugugcgcccacuacaccugggacgccuccguccuccugcaggccuggcccgcgguggaccccgaguuccugcagcagccggaggugguccagauggccgugcucaucaacaacaaggccugcggcaagauccccgugccccagcaggucgcccgggaccaggacaaggugcacgaguucgugcugcagagcgagcuggggguccgccuccugcagggccgguccaucaagaaguccuuccugagcccccgcaccgcgcucaucaacuuccuggugcaggacuga

SEQ ID NO: 32215 - RNA, 3531 nt, Artificial Sequence
  derived and/or modified sequence opt1 from LARS__Homo_sapiens__NP_064502
auggccgagcgcaagggcaccgccaagguggacuuccugaagaagaucgagaaggagauccagcagaagugggacaccgagcgggucuucgaggugaacgcgagcaaccucgagaagcagacguccaaggggaaguacuucgugaccuuccccuacccguacaugaacggccgccugcaccuggggcacaccuucagccucuccaagugcgaguucgccgucggcuaccagcggcugaaggggaagugcugccuguuccccuucggccuccacugcaccggcaugcccaucaaggccugcgccgacaagcugaagcgcgagaucgagcuguacgggugcccgcccgacuuccccgacgaggaggaggaggaggaggagacgagcgugaagaccgaggacaucaucaucaaggacaaggccaagggcaagaaguccaaggcggccgccaaggccgggagcuccaaguaccaguggggcaucaugaagucccucgggcugagcgacgaggagaucgugaaguucagcgaggcggagcacuggcuggacuacuucccgccccucgccauccaggaccugaagcggaugggccugaaggucgacuggcgccgguccuucaucaccaccgacgugaaccccuacuacgacagcuucgugcgcuggcaguuccucacgcugcgggagcgcaacaagaucaaguucggcaagcgguacaccaucuacucccccaaggacgggcagcccugcauggaccacgaccgccagaccggcgagggggucggcccccaggaguacacccugcucaagcugaaggugcuggagccguaccccagcaagcucuccggccugaaggggaagaacaucuuccugguggccgccacgcuccggcccgagaccauguucggccagaccaacugcuggguccgccccgacaugaaguacaucggguucgagaccgugaacggcgacaucuucaucugcacgcagaaggccgcgcggaacaugagcuaccagggguucaccaaggacaacggcguggucccgguggugaaggagcugaugggcgaggagauccugggggccucccucagcgcgccccugaccuccuacaaggucaucuacgugcugcccaugcucaccaucaaggaggacaagggcacggggguggucaccagcgugcccagcgacuccccggacgacaucgccgcccugcgcgaccugaagaagaagcaggcccuccgggccaaguacggcauccgcgacgacauggugcugcccuucgagcccguccccgugaucgagaucccgggguucggcaaccugagcgccgucaccaucugcgacgagcucaagauccagucccagaacgaccgggagaagcuggccgaggccaaggagaagaucuaccugaagggcuucuacgaggggaucaugcucguggacggcuucaaggggcagaaggugcaggacgucaagaagaccauccagaagaagaugaucgacgcgggcgacgcccugaucuacauggagcccgagaagcaggucaugagccgcuccagcgacgagugcgugguggcccugugcgaccagugguaccucgacuacggggaggagaacuggaagaagcagacgucccagugccugaagaaccuggagaccuucugcgaggagacccggcgcaacuucgaggccacccucggcuggcugcaggagcacgccugcagccgcacguacggccuggggacccaccuccccugggacgagcaguggcugaucgagucccugagcgacuccaccaucuacauggcguucuacaccguggcccaccuccugcagggcgggaaccugcacggccaggccgagagcccccugggcauccggccgcagcagaugacgaaggaggugugggacuacgucuucuucaaggaggcccccuuccccaagacccagaucgcgaaggagaagcucgaccagcugaagcaggaguucgaguucugguacccgguggaccugcgcguguccgggaaggaccucguccccaaccaccugagcuacuaccuguacaaccacguggccauguggcccgagcaguccgacaaguggcccaccgccgugcgggccaacggccaccuccugcugaacagcgagaagauguccaagagcaccgggaacuuccucacgcugacccaggccaucgacaaguucuccgcggacggcaugcgccuggcccucgccgacgccggggacaccgucgaggacgccaacuucguggaggcgauggccgacgccggcauccugcggcuguacaccuggguggagugggucaaggagaugguggccaacugggacagccuccgcagcggcccggccuccaccuucaacgaccggguguucgcgagcgagcugaacgccgggaucaucaagacggaccagaacuacgagaagaugauguucaaggaggcccugaagaccggcuucuucgaguuccaggccgcgaaggacaaguaccgcgagcucgccgucgaggggaugcaccgggagcugguguuccgcuucaucgaggugcagacccugcuccuggcccccuucugcccccaccugugcgagcacaucuggacccuccugggcaagcccgacuccaucaugaacgccagcuggccggucgccgggcccgugaacgaggugcugauccacuccagccaguaccucauggaggucacgcacgaccugcggcugcgccucaagaacuacaugaugcccgcgaagggcaagaagaccgacaagcagccccugcagaagccgucccacugcaccaucuacguggccaagaacuacccgcccuggcagcacaccacgcugagcgugcuccggaagcacuucgaggccaacaacggcaagcugcccgacaacaaggucaucgccuccgagcuggggagcaugcccgagcucaagaaguacaugaagaaggugaugcccuucguggccaugaucaaggagaaccuggagaagaugggcccccgcauccuggaccuccagcuggaguucgacgagaaggcgguccugauggagaacaucguguaccucaccaacucccuggagcuggagcacaucgaggugaaguucgccagcgaggccgaggacaagauccgggaggacugcugccccgggaagccgcucaacgucuuccgcaucgagcccggcguguccgugagccuggucaacccccagcccuccaacgggcacuucagcaccaagaucgagauccggcagggcgacaacugcgacuccaucauccgccggcugaugaagaugaaccgcggcaucaaggaccucagcaaggugaagcugaugcgcuucgacgacccgcugcucgggccccggcgcgugcccguccugggcaaggaguacaccgagaagacgccgaucagcgagcacgccguguucaacguggaccugauguccaagaagauccaccucaccgagaacgggauccgggucgacaucggcgacaccaucaucuaccuggugcacuga

SEQ ID NO: 32216 - RNA, 2154 nt, Artificial Sequence
  derived and/or modified sequence opt1 from LAS1L__Homo_sapiens__NP_001164120
augagcugggaguccggcgccgggcccggccuggggagccagggcauggaccucgugugguccgccugguacgggaagugcgucaagggcaagggcagccugccgcuguccgcgcacgggaucgugguggccuggcucagccgcgccgagugggaccaggucaccguguaccuguucugcgacgaccacaagcugcagcgguacgcccucaaccgcaucaccguguggcggucccgcagcggcaacgagcugccccuggccgucgcguccacggccgaccucauccggugcaagcugcuggacgugaccgggggccucgggaccgacgagcugcgccugcucuacggcauggcccuggugcgguucgucaaccugaucagcgagcgcaagaccaaguucgccaaggugccccucaagugccuggcgcaggaggugaacauccccgacuggaucgucgaccugcggcacgagcucacgcacaagaagaugccgcacaucaacgacugccgccggggcugcuacuucgugcuggacuggcugcagaagaccuacuggugccgccagcucgagaacucccugcgggagaccugggagcuggaggaguuccgcgaggggaucgaggaggaggaccaggaggaggacaagaacaucguggucgacgacaucaccgagcagaagcccgagccccaggacgacggcaagagcacggaguccgacgugaaggccgacggggacagcaagggcuccgaggagguggacagccacugcaagaaggcccucucccacaaggagcuguacgagcgggcccgcgagcugcucgucagcuacgaggaggagcaguucaccgugcuggagaaguuccgguaccugcccaaggccaucaaggcguggaacaacccgagcccccgcguggagugcguccucgccgagcugaagggcgugaccugcgagaaccgggaggccgugcuggacgccuuccucgacgacggguuccugguccccaccuucgagcagcuggccgcgcuccagaucgaguacgaggagaacguggaccugaacgacguccuggugcccaagccguucucccaguucuggcagccccuccugcgcggccugcacagccagaacuucacgcaggcccuccuggagcggaugcuguccgagcuccccgcccuggggaucagcggcauccgccccaccuacauccugcgcuggaccguggagcugaucgucgccaacaccaagacggggcggaacgcccgccgguucuccgcgggccagugggaggcccgccggggcuggcgccucuucaacugcagcgccucccuggacuggccgcggaugguggagagcugccuggggucccccugcugggccagcccccagcuccugcgcaucaucuucaaggccaugggccaggggcugcccgacgaggagcaggagaagcuccugcggaucugcuccaucuacacccagagcggcgagaacucccuggugcaggaggggagcgaggcguccccgaucggcaagagccccuacacccucgacucccuguacuggagcgucaagcccgccuccagcuccuucggcagcgaggccaaggcccagcagcaggaggagcaggggagcgugaacgacgugaaggaggaggagaaggaggagaaggagguccugcccgaccagguggaggaggaggaggagaacgacgaccaggaggaggaggaggaggacgaggacgacgaggacgacgaggaggaggaccgcauggaggugggcccguucuccaccgggcaggagagccccacggcggagaacgcccggcuccuggcccagaagcgcggcgcccugcagggguccgccuggcaggucagcuccgaggacgugcggugggacaccuucccccucggccgcaugcccggccagaccgaggacccggcggagcugaugcuggagaacuacgacaccauguaccuccuggaccagcccgugcuggagcagcggcucgagcccagcacgugcaagaccgacacccuggggcuguccugcggcgucgggagcggcaacugcuccaacagcuccagcuccaacuucgagggccuccuguggagccaggggcagcugcacggccucaagaccgggcugcagcuguucuga

SEQ ID NO: 32217 - RNA, 618 nt, Artificial Sequence
  derived and/or modified sequence opt1 from LASP1__Homo_sapiens__NP_001258537
augcugccccuccgcgaccugcaggacgacaccgagcacgaggagcugcagggccuccgggaggaggcccugcugcagcgcgugcgguacaaggaggaguucgagaagaacaaggggaagggcuucagcgucguggccgacaccccggagcuccagcgcaucaagaagacgcaggaccagaucuccaacaucaaguaccacgaggaguucgagaagucccggauggggcccagcggcggggagggcauggagcccgagcgccgggacagccaggacggcuccagcuaccgccggccccuggagcagcagcagccgcaccacauccccaccuccgcgcccguguaccagcagccccagcagcagccggucgcccagagcuacgggggcuacaaggagcccgccgcccccguguccauccagcgcagcgcccccgggggcgggggcaagcgguaccgcgcgguguacgacuacuccgccgccgacgaggacgaggucagcuuccaggacggcgacaccaucgugaacgugcagcagaucgacgacggguggauguacggcaccgucgagcggacgggggacaccggcaugcugccggccaacuacguggaggcgaucuga

SEQ ID NO: 32218 - RNA, 732 nt, Artificial Sequence
  derived and/or modified sequence opt1 from LAT2__Homo_sapiens__NP_115852
augagcuccggcaccgagcugcucuggcccggggccgcccugcuggugcuccugggcgucgcggccagccugugcgugcgcugcucccggccgggggccaagcgcagcgagaagaucuaccagcagcggucccuccgcgaggaccagcagagcuucaccggcucccggacguacagccugguggggcaggccuggcccggcccccuggccgacauggcgcccacccgcaaggacaagcuccugcaguucuacccgucccuggaggaccccgccagcucccgguaccagaacuucagcaagggcucccgccacgggagcgaggaggccuacaucgaccccaucgccauggaguacuacaacuggggccgguucuccaagcccccggaggacgacgacgcgaacagcuacgagaacguccucaucugcaagcagaagaccaccgagacgggggcccagcaggagggcaucgggggccugugccgcggcgaccugucccucagccuggcccugaagaccgggcccaccuccggccucugccccagcgccagccccgaggaggacgaggaguccgaggacuaccagaacagcgccuccauccaccaguggcgggagagccgcaaggugauggggcagcugcagcgggaggcguccccgggccccgugggcagccccgacgaggaggacggggagcccgacuacgucaacggcgagguggccgccaccgaggccuga

SEQ ID NO: 32219 - RNA, 702 nt, Artificial Sequence
  derived and/or modified sequence opt1 from LAT__Homo_sapiens__NP_001014987
auggaggaggccauccuggugcccugcguccucggccugcugcuccugccgauccuggccaugcucauggcgcugugcgugcacugccaccgccugcccgggagcuacgacuccaccagcuccgacagccucuacccccggggcauccaguucaagcgcccccacaccguggccccguggccgcccgccuacccgcccgucacguccuacccgccccugagccagcccgaccugcuccccaucccccggagcccccagccccucgggggcucccaccgcacccccuccagccggcgcgacuccgacggggccaacagcguggccuccuacgagaacgaggagcccgcgugcgaggacgccgacgaggacgaggacgacuaccacaaccccggcuaccuggugguccugcccgacagcaccccggccaccuccacggccgcgcccagcgcccccgcccuguccacccccggcauccgggacagcgccuucuccauggagagcaucgacgacuacgugaacgugccggagagcggggaguccgccgaggcgagccuggacggcucccgcgaguacgucaacgugagccaggagcuccaccccggggccgccaagaccgagcccgccgcccuguccagccaggaggcggaggagguggaggaggagggcgcccccgacuacgagaaccugcaggagcucaacuga

SEQ ID NO: 32220 - RNA, 2073 nt, Artificial Sequence
  derived and/or modified sequence opt1 from LATS1__Homo_sapiens__NP_001257448
augaagcgcagcgagaagcccgagggcuaccggcagaugcgcccgaagaccuuccccgccuccaacuacaccgugagcucccggcagaugcugcaggagauccgcgagagccuccggaaccuguccaagcccagcgacgccgcgaaggccgagcacaacauguccaagaugagcacggaggacccccgccagguccggaacccgcccaaguucgggacccaccacaaggcccugcaggagauccgcaacucccuccugcccuucgccaacgagaccaacagcucccggagcaccuccgaggugaacccccagaugcugcaggaccuccaggccgcgggcuucgacgaggacauggugauccaggcccugcagaagacgaacaaccgcagcaucgaggccgccaucgaguucaucuccaagaugagcuaccaggacccgcggcgcgagcagauggcggccgccgccgcccggcccaucaacgcguccaugaagcccgggaacguccagcagagcgugaaccgcaagcaguccuggaagggcagcaaggagagccuggugccccagcggcacgggccgccccucggcgaguccgucgccuaccacagcgagucccccaacagccagaccgacgugggccgcccccuguccgggagcggcaucuccgccuucgugcaggcccacccgagcaacgggcagcgggucaaccccccccccccgccccaggugcgcuccgugaccccccccccgcccccccggggccagacccccccgccccgcgggacgacccccccgccccccagcugggagcccaacucccagaccaagcgguacagcggcaacauggaguacgucaucucccgcaucagcccggugccccccggcgccuggcaggagggguaccccccgcccccccugaacaccucccccaugaacccgcccaaccagggccagcgcgggaucagcuccgugcccgucggccggcagcccaucaucaugcagagcuccagcaaguucaacuucccgagcggccgccccgggaugcagaacggcacggggcagaccgacuucaugauccaccagaacguggugcccgcgggcaccgucaaccggcagcccccgccccccuacccccucaccgccgccaacgggcaguccccgagcgcccugcagacgggcggcuccgccgcgcccagcuccuacaccaacgggagcaucccccaguccaugauggugccgaaccgcaacagccacaacauggagcuguacaacaucuccgugcccggccuccagaccaacuggccccagagcuccagcgcccccgcccaguccagcccguccagcgggcacgagauccccaccuggcagcccaacauccccguccgguccaacagcuucaacaacccgcugggcaaccgcgccagccacuccgccaacagccagcccuccgcgacgaccgugaccgccaucacccccgcccccauccagcagccggugaagagcaugcggguccugaagcccgagcuccagacggcccuggcgcccacccaccccuccuggaucccgcagcccauccagaccgugcagcccagccccuucccggaggggaccgccuccaacgucacggugaugccccccguggccgaggcccccaacuaccagggcccgcccccccccuacccgaagcaccugcuccaccagaaccccagcguccccccguacgaguccaucagcaagcccuccaaggaggaccagcccagccugcccaaggaggacgaguccgagaagagcuacgagaacguggacuccggcgacaaggagaagaagcagaucaccaccagcccgaucaccgugcgcaagaacaagaaggacgaggagcggcgcgagucccggauccagagcuacuccccccaggccuucaaguucuucauggagcagcacgucgagaacgugcugaagagccaccagcagcgccuccaccggaagaagcagcuggagaacgagaugaugcgcgugaagcccuucaagaugagcaucuucauccugaaccaccucuucgcguggugccuguucuga

SEQ ID NO: 32221 - RNA, 3267 nt, Artificial Sequence
  derived and/or modified sequence opt1 from LATS2__Homo_sapiens__XP_005266399
augcgccccaagaccuucccggccaccacguacagcggcaacucccggcagcgccugcaggagauccgggaggggcucaagcagcccagcaaguccagcgugcagggccugcccgccgggcccaacuccgacaccagccuggacgcgaagguccucggcuccaaggacgccacccgccagcagcagcagaugcgggccaccccgaaguucgggcccuaccagaaggcccugcgcgagauccgguacagccugcuccccuucgccaacgaguccggcacgagcgcggccgccgaggugaaccgccagaugcugcaggagcuggugaacgccggcugcgaccaggagauggcggggcgggcccucaagcagaccggcucccgcagcaucgaggccgcccuggaguacaucuccaagaugggguaccuggacccccggaacgagcagaucguccgcgugaucaagcagaccagcccgggcaaggggcucaugcccacccccgugacgcggcgccccuccuucgagggcaccggcgacagcuucgccuccuaccaccagcugagcgggaccccguacgagggccccuccuucggggcggacggccccaccgcccuggaggagaugccccggccguacgucgacuaccucuuccccggcguggggccccacggccccgggcaccagcaccagcacccgcccaagggcuacggggccagcguggaggccgccggcgcgcacuucccccugcagggcgcccacuacgggcgcccccaccuccucgucccgggcgagccccugggguacggcgugcagcggagccccuccuuccagagcaagacgcccccggagaccgggggcuacgccucccugcccaccaagggccagggcgggcccccgggggccggccucgccuucccgccgcccgcggccgggcuguacgugccccacccccaccacaagcaggccggccccgccgcccaccagcugcacguccucggcagccgcucccagguguucgcgagcgacagcccgccccagucccugcugacccccucccggaacagccucaacguggaccuguacgagcugggguccacgagcguccagcaguggcccgccgccacccuggcccgccgggacucccugcagaagcccggccuggaggcgccgccccgcgcccacguggccuuccgccccgacugccccgugcccagccggaccaacuccuucaacagccaccagccccgccccgggcccccgggcaaggccgagcccucccuccccgcccccaacaccgucacggcggugaccgccgcccacauccugcacccggucaagagcgugcgggugcugcgccccgagccccagaccgccgugggcccgucccaccccgccuggguccccgcgcccgccccggcccccgcccccgcccccgcgccggccgccgaggggcucgacgccaaggaggagcacgcgcuggcccugggcggggccggcgccuucccccucgacguggaguacgggggccccgaccggcgcugcccgcccccgcccuaccccaagcaccuccugcugcggagcaagagcgagcaguacgaccuggacucccugugcgccggcauggagcagagccuccgcgcggggcccaacgagcccgagggcggggacaagucccgcaagagcgccaagggcgacaagggcgggaaggacaagaagcagauccagaccucccccguccccgugcggaagaacagccgggacgaggagaagcgcgagucccggaucaagagcuacuccccguacgccuucaaguucuucauggagcagcacguggagaacgucaucaagacguaccagcagaaggugaaccgccggcugcagcuggagcaggagauggccaaggccggccucugcgaggcggagcaggagcagaugcgcaagauccuguaccagaaggagagcaacuacaaccggcugaagcgcgccaagauggacaaguccauguucgugaagaucaagacccuggggaucggcgccuucggggaggucugccucgccugcaagguggacacccacgcccuguacgcgaugaagacccugcggaagaaggacgugcucaaccgcaaccaggucgcccacgugaaggccgagcgcgacauccuggccgaggcggacaacgaguggguggucaagcuguacuacagcuuccaggacaaggacucccucuacuucgugauggacuacauccccggcggggacaugaugagccugcugauccggauggagguguuccccgagcaccucgcccgcuucuacaucgccgagcugacgcuggccaucgaguccguccacaagaugggcuucauccaccgggacaucaagcccgacaacauccucaucgaccuggacggccacaucaagcugaccgacuucgggcucugcaccggcuuccgcuggacccacaacagcaaguacuaccagaaggggucccacgugcggcaggacagcauggagccgagcgaccugugggacgacguguccaacugccgcugcggcgaccggcugaagacgcucgagcagcgcgcccggaagcagcaccagcgcugccuggcgcacagccuggucgggacccccaacuacaucgcccccgaggugcuccugcggaagggcuacacccagcugugcgacuggugguccgugggcgucauccucuucgagaugcugguggggcagcccccguuccuggcccccacccccacggagacccagcucaaggugaucaacugggagaacacccugcacaucccggcccaggucaagcugagccccgaggcccgcgaccucaucaccaagcugugcugcuccgcggaccaccggcugggccgcaacggggccgacgaccucaaggcccaccccuucuucagcgccaucgacuucuccagcgacauccggaagcagcccgccccguacgugcccaccaucucccaccccauggacacgagcaacuucgaccccguggacgaggaguccccguggaacgacgcgagcgagggcuccaccaaggccugggacacccugaccagccccaacaacaagcaccccgagcacgccuucuacgaguucacguuccgccgguucuucgacgacaacggcuaccccuuccgcugcccgaagcccuccggggccgaggccagccaggcggaguccagcgaccuggaguccagcgaccucgucgaccagaccgagggcugccagcccguguacguguga

SEQ ID NO: 32222 - RNA, 1149 nt, Artificial Sequence
  derived and/or modified sequence opt1 from LAX1__Homo_sapiens__NP_001129662
augcgcagccacuuccugcagugggcccucgccaccucccggaacaaggaccagaucaccaacaucuucagcggcuucgcggggcugcuggccauccuccugguggucgccguguucugcauccuguggaacuggaacaagcgcaagaagcgccaggugcccuaccuccgggucacggugaugccgcugcugacccucccccagacccggcagcgcgccaagaacaucuacgacauccugcccuggcggcaggaggaccugggccgccacgagucccggagcaugcgcaucuucuccaccgagagccuccugucccggaacagcgagucccccgagcacgugccgagccaggccgggaacgcguuccaggagcacacggcccacauccacgccaccgaguacgccgucggcaucuacgacaacgcgauggugccccagaugugcgggaaccugacccccuccgcccacugcaucaacgugcgcgccagccgggacugcgccuccaucagcuccgaggacagccacgacuacgucaacgugcccaccgccgaggagaucgcggagacgcucgccuccaccaagagcccgucccgcaaccuguucgugcugcccagcacccagaagcucgaguucaccgaggagcgggacgagggcugcggcgacgccggggacugcacgagccuguacucccccggcgccgaggacagcgacucccugagcaacggggagggcuccagccagaucuccaacgacuacgucaacaugaccgggcucgaccugagcgccauccaggagcgccagcuguggguggcguuccagugcugccgggacuacgagaacgugcccgccgccgacccguccggcagccagcagcaggccgagaaggacguccccuccagcaacaucggccacguggaggacaagaccgacgaccccgggacccacgugcagugcgucaagcgcacguuccucgccuccggcgacuacgcggacuuccagcccuucacccagagcgaggacucccagaugaagcaccgggaggagaugagcaacgaggacuccagcgacuacgagaacgugcugaccgccaagcucgggggccgcgacuccgagcagggcccggggacccagcugcugcccgacgaguga

SEQ ID NO: 32223 - RNA, 1149 nt, Artificial Sequence
  derived and/or modified sequence opt1 from LAYN__Homo_sapiens__NP_001245319
augcgccccggcaccgcccugcaggccgugcuccuggcgguccugcucguggggcugcgggccgccaccggccgccugcucagcgccuccgaccuggaccugcggggcgggcagccggugugccgcgggggcacgcagcggcccugcuacaaggucaucuacuuccacgacaccagccgccggcucaacuucgaggaggccaaggaggcgugccgccgggacggcgggcagcugguguccaucgagagcgaggacgagcagaagcugaucgagaaguucaucgagaaccuccugcccuccgacggcgacuucuggaucgggcugcgccggcgcgaggagaagcagagcaacuccaccgccugccaggaccucuacgccuggaccgacggcagcaucucccaguuccggaacugguacguggacgagcccagcugcggguccgaggucugcguggugauguaccaccagccgagcgcccccgcgggcaucggcgggcccuacauguuccaguggaacgacgaccgcugcaacaugaagaacaacuucaucugcaaguacuccgacgagaagcccgccgucccgagccgggaggccgagggcgaggagacggagcugaccacccccgugcugcccgaggagacccaggaggaggacgccaagaagacguucaaggagucccgcgaggccgcgcucaaccuggccuacauccugauccccagcaucccgcuccugcugcuccugguggucaccaccguggugugcugggucuggaucugccggaagcgcaagcgggagcagcccgaccccuccaccaagaagcagcacacgaucuggcccagcccgcaccaggggaacucccccgaccuggagguguacaacgugauccgcaagcagagcgaggccgaccucgccgagacccggcccgaccugaagaacaucagcuuccgcgucugcuccggcgaggccacccccgacgacaugagcugcgacuacgacaacauggcggugaacccguccgagagcggcuucgugacccuggucuccguggagagcggguucgugacgaacgacaucuacgaguucucccccgaccagaugggccgcagcaaggaguccgggugggucgagaacgagaucuacggcuacuga

SEQ ID NO: 32224 - RNA, 318 nt, Artificial Sequence
  derived and/or modified sequence opt1 from LBH__Homo_sapiens__NP_112177
augagcaucuacuuccccauccacugcccggacuaccugcgcuccgccaagaugaccgaggugaugaugaacacccagcccauggaggagaucggccucagcccccggaaggacgggcuguccuaccagaucuuccccgacccgagcgacuucgaccgcugcugcaagcugaaggaccggcuccccuccaucgucguggagcccacggagggcgagguggagagcggggagcugcgcuggcccccggaggaguuccugguccaggaggacgagcaggacaacugcgaggagaccgccaaggagaacaaggagcaguga

SEQ ID NO: 32225 - RNA, 1446 nt, Artificial Sequence
  derived and/or modified sequence opt1 from LBP__Homo_sapiens__NP_004130
augggcgcccuggcccgcgcgcuccccagcauccugcuggcccuccugcugaccuccaccccggaggcccucggggccaaccccggccugguggcccggaucacggacaaggggcugcaguacgcggcccaggagggccuccuggcccugcagagcgagcuccugcgcaucacccugcccgacuucaccggggaccuccggaucccccacgucggccgcggccgguacgaguuccacucccugaacauccacagcugcgagcugcuccacuccgcccugcgcccggugcccgggcagggccugagccucuccaucagcgacuccagcauccgggugcaggggcgcuggaagguccggaaguccuucuucaagcugcagggcagcuucgacguguccgugaaggggaucagcaucuccgucaaccugcuccugggcagcgaguccagcggccgccccaccgugacggcguccagcugcagcuccgacaucgccgacguggaggucgacaugagcggggaccugggcuggcuccugaaccuguuccacaaccagaucgaguccaaguuccagaaggugcucgagagccggaucugcgagaugauccagaaguccgugagcuccgaccugcagcccuaccugcagacccucccggucaccaccgagaucgacagcuucgccgacaucgacuacucccugguggaggcgccccgcgccacggcccagaugcuggaggugauguucaagggggagaucuuccaccggaaccaccgcagccccgucacccuccuggccgccgugaugucccugcccgaggagcacaacaagaugguguacuucgccaucagcgacuacgucuucaacaccgccucccucguguaccacgaggagggcuaccugaacuucagcaucaccgacgacaugaucccgcccgacuccaacauccggcugacgaccaagagcuuccgccccuucgugccccggcucgcgcgccuguacccgaacaugaaccuggagcuccagggcuccguccccagcgcgccccugcugaacuucucccccgggaaccucagcguggacccguacauggagaucgacgccuucgugcugcugcccagcuccagcaaggagcccgucuuccggcuguccguggccaccaacgucagcgccacccucacguucaacaccuccaagaucaccggcuuccugaagcccgggaaggugaagguggagcugaaggagagcaaggucggccucuucaacgccgagcugcuggaggcccuccugaacuacuacauccugaacaccuucuacccgaaguucaacgacaagcucgccgagggguucccccugccccugcucaagcgcgugcagcuguacgaccugggccuccagauccacaaggacuuccuguuccugggcgccaacgugcaguacaugcgggucuga

SEQ ID NO: 32226 - RNA, 1722 nt, Artificial Sequence
  derived and/or modified sequence opt1 from LBR__Homo_sapiens__XP_005273182
augcccagccgcaaguucgccgacggcgaggugguccgggggcgcuggccgggcuccagccuguacuacgagguggagauccucucccacgacagcaccucccagcuguacaccgugaaguacaaggacgggacggagcuggagcucaaggagaacgacaucaagccccugaccagcuuccggcagcgcaagggcggguccaccagcuccagccccucccggcgccggggcagccgcucccggagccgcucccggagccccggccgcccgcccaaguccgcccggcgcagcgcguccgccagccaccaggccgacaucaaggaggcccggcgcgaggucgaggugaagcugacgccccucauccugaagcccuucgggaacagcaucucccgguacaacggcgagccggagcacaucgagcgcaacgacgcgccccacaagaacacccaggagaaguucagccugucccaggagagcuccuacaucgccacccaguacagccuccggccccgccgggaggaggugaagcugaaggagaucgacuccaaggaggagaaguacgucgccaaggagcuggccgugcgcaccuucgaggugacccccauccgcgccaaggaccucgaguucgggggcgucccggggguguuccugaucauguucggccugcccguguuccucuuccugcugcuccugaugugcaagcagaaggaccccagccugcucaacuucccgccgccccugcccgcgcuguacgagcucugggagacgcgggucuucggcguguaccugcugugguuccucauccaggugcuguucuaccugcuccccaucgggaaggucguggagggcacgccccugaucgacgggcgccggcugaaguaccgccucaacggcuucuacgccuucauccugaccuccgccgugaucggcaccagccuguuccagggggucgaguuccacuacguguacucccacuuccuccaguucgcccuggccgcgaccguguucugcgucgugcugagcguguaccucuacaugcggucccugaaggcgccccgcaacgaccugagccccgccuccagcggcaacgccgucuacgacuucuucaucgggcgggagcucaacccccgcaucggcaccuucgaccugaaguacuucugcgagcugcggccggggcucaucggcugggaggcccugcugaccaccauggacaucauccacgacggcuucggguucaugcucgccuucggcgaccugguguggguccccuucaucuacuccuuccaggccuucuaccuggugagccaccccaacgagguguccuggcccauggccagccugaucaucguccucaagcugugcggguacgugaucuuccgcggcgccaacagccagaagaacgccuuccggaagaacccguccgaccccaagcuggcgcaccucaagacgauccacaccagcaccgggaagaaccugcugguguccggcugguggggcuucguccgccaccccaacuaccucggggaccugaucauggcccuggccuggagccucccgugcggcuucaaccacauccugcccuacuucuacaucaucuacuucaccaugcugcucgugcaccgggaggcccgcgacgaguaccacugcaagaagaaguacgggguggccugggagaaguacugccagcggguccccuaccgcaucuuccccuacaucuacuga

SEQ ID NO: 32227 - RNA, 846 nt, Artificial Sequence
  derived and/or modified sequence opt1 from LBX1__Homo_sapiens__XP_005269500
augaccagcaaggaggacggcaaggccgcccccggggaggagcgccggcgcuccccgcuggaccaccucccgccgcccgcgaacagcaacaagccccugacccccuucuccaucgaggacauccugaacaagcccagcgugcggcgcuccuacagccucugcggcgccgcccaccuccuggccgccgcggacaagcacgcccagggcgggcugccccuggccgggcgggcccugcucucccagacgagcccccugugcgcgcuggaggagcucgccuccaagaccuucaagggccuggaggucagcgugcugcaggccgccgagggccgcgacgggaugaccaucuucggccagcggcagacccccaagaagcgccggaagucccgcacggccuucaccaaccaccagaucuacgagcucgagaagcgguuccuguaccagaaguaccugagccccgcggaccgcgaccagaucgcccagcagcucgggcugaccaacgcccaggugaucaccugguuccagaaccggcgcgccaagcugaagcgggaccucgaggagaugaaggccgacgucgaguccgcgaagaagcugggccccagcgggcagauggacaucguggcccuggccgagcucgagcagaacuccgaggccacggccggcggcgggggcgggugcggccgcgcgaagucccggccgggcucccccgugcugccgcccggggcccccaaggcccccggcgccggggcccugcagcucagccccgcgagcccccugaccgaccagccggccagcagccaggacugcuccgaggacgaggaggacgaggagaucgacgucgacgacuga

SEQ ID NO: 32228 - RNA, 585 nt, Artificial Sequence
  derived and/or modified sequence opt1 from LBX2__Homo_sapiens__NP_001009812
augggcaagcgcaccagccuggaggugucccucggggagcugggcggggagaagugccggggcgggcgccggagcuucccgccccuggccgccucccgccccgcgcggcccggcggcuggcgcugggcccggcgcgaccucugcaagaccgccagccgggccgagaacaacucccaggccugccgcccccagcggcgcgcggggccggacgcccugggccccgggcccuucggccggaagcgccgcaagagccggacggccuucaccgcccagcagguccuggagcucgagcggcgcuucguguuccagaaguaccuggcgcccuccgagcgggacgggcuggccacccgccucggccuggccaacgcccagguggucaccugguuccagaaccggcgcgccaagcugaagcgcgacguggaggagaugcgggcggacguggccagccuccgcgcccuguccccggagguccugugcagccucgcccugcccgagggcgcccccgaccccgggcugugccucggcccggcggggcccgacucccggccccaccugagcgacgaggagauccagguggacgacuga

SEQ ID NO: 32229 - RNA, 2094 nt, Artificial Sequence
  derived and/or modified sequence opt1 from LCA5__Homo_sapiens__NP_001116241
augggcgagcgcgccgggagccccggcaccgaccaggagcggaaggccgggaagcaccacuacuccuaccugagcgacuucgagaccccgcaguccagcggccgcuccagccucguguccagcucccccgcgagcguccggcgcaagaaccccaagcggcagacguccgacggccaggugcaccaccaggcgccccgcaagccgagccccaaggggcugcccaaccggaagggcgugcgcgucggguuccggucccagagccugaaccgcgagccccuccggaaggacaccgaccuggugaccaagcgcauccuguccgcccggcuccugaagaucaacgagcugcagaacgaggugagcgagcuccaggucaagcuggccgagcugcucaaggagaacaagucccugaagcgccugcaguaccggcaggagaaggcccucaacaaguucgaggacgccgagaacgagaucagccagcugaucuuccgccacaacaacgagaucaccgcccugaaggagcggcuccgcaagucccaggagaaggagcgggccacggagaagcgcgugaaggacaccgagagcgagcuguuccggaccaaguucagccugcagaagcucaaggagaucuccgaggcccgccaccucccggagcgcgacgaccuggcgaagaagcuggugagcgccgagcugaagcuggacgacaccgagcggcgcaucaaggagcucuccaagaaccuggagcugagcacgaacuccuuccagcggcagcuccuggccgagcgcaagcgggccuacgaggcccacgacgagaacaagguccugcagaaggaggugcagcgccucuaccacaagcugaaggagaaggagcgggagcuggacaucaagaacaucuacagcaaccgccuccccaaguccagccccaacaaggagaaggagcuggcgcugcggaagaacgccgccugccaguccgacuucgccgaccucugcaccaagggcgugcagaccauggaggacuucaagcccgaggaguacccgcugacccccgagacgaucaugugcuacgagaacaagugggaggagcccgggcaccugacccucgaccugcagagccagaagcaggaccgccacggcgaggccgggauccugaaccccaucauggagcgggaggagaaguucgucaccgacgaggagcuccacguggugaagcaggaggucgagaagcuggaggacgagugggagcgcgaggagcuggacaagaagcagaaggagaaggcgucccuccuggagcgggaggagaagccggagugggagaccggccgcuaccagcugggcauguaccccauccagaacauggacaagcugcagggggaggaggaggagcggcucaagcgcgagaugcugcuggccaagcucaacgagaucgaccgggagcugcaggacagccgcaaccugaaguaccccgugcucccccugcugccggacuucgaguccaagcuccacagccccgagcggucccccaagacguaccgcuucagcgaguccagcgagcgccuguucaacggccaccaccuccaggacaucuccuucagcacccccaagggggagggccagaacagcggcaacgugcgguccccggccagccccaacgaguucgccuucggguccuacguccccagcuucgccaagaccuccgagcgcagcaaccccuucucccagaaguccagcuuccuggacuuccagcggaacagcauggagaagcuguccaaggacggcguggaccugaucacccgcaaggagaagaaggcgaaccucauggagcagcuguucggggccagcggcuccagcacgaucuccagcaaguccagcgacccgaacagcguggccuccagcaagggggacaucgacccccugaacuuccuccccggcaacaagggcucccgggaccaggagcacgacgaggacgagggguucuuccugagcgagggccgcuccuucaacccgaaccggcaccgccugaagcacgccgacgacaagcccgccgucaaggcggccgacagcguggaggacgagaucgaggagguggcccuccgguga

SEQ ID NO: 32230 - RNA, 1323 nt, Artificial Sequence
  derived and/or modified sequence opt1 from LCAT__Homo_sapiens__NP_000220
augggcccgcccgggagccccuggcagugggugacccugcuccugggccugcuccugccgcccgccgcccccuucuggcugcucaacguccuguucccgccccacaccacgcccaaggcggagcuguccaaccacacccgccccgugauccucgugcccgggugccugggcaaccagcuggaggccaagcucgacaagcccgacgucgugaacuggaugugcuaccggaagaccgaggacuucuucaccaucuggcuggaccugaacauguuccucccccuggggguggacugcuggaucgacaacacgcgcgucguguacaaccggagcuccggccuggugagcaacgcccccggcguccagauccgcgugcccggguucggcaagaccuacuccguggaguaccucgacagcuccaagcuggccggguaccugcacacccucguccagaaccuggugaacaacggcuacgugcgggacgagaccguccgcgccgcgcccuacgacuggcggcuggagcccgggcagcaggaggaguacuaccgcaagcucgccggccugguggaggagaugcacgccgccuacggcaagccgguguuccugaucgggcacagccucggcugccugcaccuccuguacuuccugcugcggcagccccaggcguggaaggaccgcuucaucgacggguucaucucccucggcgcccccuggggcgggagcaucaagcccaugcugguccuggccuccggcgacaaccaggggaucccgaucaugagcuccaucaagcucaaggaggagcagcggaucacgaccaccagccccuggauguuccccucccgcauggccuggcccgaggaccacguguucaucagcaccccguccuucaacuacacgggccgggacuuccagcgcuucuucgccgaccugcacuucgaggaggggugguacauguggcugcagagccgggaccuccuggcgggccugcccgcccccggcguggaggucuacugccucuacggggugggccugcccaccccgcgcaccuacaucuacgaccacggguuccccuacaccgaccccgugggcguccuguacgaggacggggacgacacgguggccacccgguccaccgagcucugcggccuguggcagggccgccagccgcagcccguccaccuccugccccugcacgggauccagcaccugaacaugguguucagcaaccugacccucgagcacaucaacgccauccugcugggcgccuaccggcaggggcccccggcgagccccacggccucccccgagcccccgccgcccgaguga

SEQ ID NO: 32231 - RNA, 267 nt, Artificial Sequence
  derived and/or modified sequence opt1 from LCE1C__Homo_sapiens__NP_001263260
augagcugccagcagucccagcagcagugccagcccccgcccaacgugagcuccggcgggugcugcggcagcuccagcgggggcuccugcgggagcuccagcggcggcugcugcuccagcgggggcgggggcugcugccugucccaccaccgccggcgccggagccacugccaccgcccccaguccagcgggugcugcucccagcccagcggcggcuccagcugcugcgggggcgggagcggccagcacuccggcgggugcugcuga

SEQ ID NO: 32232 - RNA, 270 nt, Artificial Sequence
  derived and/or modified sequence opt1 from LCE3A__Homo_sapiens__NP_848518
augagcugccagcagaaccagcagcagugccagcccccgcccaagugccccgccaagucccccgcccagugccugccgcccgcgagcuccagcugcgcccccuccagcggcgggugcggccccuccagcgagcgcuccugcugccucagccaccaccggugccgccggucccaccgcugccggugccagagcuccaacagcugcgaccgcggguccggccagcagggcgggagcuccagcugcggccacuccagcgccgggugcugcuga

SEQ ID NO: 32233 - RNA, 288 nt, Artificial Sequence
  derived and/or modified sequence opt1 from LCE3B__Homo_sapiens__NP_848520
augagcugccagcagaaccagcagcagugccagccccugccgaagugccccucccccaagugcccgcccaagagcuccgcccagugccucccgcccgccagcuccugcugcgcgccccgccccggcugcugcgggggccccagcuccgagggcgggugcugccugagccaccaccggugcugccgcucccaccggugccgccggcagagcuccaacagcugcgaccgcggguccggccagcaggacggcgccagcgacugcggguacggcuccgggggcugcugcuga

SEQ ID NO: 32234 - RNA, 285 nt, Artificial Sequence
  derived and/or modified sequence opt1 from LCE3C__Homo_sapiens__NP_848521
augagcugccagcagaaccagcagcagugccagcccccgcccuccugccccagccccaagugcccgcccaagucccccgcccagugccugcccccgcccagcuccgacugcgcccucagcuccggcgggugcggccccagcuccgagagcgggugcugccugucccaccaccgccacuuccggagccaccagugccgccggcagcgcuccaacagcugcgaccggggcuccgggcagcagggcggcgggagcugccgcggccacggguccggcgggugcugcuga

SEQ ID NO: 32235 - RNA, 279 nt, Artificial Sequence
  derived and/or modified sequence opt1 from LCE3D__Homo_sapiens__NP_115952
augagcugccagcagaaccagcagcagugccagcccccgcccaagugccccucccccaagugcccgcccaagagccccgugcagugccugcccccggccuccagcggcugcgcccccuccagcgggggcugcgggcccuccagcgagggcgggugcuuccucaaccaccaccgccggcaccaccgcugccggcgccagcggcccaacuccugcgaccgcggcagcggccagcagggcggcggguccgggugcgggcacggcagcggcgggugcugcuga

SEQ ID NO: 32236 - RNA, 279 nt, Artificial Sequence
  derived and/or modified sequence opt1 from LCE3E__Homo_sapiens__NP_848522
augagcugccagcagaaccagaagcagugccagcccccgcccaagugccccucccccaagugcccgcccaagaaccccgugcagugccugcccccggccagcuccggcugcgcccccagcuccgggggcugcgggcccagcuccgagggcgggugcuuccucaaccaccaccgccggcaccaccgcugccggcgccagcggagcaacuccugcgaccgcggcagcggccagcagggcggcggguccgggugcugccacgggagcggcggcugcugcuga

SEQ ID NO: 32237 - RNA, 357 nt, Artificial Sequence
  derived and/or modified sequence opt1 from LCE5A__Homo_sapiens__NP_848525
augagcugccagcagucccagcagcagugccagcccccgcccaagugcacccccaagugccccccgaagugcacccccaagugcccccccaagugcccgcccaagugccccccccagugcagcgccccgugccccccccccguguccagcugcugcggcuccagcuccgggggcugcugcagcuccgaggggggcgggugcugccugagccaccaccgcccgcggcagucccuccgccggcgcccccagagcuccagcugcugcggcuccggcagcgggcagcaguccggcgggagcuccugcugccacagcagcggcggguccggcugcugccacagcuccggcgggugcugcuga

SEQ ID NO: 32238 - RNA, 1551 nt, Artificial Sequence
  derived and/or modified sequence opt1 from LCK__Homo_sapiens__XP_011539756
augggcugcgggugcagcucccaccccgaggacgacuggauggagaacaucgacgugugcgagaacugccacuacccgaucgucccccuggacggcaaggggacccuccugauccgcaacggcagcgaggugcgggacccccuggugaccuacgagggguccaacccgcccgccagcccccuccagggcgacccccgccagcagggccugaaggacaaggccugcgggucccuggcggucggcuuccaccucagccccacguacuuccugccggggcuggccuuccucgugccccaccccgugacccccggcuuccugccgauccccgcccgguucucccugaugccccucgucuucaccgacaaccuggugaucgcccugcacagcuacgagcccucccacgacggggaccucggcuucgagaagggcgagcagcugcgcauccuggagcagagcggggagugguggaaggcccagucccucaccacgggccaggagggguucaucccguucaacuucguggcgaaggccaacagccuggagcccgagcccugguucuucaagaaccugucccggaaggacgccgagcgccagcuccuggcccccggcaacacccacggcagcuuccugauccgggaguccgagagcaccgcgggguccuucagccucuccguccgcgacuucgaccagaaccagggcgagguggugaagcacuacaagauccggaaccuggacaacgggggcuucuacaucagcccgcgcaucaccuuccccgggcugcacgagcucguccggcacuacacgcgcuacuacaacggccacaccaagguggccgucaagagccugaagcagggcuccaugagccccgacgccuuccuggccgaggccaaccucaugaagcagcugcagcaccagcggcuggugcgccucuacgcgguggugacccaggagcccaucuacaucaucaccgaguacauggagaacgggucccuggucgacuuccugaagacgccgagcggcaucaagcucaccaucaacaagcugcuggacauggccgcccagaucgccgaggggauggccuucaucgaggagcggaacuacauccaccgcgaccuccgggcggccaacauccugguguccgacacccugagcugcaagaucgccgacuucggccucgcccgccugaucgaggacaacgaguacaccgcccgggagggggcgaaguuccccaucaaguggacggcccccgaggccaucaacuacggcaccuucaccaucaaguccgacguguggagcuucggcauccugcucaccgagaucgucacgcacgggcgcauccccuacccgggcaugaccaaccccgaggugauccagaaccuggagcggggguaccgcauggugcgccccgacaacugcccggaggagcuguaccagcucaugcggcugugcuggaaggagcgccccgaggaccggcccaccuucgacuaccugcgcuccguccuggaggacuucuucaccgccacggagggccaguaccagccccagccguga

SEQ ID NO: 32239 - RNA, 1131 nt, Artificial Sequence
  derived and/or modified sequence opt1 from LCLAT1__Homo_sapiens__NP_001291374
auggugagcuggaagggcaucuacuucauccugacccucuucuggggguccuucuucggcagcaucuucaugcugucccccuuccugccgcucauguucgucaaccccagcugguaccgcuggaucaacaaccggcugguggccaccuggcugacgcuccccguggcccugcuggagaccauguucggggucaaggugaucaucaccggcgacgcguucgugcccggggagcgcuccgucaucaucaugaaccaccggacccgcauggacuggauguuccucuggaacugccugaugcgguacagcuaccugcgccucgagaagaucugccugaaggccucccugaagggcgugccgggcuucgggugggccaugcaggccgccgcguacaucuucauccaccggaaguggaaggacgacaagagccacuucgaggacaugaucgacuacuucugcgacauccacgagccccuccagcugcugaucuuccccgagggcacggaccucaccgagaacuccaagagccgcuccaacgccuucgccgagaagaacgggcugcagaaguacgaguacgugcugcacccccggaccaccggcuucacguucgucguggaccgccuccgggaggggaagaaccuggacgccgugcacgacaucaccgucgcguacccgcacaacaucccccagagcgagaagcaccuccugcagggcgacuucccccgcgagauccacuuccacgugcaccgguaccccaucgacacccugccgaccuccaaggaggaccugcagcucuggugccacaagcgcugggaggagaaggaggagcggcugcgcagcuucuaccagggcgagaagaacuucuacuucacggggcaguccgugaucccgcccugcaagagcgagcugcggguccucguggugaagcugcuguccauccucuacuggacccuguucagccccgccaugugccugcucaucuaccuguacucccuggucaagugguacuucaucaucaccaucgugaucuucgugcuccaggagcgcaucuucggcgggcuggagaucaucgagcuggccugcuaccggcuccugcacaagcagccccaccugaacagcaagaagaacgaguga

SEQ ID NO: 32240 - RNA, 840 nt, Artificial Sequence
  derived and/or modified sequence opt1 from LCMT1__Homo_sapiens__NP_001027563
auggccacccgccagcgggagagcuccaucaccagcugcugcuccacgagcuccugcgacgccgacgacgagggcgugcgcgggaccugcgaggacgcgagccugugcaagcgguucgccgucuccaucggcuacuggcacgaccccuacauccagcacuucgugcgccucagcaaggagcggaaggccccggagaucaaccgcggguacuucgcccgggugcacggcgucucccagcugaucaaggccuuccugcgcaagaccgagugccacugccagaucgugaaccucggggcgggcauggacaccacguucuggcggcugaaggacgaggaccugcuccccagcaaguacuucgagguggacuuccccaugaucgucacccgcaagcugcacuccaucaagcugcccacccuccugaucgccgagugcgugcugguguacaugaccccggagcagagcgccaaccuccugaagugggccgcgaacuccuucgagcgggccauguucaucaacuacgagcaggucaacaugggcgaccgcuucgggcagaucaugaucgagaaccugcggcgccggcagugcgaccucgccggcguggagacgugcaagagccuggagucccagaaggagcgccugcucagcaacgggugggagaccgccuccgccguggacaugauggagcuguacaaccggcugccccgcgcggaggucagccggaucgagucccucgaguuccuggacgagauggagcugcucgagcagcugaugcgccacuacugccugugcugggccaccaagggcgggaacgagcucggccugaaggagaucaccuacuga

SEQ ID NO: 32241 - RNA, 531 nt, Artificial Sequence
  derived and/or modified sequence opt1 from LCN1__Homo_sapiens__NP_001239546
augaagccccugcuccuggccgugagccugggccucaucgccgcgcugcaggcccaccaccuccuggccuccgacgaggagauccaggacgucagcgggaccugguaccugaaggccaugaccguggaccgcgaguucccggagaugaaccuggaguccgugacgcccaugacccucaccacccuggagggcgggaaccuggaggccaaggucacgaugcucaucagcggccggugccaggaggugaaggcggugcuggagaagaccgacgagcccgggaaguacaccgccgacggcggcaagcacgucgccuacaucauccgcucccacgugaaggaccacuacaucuucuacugcgagggggagcugcacggcaagcccgugcgcggggucaagcucgugggccgggacccgaagaacaaccuggaggcccuggaggacuucgagaaggcggccggggcccggggccucagcaccgaguccauccugaucccccgccagagcgagacgugcucccccggcagcgacuga

SEQ ID NO: 32242 - RNA, 597 nt, Artificial Sequence
  derived and/or modified sequence opt1 from LCN2__Homo_sapiens__NP_005555
augccccugggccuccuguggcuggggcucgcccugcugggcgcccuccacgcgcaggcccaggacagcaccuccgaccugaucccggccccgccccugagcaaggugccccuccagcagaacuuccaggacaaccaguuccaggggaagugguacgucgugggccuggccgggaacgccauccugcgcgaggacaaggacccccagaagauguacgcgaccaucuacgagcucaaggaggacaaguccuacaacgugacgagcguccuguuccggaagaagaagugcgacuacuggauccgcaccuucgugcccggcugccagcccggcgaguucacccuggggaacaucaaguccuaccccggccucaccagcuaccuggugcgggucguguccacgaacuacaaccagcacgccaugguguucuucaagaaggucagccagaaccgcgaguacuucaagaucacccuguacgggcggaccaaggagcucaccuccgagcugaaggagaacuucauccgcuucagcaagucccugggccucccggagaaccacaucguguuccccgugcccaucgaccagugcaucgacggguga

SEQ ID NO: 32243 - RNA, 1221 nt, Artificial Sequence
  derived and/or modified sequence opt1 from LCOR__Homo_sapiens__NP_001164237
augcagcgcaugauccagcaguucgccgccgaguacaccagcaagaacuccagcacccaggaccccucccagccgaacagcacgaagaaccagucccugcccaaggcgagccccgugaccaccucccccaccgccgccacgacccagaacccgguccucagcaagcugcugauggccgaccaggacagcccccucgaccugaccgugcgcaagagccaguccgagcccagcgagcaggacggcgugcuggaccucuccaccaagaagucccccugcgccggguccacgagccugucccacagcccgggcugcuccagcacccaggggaacggccggcccgggcggcccagccaguaccgccccgacggccugcgguccggcgacggggucccgccccgcagccuccaggacggcacccgggagggguucggccacuccaccagccugaaggugccccuggcgcgcucccuccagaucagcgaggagcugcugucccggaaccagcucagcacggccgccucccuggggcccagcggccugcagaaccacggccagcaccucauccugucccgcgaggccagcugggcgaagccgcacuacgaguucaaccugucccggaugaaguuccgcgggaacggcgcccucagcaacaucuccgaccugcccuuccuggccgagaacagcgccuuccccaagauggcccuccaggcgaagcaggacgggaagaaggacgugucccacagcucccccgucgaccugaagaucccccaggugcggggcauggaccugagcugggagagccgcaccggcgaccaguacuccuacagcucccucgugauggggagccagaccgaguccgcccugagcaagaagcugcgggccauccucccgaagcagucccgcaagagcaugcuggacgccggccccgacuccugggggagcgacgccgagcaguccaccagcggccagcccuacccgacguccgaccaggagggggaccccggcagcaagcagccccggaagaagcgcggccgguaccgccaguacaacuccgagauccuggaggaggcgaucagcgucgugauguccgggaagaugagcgugagcaaggcccaguccaucuacggcaucccccacagcacccucgaguacaaggucaaggagcggcuggggacccugaagaacccgcccaagaagaagaugaagcucauguccggcuga

SEQ ID NO: 32244 - RNA, 1884 nt, Artificial Sequence
  derived and/or modified sequence opt1 from LCP1__Homo_sapiens__XP_005266431
auggcccgcggcagcguguccgacgaggagaugauggagcugcgggaggccuucgcgaaggucgacaccgacgggaacggcuacaucagcuucaacgagcucaacgaccuguucaaggccgccugccugccccucccgggguaccgcgugcgggagaucaccgagaaccugauggccacgggcgaccuggaccaggacgggcgcaucuccuucgacgaguucaucaagaucuuccacggccucaagagcaccgacguggccaagaccuuccggaaggcgaucaacaagaaggagggcaucugcgccaucgggggcaccuccgagcagagcuccgucgggacgcagcacagcuacuccgaggaggagaaguacgccuucgugaacuggaucaacaaggcccuggagaacgaccccgacugccgccacgugauccccaugaaccccaacaccaacgaccuguucaacgcggucggcgacgggaucgugcucugcaagaugaucaaccugagcgugccggacaccaucgacgagcggaccaucaacaagaagaagcugacgcccuucaccauccaggagaaccucaaccuggcccugaacuccgccagcgccaucggcugccacgucgugaacaucggcgccgaggaccucaaggaggggaagcccuaccuggugcugggccuccuguggcaggucaucaagaucgggcuguucgcggacaucgagcucucccgcaacgaggcccugaucgcccugcuccgggagggcgagagccuggaggaccugaugaagcucucccccgaggagcugcugcuccgcugggccaacuaccaccuggagaacgccggcugcaacaagaucgggaacuucagcaccgacaucaaggacuccaaggcguacuaccaccuccuggagcaggucgccccgaagggcgacgaggagggggugcccgccguggugaucgacaugagcggccugcgggagaaggacgacauccagcgcgccgagugcaugcugcagcaggccgagcggcucgggugccgccaguucgugaccgcgacggacgucgugcggggcaaccccaagcugaaccuggccuucaucgccaaccucuucaaccgcuaccccgcccugcacaagccggagaaccaggacaucgacuggggcgcccuggagggggagacccgggaggagcgcaccuuccggaacuggaugaacucccucggcgugaacccccgcgucaaccaccuguacagcgaccugagcgacgcgcucgugaucuuccagcuguacgagaagaucaaggugcccgucgacuggaaccgggugaacaagcccccguaccccaagcucgggggcaacaugaagaagcuggagaacugcaacuacgccgucgagcuggggaagaaccaggccaaguucucccuggugggcaucggcgggcaggaccugaacgagggcaaccgcacccucacgcuggcccugaucuggcagcucaugcgccgguacacccugaacauccuggaggagaucgggggcgggcagaaggugaacgacgacaucaucgucaacugggugaacgagacccuccgcgaggcgaagaaguccagcagcaucuccagcuucaaggaccccaagaucuccaccagccugcccgugcuggaccucaucgacgccauccagccgggcuccaucaacuacgaccugcugaagacggagaaccucaacgacgacgagaagcugaacaacgccaaguacgccaucagcauggcccggaagaucggcgcgcgcgucuacgcccugcccgaggaccucguggaggugaaccccaagauggucaugaccguguucgccugccugauggggaagggcaugaagcggguguga

SEQ ID NO: 32245 - RNA, 1602 nt, Artificial Sequence
  derived and/or modified sequence opt1 from LCP2__Homo_sapiens__NP_005556
auggcccugcgcaacgugcccuuccggagcgagguccucggcugggacccggacucccuggccgacuacuucaagaagcugaacuacaaggacugcgagaaggcggugaagaaguaccacaucgacggggcccgcuuccucaaccugaccgagaacgacauccagaaguuccccaagcugcgggugcccauccucagcaagcugucccaggagaucaacaagaacgaggagcgccggagcaucuucacccgcaagccccaggucccgcgguuccccgaggagacggagucccacgaggaggacaacggcggguggagcuccuucgaggaggacgacuacgagagccccaacgacgaccaggacggcgaggacgacggggacuacgagucccccaacgaggaggaggaggccccgguggaggacgacgccgacuacgagcccccccccagcaacgacgaggaggcccugcagaacuccauccucccggcgaagcccuuccccaacagcaacuccauguacaucgaccgccccccgagcggcaagaccccccagcagccccccgugccgccccagcggcccauggccgcccugcccccgccccccgccggccgcaaccacuccccccugccgcccccccagaccaaccacgaggagccgagccggucccgcaaccacaagaccgcgaagcuccccgcccccagcaucgaccgguccacgaagcccccgcuggaccgcagccuggcccccuucgaccgggagcccuucacccucgggaagaagcccccguucagcgacaagcccuccauccccgccggccgcagccugggggagcaccugcccaagauccagaagccgccccucccccccaccaccgagcggcacgagcgcuccagcccgcugcccggcaagaagccccccgucccgaagcacggguggggccccgaccggcgcgagaacgacgaggacgacgugcaccagcggccccugccccagccggcccuccugcccauguccagcaacacguuccccucccgcagcaccaagccgucccccaugaacccccugcccagcucccacaugccgggcgcguucagcgaguccaacagcuccuucccccagagcgccucccucccccccuacuucagccaggggccguccaaccgcccccccauccgggccgagggccgcaacuucccccugccgcugcccaacaagccccggcccccgagccccgccgaggaggagaacagccucaacgaggagugguacguguccuacaucacccgccccgaggccgaggcggcccugcggaagaucaaccaggacgggaccuuccugguccgcgacagcuccaagaagacgaccaccaaccccuacgugcucauggugcuguacaaggacaaggucuacaacauccagauccgguaccagaaggagagccagguguaccugcucggcaccggccugcgcgggaaggaggacuuccuguccgugagcgacaucaucgacuacuuccggaagaugccgcuccugcugaucgacggcaagaaccgcgggucccgguaccagugcacgcucacccacgccgccggcuaccccuga

SEQ ID NO: 32246 - RNA, 5784 nt, Artificial Sequence
  derived and/or modified sequence opt1 from LCT__Homo_sapiens__NP_002290
auggagcugagcuggcacguggucuucaucgcccuccugagcuucagcugcuggggcuccgacugggagagcgaccgcaacuucaucuccaccgccgggccccugaccaacgaccuccugcacaaccugagcggccuccugggggaccaguccagcaacuucguggcgggcgacaaggacauguacgugugccaccagccccugcccaccuuccuccccgaguacuucuccagccugcacgccucccagaucacccacuacaaggucuuccugagcugggcccagcuccugcccgccggguccacccagaaccccgacgagaagaccgugcagugcuaccggcgccugcucaaggcccugaagaccgcgcggcugcagcccauggugauccuccaccaccagacccugcccgccagcacccugcgccggaccgaggccuucgccgaccucuucgcggacuacgccacguucgccuuccacuccuucggcgaccuggucggcaucugguucaccuucagcgaccuggaggaggugaucaaggagcucccccaccaggagucccgcgccagccagcugcagacccuguccgacgcccaccggaaggcguacgagaucuaccacgagagcuacgccuuccagggcgggaagcucagcgugguccugcgcgccgaggacaucccggagcugcuccuggagccgcccaucuccgcccuggcccaggacaccguggacuuccucagccuggaccuguccuacgagugccagaacgaggcgagccuccggcagaagcuguccaagcugcagacgaucgagcccaaggugaaggucuucaucuucaaccucaagcugccggacugccccagcaccaugaagaaccccgccucccuccuguucagccuguucgaggccaucaacaaggaccaggugcugaccaucggguucgacaucaacgaguuccucuccugcagcuccagcuccaagaaguccauguccugcagccugaccggcucccuggcccuccagcccgaccagcagcaggaccacgagacgaccgacagcuccccggccagcgcguaccagcgcaucugggaggccuucgccaaccagagccgggccgagcgcgacgccuuccugcaggacaccuuccccgagggguuccuguggggcgcguccaccggcgccuucaacguggagggcgggugggccgagggcgggcggggcgucagcaucugggacccccgccggccccugaacacgaccgaggggcaggccacccucgagguggcguccgacagcuaccacaagguggccuccgacgucgcccugcugugcggccuccgcgcccagguguacaaguucagcaucuccuggagccggaucuucccgauggggcacggcuccagccccucccugcccgggguggccuacuacaacaagcugaucgaccgccuccaggacgcgggcaucgagcccauggccacccuguuccacugggaccugccgcaggcccuccaggaccacggcggguggcagaacgagagcgucguggacgccuuccuggacuacgccgcguucugcuucuccacguucggcgaccgggugaagcugugggucaccuuccacgagcccugggugaugagcuacgccggguacggcaccgggcagcacccgcccggcaucuccgacccgggcgucgccagcuucaagguggcccaccucgugcugaaggcccacgcgcgcaccuggcaccacuacaacucccaccaccggccccagcagcaggggcacgucggcaucgugcugaacagcgacugggccgagccccucagcccggagcgccccgaggaccugcgcgccuccgagcgguuccugcacuucaugcucgggugguucgcccaccccguguucgucgacggcgacuaccccgcgacgcugcgcacccagauccagcagaugaaccggcagugcagccacccgguggcccagcugcccgaguucaccgaggccgagaagcagcuccugaagggguccgccgacuuccugggccucagccacuacaccucccgccugaucagcaacgcgccccagaacacgugcauccccuccuacgacaccaucggcggguucagccagcacgugaaccacgucuggccgcagaccuccagcuccuggauccggguggugcccuggggcauccgccggcugcuccaguucgucagccuggaguacacccgcgggaaggugcccaucuaccuggccggcaacggcaugcccaucggggaguccgagaaccucuucgacgacagccugcggguggacuacuucaaccaguacaucaacgagguccugaaggccaucaaggaggacuccguggacgugcgcagcuacaucgcccggucccucaucgacggcuucgaggggccgagcggcuacucccagcgcuucgggcugcaccacgucaacuucagcgacagcuccaagagccggacgccccgcaaguccgccuacuucuucaccagcaucaucgagaagaacggcuuccugaccaagggcgccaagcggcuccugccgcccaacaccgugaaccugccguccaaggugcgcgcguucaccuuccccagcgagguccccuccaaggccaagguggugugggagaaguucagcucccagcccaaguucgagcgggaccucuucuaccacgggacguuccgcgacgacuuccuguggggcgucagcuccagcgccuaccagaucgagggggccugggacgccgacggcaaggggccguccaucugggacaacuucacccacacccccggcagcaacgugaaggacaacgcgaccggcgacaucgccugcgacuccuaccaccagcuggacgccgaccucaacaugcugcgggcccugaaggugaaggcguaccgcuucagcaucuccuggagccgcaucuuccccacggggcggaacuccagcaucaacagccacggcgucgacuacuacaaccgccucaucaacgggcugguggccuccaacaucuuccccauggugacccuguuccacugggaccucccgcaggcccugcaggacaucggcgggugggagaaccccgcccugaucgaccucuucgacagcuacgccgacuucugcuuccagaccuucggcgaccgggucaaguucuggaugaccuucaacgagcccauguaccuggcguggcugggcuacggguccggcgaguucccgcccggggugaaggaccccggcugggcccccuaccgcaucgcccacgccgugaucaaggcccacgcgcgggucuaccacacguacgacgagaaguaccgccaggagcagaagggggugaucagccucucccugagcacccacugggccgagccgaagucccccggcgugccccgggacgucgaggccgccgaccgcaugcugcaguucagccucggcugguucgcccaccccaucuuccggaacggggacuacccggacaccaugaaguggaaggugggcaaccgcuccgagcugcagcaccuggcgaccagccggcuccccuccuucacggaggaggagaagcgcuucauccgggccaccgccgacguguucugccugaacaccuacuacagccgcaucguccagcacaagacgccccggcugaacccgcccuccuacgaggacgaccaggagauggccgaggaggaggaccccagcuggcccuccacggccaugaaccgcgcggcccccugggggacccggcgccuccugaacuggaucaaggaggaguacggcgacauccccaucuacaucaccgagaacggcguggggcugaccaaccccaacacggaggacaccgaccggaucuucuaccacaagaccuacaucaacgaggcccucaaggccuaccgccuggacggcaucgaccugcggggguacguggcguggagccucauggacaacuucgaguggcugaacggcuacaccgucaaguucgggcuguaccacguggacuucaacaacacgaaccgcccccgcaccgcccgggccuccgcccgcuacuacaccgaggugaucaccaacaacggcaugccccucgcccgggaggacgaguuccuguacggccgcuucccggagggguucaucuggagcgcggccuccgccgccuaccagaucgagggcgccuggcgggcggacgggaagggccugagcaucugggacacguucagccacacgccccuccgcgucgagaacgacgccaucggggacguggccugcgacuccuaccacaagaucgccgaggaccuggugacccugcagaaccucggcgucagccacuaccgguucuccaucagcuggucccgcauccugcccgacggcaccacgcgguacaucaacgaggccgggcugaacuacuacgugcgccucaucgacacccugcuggcggccagcauccagccccaggugaccaucuaccacugggaccucccgcagacccugcaggacgucggcgggugggagaacgagacgaucgugcagcgguucaaggaguacgccgacguccuguuccagcgccucggcgacaaggugaaguucuggaucacccugaacgagcccuucgugaucgccuaccagggguacggcuacggcaccgcggcccccggggucuccaaccggcccggcaccgccccguacaucguggggcacaaccugaucaaggcccacgccgaggcguggcaccucuacaacgacguguaccgcgccagccagggcggcgucaucuccaucaccaucagcuccgacugggccgagccccgggaccccagcaaccaggaggacguggaggccgcccgccgguacgugcaguucaugggcgggugguucgcgcacccgaucuucaagaacggggacuacaacgaggucaugaagacgcgcauccgggaccgcucccuggccgccggccugaacaagagccgccuccccgaguucaccgaguccgagaagcggcgcaucaacgggaccuacgacuucuucggcuucaaccacuacaccacggugcuggccuacaaccugaacuacgccaccgcgaucagcuccuucgacgccgaccggggcguggccagcaucgccgaccgcuccuggcccgacagcgggagcuucuggcugaagaugacccccuucggcuuccggcgcauccucaacuggcugaaggaggaguacaacgacccgcccaucuacgucaccgagaacggggugucccagcgggaggagacggaccugaacgacaccgcgcgcaucuacuaccuccggaccuacaucaacgaggcccugaaggccgugcaggacaaggucgaccugcgcggcuacaccguguggagcgccauggacaacuucgagugggccacgggguucuccgagcgguucggccuccacuucgugaacuacagcgaccccucccugccccgcaucccgaaggcgagcgccaaguucuacgccuccgucgugcggugcaacggcuuccccgaccccgccaccgggccccacgccugccugcaccagccggacgcgggccccaccaucagccccgugcgccaggaggagguccaguuccucgggcugaugcugggcaccacggaggcccagaccgcccucuacgugcuguucucccuggugcuccugggggucugcggccuggccuuccucagcuacaaguacugcaagcgguccaagcagggcaagacccagcgcagccagcaggagcugucccccgugagcuccuucuga

SEQ ID NO: 32247 - RNA, 1236 nt, Artificial Sequence
  derived and/or modified sequence opt1 from LDB1__Homo_sapiens__NP_001106878
augagcgugggcugcgccugccccgggugcuccagcaaguccuucaagcuguacagcccgaaggagccgcccaacggcaacgccuucccgcccuuccaccccgggaccaugcucgaccgcgacgucggccccacccccauguacccgcccacguaccuggagcccgggaucggccggcacacccccuacggcaaccagaccgacuaccgcaucuucgagcugaacaagcggcuccagaacuggaccgaggagugcgacaaccuguggugggacgcguucacgaccgaguucuucgaggacgacgccaugcugaccaucaccuucugccucgaggacgggcccaagcgcuacacgaucggccggacccugaucccccgcuacuuccgguccaucuucgagggcggggccaccgagcuguacuacgugcucaagcaccccaaggaggccuuccacagcaacuucgugucccuggacugcgaccaggggagcauggucacccagcacggcaagcccauguucacccaggugugcguggagggccgccuguaccucgaguucauguucgacgacaugaugcggaucaagacguggcacuucuccauccgccagcaccgggagcugaucccgcgcagcauccuggccaugcacgcgcaggacccccagaugcucgaccagcuguccaagaacaucacccggugcgggcugagcaacuccacccucaacuaccugcgccugugcgucauccucgagcccaugcaggagcugaugagccggcacaagacguacucccugagcccccgcgacugccucaagaccugccuguuccagaaguggcagcggaugguggccccgcccgccgagcccacccgccagcagcccuccaagcggcgcaagcggaagaugagcggcggguccaccaugagcagcggcggcgggaacacgaacaacuccaacagcaagaagaaguccccggccagcaccuucgcgcuguccagccaggugcccgacgucaugguggugggcgagcccacccucaugggcggggaguucggggacgaggacgagcgccugaucacccgccuggagaacacgcaguucgacgccgccaacggcaucgacgacgaggacuccuucaacaacagccccgcccucggcgccaacuccccguggaacagcaagccgcccuccagccaggaguccaagagcgagaaccccaccucccaggcgagccaguga

SEQ ID NO: 32248 - RNA, 996 nt, Artificial Sequence
  derived and/or modified sequence opt1 from LDB2__Homo_sapiens__NP_001124306
augagcuccacgccccacgacccguucuacagcucccccuucggccccuucuaccgccggcacacccccuacauggugcagccggaguaccgcaucuacgagaugaacaagcggcugcagagccgcaccgaggacuccgacaaccucuggugggacgccuucgccaccgaguucuucgaggacgacgcgacccugacccugagcuucugccucgaggacgggcccaagcgguacacgaucggccgcacccugaucccccgguacuucuccaccgucuucgagggcggggugaccgaccuguacuacauccucaagcacagcaaggaguccuaccacaacagcuccaucacgguggacugcgaccagugcaccauggucacccagcacgggaagcccauguucaccaaggugugcacggagggccgccugauccuggaguucaccuucgacgaccucaugcggaucaagaccuggcacuucaccauccgccaguaccgggagcuggugccgcgcagcauccuggccaugcacgcccaggacccccagguccucgaccagcuguccaagaacaucacgcggaugggccugaccaacuucacccucaacuaccugcgccugugcgugauccucgagcccaugcaggagcugaugagccggcacaagaccuacaaccugagcccccgcgacugccucaagacgugccuguuccagaaguggcagcggaugguggccccgcccgccgagcccacccgccagcccaccaccaagcggcgcaagcggaagaacuccacguccagcaccuccaacagcagcgcggggaacaacgccaacuccaccggcagcaagaagaagaccacggccgccaaccugucccucagcucccaggucccggggcugggcgcgauccccaacugcagccugaaccccgggcgcgacggcgaccucugccacuccaccgccgugacccccagcggccaguucaaggagaagcacuga

SEQ ID NO: 32249 - RNA, 1854 nt, Artificial Sequence
  derived and/or modified sequence opt1 from LDB3__Homo_sapiens__NP_001073583
augagcuacuccgugacccugaccggccccgggccguggggcuuccgccuccagggcgggaaggacuucaacaugccccugaccaucagccggaucacccccggguccaaggccgcccagagccagcugucccagggcgaccucgucguggcgaucgacggcgugaacaccgacaccaugacgcaccuggaggcccagaacaagaucaagagcgccuccuacaaccugagccucacccugcagaaguccaagcgccccaucccgaucagcaccaccgccccgcccguccagacgccccugcccgugaucccccaccagaagguggucgugaacucccccgccaacgcggacuaccaggagcgguucaaccccagcgcccucaaggacuccgcccugagcacccacaagccgaucgaggugaaggggcugggcgggaaggccaccaucauccacgcgcaguacaacacccccaucuccauguacagccaggacgccaucauggacgccaucgccggccaggcccaggcgcagggguccgacuucagcggcucccuccccaucaaggaccuggccgucgacagcgccagccccguguaccaggccgugaucaagucccagaacaagccggaggacgaggccgacgagugggcgcgccggagcuccaaccugcagagccgcuccuuccggauccucgcccagaugacgggcaccgaguucaugcaggaccccgacgaggaggcccugcgccggagccgcccccaggccuccagcuacucccccgccgucgcggccagcuccgccccggccacccacaccagcuacuccgaggggcccgccgcgcccgcccccaagccgcggguggugacgaccgccagcauccgccccuccgucuaccagcccgugcccgccagcaccuacuccccgagccccggcgcgaacuacucccccaccccguacacgcccagccccgcccccgccuacaccccgagccccgcccccgccuacacccccuccccggugcccaccuacacgcccagccccgcgccggccuacacccccucccccgcccccaacuacaacccggcccccagcgucgccuacuccgggggccccgcggagcccgccagccggccgcccugggugaccgacgacuccuucagccagaaguucgcccccggcaaguccaccacgagcaucuccaagcagacccugccccgcgggggcccggccuacacccccgccgggccccaggugccgccccucgcgcggggcaccguccagcgcgccgagcgguuccccgccagcucccgcacgccccugugcgggcacugcaacaacgugauccggggcccguuccugguggccaugggccgcagcuggcaccccgaggaguucacgugcgcguacugcaagaccucccucgccgacgucugcuucguggaggagcagaacaacgucuacugcgagcggugcuacgagcaguucuucgcgccccugugcgccaagugcaacaccaagaucaugggggaggugaugcacgcccugcgccagaccuggcacacgaccugcuucgugugcgccgccugcaagaagcccuucggcaacagccucuuccacauggaggacggggagccguacugcgagaaggacuacaucaaccuguucuccaccaagugccacggcugcgacuuccccgucgaggccggggacaaguucaucgaggcccugggccacaccuggcacgacacgugcuucaucugcgccgugugccacgugaaccucgagggccagcccuucuacagcaagaaggaccgcccccugugcaagaagcacgcgcacaccaucaaccuguga

SEQ ID NO: 32250 - RNA, 825 nt, Artificial Sequence
  derived and/or modified sequence opt1 from LDHA__Homo_sapiens__NP_001128711
auggccacccugaaggaccagcucaucuacaaccugcugaaggaggagcagacgccccagaacaagaucaccguggucggcgugggggccgugggcauggcgugcgccaucagcauccucaugaaggaccuggccgacgagcuggcccucgucgacgugaucgaggacaagcugaagggggagaugauggaccugcagcacggcucccucuuccugcgcaccccgaagaucgugagcgggaaggucgacauccugaccuacguggccuggaagaucuccggcuuccccaagaaccgggugaucggcagcgggugcaaccucgacuccgcgcgcuuccgguaccugaugggcgagcgccuggggguccacccccucagcugccacggcugggugcugggggagcacggcgacuccagcgugcccgucugguccggcaugaacguggccggggugagccugaagacccuccacccggaccugggcacggacaaggacaaggagcaguggaaggagguccacaagcaggucguggaguccgccuacgaggugaucaagcugaagggguacaccagcugggccaucggccucuccguggcggaccuggccgagagcaucaugaagaaccugcggcgcgugcaccccgucuccaccaugaucaagggccucuacgggaucaaggacgacguguuccugagcgugcccugcauccugggccagaacgggaucuccgaccucgucaaggugacccugacgagcgaggaggaggcccggcugaagaaguccgccgacacccucuggggcauccagaaggagcugcaguucuga

SEQ ID NO: 32251 - RNA, 1146 nt, Artificial Sequence
  derived and/or modified sequence opt1 from LDHAL6B__Homo_sapiens__NP_149972
augagcuggaccgugcccgucgugcgcgccucccagcgggugagcuccgucggcgccaacuuccugugccucgggauggcgcugugcccgcgccaggccacccggaucccccugaacggcacguggcuguucacccccgugagcaagauggccaccgugaaguccgagcucaucgagcgcuucaccagcgagaagcccguccaccacuccaaggugagcaucaucgggacgggcuccguggggauggccugcgccaucagcauccugcucaagggccuguccgacgagcuggcgcucgucgaccuggacgaggacaagcugaagggcgagaccauggaccuccagcacgggagcccguucaccaagaugcccaacaucgugugcuccaaggacuacuucgugaccgccaacagcaaccuggucaucaucacggccggcgcccggcaggagaagggggagacccgccugaaccucgugcagcggaacguggcgaucuucaagcugaugaucuccagcaucguccaguacagcccccacugcaagcugaucaucguguccaaccccguggacauccucaccuacgucgccuggaagcuguccgccuucccgaagaaccgcaucaucggcagcgggugcaaccuggacaccgcccgguuccgcuuccucaucggccagaagcugggcauccacagcgaguccugccacggguggauccugggcgagcacggggacagcuccgugcccguguggagcggcgucaacaucgccggcgugccccucaaggaccugaacuccgacaucgggacggacaaggaccccgagcaguggaagaacgugcacaaggaggucaccgcgaccgccuacgagaucaucaagaugaagggcuacaccagcugggccaucgggcuguccguggccgaccucacggagagcauccugaagaaccugcggcgcauccacccggucuccaccaucaucaagggccucuacgggaucgacgaggagguguuccugagcauccccugcauccugggcgagaacggcaucaccaaccucaucaagaucaagcugacccccgaggaggaggcccaccugaagaaguccgcgaagacgcucugggagauccagaacaagcugaagcuguga

SEQ ID NO: 32252 - RNA, 1005 nt, Artificial Sequence
  derived and/or modified sequence opt1 from LDHB__Homo_sapiens__NP_002291
auggccacccugaaggagaagcucaucgcccccguggcggaggaggaggccaccgucccgaacaacaagaucacgguggugggcgucggccagguggggauggccugcgccaucagcauccugggcaagagccuggccgacgagcucgcgcugguggacguccuggaggacaagcucaagggggagaugauggaccugcagcacgggagccuguuccuccagacccccaagaucguggccgacaaggacuacuccgugaccgccaacagcaagaucgucguggugaccgccggcguccgccagcaggagggcgagucccggcugaaccuggugcagcgcaacgugaacgucuucaaguucaucaucccccagaucgugaaguacagccccgacugcaucaucaucguggucuccaacccgguggacauccucacguacgugaccuggaagcugagcgggcugcccaagcaccgggucaucggcuccgggugcaaccucgacagcgcgcgcuuccgguaccugauggccgagaagcugggcauccaccccuccagcugccacggguggauccucggcgagcacggcgacuccagcguggccgugugguccggggucaacguggccggcgucagccugcaggagcugaaccccgagauggggaccgacaacgacuccgagaacuggaaggaggugcacaagaugguggucgagagcgccuacgaggugaucaagcucaagggcuacaccaacugggcgaucggccuguccguggccgaccugaucgagagcaugcucaagaaccugagccgcauccacccggucuccacgauggugaaggggauguacggcaucgagaacgagguguuccugagccuccccugcauccugaacgcccgggggcugaccuccgucaucaaccagaagcucaaggacgacgagguggcccagcugaagaaguccgccgacacccugugggacauccagaaggaccucaaggaccuguga

SEQ ID NO: 32253 - RNA, 999 nt, Artificial Sequence
  derived and/or modified sequence opt1 from LDHC__Homo_sapiens__NP_059144
augagcaccgugaaggagcagcugaucgagaagcucaucgaggacgacgagaacagccagugcaagaucaccaucgucggcacgggggccgugggcauggccugcgcgaucagcauccugcugaaggaccucgccgacgagcuggcccugguggacgucgcccucgacaagcugaagggggagaugauggaccugcagcacggcucccucuucuucagcaccuccaagaucaccagcgggaaggacuacuccgugagcgccaacucccgcaucgugaucgucaccgcgggcgcccggcagcaggagggcgagacgcgccuggcccuggugcagcggaacguggccaucaugaaguccaucauccccgcgaucguccacuacagcccggacugcaagauccucguggugagcaaccccgucgacauccugaccuacaucguguggaagaucuccgggcugcccgugacccgcgucaucggcagcgggugcaaccucgacuccgcccgguuccgcuaccugaucggcgagaagcugggggugcaccccaccagcugccacggcuggaucaucggcgagcacggggacuccagcgugccgcucugguccggcgucaacguggccgggguggcccugaagacgcuggaccccaagcucggcaccgacagcgacaaggagcacuggaagaacauccacaagcaggucauccagagcgccuacgagaucaucaagcugaagggcuacaccuccugggcgaucgggcugagcgugauggaccucgugggcuccauccugaagaaccugcggcgcguccaccccgugagcaccauggucaaggggcucuacggcaucaaggaggagcuguuccuguccauccccugcgugcucgggcggaacggcgugagcgacgucgugaagaucaaccugaacuccgaggaggaggcccuguucaagaaguccgccgagacgcucuggaacauccagaaggaccugaucuucuga

SEQ ID NO: 32254 - RNA, 1524 nt, Artificial Sequence
  derived and/or modified sequence opt1 from LDHD__Homo_sapiens__NP_705690
auggcccgccugcuccggagcgccaccugggagcuguuccccuggcgcggcuacugcucccagaaggcgaagggggagcugugccgggacuucguggaggcccucaaggccgucgugggcgggagccacguguccaccgccgccgucgugcgcgagcagcacggccgggacgagagcgugcaccgcugcgagccgcccgacgcggucguguggccccagaacguggagcaggucucccggcuggccgcccugugcuaccgccagggggugcccaucaucccguucggcacgggcaccgggcucgagggcggggugugcgccguccagggcggggugugcgugaaccugacccacauggaccggauccuggagcucaaccaggaggacuucagcgucgugguggagcccggcgucacccgcaaggcgcugaacgcccaccuccgggacuccggccugugguuccccguggaccccggggccgacgccagccugugcggcauggccgcgacgggggccuccggcaccaacgccgugcgcuacggcaccaugcgggacaacguccugaaccucgagguggugcugccggacgggcgccugcuccacaccgccggccgggggcgccacuuccgguucggcuucuggcccgagaucccccaccacacggccugguacagccccugcgucucccuggggcgccgcaagagcgcggccggcuacaaccugaccggccucuucgugggguccgagggcacccuggggcugaucaccgccacgacccuccggcugcacccggcccccgaggccaccgucgcggcgaccugcgccuuccccagcgugcaggccgccguggacuccacgguccacauccugcaggccgccgugcccguggcccggaucgaguuccucgacgaggucaugauggacgccugcaaccgcuacagcaagcugaacugccugguggcgccgacccucuuccuggaguuccacggcucccagcaggcccuggaggagcagcuccagcgcaccgaggagaucgugcagcagaacggggccagcgacuucuccugggccaaggaggccgaggagcggagccgccuguggaccgcgcggcacaacgccugguacgccgcccuggccacgcgccccggcugcaagggcuacagcaccgacgucugcgugcccaucucccggcuccccgagaucgugguccagaccaaggaggaccugaacgcgagcgggcugaccggcuccaucguggggcacgugggcgacgggaacuuccacugcauccuccuggucaacccggacgacgccgaggagcugggccgcgugaaggccuucgccgagcagcucggccggcgcgcccuggcgcugcacgggacgugcaccggcgagcacgggaucggcaugggcaagcggcagcuccugcaggaggaggugggggccgucggcguggagaccaugcgccagcugaaggccgugcucgacccccaggggcugaugaaccccggcaagguccuguga

SEQ ID NO: 32255 - RNA, 1038 nt, Artificial Sequence
  derived and/or modified sequence opt1 from LDLRAD3__Homo_sapiens__NP_777562
auguggcugcucggcccccugugccugcuccugagcuccgccgccgagagccagcugcuccccgggaacaacuucaccaacgagugcaacauccccggcaacuucaugugcuccaacgggcgcugcauccccggcgcguggcagugcgacgggcugcccgacugcuucgacaagagcgacgagaaggagugcccgaaggccaaguccaagugcggccccaccuucuuccccugcgccagcggcauccacugcaucaucgggcgguuccgcugcaacggcuucgaggacugccccgacggguccgacgaggagaacugcacggccaacccgcugcucugcagcaccgcccgguaccacugcaagaacggccugugcaucgacaaguccuucaucugcgacgggcagaacaacugccaggacaacagcgacgaggaguccugcgagagcucccaggagcccggcagcggccagguguucgucaccuccgagaaccagcugguguacuaccccagcaucaccuacgcgaucaucggguccagcgugaucuucguccucgugguggcccugcuggcccucguccugcaccaccagcgcaagcggaacaaccugaugacgcuccccgugcaccgccugcagcacccggugcugcucucccggcuggucgugcuggaccacccccaccacugcaacgugaccuacaacgucaacaacggcauccaguacguggccagccaggcggagcagaacgccagcgaggugggguccccgcccagcuacuccgaggcccuccuggaccagcgccccgccugguacgaccugcccccgccgcccuacagcuccgacaccgagagccucaaccaggccgaccugccgcccuaccggucccgcagcggcuccgcgaacagcgccuccagccaggccgccuccagccugcucuccgucgaggacaccagccacucccccggccagcccgggccccaggagggcacggccgagccccgggacagcgagcccucccaggggaccgaggagguguga

SEQ ID NO: 32256 - RNA, 810 nt, Artificial Sequence
  derived and/or modified sequence opt1 from LDLRAD4__Homo_sapiens__NP_001003674
augagcuccgaccaccugaacaacagcacccucaaggaggcccaguucaaggaccuguuccugaagaaggccgagcucgaguucgcgcagaucaucaucaucguggucguggugaccgucauggugguggucaucgugugccugcugaaccacuacaagguguccacgcgcagcuucaucaaccggcccaaccagucccgccggcgcgaggacggccucccccaggaggggugccuguggcccagcgacuccgccgcgccccggcugggcgccagcgagaucaugcacgcgccccgcucccgggaccgcuucaccgccccgagcuucauccagcgggaccgcuucucccgguuccagcccaccuaccccuacguccagcacgagaucgaccugcccccgaccaucagccucuccgacggggaggagcccccgcccuaccagggccccugcacgcugcagcuccgcgaccccgagcagcagauggagcugaaccgggagagcgugcgcgccccgcccaaccggaccaucuucgacuccgaccugaucgacaucgccauguacagcgggggccccugcccgcccuccagcaacuccggcaucagcgccagcacgugcuccagcaacgggcgcauggagggcccgccgcccaccuacuccgaggugauggggcaccaccccggcgccagcuuccuccaccaccagcgguccaacgcccaccgcgggagccggcugcaguuccagcagaacaacgccgaguccaccaucguccccaucaagggcaaggaccgcaagcccggcaaccugguguga

SEQ ID NO: 32257 - RNA, 2583 nt, Artificial Sequence
  derived and/or modified sequence opt1 from LDLR__Homo_sapiens__NP_000518
augggccccuggggguggaagcugcgcuggaccguggcccuccugcuggccgcggccggcaccgccgucggggaccggugcgagcgcaacgaguuccagugccaggacggcaagugcaucagcuacaagugggugugcgacggguccgccgagugccaggacggcagcgacgagucccaggagacgugccucagcgugaccugcaaguccggcgacuucagcugcgggggccgggucaaccgcugcaucccgcaguucuggcggugcgacggccagguggacugcgacaacggguccgacgagcaggggugcccgcccaagaccugcagccaggacgaguuccgcugccacgacggcaagugcaucucccggcaguucgugugcgacagcgaccgcgacugccuggacggcuccgacgaggccagcugccccguccugaccugcgggcccgcguccuuccagugcaacagcuccacgugcaucccccagcucugggccugcgacaacgaccccgacugcgaggacggcagcgacgaguggccccagcggugccgcgggcuguacguguuccagggcgacuccagcccgugcuccgccuucgaguuccacugccugagcggcgagugcauccacagcuccuggcggugcgacgggggccccgacugcaaggacaagagcgacgaggagaacugcgccguggcgaccugccgccccgacgaguuccagugcuccgacgggaacugcauccacggcagccggcagugcgaccgcgaguacgacugcaaggacauguccgacgaggucgggugcgugaacgugacccucugcgagggccccaacaaguucaagugccacagcggcgagugcaucacccuggacaaggucugcaacauggcccgggacugccgcgacugguccgacgagccgaucaaggagugcgggacgaacgagugccuggacaacaacggcgggugcagccacgugugcaacgaccucaagaucggcuacgagugccugugccccgacggguuccagcugguggcccagcggcgcugcgaggacaucgacgagugccaggaccccgacacgugcucccagcucugcgucaaccuggagggcggcuacaagugccagugcgaggagggguuccagcuggacccccacaccaaggccugcaaggccgugggcagcaucgcguaccucuucuucaccaaccggcacgaggugcgcaagaugacgcuggaccgguccgaguacaccagccugaucccgaaccuccgcaacgucguggcccuggacaccgagguggccuccaaccgcaucuacuggagcgaccugucccagcggaugaucugcagcacccagcucgaccgcgcccacggggucuccagcuacgacacggugaucucccgggacauccaggcccccgacggccuggcgguggacuggauccacagcaacaucuacuggaccgacagcguccuggggaccguguccgucgccgacaccaagggcgugaagcgcaagacccucuuccgggagaacggcagcaagccccgcgccaucguggucgaccccgugcacggguucauguacuggaccgacuggggcaccccggccaagaucaagaagggcgggcugaacggcguggacaucuacucccuggucaccgagaacauccaguggcccaacgggaucacgcucgaccugcugagcggccggcucuacuggguggacuccaagcugcacagcaucuccagcaucgacgugaacgggggcaaccgcaagaccauccuggaggacgagaagcggcucgcccaccccuucucccuggcggucuucgaggacaagguguucuggaccgacaucaucaacgaggccaucuucagcgccaaccgccugaccggguccgacgugaaccuccuggccgagaaccugcucagccccgaggacaugguccuguuccacaaccugacgcagccgcggggcgugaacuggugcgagcgcaccacccucuccaacggcgggugccaguaccugugccugcccgcgccccagaucaacccccacagcccgaaguucacgugcgccugccccgacggcaugcuccuggcccgggacaugcgcuccugccugaccgaggccgaggccgcgguggccacccaggagaccagcaccguccggcugaagguguccagcacggccgugcgcacccagcacaccaccacccggcccgucccggacacgagccgccuccccggggccacccccggccugaccaccguggagaucgugacgaugucccaccaggcccugggggacgucgcgggccggggcaacgagaagaagcccagcuccgugcgcgcccucagcaucgugcugccgaucguccugcucguguuccugugccuggggguguuccuccuguggaagaacuggcgccugaagaacaucaacuccaucaacuucgacaaccccgucuaccagaagaccaccgaggacgaggugcacaucugccacaaccaggacggcuacagcuaccccucccggcagauggugagccucgaggacgacgucgccuga

SEQ ID NO: 32258 - RNA, 441 nt, Artificial Sequence
  derived and/or modified sequence opt1 from LDOC1__Homo_sapiens__NP_036449
augguggacgagcugguccuccugcugcacgcccuccugaugcgccaccgggcccugagcaucgagaacucccagcucauggagcagcugcgccugcucgugugcgagcgggcgagccugcugcgccaggugcggcccccguccugccccguccccuuccccgagaccuucaacggcgagagcucccgccucccggaguucaucgugcagaccgccagcuacaugcuggugaacgagaaccgguucugcaacgacgccaugaaggucgccuuccugaucucccuccugacgggggaggccgaggaguggguggugcccuacaucgagauggacagccccauccugggcgacuaccgcgcguuccucgacgagaugaagcagugcuucgggugggacgacgacgaggacgacgacgacgaggaggaggaggacgacuacuga

SEQ ID NO: 32259 - RNA, 720 nt, Artificial Sequence
  derived and/or modified sequence opt1 from LDOC1L__Homo_sapiens__NP_115663
auggugcagccccagaccagcaaggccgaguccccggcccuggcggccagccccaacgcccagauggacgacgucaucgacacccucacgucccugcgccugaccaacagcgcccuccggcgcgaggccuccacccugcgggcggagaaggccaaccugaccaacaugcucgagagcgugauggccgagcugacgcugcuccgcacccgggcccgcauccccggcgcgcugcagaucacgcccccgaucuccagcaucaccuccaacgggacccggcccaugaccaccccgcccaccagccugcccgagcccuucuccggcgaccccgggcgccucgccggcuuccugaugcagauggaccgguucaugaucuuccaggccagccgcuuccccggggaggccgagcggguggccuuccuggucucccgccucacgggcgaggcggagaagugggccaucccgcacaugcagcccgacagcccccugcggaacaacuaccagggcuuccuggccgagcuccgccggaccuacaagagcccccugcgccacgcccggcgcgcccagauccggaagaccuccgcguccaaccgcgccgugcgggagcgccagaugcugugccgccagcucgccagcgccgggaccggcccgugccccgugcaccccgccuccaacgggacgagccccgcgccggcccugcccgcccgggcccgcaaccuguga

SEQ ID NO: 32260 - RNA, 234 nt, Artificial Sequence
  derived and/or modified sequence opt1 from LEAP2__Homo_sapiens__NP_443203
auguggcaccugaagcucugcgccgugcugaugaucuuccugcuccugcugggccagaucgacgggagccccaucccggaggucuccagcgccaagcgccggccccgccggaugacccccuucuggcgcggcgugucccuccggcccaucggggcgagcugccgcgacgacuccgagugcaucacccggcugugccgcaagcggcgcugcagccuguccguggcccaggaguga

SEQ ID NO: 32261 - RNA, 1002 nt, Artificial Sequence
  derived and/or modified sequence opt1 from LECT1__Homo_sapiens__NP_001011705
augaccgagaacagcgacaaggugcccaucgcccuggucggcccggacgacguggaguucugcuccccgcccgccuacgcgacccucacggugaagcccagcucccccgcccgccugcugaaggucggggccguggugcucaucagcggcgccguccugcuccuguucggggccaucggcgcguucuacuucuggaagggguccgacagccacaucuacaacgugcacuacaccauguccaucaacggcaagcugcaggacggcagcauggagaucgacgccgggaacaaccuggagaccuucaagaugggcuccggggccgaggaggccaucgcggugaacgacuuccagaacggcaucaccgggauccgguucgccggcggcgagaagugcuacaucaaggcccaggucaaggcccgcauccccgaggugggggccgugacgaagcagagcaucuccagcaagcucgagggcaagaucaugcccgucaaguacgaggagaacucccugaucuggguggcgguggaccagcccgucaaggacaacagcuuccuguccagcaaggugcucgagcugugcggggaccugccgaucuucuggcucaagcccaccuaccccaaggagauccagcgggagcgccgggaggugguccgcaagaucgugcccaccaccacgaagcggccgcacuccggcccccgcagcaaccccggcgccgggcggcugaacaacgagacccgccccuccgugcaggaggacagccaggccuucaacccggacaaccccuaccaccaggagggcgagagcaugaccuucgacccccggcuggaccacgaggggaucugcugcaucgagugccgccgguccuacacccacugccagaagaucugcgagccccucggcggguacuacccguggcccuacaacuaccagggcugccgcagcgccugccgggucaucaugcccugcuccugguggguggcccgcauccugggcaugguguga

SEQ ID NO: 32262 - RNA, 456 nt, Artificial Sequence
  derived and/or modified sequence opt1 from LECT2__Homo_sapiens__NP_002293
auguucagcaccaaggcccugcuccuggccggccugaucuccaccgcgcucgccgggcccugggccaacaucugcgccggcaagagcuccaacgagauccgcacgugcgaccggcacgggugcggccaguacagcgcccagcgcucccagcggccgcaccaggggguggacauccugugcagcgcgggcuccaccgucuacgcccccuucaccggcaugaucguggggcaggagaagcccuaccagaacaagaacgccaucaacaacggcgugcgcaucagcgggcggggcuucugcgucaagauguucuacaucaagcccaucaaguacaaggggccgaucaagaagggcgagaagcugggcacccuccugccccugcagaagguguaccccgggauccagucccacgugcacaucgagaacugcgacagcuccgaccccacggccuaccucuga

SEQ ID NO: 32263 - RNA, 1116 nt, Artificial Sequence
  derived and/or modified sequence opt1 from LEF1__Homo_sapiens__NP_001124185
augccccagcugagcggcgggggcgggggcgggggcggcgacccggagcucugcgccaccgacgagaugauccccuucaaggacgagggggacccccagaaggagaagaucuucgccgagaucucccaccccgaggaggagggcgaccuggcggacaucaagagcucccuggugaacgagagcgagaucaucccggccuccaacgggcacgaggucgcccgccaggcccagaccagccaggagcccuaccacgacaaggcccgggagcaccccgacgacggcaagcaccccgacgggggccucuacaacaagggcccguccuacagcuccuacagcggguacaucaugaugcccaacaugaacaacgaccccuacauguccaacggcagccuguccccgcccaucccccgcacgagcaacaaggugcccgugguccagcccucccacgcggugcacccgcugaccccgcucaucaccuacagcgacgagcacuucucccccgggagccaccccucccacauccccagcgacgugaacagcaagcagggcaugucccggcacccgcccgcccccgacauccccaccuucuacccccugagccccggcggggucggccagaucacgcccccgcuggggugguucucccaccacaugauccccgggcccccgggcccccacaccaccggcaucccccaccccgccaucgugaccccgcaggucaagcaggagcacccccacacggacagcgaccucaugcacgugaagccccagcacgagcagcgcaaggagcaggagcccaagcggccgcacaucaagaagccccugaacgccuucaugcuguacaugaaggagaugcgcgcgaacgugguggccgagugcacccucaaggaguccgccgccaucaaccagauccugggccggcgcuggcacgcccugagccgggaggagcaggcgaaguacuacgagcucgcccgcaaggagcggcagcugcacaugcagcuguaccccgggugguccgcccgcgacaacuacggcaagaagaagaagcggaagcgcgagaagcuccaggagagcgccuccgggaccggcccccggaugaccgccgcguacaucuga

SEQ ID NO: 32264 - RNA, 1101 nt, Artificial Sequence
  derived and/or modified sequence opt1 from LEFTY1__Homo_sapiens__NP_066277
augcagccccuguggcucugcugggcccugugggugcugccgcucgccagccccggcgcggcccugaccggggagcagcugcucggcucccugcugcgccagcuccagcugaaggagguccccacccuggaccgggccgacauggaggagcucgugauccccacgcacgugcgcgcccaguacgucgcccugcugcagcggagccacggggaccgcucccggggcaagcgcuucagccaguccuuccgggagguggcggggcgcuuccucgcccuggaggccagcacccaccuccugguguucggcauggagcagcggcugccgcccaacuccgagcugguccaggccgugcuccgccuguuccaggagcccgugcccaaggcggcccugcaccggcacggccgccucagcccgcgguccgcccgcgcccgggucaccguggaguggcugcgcgugcgggacgacgggagcaaccgcaccucccugaucgacagccggcucgucuccgugcacgagagcggcuggaaggccuucgacgugacggaggcggucaacuucuggcagcagcugucccgcccccggcagccccugcuccuccaggugagcgugcagcgcgagcaccuggggccccuggccuccggcgcccacaagcugguccgcuucgccagccagggggccccggcgggccugggcgagccccagcucgagcugcacacccuggaccucggggacuacggcgcccagggggacugcgaccccgaggcccccaugaccgagggcacccggugcugccgccaggagauguacaucgaccugcagggcaugaagugggccgagaacugggugcuggagccgcccggguuccucgccuacgagugcgugggcacgugccggcagccgcccgaggcgcuggccuucaaguggcccuuccuggggccccgccagugcaucgccuccgagaccgacagccuccccaugaucgucagcaucaaggagggcgggcggacccgcccccagguggugucccugccgaacaugcggguccagaagugcagcugcgccuccgacggcgcccuggugccccgccggcuccagcccuga

SEQ ID NO: 32265 - RNA, 999 nt, Artificial Sequence
  derived and/or modified sequence opt1 from LEFTY2__Homo_sapiens__NP_001165896
auguggccccuguggcucugcugggcccugugggugcugccgcucgccggccccggggcggcccugaccgaggagcagcugcucggcagccugcugcgccagcuccagcuguccgagguccccgugcuggaccgggccgacauggagaagcucgugauccccgcccacguccgcgcccaguacguggugcugcugcggcgcagccacggggaccggucccgcggcaagcgguucagccaguccuuccgcgaggucgcggggcgguuccucgccagcgaggccgcccugcaccgccacggccggcuguccccgcgcagcgcgcaggcccgggugaccguggaguggcuccgcguccgggacgacggcuccaaccgcacgagccugaucgacucccggcuggugagcgugcacgaguccggguggaaggccuucgacgucaccgaggccgugaacuucuggcagcagcucagccgcccccggcagccccugcugcuccagguguccguccagcgcgagcaccugggcccccuggccagcggggcgcacaagcucgugcgguucgccucccagggcgccccggccgggcugggcgagccccagcuggagcuccacacccuggaccugcgcgacuacggcgcccagggggacugcgaccccgaggcgcccaugaccgagggcacgcgcugcugccggcaggagauguacaucgaccuccaggggaugaagugggccaagaacugggugcuggagccgcccggcuuccuggccuacgagugcgucgggaccugccagcagccgcccgaggcccucgccuucaacuggcccuuccugggcccccgccagugcaucgcgagcgagaccgccucccugcccaugaucgugagcaucaaggagggcgggcggacccgcccccagguggucagccucccgaacaugcgggugcagaagugcuccugcgccagcgacggcgcccuggugccccgccggcugcagcccuga

SEQ ID NO: 32266 - RNA, 2079 nt, Artificial Sequence
  derived and/or modified sequence opt1 from LEKR1__Homo_sapiens__NP_001004316
auggaccaccacauccccaugcacgcccugccggaggagauccagaagaugcuccccgaggagaaggugugcaaguacugcggcgucagcuaccugauccugcacgaguucaaggccauggaggagaaggugaaggcgauggagaaggagaugaaguucuaccagggguccguggaccgcgagaagcggcuccaggagaagcugcacagccugucccaggagcucgagcaguacaagaucgacaacaagagcaagaccgagcgcaucuacgacgucggcaugcagcugaagucccagcagaacgaguuccagaaggugaagaagcagcugagccaccuccaggacgagcugaagaucaaguaccggcaguccuacaucuucagccagcgccuguccgaguacaaguacuucuggaacaagacccucagccugcugacguucaccaagcgggagcucaccuccaucaagaacgagguguacgacaacuaccagaacuggaccagccugaagggggccgucuuccugcagaucaaguccaucagcgagacggcccucaccgagaucgacauccugaacaagucccugaccgugagccagcgcaacaaggugugccucgagaaggagaugaagaaccugaagcugcucuccgacgccgccauccugcggagccagcagauccgcaccucccggcagcaggaggucaaccugcagacgcgcugcuacgaccuccagaaggaggugcuggaccugcagugccucguggaggcgcugggccugaagcuccagaaggccgucaccgagauggacaacuacaaggagaugcugaugaacaagagcaacgaggccgacgacugccagcgggagcugaagaagcucaaguucgagagcaucaucuccgagagccagcacaccaugcugcugaaggagaaggaggacucccucaugaccugccagcagaucuacaaggcccugcaggaggagcugacggugaaggagaagcaggaggaggacaucaagcgccggaucaaccucgcggagaacgagcuggagaucaccaagacccugcucaaccagacccgcgaggaggugcugacgcugaagaacgagcgggagcucaugcugaucagccaccagaaguccaucgagcagcugcaggagacccugcgccagaagcuccugagcgacgacaacuggaaggagaagaucgaggccgagcuggccaaggagcgggcccagcaccucgucgaguucgaggagcaggcccugcuguucaaggaggagaccaagcuccagcuggacaucgagaaggagaagcaccaggacgugauccagaaguacaagaaggagcaggaggagcugcagaugaagaucuccgaccucaucaccggggcgacgcgcgaccugcggcaggaggugaccacccugaaggagaagcuccacaagagccacauccgcuacaccgaggaguccaacagcaaggagaaggagaucgagaaccugaagaaccuggucgccgaguucgagucccggcucaagaaggagaucgacagcaacgacuccgugagcgagaaccugcgcaaggagauggagcagaaguccgacgagcugaagcgcgugaugcucgcccagacgcagcugaucgagcaguucaaccagagccaggaggagaacaccuuccugcaggagaccguccggcgcgagugcgaggagcgguucgagcucaccgaggcccugucccaggcccgcgagcagcugcucgagcugagcaagcugcggggcucccuccccuucagccccugcagccuguccaagggcagccugacguccccggcggccgccgugagcaaccacggggagcgcucccucgcccggcugaacagcgagaagggcauccagauccccaaccugcgcgggguguccaagcccaccaccuuccccaccagcgacaagccgaagcggguccgcuccggcgugcccauccucccccagccccacccgccccgcgggggcgccagcuccgcgaacgagacgcggcagcggcuggccgccauccugcgccggcgccggagccagcaguga

SEQ ID NO: 32267 - RNA, 606 nt, Artificial Sequence
  derived and/or modified sequence opt1 from LEMD2__Homo_sapiens__NP_001137416
auggaggcccaggaguacaucgccaacgugaccagcuccagcuccgcgaaguucgaggccgcccugaccuggauccucagcuccaacaaggacgucggcaucuggcugaagggggaggaccagagcgagcuggugacgaccguggacaaggucgugugccucgaguccgcccacccccgcaugggcguggggugccggcugagccgcgcccugcucaccgcggucaccaacgugcugaucuucuucuggugccuggccuuccucuggggccugcugauccuccugaaguaccgguggcgcaagcuggaggaggaggagcaggccauguacgagauggugaagaagaucaucgacgucgugcaggaccacuacguggacugggagcaggacauggagcgguaccccuacgucgggauccuccacgugcgcgacucccugaucccgccccagagccggcgccggaugaagcgcgugugggaccgggccgucgaguuccuggcguccaacgagagccgcauccagacggagucccaccggguggccggcgaggacaugcucguguggcgcuggaccaagcccagcuccuucagcgacuccgagcgguga

SEQ ID NO: 32268 - RNA, 2736 nt, Artificial Sequence
  derived and/or modified sequence opt1 from LEMD3__Homo_sapiens__NP_055134
auggccgccgcggccgccagcgcgccccagcagcuguccgacgaggagcuguucagccagcugcgccgguacggccuguccccggggcccgugaccgagagcacccgccccgucuaccucaagaagcugaagaagcugcgggaggaggagcagcagcagcaccgcuccggcgggcggggcaacaagacgcgcaacagcaacaacaacaacaccgccgccgccaccguggccgccgcggggcccgccgccgccgccgcggccggcaugggcgugcggccggucuccggggaccucagcuaccugcgcacccccggcgggcugugccggaucuccgccagcggccccgagucccuccucgggggccccggcggggccagcgccgcgccggccgccggcuccaaggugcugcucggguucagcuccgacgagagcgacguggaggccagcccccgcgaccaggccggcggcgggggccggaaggaccgcgcgucccugcaguaccgggggcugaaggccccgcccgcgccccucgccgccuccgaggucacgaacagcaacagcgccgagcgccggaagccccacuccugguggggcgcccgccggcccgccgggcccgagcugcagaccccgcccggcaaggacggcgccguggaggacgaggagggggagggcgaggacggggaggagcgcgaccccgagaccgaggagccccugugggcgagccggaccgugaacggcucccgccucgucccguacagcugccgggagaacuacuccgacagcgaggaggaggacgacgacgacguggccuccagccgccaggugcugaaggacgacucccugagccgccaccggccccgccggacgcacuccaagccccugcccccgcugaccgccaagagcgccgggggccgccucgagaccuccguccagggcgggggcgggcucgccaugaacgaccgggcggccgccgccggcagccuggaccgcucccggaaccuggaggaggccgcggccgccgagcagggcgggggcugcgaccagguggacagcucccccgugccccgcuaccgggucaacgccaagaagcucacgccccugcugccgccgccccucaccgacauggacagcacccuggacuccagcaccgggagccugcucaagaccaacaaccacaucggcgggggcgccuucuccguggacagcccccgcaucuacuccaacagccugccgcccuccgcggccguggccgccagcuccagccugcggaucaaccacgcgaaccacacgggcuccaaccacaccuaccucaagaacaccuacaacaagcccaagcugagcgagcccgaggaggagcugcuccagcaguucaagcgcgaggaggucucccccaccgggagcuucuccgcccacuaccugagcauguuccugcucacggccgccugccuguucuuccugauccucggccugaccuaccuggggaugcggggcaccgggguguccgaggacggcgagcucagcaucgagaaccccuucggcgagaccuucgggaagauccaggaguccgagaagacgcugaugaugaacacccuguacaagcugcacgaccgccucgcccagcuggcgggcgaccacgagugcgggagcagcucccagcggacccugagcgugcaggaggccgccgccuaccucaaggaccugggccccgaguacgaggggaucuucaacaccucccugcaguggauccucgagaacggcaaggacgucggcauccgcugcgugggguucggcccggaggaggagcugacgaacaucaccgacgugcaguuccugcagagcacccggccccucauguccuucuggugccgcuuccggcgcgccuucgucaccgugacgcaccgccugcugcuccugugccugggggucgugauggugugcgucgugcuccgguacaugaaguaccgcuggaccaaggaggaggaggagacccggcagauguacgacaugguggucaagaucaucgacgugcugcgcagccacaacgaggcgugccaggagaacaaggaccugcagcccuacaugcccaucccgcacgugcgggacucccucauccagccccacgaccgcaagaagaugaagaaggucugggaccgggccguggacuuccuggccgccaacgagagccgcgugcggaccgagacgcgccggaucggcggggccgacuuccuggucuggcgcuggauccagcccuccgcgagcugcgacaagauccucgugauccccuccaagguguggcagggccaggccuuccaccuggaccggcgcaacagcccgcccaacucccugacccccugccucaagauccggaacauguucgaccccgucauggagaucggcgaccaguggcaccuggccauccaggaggccauccuggagaagugcagcgacaacgacgggaucgugcacaucgcgguggacaagaacucccgcgagggcugcgucuacgugaagugccucagcccggaguacgccgggaaggccuucaaggcccugcacggcuccugguucgacgggaagcuggugaccgucaaguaccuccggcuggaccgcuaccaccaccgguucccccaggcccugaccagcaacacgccccucaagcccuccaacaagcacaugaacagcaugagccaccuccggcugcgcaccggccugaccaacucccagggcagcuccuga

SEQ ID NO: 32269 - RNA, 1821 nt, Artificial Sequence
  derived and/or modified sequence opt1 from LEO1__Homo_sapiens__NP_001273359
auggccgacauggaggaccuguucggcagcgacgccgacuccgaggcggagcgcaaggacagcgacuccgggagcgacuccgacagcgaccaggagaacgccgccuccggcagcaacgccuccgggagcgaguccgaccaggacgagcggggcgacagcgggcagcccuccaacaaggagcuguucggcgacgacagcgaggacgagggcgccucccaccacagcggguccgacaaccacagcgagcgcuccgacaaccggagcgaggcgagcgagcgcuccgaccacgaggacaacgacccgagcgacguggaccagcacuccggcagcgaggcccccaacgacgacgaggacgaggggcaccgguccgacggcgggagccaccacuccgaggccgagggcagcgagaaggcccacuccgacgacgagaaguggggccgcgaggacaagagcgaccaguccgacgacgagaagauccagaacagcgacgacgaggagcgggcgcagggguccgacgaggacaagcuccagaacagcgacgacgacgagaagaugcagaacaccgacgacgaggagcgcccccagcuguccgacgacgagcggcagcagcucagcgaggaggagaaggccaacuccgacgacgagcgccccgucgccagcgacaacgacgacgagaagcagaacuccgacgacgaggagcagccgcagcugagcgacgaggagaagaugcagaacagcgacgacgagcggccccaggccuccgacgaggagcaccgccacagcgacgacgaggaggagcaggaccacaaguccgagagcgcccggggcuccgacagcgaggacgaggugcugcgcaugaagcggaagaacgcgaucgccuccgacagcgaggccgacuccgacaccgaggugcccaaggacaacagcgggacgauggaccucuucggcggcgccgacgacaucuccagcggguccgacggcgaggacaagcccccgacccccgggcagcccgucgacgagaacggccugccccaggaccagcaggaggaggagccgauccccgagacccgcaucgagguggagauccccaaggugaacaccgaccuggggaacgaccucuacuucgucaagcugcccaacuuccugagcguggagccguccaugagccuccaccugggcaacgagguguucgacgucuacaaggcgccccugcagggcgaccacaaccaccucuucauccggcaggggacgggccugcaggggcaggccguguucaagaccaagcugaccuuccgcccccacuccaccgacagcgccacgcaccggaagaugacccucagccuggccgaccgcugcuccaagacccagaagauccggauccugcccauggccggccgcgacccggagugccagcgcaccgagaugaucaagaaggaggaggagcggcuccgcgccagcauccggcgcgagucccagcagcggcgcaugcgggagaagcagcaccagcgcgggcugagcgcguccuaccuggagcccgaccgguacgacgaggaggaggagggcgaggagagcaucucccucgccgccaucaagaaccgcuacaagggcgggauccgggaggagcgcgcccggaucuacagcuccgacagcgacgagggcuccgaggaggacaaggcccagcgccugcugaaggcgaagaagcucacgagcgacgaggagggggagcccuccggcaagcggaaggccgaggacgacgacaaggccaacaagaagcacaagaaguacgugaucagcgacgaggaggaggaggacgacgacuga

SEQ ID NO: 32270 - RNA, 504 nt, Artificial Sequence
  derived and/or modified sequence opt1 from LEP__Homo_sapiens__NP_000221
augcacuggggcacccugugcggguuccucuggcuguggcccuaccuguucuacgugcaggccgucccgauccagaaggugcaggacgacaccaagacgcucaucaagaccaucgugacccgcaucaacgacaucagccacacccaguccgucagcuccaagcagaaggugacgggccuggacuucauccccgggcugcaccccauccucacccugagcaagauggaccagacccuggccguguaccagcagauccucaccuccaugcccagccggaacgucauccagaucuccaacgaccuggagaaccugcgcgaccuccugcacgugcuggcguucagcaaguccugccaccucccgugggccagcggccuggagacgcuggacucccucgggggcgugcuggaggccagcggcuacuccaccgaggucguggcccugagccggcuccaggggucccugcaggacaugcuguggcagcucgaccugagccccggcugcuga

SEQ ID NO: 32271 - RNA, 510 nt, Artificial Sequence
  derived and/or modified sequence opt1 from LEPROTL1__Homo_sapiens__NP_001121680
auggccggcaucaaggcccugaucagccucuccuucgggggcgcgaucgggcugauguuccugaugcucggcugcgcccugcccaucuacaacaaguacuggccccuguucguccucuucuucuacauccugagccccauccccuacugcaucgcccgccggcugguggacgacaccgacgccauguccaacgccugcaaggagcucgcgaucuuccugaccacggggaucguggugagcgccuucggccugcccaucgucuucgcccgcgcccaccucaugggccggcugccguucuucuccaagauggggaccgcggagagcgagggccgcgagacccugacccagcagcucccccugcccgccgccgccaugcggcgccugcuccccgccucccgggugagcacgcagccggugcugcgccuggcggacuccgccgagagccuccuggggcggcccgcccugugggcccucggcuuccugcugugcccgcccucccaggcccaguga

SEQ ID NO: 32272 - RNA, 2220 nt, Artificial Sequence
  derived and/or modified sequence opt1 from LETM1__Homo_sapiens__NP_036450
auggccagcauccugcuccgcuccugccggggccgcgcccccgcgcggcugccgccccccccccgcuacaccgugccgcgggggagccccggcgaccccgcccaccuguccugcgccagcacccucgggcugcgcaacugccugaacguccccuucggcugcugcacgccgauccaccccguguacaccuccagccggggggaccaccucggcugcugggcccugcgccccgagugccugcggaucgugucccgcgcccccuggaccagcaccuccgucggcuucguggcgguggggccgcagugccuccccguccggggcuggcacagcucccgccccgugcgggacgacagcguggucgagaagucccugaagagccugaaggacaagaacaagaagcucgaggaggggggccccguguacuccccgcccgccgagguggucgugaagaagagccuggggcagcgcgugcuggacgagcucaagcacuacuaccacggcuuccggcugcuguggaucgacacgaagaucgccgcccgcaugcucuggcggauccugaacggccacucccugacccgccgggagcgccggcaguuccuccgcaucugcgcggaccuguuccgccugguccccuuccucguguucguggucgugcccuucauggaguuccugcugccgguggccgucaagcucuuccccaacaugcugcccagcaccuucgagacccagucccugaaggaggagcggcucaagaaggagcugcgcgugaagcuggagcucgccaaguuccugcaggacacgaucgaggagauggcccugaagaacaaggccgcgaaggggagcgccaccaaggacuucagcguguucuuccagaagauccgggagaccggcgagcgccccuccaacgaggagaucaugcgguucagcaagcucuucgaggacgagcugacccuggacaaccucacgcgcccgcagcuggucgcccugugcaagcuccuggagcugcaguccaucgggaccaacaacuuccuccgguuccagcugaccaugcgccugcggagcaucaaggccgacgacaagcucaucgccgaggagggcguggacucccugaacgucaaggagcugcaggcggccugccgcgcccggggcaugcgcgcccugggggugaccgaggaccggcuccgcggccagcugaagcaguggcuggaccuccaccugcaccaggagauccccacgagccugcucauccugucccgggccauguaccugcccgacacccucagccccgcggaccagcugaaguccacccugcagacccucccggagaucguggccaaggaggcccaggucaagguggccgagguggagggggagcaggucgacaacaaggccaagcuggaggcgacgcugcaggaggaggccgccauccagcaggagcaccgcgagaaggagcuccagaagcggagcgagguggccaaggacuucgagcccgagcgcguggucgcggccccccagcggccgggcaccgagccccagcccgagaugcccgacaccgugcugcaguccgagacccugaaggacacggccccggugcucgaggggcugaaggaggaggagaucaccaaggaggagaucgacauccugagcgacgccugcuccaagcuccaggagcagaagaagagccugaccaaggagaaggaggagcuggagcuccugaaggaggacguccaggacuacuccgaggaccugcaggagaucaagaaggagcucagcaagaccggcgaggagaaguacguggaggaguccaaggccagcaagcgccugacgaagcgcgugcagcagaugaucggccagaucgacgggcugaucucccagcucgagauggaccagcaggcgggcaagcuggcccccgccaacgggaugcccaccggcgagaacgucaucagcguggccgagcugaucaacgccaugaagcaggugaagcacauccccgagagcaagcucaccucccuggcggccgcccuggacgagaacaaggacgggaaggucaacaucgacgaccucgugaaggugaucgagcuggucgacaaggaggacgugcacaucagcaccucccagguggccgagaucgucgccacgcuggagaaggaggagaagguggaggagaaggagaaggcgaaggagaaggccgagaaggagguggccgaggucaagagcuga

SEQ ID NO: 32273 - RNA, 1122 nt, Artificial Sequence
  derived and/or modified sequence opt1 from LETMD1__Homo_sapiens__NP_001230618
auggcccugagccgcgugugcugggcccgguccgcggucuggggcagcgccgugacccccgggcacuucgugacccgccggcuccagcugggccgcuccgggcuggccuggggcgcgccccggagcuccaagcuccaccugagccccaaggccgacgucaagaaccugauguccuacguggugacgaagaccaaggccaucaacgggaaguaccaccgcuuccucggccggcacuucccccgcuucuacguccuguacaccaucuucaugaagggccugcagaugcucugggccgacgccaagaaggcccggcgcaucaagaccaacauguggaagcacaacaucaaguuccaccagcugcccuaccgggagauggagcaccuccgccaggugugggcgcgggggcgcuacccggaggugcacggcgaguuccggcaggacgucacgaagugccuguuccuggggaucaucagcaucccgcccuucgccaacuaccugguguuccuccugauguaccuguucccccgccagcuccugauccggcacuucuggacccccaagcagcagaccgacuuccuggacaucuaccacgccuuccgcaagcagucccaccccgagaucaucagcuaccucgagaaggugaucccccugaucuccgacgccggccugcgguggcgccucaccgaccugugcacgaagauccagcgggggacccaccccgccauccacgacauccuggcgcuccgcgagugcuucagcaaccacccgcugggcaugaaccagcugcaggcccuccacgucaaggcccugucccgcgccaugcugcucaccagcuaccugcccccgccccugcuccggcaccgccugaagacccacacgaccgugauccaccagcuggacaaggcccucgcgaagcugggcaucgggcagcugaccgcccaggaggugaaguccgccugcuaccuccggggccugaacagcacccacaucggggaggaccgcugccggacguggcugggcgaguggcuccagaucuccugcagccugaaggaggccgagcugucccuccugcugcacaacgucgugcugcucagcaccaacuaccugggcacccgccgguga

SEQ ID NO: 32274 - RNA, 507 nt, Artificial Sequence
  derived and/or modified sequence opt1 from LEUTX__Homo_sapiens__NP_001137304
augcaccccagccuggccaccaugggcaagcucgccuccaagcugcagcuggaccucagcguggucaagaucugguucaagaaccagcgcgcgaaguggaagcggcagcagcgccagcagaugcagacccggccgucccuggggcccgccaaccagacgaccagcgugaagaaggaggagacccccuccgccaucaccacggccaacauccgccccgugagcccgggcaucuccgacgccaacgaccacgaccugcgggagcccagcgggaucaagaaccccggcggggcguccgccagcgcccgcgucuccagcugggacucccagagcuacgacaucgagcagaucugccucggcgccuccaacccgcccugggcgagcacccuguucgagaucgacgaguucgugaagaucuacgaccugcccggcgaggacgacaccuccagccucaaccaguaccuguuccccgugugccuggaguacgaccagcuccaguccagcgucuga

SEQ ID NO: 32275 - RNA, 1140 nt, Artificial Sequence
  derived and/or modified sequence opt1 from LFNG__Homo_sapiens__NP_001035257
augcugaagcgcugcggccggcgccuccugcuggcccucgccggggcgcugcuggccugccuccuggugcugaccgccgacccgcccccgccgccccuccccgccgagcggggccgccgggcccugcgcagccuggcggggcccgccggcgccgcccccgcgcccgggcucggcgccgccgccgccgcgcccggcgcccuggugcgggacgugcacucccugagcgaguacuucucccuccugacccgcgcccggcgcgacgccgggcccccgcccggcgccgcgccccggcccgccgacgggcacccccgcccccuggccgagccgcucgcgccccgggacguguucaucgccgucaagacgaccaagaaguuccaccgcgcccggcuggaccugcuccuggagaccuggaucagccgccacaaggagaugaccuucaucuucacggacggcgaggacgaggcccuggcccggcacaccgggaacguggugaucaccaacugcuccgccgcccacagccgccaggcgcucuccugcaagauggccgucgaguacgaccgguucaucgagagcggccgcaagugguucugccacguggacgacgacaacuacgugaaccugcgggcccugcuccgccugcuggccuccuacccccacacccgcgacgucuacgugggcaagcccagccucgaccggccgauccaggcgauggagcgcguguccgagaacaagguccggcccgugcacuucugguucgccaccgggggcgccggguucugcaucagccgcggccuggcccugaagaugucccccugggccagcggcgggcacuucaugaacacggcggagcggauccgccuccccgacgacugcaccaucggcuacaucguggaggcccugcugggggucccgcucauccgguccggccuguuccacagccaccuggagaaccuccagcagguccccaccuccgagcugcacgagcaggucacgcugagcuacgggauguucgagaacaagcgcaacgccgugcacgugaagggccccuucuccguggaggccgaccccagccgguuccgcagcauccacugccaccucuacccggacacccccuggugcccccggaccgccaucuucuga

SEQ ID NO: 32276 - RNA, 1014 nt, Artificial Sequence
  derived and/or modified sequence opt1 from LGALS12__Homo_sapiens__NP_001136007
augagccagcccuccggcgggcgcgccccgggcacccggaucuacagcugguccugccccaccgugaugagccccggggagaagcuggaccccaucccggacuccuucauccuccagccgcccgucuuccaccccguggugcccuacgucacgaccaucuucggcgggcugcacgccggcaagauggugaugcugcagggcguggucccccucgacgcgcacagccgcuuccagguggacuuccagugcgggugcucccugugcccccggcccgacaucgccuuccacuucaacccgcgcuuccacaccaccaagccccacgugaucugcaacacgcugcacggcgggcgguggcagcgcgaggcccgguggccccaccucgcccugcgccggggcagcuccuuccugauccucuuccuguucgggaacgaggaggucaaggugagcgugaacggccagcacuuccugcacuuccgcuaccggcucccccugucccacgucgacacccugggcaucuucggggacauccucguggaggccgugggcuuccugaacaucaacccguucgucgaggggagccgcgaguaccccgcgggccaccccuuccugcucaugagcccccggcuggaggugccgugcucccacgcccugccccagggccucucccccggccaggugaucaucguccgcgggcuggugcugcaggagcccaagcacuucaccgugagccuccgggaccaggccgcccacgcgccggucacccugcgcgccuccuucgccgaccggacgcuggccuggaucagccgcugggggcagaagaagcucaucuccgcccccuuccuguucuacccccagcgguucuucgaggugcugcuccuguuccaggagggcgggcugaagcucgcgcugaacggccagggccugggggccaccagcaugaaccagcaggcccucgagcagcugcgcgagcugcggaucagcggcuccgugcagcucuacugcguccacagcuga

SEQ ID NO: 32277 - RNA, 420 nt, Artificial Sequence
  derived and/or modified sequence opt1 from LGALS13__Homo_sapiens__NP_037400
augagcucccugcccgugcccuacaagcuccccgucagccuguccgugggcagcugcgugaucaucaaggggacccccauccacuccuucaucaacgacccccagcugcaggucgacuucuacaccgacauggacgaggacagcgacaucgccuuccgcuuccgggugcacuucggcaaccacguggucaugaaccgccgggaguucgggaucuggaugcucgaggagacgaccgacuacgugccguucgaggacggcaagcaguucgagcugugcaucuacgugcacuacaacgaguacgagaucaaggucaacgggauccgcaucuacggcuucgugcaccggaucccgcccuccuucgugaagaugguccaggugagccgcgacaucucccugaccagcgugugcgucugcaacuga

SEQ ID NO: 32278 - RNA, 420 nt, Artificial Sequence
  derived and/or modified sequence opt1 from LGALS14__Homo_sapiens__NP_064514
augagcucccugcccgugccguacacccuccccgucagccugcccgugggcuccugcgugaucaucaccgggacgcccauccugaccuucgucaaggacccgcagcucgaggugaacuucuacaccggcauggacgaggacagcgacaucgccuuccaguuccgccugcacuucgggcaccccgccaucaugaacuccugcguguucggcaucuggcgguacgaggagaagugcuacuaccugcccuucgaggacgggaagcccuucgagcucugcaucuacguccgccacaaggaguacaaggugauggugaacggccagcggaucuacaacuucgcgcaccgcuucccgcccgccagcgucaagaugcuccagguguuccgggacaucucccugacccgcgugcugaucagcgacuga

SEQ ID NO: 32279 - RNA, 429 nt, Artificial Sequence
  derived and/or modified sequence opt1 from LGALS16__Homo_sapiens__NP_001177370
augagcuuccugaccgugcccuacaagcucccggucucccugagcgugggcuccugcgugaucaucaaggggacccugaucgacagcuccaucaacgagccccagcuccaggucgacuucuacacggagaugaacgaggacagcgagaucgccuuccaccuccgcgugcaccugggccggcgcguggucaugaacucccgggaguucgggaucuggaugcuggaggagaaccugcacuacgugcccuucgaggacggcaagcccuucgaccugcgcaucuacgugugccacaacgaguacgaggucaaggugaacggggaguacaucuacgccuucgugcaccggaucccgcccagcuacgucaagaugauccagguguggcgcgacgugucccucgacagcguccuggugaacaacggccggcgcuga

SEQ ID NO: 32280 - RNA, 408 nt, Artificial Sequence
  derived and/or modified sequence opt1 from LGALS1__Homo_sapiens__NP_002296
auggccugcggccugguggccagcaaccucaaccugaagcccggggagugccugcgcguccggggcgagguggcgccggacgccaaguccuucgugcucaaccuggggaaggacagcaacaaccugugccuccacuucaacccccgcuucaacgcccacggcgacgccaacaccaucgucugcaacuccaaggacgggggcgccuggggcaccgagcagcgggaggcgguguuccccuuccagcccgggagcguggccgaggucugcaucacguucgaccaggccaaccugaccgugaagcugccggacggcuacgaguucaaguuccccaaccgccucaaccuggaggccaucaacuacauggcggccgacggggacuucaagaucaagugcguggccuucgacuga

SEQ ID NO: 32281 - RNA, 399 nt, Artificial Sequence
  derived and/or modified sequence opt1 from LGALS2__Homo_sapiens__NP_006489
augaccggcgagcuggaggugaagaacauggacaugaagcccgggagcacccucaagaucacgggcuccaucgccgacgggaccgacggcuucgucaucaaccuggggcagggcaccgacaagcugaaccuccacuucaacccgcgguucagcgaguccaccaucgugugcaacagccuggacggcuccaacugggggcaggagcagcgggaggaccaccugugcuucagccccggcuccgaggugaaguucacggucaccuucgagagcgacaaguucaaggugaagcuccccgacgggcacgagcugaccuuccccaaccgccugggccacucccaccucagcuaccuguccgugcgcgggggcuucaacaugagcuccuucaagcugaaggaguga

SEQ ID NO: 32282 - RNA, 1758 nt, Artificial Sequence
  derived and/or modified sequence opt1 from LGALS3BP__Homo_sapiens__NP_005558
augacgcccccgcgccuguucuggguguggcuccuggucgccggcacccagggggugaacgacggcgacaugcggcuggccgacgggggcgcgaccaaccaggggcgcguggagaucuucuaccggggccaguggggcaccgucugcgacaaccucugggaccugaccgacgccagcguggugugccgcgcccugggguucgagaacgccacccaggcccucggccgggcggccuucgggcagggcuccgggcccaucaugcuggacgagguccagugcacgggcaccgaggccagccuggccgacugcaagucccucggcuggcucaagagcaacugccgccacgagcgggacgcggggguggugugcaccaacgagacccgcuccacgcacacccuggaccugagccgggagcuguccgaggcccugggccagaucuucgacagccagcgcgggugcgaccucuccaucagcgucaacgugcagggcgaggacgcccugggcuucugcgggcacaccgugauccugaccgccaaccucgaggcccaggcgcuguggaaggagcccggcuccaacgucacgaugagcguggacgccgagugcgugcccaugguccgggaccugcuccgcuacuucuacucccggcgcaucgacaucacccugagcuccgugaagugcuuccacaagcuggccagcgccuacggggcccggcagcuccagggcuacugcgcgucccuguucgccauccugcucccgcaggaccccagcuuccagaugccccuggaccuguacgccuacgccguggccaccggggacgcgcuccuggagaagcugugccuccaguuccuggccuggaacuucgaggcccugacccaggccgaggccuggcccuccgucccgacggaccuccugcagcugcuccugccccgcagcgaccuggcggugcccagcgagcucgcccugcugaaggccguggacaccugguccuggggcgagcgggccagccacgaggaggucgagggccucguggagaagauccgcuuccccaugaugcugccggaggagcuguucgagcuccaguucaaccugucccuguacuggagccacgaggcgcuguuccagaagaagacccuccaggcccuggaguuccacaccgugcccuuccagcugcucgcccgguacaaggggcugaaccugacggaggacaccuacaagccccgcaucuacaccucccccaccuggagcgccuucgucacggacuccagcugguccgcccgcaagagccagcucguguaccagucccggcgcggcccgcuggucaaguacagcuccgacuacuuccaggcgcccagcgacuaccgguacuaccccuaccaguccuuccagacgccccagcacccgagcuuccuguuccaggacaagcgcguguccuggagccucguguaccugcccaccauccaguccugcuggaacuacggguucagcugcagcuccgacgagcugcccguccucggccugaccaagagcgggggcuccgaccggaccaucgccuacgagaacaaggcccugaugcucugcgagggccuguucguggccgacgugaccgacuucgagggguggaaggccgcgauccccagcgcccuggacaccaacuccagcaaguccaccagcuccuucccgugccccgccggccacuucaacggguuccgcacggucauccggcccuucuaccucaccaacagcuccggcguggacuga

SEQ ID NO: 32283 - RNA, 603 nt, Artificial Sequence
  derived and/or modified sequence opt1 from LGALS3__Homo_sapiens__NP_001170859
auggccgacaacuucagccugcacgacgcccucuccggcagcgggaaccccaacccgcagggcuggcccggggcguggggcaaccagcccgccggggccggcggcuaccccggggccuccuacccgggcgccuaccccgggcaggcgccgcccggcgccuaccccgggcaggccccgcccggcgccuaccccggcgcgcccggggccuaccccggcgcccccgcccccgggguguacccgggcccgcccagcggccccggggccuaccccuccagcggccagcccuccgcgaccggggccuaccccgccaccggccccuacggggccccggccggcccccugaucguccccuacaaccugccccucccgggcgggguggugccccgcaugcugaucacgauccugggcaccgucaagcccaacgcgaaccggaucgcccucgacuuccagcgcgggaacgacguggccuuccacuucaacccgcgguucaacgagaacaaccgccgggugaucgucugcaccuacaugugcaagggcuucauguucaccgugagcgagaacuucuacauccaccaguaccccuccugcaagagcuccacguga

SEQ ID NO: 32284 - RNA, 972 nt, Artificial Sequence
  derived and/or modified sequence opt1 from LGALS4__Homo_sapiens__NP_006140
auggccuacgugcccgcccccggcuaccagcccaccuacaaccccacccugcccuacuaccagccgauccccgggggccucaacgucgggaugagcguguacauccagggcguggcguccgagcacaugaagcgcuucuucgucaacuucgugguggggcaggaccccggcagcgacgucgccuuccacuucaacccccgguucgacggcugggacaaggugguguucaacacgcugcagggcgggaaguggggguccgaggagcgcaagcggagcaugccguucaagaagggcgccgccuucgagcuggucuucaucgugcucgccgagcacuacaagguggucgugaacgggaaccccuucuacgaguacggccaccgccugccccugcagauggugacccaccuccaggucgacggcgaccugcagcugcaguccaucaacuucaucgggggccagccccuccggccgcaggggccgcccaugaugccgcccuaccccggccccggccacugccaccagcagcugaacagccugcccaccauggaggggccgcccaccuucaacccgcccgugcccuacuucggccgccuccagggcgggcugacggcgcggcgcaccaucaucaucaagggguacgugccgcccaccggcaaguccuucgccaucaacuucaaggucggcagcuccggggacaucgcccugcacaucaacccccggaugggcaacgggaccguggugcgcaacagccuccugaacggcuccugggggagcgaggagaagaagaucacgcacaaccccuucggccccggccaguucuucgaccuguccauccggugcgggcucgaccgcuucaaggucuacgccaacggccagcaccuguucgacuucgcgcaccggcugagcgccuuccagcgcguggacacccucgagauccagggggacgugacccuguccuacguccagaucuga

SEQ ID NO: 32285 - RNA, 411 nt, Artificial Sequence
  derived and/or modified sequence opt1 from LGALS7B__Homo_sapiens__NP_001035972
augagcaacgugccccacaaguccagccugccggagggcauccgccccgggaccguccuccggauccgcggccuggugccgcccaacgccucccgguuccacgugaaccugcucugcggggaggagcagggcagcgacgccgcgcugcacuucaacccccgccuggacaccuccgaggucguguucaacagcaaggagcagggguccuggggccgggaggagcgcggccccggggugcccuuccagcggggccagcccuucgagguccucaucaucgccagcgacgacggguucaaggccguggugggcgacgcccaguaccaccacuuccgccaccggcugccgcuggcccgcguccggcucguggaggucgggggcgacgugcagcuggacuccgugcgcaucuucuga

SEQ ID NO: 32286 - RNA, 1080 nt, Artificial Sequence
  derived and/or modified sequence opt1 from LGALS8__Homo_sapiens__NP_006490
augaugcugagccucaacaaccugcagaacaucaucuacaaccccgugaucccguucgucggcaccauccccgaccagcuggaccccgggacccucaucgugauccgcggccacgugcccuccgacgccgaccgguuccaggucgaccugcagaacgggagcuccaugaagccgcgcgccgacguggcguuccacuucaacccccgguucaagcgcgccggcugcaucgugugcaacacgcugaucaacgagaagugggggcgggaggagaucaccuacgacacccccuucaagcgcgagaaguccuucgagaucgucaucauggugcucaaggacaaguuccagguggccgucaacggcaagcacacccugcuguacggccaccggaucgggcccgagaagaucgacacgcucggcaucuacgggaaggugaacauccacagcaucggcuucagcuucuccagcgaccugcaguccacccaggccagcucccuggagcucaccgagaucagccgcgagaacgugccgaaguccgggacgccccagcugcccagcaaccggggcggcgacaucuccaagaucgcgccccgcaccgucuacaccaagagcaaggacuccaccgugaaccacacccugacgugcaccaagaucccgcccaugaacuacgugagcaagcggcuccccuucgccgcccgccugaacacccccauggggccgggccggaccgucguggugaagggggaggucaacgccaacgccaaguccuucaacguggaccugcucgcgggcaagagcaaggacaucgcccugcaccugaacccccgccucaacaucaaggccuucgugcggaacagcuuccugcaggaguccuggggcgaggaggagcgcaacaucacgagcuuccccuucucccccgggauguacuucgagaugaucaucuacugcgacguccgggaguucaagguggccgugaacggcguccacagccuggaguacaagcaccgcuucaaggagcucuccagcaucgacacccuggagaucaacggggacauccaccuccuggaggugcgguccugguga

SEQ ID NO: 32287 - RNA, 972 nt, Artificial Sequence
  derived and/or modified sequence opt1 from LGALS9__Homo_sapiens__NP_002299
auggccuucagcggcucccaggcccccuaccugagcccggcggugcccuucuccgggaccauccagggcgggcuccaggacggccugcagaucaccgucaacgggacggugcugagcuccagcggcacccgcuucgccgugaacuuccagaccggcuucuccgggaacgacaucgccuuccacuucaacccccgguucgaggacggcggguacgucgugugcaacacccgccagaacggcagcugggggcccgaggagcggaagacgcacaugccguuccagaagggcaugcccuucgaccucugcuuccuggugcaguccagcgacuucaaggucauggugaacggcauccuguucgugcaguacuuccaccgcguccccuuccaccggguggacaccaucuccgugaacgggagcguccagcucuccuacaucagcuuccagcccccgggcguguggcccgccaaccccgcccccaucacccagaccgugauccacacgguccaguccgcgccggggcagauguucagcacccccgccaucccgcccaugauguacccccaccccgccuaccccaugcccuucaucaccaccauccugggcggccuguacccguccaagagcauccuccuguccgggacggugcugcccagcgcccagcgcuuccacaucaaccucugcagcggcaaccacaucgcguuccaccugaacccccgguucgacgagaacgccgugguccgcaacacccagaucgacaacuccugggggagcgaggagcggucccugccccgcaagaugccguucgugcggggccagagcuucuccguguggauccucugcgaggcccacugccugaaggucgccguggacgggcagcaccuguucgaguacuaccaccgccuccggaaccugcccaccaucaaccgccuggaggugggcggcgacauccagcucacccacguccagacguga

SEQ ID NO: 32288 - RNA, 519 nt, Artificial Sequence
  derived and/or modified sequence opt1 from LGALSL__Homo_sapiens__NP_054900
auggccggcagcguggccgacuccgacgcggucgugaagcuggacgacgggcaccucaacaacagccuguccagccccgugcaggccgacgucuacuucccgcgccugaucgugcccuucugcggccacaucaagggcgggaugcggcccgggaagaaggugcucgucaugggcaucguggaccugaaccccgaguccuucgccaucagccugaccugcggcgacuccgaggacccgcccgccgacguggccaucgagcucaaggcggucuucaccgaccgccagcugcugcggaacagcugcaucuccggggagcgcggcgaggagcagagcgccauccccuacuuccccuucaucccggaccagcccuuccggguggagauccucugcgagcacccccgcuuccggguguucgucgacgggcaccagcuguucgacuucuaccaccgcauccagacgcuguccgccaucgacaccaucaagaucaacggcgaccuccagaucaccaagcugggguga

SEQ ID NO: 32289 - RNA, 1674 nt, Artificial Sequence
  derived and/or modified sequence opt1 from LGI1__Homo_sapiens__NP_005088
auggagagcgagcgcuccaagcggaugggcaacgccugcaucccccugaagcgcaucgccuacuuccucugccugcugagcgcccuccugcugaccgaggggaagaagccggccaagcccaagugccccgccgugugcacgugcaccaaggacaacgcccucugcgagaacgcccgguccaucccccgcaccgucccgcccgacgugaucagccuguccuucgugcggagcggcuucaccgagaucuccgaggggagcuuccuguucacccccucccuccagcugcuccuguucacgagcaacuccuucgacgucaucagcgacgacgcguucaucggccugccccaccuggaguaccucuucaucgagaacaacaacaucaaguccaucagccgccacaccuuccgggggcugaagucccugauccaccucagccuggccaacaacaaccugcagacccucccgaaggacaucuucaagggccuggacucccugaccaacguggaccuccgcggcaacagcuucaacugcgacugcaagcugaaguggcugguggaguggcucgggcacacgaacgccaccgucgaggacaucuacugcgagggcccgcccgaguacaagaagcggaagaucaacucccugagcagcaaggacuucgacugcaucaucaccgaguucgccaagucccaggaccugcccuaccagagccucuccaucgacaccuucagcuaccugaacgacgaguacguggugaucgcgcagcccuucacggggaagugcaucuuccuggagugggaccacgucgagaagaccuuccgcaacuacgacaacaucaccggcaccuccacgguggugugcaagcccaucgucaucgagacccagcucuacgugaucguggcccagcuguucgggggcagccacaucuacaagcgggacuccuucgccaacaaguucaucaagauccaggacaucgagauccugaagauccgcaagcccaacgacaucgagaccuucaagaucgagaacaacugguacuucgucguggccgacagcuccaaggccggcuucaccacgaucuacaaguggaacgggaacggcuucuacagccaccagucccuccacgcgugguaccgggacaccgacguggaguaccuggagaucguccgcacgccccagacccugcggaccccgcaccucauccugagcuccagcucccagcgccccgugaucuaccaguggaacaaggccacccagcuguucaccaaccagaccgacauccccaacauggaggacguguacgccgucaagcacuucagcgugaagggggacguguacaucugccucacgcgguucaucggcgacuccaaggucaugaaguggggcgggagcuccuuccaggacauccagcgcaugcccagccggggcagcaugguguuccagccgcugcagaucaacaacuaccaguacgccauccugggguccgacuacagcuucacccaggucuacaacugggacgccgagaaggcgaaguucgugaaguuccaggagcucaacgugcaggcgccccgcuccuucacccacgucagcaucaacaagcggaacuuccuguucgccuccagcuucaagggcaacacccagaucuacaagcacgugaucguggaccuguccgccuga

SEQ ID NO: 32290 - RNA, 1638 nt, Artificial Sequence
  derived and/or modified sequence opt1 from LGI2__Homo_sapiens__NP_060646
auggcccugcgccggggcgggugcggcgcccucgggcugcugcuccugcugcucggcgcggccugccugaucccccgcagcgcccaggugcggcgccuggcccggugcccggcgaccugcuccugcaccaaggagagcaucaucugcgucggguccagcugggugccccgcaucgugcccggcgacaucuccagccucucccuggucaacggcacguucagcgagaucaaggaccggauguucucccaccuccccagccuccagcugcugcuccugaacuccaacagcuucaccaucauccgcgacgacgccuucgccgggcuguuccaccucgaguaccuguucaucgagggcaacaagaucgagaccaucucccggaacgccuuccgcgggcugcgggaccucacccaccugagccuggccaacaaccacaucaaggcgcucccgcgcgacguguucuccgaccuggacagccugaucgagcucgaccugcggggcaacaaguucgagugcgacugcaaggccaaguggcuguaccucuggcugaagaugacgaacuccaccgugagcgacguccugugcaucgggccgcccgaguaccaggagaagaagcucaacgacgugaccuccuucgacuacgagugcaccacgaccgacuucgugguccaccagacccugcccuaccagagcgugagcguggacaccuucaacuccaagaacgacgucuacguggccaucgcccagcccagcauggagaacugcauggugcuggagugggaccacaucgagaugaacuuccgcuccuacgacaacaucacgggccagagcaucgucggcugcaaggccauccucaucgacgaccagguguucguggucguggcgcagcuguucgggggcucccacaucuacaaguacgacgagagcuggaccaaguucgugaaguuccaggacaucgaggucucccggaucagcaagcccaacgacaucgagcuguuccagaucgacgacgagaccuucuucgugaucgccgacuccagcaaggccgggcucuccaccguguacaaguggaacagcaagggcuucuacuccuaccagagccugcacgagugguuccgcgacacggacgccgaguucgucgacaucgacggcaagucccaccugauccucagcucccggagccaggugcccaucauccugcaguggaacaaguccagcaagaaguucgucccccacggggacaucccgaacauggaggacgugcuggccgucaagagcuuccgcaugcagaacacccucuaccugucccugacccgguucaucggcgacagccgcgugaugcgguggaacuccaagcaguucguggagauccaggcgcuccccagccgcggggccaugacccugcagcccuucuccuucaaggacaaccacuaccuggcccugggcagcgacuacacguucucccagaucuaccagugggacaaggagaagcagcuguucaagaaguucaaggagaucuacgugcaggcgccccgcagcuucaccgccgucuccaccgaccggcgcgacuucuucuucgccagcuccuucaaggggaagaccaagaucuucgagcacaucaucguggaccugagccuguga

SEQ ID NO: 32291 - RNA, 1614 nt, Artificial Sequence
  derived and/or modified sequence opt1 from LGI4__Homo_sapiens__NP_644813
augggcggggccggcauccugcuccugcugcucgccggggcgggcguggucguggccuggcggcccccgaaggggaagugcccccugcgcugcagcugcuccaaggacagcgcccugugcgagggcucccccgaccuccccgugagcuucuccccgacccugcugagccucucccugguccgcaccggcgugacgcagcugaaggccgggagcuuccuccggauccccucccugcaccuccugcuguucaccagcaacuccuucagcgugaucgaggacgacgccuucgcgggccugucccaccuccaguaccuguucaucgaggacaacgagaucgggagcaucuccaagaacgcccugcgcggccuccggagccugacccaccugucccucgccaacaaccaccuggagacccugccccgcuuccucuuccgggggcuggacacgcugacccacgucgaccuccgcggcaaccccuuccagugcgacugccgggugcuguggcugcuccaguggaugccgaccgugaacgccagcgucggcaccggggcgugcgccggccccgccucccugagccacaugcagcugcaccaccucgaccccaagacguucaagugccgcgccaucgagcugagcugguuccagaccgugggggaguccgcccugagcguggagcccuucuccuaccagggcgagccgcacaucguccucgcgcagcccuucgccggccggugccugauccugagcugggacuacucccuccagcgcuuccggcccgaggaggagcugcccgccgccagcgugguguccugcaagccgcugguccucgggcccagccuguucgugcuggccgcgcgccucuggggcgggucccagcugugggcccggcccagccccggccugcgccuggccccgacccagacccucgcgccccggcgccugcugcggcccaacgacgccgagcuccuguggcuggaggggcagcccugcuucguggucgccgacgccuccaaggccggcagcacgacccuccugugccgcgacggcccgggguucuacccccaccagucccugcacgccuggcaccgggacaccgacgccgaggcgcucgagcuggacggccgcccccaccuccugcuggccagcgccucccagcgccccgugcuguuccacuggaccgggggccgguucgagcgccggacggacaucccggaggccgaggacguguacgcgacccgccacuuccaggccgggggcgacgucuuccucugccugacccgguacaucggcgacagcauggugaugcgcugggacggguccauguuccggcugcuccagcagcugcccagccgcggcgcccacguguuccagccccugcucaucgcccgggaccagcuggccauccugggguccgacuucgcguucagccagguccuccgccuggagccggacaagggccugcucgagccccugcaggagcuggggccgcccgcccucguggcgccccgggccuucgcccacaucaccauggccggccgccgguuccuguucgccgccugcuucaagggccccacgcagaucuaccagcaccacgagaucgaccugagcgccuga

SEQ ID NO: 32292 - RNA, 1302 nt, Artificial Sequence
  derived and/or modified sequence opt1 from LGMN__Homo_sapiens__NP_005597
augguguggaaggucgccguguuccugagcguggcccucggcaucggggcgguccccaucgacgacccggaggacggcgggaagcacuggguggugaucgucgccggcuccaacgggugguacaacuaccgccaccaggccgacgccugccacgccuaccagaucauccaccggaacggcauccccgacgagcagaucguggugaugauguacgacgacaucgcguacagcgaggacaaccccacccccggcaucgucaucaaccgcccgaacgggaccgacguguaccagggcgugcccaaggacuacacgggggaggacgucacgccccagaacuuccuggccgugcugcggggcgacgccgaggccgugaaggggaucggcuccggcaagguccucaagagcgggccccaggaccacguguucaucuacuucaccgaccacggcuccaccgggauccugguguucccgaacgaggaccugcacgucaaggaccucaacgagaccauccacuacauguacaagcacaagauguaccgcaagaugguguucuacaucgaggcgugcgagagcggcuccaugaugaaccaccuccccgacaacaucaacguguacgccaccaccgccgccaacccccgggagagcuccuacgccugcuacuacgacgagaagcgcagcaccuaccugggcgacugguacuccgucaacuggauggaggacagcgacguggaggaccugacgaaggagacccugcacaagcaguaccaccuggugaagucccacaccaacaccagccacgucaugcaguacgggaacaagacgaucuccaccaugaaggugaugcaguuccagggcaugaagcggaaggcgagcucccccgucccgcucccgcccgugacccaccuggaccugacccccagccccgacgugccccucacgaucaugaagcgcaagcugaugaacaccaacgaccuggaggagucccggcagcucaccgaggagauccagcgccaccuggacgcccggcaccugaucgagaaguccguccgcaagaucgugagccuccuggccgccagcgaggccgagguggagcagcugcucagcgagcgggcgccccugaccgggcacuccugcuaccccgaggcccugcuccacuuccgcacgcacugcuucaacuggcacagcccgaccuacgaguacgcccugcggcaccuguacguccucgugaaccugugcgagaagcccuacccccugcaccgcaucaagcucuccauggaccacgugugccugggccacuacuga

SEQ ID NO: 32293 - RNA, 2856 nt, Artificial Sequence
  derived and/or modified sequence opt1 from LGR4__Homo_sapiens__NP_060960
augcccggcccgcuggggcuccugugcuuccuggcccucggccugcuggggagcgccggccccuccggggcggccccgccccucugcgccgcccccugcagcugcgacggcgaccgccggguggacugcuccggcaaggggcugaccgccguccccgagggccugagcgcguucacccaggcccucgacaucuccaugaacaacaucacgcagcugcccgaggacgccuucaagaacuuccccuuccuggaggagcuccagcuggccgggaacgaccugagcuucauccacccgaaggcgcucuccggccugaaggagcugaaggugcucacccugcagaacaaccagcugaagaccgugcccagcgaggccauccgcgggcucuccgcccugcagagccugcggcucgacgccaaccacaucaccuccguccccgaggacagcuucgagggccuggugcagcugcgccaccucuggcuggacgacaacucccugacggaggugcccguccacccgcucagcaaccugcccacccugcaggcccucacccuggcgcugaacaagaucuccagcauccccgacuucgccuucaccaaccucuccagccugguggugcugcaccuccacaacaacaagauccggucccugagccagcacugcuucgacggccuggacaaccucgagacgcuggaccugaacuacaacaaccucggggaguucccccaggccaucaaggcccugccgagccugaaggagcucggcuuccacuccaacagcaucuccgucauccccgacggggccuucgacggcaacccccugcugcgcaccauccaccuguacgacaacccccucagcuucgugggcaacuccgcguuccacaaccugagcgaccugcacucccucgugauccgcggggccagcaugguccagcaguucccgaaccugaccggcaccgugcaccuggagucccucacgcugaccgggaccaagaucagcuccauccccaacaaccugugccaggagcagaagaugcuccggacccuggaccugagcuacaacaacauccgggaccuccccuccuucaacggcugccacgcccuggaggagaucagccugcagcgcaaccagaucuaccagaucaaggaggggacguuccagggccucaucucccugcggauccuggaccucagccgcaaccugauccacgagauccacucccgggccuucgccacccugggccccaucaccaaccucgacgugagcuucaacgagcugaccuccuucccgacggaggggcugaacggccucaaccagcugaagcuggucgggaacuucaagcucaaggaggcgcuggccgccaaggacuucgugaaccugcgcagccucagcgugcccuacgccuaccagugcugcgccuucuggggcugcgacuccuacgcgaaccugaacaccgaggacaacagccugcaggaccacuccgucgcccaggagaaggggaccgccgacgccgcgaacgugaccagcacgcucgagaacgaggagcacucccagaucaucauccacugcacccccagcaccggcgccuucaagcccugcgaguaccugcugggcuccuggaugauccggcucaccgugugguucaucuuccuggucgcccuguucuucaaccuccuggugauccugacgaccuucgccagcugcaccucccucccgagcuccaagcuguucaucgggcugaucagcguguccaaccucuucaugggcaucuacaccgggauccugacguuccuggacgccgucagcuggggccgcuucgcggaguucgggaucuggugggagaccggcuccggcugcaagguggccggguuccucgccgucuucagcuccgagagcgccaucuuccugcugaugcucgccaccguggagcggagccuguccgcgaaggacaucaugaagaacggcaagagcaaccaccugaagcaguuccgcguggccgcccuccuggccuuccugggggccaccgucgcgggcugcuucccccucuuccaccggggcgaguacuccgccagcccccugugccugccguuccccacgggggagacccccucccucggcuucaccgugacccuggugcugcucaacagccuggccuuccugcucauggccgucaucuacaccaagcuguacugcaaccuggagaaggaggaccucuccgagaacagccaguccagcaugaucaagcacguggcguggcugaucuucacgaacugcaucuucuucugccccguggccuucuucuccuucgccccgcugaucaccgccaucagcaucucccccgagaucaugaaguccgucacccucaucuucuucccccugcccgccugccugaacccggugcucuacguguucuucaaccccaaguucaaggaggacuggaagcugcugaagcgccgggucaccaagaaguccgggagcgugagcgugagcaucuccagccagggcgggugccucgagcaggacuucuacuacgacugcggcauguacagccaccuccagggcaaccugacggucugcgacugcugcgaguccuuccugcugaccaagcccgugagcugcaagcaccugaucaagucccacagcugccccgcgcucgccguggccuccugccagcgcccggagggguacuggagcgacugcggcacccaguccgcccacagcgacuacgccgacgaggaggacuccuucgucagcgacuccagcgaccaggugcaggcgugcgggcgcgccugcuucuaccagucccggggcuucccccuggugcgcuacgccuacaaccugccccgggucaaggacuga

SEQ ID NO: 32294 - RNA, 2652 nt, Artificial Sequence
  derived and/or modified sequence opt1 from LGR5__Homo_sapiens__NP_001264155
auggacaccagccgccugggcgugcuccugucccugcccguccuccugcagcuggccaccgggggcagcuccccgcggagcggggugcuccugcgcggcugccccacgcacugccacugcgagcccgacgggcggaugcugcuccgcguggacugcuccgaccugggccugagcgagcuccccuccaaccugagcgucuucaccuccuaccuggaccucagcaugaacaacaucucccagcugcugccgaacccccuccccagccugcgguuccuggaggagcuccgccuggccggcaacgcgcugaccuacauccccaagggggccuucaccggccucuacucccugaaggugcugaugcuccagaacaaccagcugcggcacgugccgacggaggcccugcagaaccuccgcagccugcagucccugcggcucgacgccaaccacaucagcuacgucccgcccuccugcuucagcgggcugcacucccugcgccaccucuggcuggacgacaacgcccugaccgagauccccgugcaggcguuccggagccucagcgcccugcaggccaugacccuggcccucaacaagauccaccacauccccgacuacgcguucggcaaccuguccagccuggugguccuccaccuccacaacaaccgcauccacucccuggggaagaagugcuucgacggccugcacagccuggagacccuggaccugaacuacaacaaccucgacgaguuccccacggccauccggacccuguccaaccugaaggagcuccacuucuacgacaaccccauccaguucgugggccgcagcgccuuccagcaccuccccgagcugcggacccugacccugaacggggccucccagaucacggaguucccggaccugaccggcaccgccaaccucgagagccugacccugacgggggcgcagaucuccagccucccccagaccgugugcaaccagcugcccaaccugcagguccucgaccuguccuacaaccugcucgaggaccugcccagcuucuccgugugccagaagcugcagaagaucgaccuccgccacaacgagaucuacgagaucaagguggacaccuuccagcagcugcugagccuccggucccugaaccuggccuggaacaagaucgccaucauccacccgaacgccuucagcacccuccccucccugaucaagcuggaccucagcuccaaccugcugagcagcuuccccaucacgggccuccacggccugacccaccugaagcucaccgggaaccacgcccugcagucccugaucagcuccgagaacuuccccgagcucaaggucaucgagaugccguacgcguaccagugcugcgccuucggcgugugcgagaacgccuacaagaucagcaaccaguggaacaagggggacaacuccagcauggacgaccugcacaagaaggacgccggcauguuccaggcccaggacgagcgcgaccuggaggacuuccuccuggacuucgaggaggaccugaaggcgcuccacuccgugcagugcagccccucccccgggcccuucaagccgugcgagcaccuccuggacggcuggcugauccggaucggcgucuggaccaucgccgugcuggcccugacgugcaacgcccucgugaccagcaccgucuuccgcagcccccuguacaucucccccaucaagcugcucaucggggugaucgccgcggugaacaugcugaccggcgucuccagcgccgugcuggccggggucgacgccuucacguucggcuccuucgcgcggcacggggccuggugggagaacggcgugggcugccacgugaucggguuccucagcaucuucgccuccgagagcagcgucuuccugcugacccucgccgcccuggagcgcggcuucuccgugaaguacagcgcgaaguucgagaccaaggccccguucuccagccugaaggugaucauccuccugugcgcccugcucgcccugaccauggccgcggucccccugcucgggggcuccaaguacggggccagcccccugugccugccccucccguucggcgagcccuccacgaugggcuacaugguggcccugauccugcucaacagccugugcuuccugaugaugaccaucgccuacaccaagcucuacugcaaccuggacaagggggaccuggagaacaucugggacugcuccauggugaagcacaucgcccuccugcuguucaccaacugcauccucaacugccccgucgcguuccugagcuucuccagccugaucaaccucacguucaucucccccgaggugaucaaguucauccugcugguggucgugccgcuccccgccugccugaacccccugcucuacauccuguucaacccccacuucaaggaggaccuggugagccugcgcaagcagaccuacgucuggacccgguccaagcacccgagccucauguccaucaacagcgacgacguggagaagcaguccugcgacagcacccaggcccuggugaccuucacgagcuccagcaucaccuacgaccugccgcccuccagcguccccucccccgccuaccccgugaccgagagcugccaccucuccagcguggcguucguccccugccuguga

SEQ ID NO: 32295 - RNA, 2904 nt, Artificial Sequence
  derived and/or modified sequence opt1 from LGR6__Homo_sapiens__NP_001017403
augcccagcccgcccggccugcgcgcccucuggcugugcgccgcccugugcgccucccggcgcgccgggggcgcgccccagcccgggccgggccccaccgccugccccgcgcccugccacugccaggaggacgggaucaugcucagcgccgacugcuccgagcugggccugagcgccgugccgggcgaccucgacccccugaccgccuaccuggaccucuccaugaacaaccugacggagcugcagcccgggcuguuccaccaccuccgguuccuggaggagcuccgccugagcggcaaccaccugucccacauccccgggcaggcguucagcggccucuacucccugaagauccugaugcuccagaacaaccagcucgggggcaucccggccgaggcccugugggagcugcccagccugcagucccugcggcucgacgccaaccugaucagccugguccccgagcgcuccuucgagggccucagcucccugcggcaccuguggcucgacgacaacgcccugaccgagauccccgugcgcgcgcugaacaaccucccggcccugcaggccaugacccuggcccucaaccggaucagccacauccccgacuacgccuuccagaaccugaccucccuggugguccuccaccuccacaacaaccgcauccagcaccuggggacgcacagcuucgagggccugcacaaccuggagacccuggaccucaacuacaacaagcugcaggaguuccccguggcgauccggacccuggggcgccugcaggagcucggcuuccacaacaacaacaucaaggccauccccgagaaggccuucaugggcaacccgcugcugcagaccauccacuucuacgacaaccccauccaguucguggggcgguccgccuuccaguaccuccccaagcugcacacgcugagccucaacggcgccauggacauccaggaguuccccgaccugaaggggaccaccagccuggagauccucacccugacgcgcgcgggcauccggcugcucccguccgggaugugccagcagcugccccgccugcggguccucgagcugagccacaaccagaucgaggagcugcccucccuccaccgcugccagaagcuggaggagaucggccugcagcacaaccggaucugggagaucggcgccgacaccuucagccagcucuccagccugcaggcccuggaccucuccuggaacgccauccgcagcauccaccccgaggccuucuccacccugcacagccuggugaagcucgaccugaccgacaaccagcugacgacccucccgcuggcggggcugggcgggcucaugcaccugaagcugaagggcaaccucgcccugucccaggccuucagcaaggacuccuuccccaagcugcggauccucgaggugcccuacgccuaccagugcugcccguacgggaugugcgcgagcuucuucaaggccuccggccagugggaggccgaggaccugcaccuggacgacgaggagagcuccaagcgcccccucggccugcuggcccgccaggccgagaaccacuacgaccaggaccucgacgagcugcagcuggagauggaggacagcaagccccaccccuccguccagugcagcccgacccccgggcccuucaagcccugcgaguaccucuucgagagcuggggcauccggcuggcggugugggccaucgugcugcucuccguccugugcaacgggcuggugcuccugaccguguucgccggcgggccggucccccugccgcccgugaaguucguggucggcgccaucgccggcgcgaacacgcucaccgggaucagcugcggccugcuggccuccguggacgcccucaccuucgggcaguucagcgaguacggcgcccgcugggagaccggccuggggugccgggccacgggcuuccuggcggugcucggguccgaggccagcguccugcugcucacccuggccgccgugcagugcuccgugagcgucuccugcgugcgcgcguacggcaagagccccucccuggggagcguccgggccggcgugcucggcugccuggcccuggccgggcucgccgcggcccugccccuggccuccgugggcgaguacggggccagcccccucugccugcccuacgccccgcccgagggccagcccgcggcccugggguucaccgucgcccucgugaugaugaacuccuucugcuuccugguggucgccggcgccuacaucaagcuguacugcgaccucccccgcggcgacuucgaggcggugugggacugcgccauggugcggcacgucgccuggcugaucuucgccgacgggcugcucuacugcccgguggcguuccugagcuucgccuccaugcugggccucuuccccgugacccccgaggccgucaagagcgugcugcuggugguccucccccugccggccugccugaacccccuccuguaccugcuguucaacccccacuuccgcgacgaccuccggcgccugcggccgcgcgccggggacagcggcccccuggcguacgccgccgccggggagcucgagaaguccagcugcgacuccacgcaggcccugguggcguucagcgacguggaccugauccucgaggccuccgaggccggccggccgcccggccuggagaccuacggguuccccagcgucacccugaucuccugccagcagcccggcgcgccccgccucgaggggagccacugcguggagcccgagggcaaccacuucgggaacccgcagcccuccauggacggcgagcugcugcuccgggccgagggcagcacccccgccgggggcgggcuguccggcggcgggggcuuccagcccagcgggcuggccuucgccucccacguguga

SEQ ID NO: 32296 - RNA, 627 nt, Artificial Sequence
  derived and/or modified sequence opt1 from LGSN__Homo_sapiens__NP_001137412
augaacaacgaggaggaccugcuccaggaggacagcacccgcgacgagggcaacgagaccgaggccaacuccaugaacacgcugcggcgcacccggaagaaggugaccaagcccuacgucugcagcaccgaggugggggagacggacauguccaacagcaacgacugcaugcgcgacuccagccagauccugaccccgccccagcucuccagccggaugaagcacauccgccaggccauggcgaagaaccggcugcaguucgugcgcuucgaggccaccgaccugcacggcgucucccggagcaagaccauccccgcccacuucuuccaggagaaggugucccacggggugugcaugccccgcggcuaccucgaggucaucccgaaccccaaggacaacgagaugaacaacauccgggccacgugcuucaacagcgacaucgugcugaugcccgagcuguccaccuuccgcgugcuccccugggccgaccggaccgcgcgcgucaucugcgacaccuucacggugaccgugagcgggauguccaucggccggaagaccugcagcgccgcccugcuggagcucuccagcucccgcagccugggcaagaacggguggcaggacagcuga

SEQ ID NO: 32297 - RNA, 426 nt, Artificial Sequence
  derived and/or modified sequence opt1 from LHB__Homo_sapiens__NP_000885
auggagaugcugcagggccuccugcugcuccugcugcucagcaugggcggggccugggccucccgcgagccccugcggccguggugccaccccaucaacgcgauccuggccguggagaaggaggggugccccgucugcaucaccgugaacaccacgaucugcgccggcuacugccccaccaugaugcgcgugcuccaggccguccugccgccccugccccagguggugugcaccuaccgggacguccgcuucgagagcauccggcuccccgggugcccgcgcggcguggaccccguggucuccuuccccguggcccugagcugccggugcggccccugccgccgguccaccagcgacugcgggggcccgaaggaccacccccugacgugcgaccacccccagcucuccgggcugcuguuccucuga

SEQ ID NO: 32298 - RNA, 2100 nt, Artificial Sequence
  derived and/or modified sequence opt1 from LHCGR__Homo_sapiens__NP_000224
augaagcagcgcuucagcgcccugcagcuccugaagcugcuccugcugcuccagcccccgcugccccgggcccugcgcgaggcgcucugccccgagcccugcaacugcgugccggacggcgcccugcggugccccgggcccaccgccggccugacccgccucucccuggccuaccugcccgucaaggugaucccgagccaggccuuccgggggcucaacgaggugaucaagaucgagaucucccagaucgacagccuggagcgcaucgaggcgaacgccuucgacaaccugcucaaccuguccgagauccugauccagaacacgaagaaccuccgguacaucgagcccggcgccuucaucaaccugccccgccugaaguaccucagcaucugcaacaccgggauccggaaguuccccgacgucaccaagguguucuccagcgaguccaacuucauccuggagaucugcgacaaccugcacaucaccacgaucccgggcaacgccuuccagggcaugaacaacgagagcgugacccucaagcuguacgggaacggcuucgaggagguccagucccacgcguucaacgggaccacccugacgagccucgagcugaaggagaacgugcaccuggagaagaugcacaacggcgccuuccgcggggccaccggccccaagacccucgacaucuccagcaccaagcugcaggcccugcccuccuacggccucgagagcauccagcggcugaucgccacguccagcuacucccugaagaagcuccccagccgcgagaccuucgugaaccugcuggaggcgacccucaccuacccgagccacugcugcgccuuccggaaccugcccacgaaggagcagaacuucucccacagcaucuccgagaacuucagcaagcagugcgaguccaccguccgcaaggugaacaacaagacccuguacagcuccaugcucgccgagagcgagcuguccgggugggacuacgaguacggcuucugccugcccaagacgccccggugcgccccggagcccgacgccuucaaccccugcgaggacaucaugggguacgacuuccuccgcgugcugaucuggcugaucaacauccuggcgaucaugggcaacaugaccguccucuucgugcugcugaccagccgguacaagcucaccgugccccgcuuccugaugugcaaccuguccuucgccgacuucugcaugggccucuaccugcugcucaucgccagcgucgacucccagaccaaggggcaguacuacaaccacgccaucgacuggcagacgggcagcgggugcuccaccgccggcuucuucaccguguucgcgagcgagcuguccguguacacccugacggucaucacccucgagcgguggcacaccaucaccuacgccauccaccuggaccagaagcugcgccuccggcacgccauccugaucaugcucgggggcuggcuguucagcucccugaucgccaugcugccgcucgugggcgugagcaacuacaugaaggucagcaucugcuuccccauggacguggagacgacccugucccagguguacauccugaccauccucauccugaacgucguggccuucuucaucaucugcgcgugcuacaucaagaucuacuucgccguccgcaaccccgagcugauggccaccaacaaggacacgaagaucgccaagaagauggcgauccucaucuucaccgacuucacgugcauggcccccaucagcuucuucgccaucuccgccgccuucaaggugccgcugaucaccgugaccaacagcaagguccugcucgugcuguucuaccccaucaacuccugcgcgaaccccuuccuguacgccaucuucaccaagaccuuccagcgcgacuucuuccuccugcugagcaaguucgggugcugcaagcggcgcgccgagcucuaccggcgcaaggacuucuccgccuacaccagcaacugcaagaacggcuucaccggguccaacaagccgagccaguccacgcugaagcugagcacccuccacugccagggcaccgcccugcuggacaagacccgguacacggagugcuga

SEQ ID NO: 32299 - RNA, 603 nt, Artificial Sequence
  derived and/or modified sequence opt1 from LHFP__Homo_sapiens__XP_011533163
auggccagcucccugaccugcaccggcgugaucugggcccuccugagcuuccugugcgcggccacguccugcgucggguucuucaugcccuacuggcucuggggcagccagcuggggaagccgguguccuucggcaccuuccgccggugcagcuaccccgugcacgacgagucccgccagaugauggucaugguggaggagugcgggcgguacgccagcuuccagggcauccccuccgccgaguggcgcaucugcaccaucgugaccggccuggggugcggccuccugcugcucgucgcccugacggcgcugauggggugcugcgugagcgaccucaucucccggaccgugggccgcgucgccgggggcauccaguuccugggcgggcugcucaucggcgccgggugcgcccuguacccccugggcugggacagcgaggaggugcggcagaccugcggcuacaccuccgggcaguucgaccucggcaagugcgagaucgggugggcguacuacugcacgggcgccggggccaccgccgccaugcugcugugcaccuggcucgcgugcuucagcggcaagaagcagaagcacuacccguacuga

SEQ ID NO: 32300 - RNA, 732 nt, Artificial Sequence
  derived and/or modified sequence opt1 from LHFPL1__Homo_sapiens__XP_011529245
auggugaccuacugcaucuggugcugcgaccccacccaccucccgauccccgccgagaagcccgucacgaugcgcagcucccugaccauggugggcacccugugggccuuccugagccucgugaccgcggucacguccagcaccuccuacuuccugcccuacuggcuguucgggagccagaugggcaagccgguguccuucagcaccuuccggcgcugcaacuaccccgugcggggcgagggccacucccucaucauggucgaggagugcgggcgcuacgccagcuucaacgccauccccucccuggccuggcagaugugcaccguggugacgggcgccggcugcgcgcugcuccugcuggucgcccucgccgccgugcuggggugcugcauggaggagcugaucagccggaugaugggccgcugcaugggggcggcccaguucgugggcgggcuccugaucuccagcggcugcgcccuguacccccucggcuggaacuccccggagaucaugcagaccugcgggaacgucagcaaccaguuccagcuggggaccugccggcuggggugggccuacuacugcgccggcggcggggcggccgccgccaugcucaucugcaccuggcuguccugcuucgccggccgcaaccccaagcccgugauccugguggagagcaucaugcggaacacgaacuccuacgcgauggagcucgaccacugccugaagcccuga

SEQ ID NO: 32301 - RNA, 687 nt, Artificial Sequence
  derived and/or modified sequence opt1 from LHFPL2__Homo_sapiens__NP_005770
augugccacgugaucgugaccugccgcagcaugcuguggacccuccuguccaucgucguggccuucgccgagcugaucgcguucaugagcgccgacuggcucaucggcaaggcccggucccgcgggggcgucgagcccgccgggccgggcgggggcagccccgagcccuaccaccccacgcugggcaucuacgcccggugcauccgcaacccgggggugcagcacuuccagcgggacacccugugcggccccuacgcggaguccuucggggagaucgccagcggcuucuggcaggccaccgccaucuuccucgcgguggggaucuucauccugugcauggucgcccugguguccguguucaccaugugcguccagagcaucaugaagaaguccaucuucaacgugugcggccuccugcagggcaucgccgggcuguuccucauccugggccugauccucuaccccgccggguggggcugccagaaggccaucgacuacugcggccacuacgcgagcgccuacaagcccggggacugcucccugggcugggccuucuacacggccaucgggggcaccgugcugaccuucaucugcgccgucuucagcgcgcaggccgagaucgccaccuccagcgacaaggugcaggaggagaucgaggaggggaagaaccucaucugccugcuguga

SEQ ID NO: 32302 - RNA, 711 nt, Artificial Sequence
  derived and/or modified sequence opt1 from LHFPL3__Homo_sapiens__NP_945351
augcccggcgccgccgcggccgccgccgccgcggccgccgccaugcugccggcgcaggaggccgccaagcucuaccacaccaacuacgugcgcaacagccgggccaucgggguccugugggccaucuucaccaucugcuucgcgaucgugaacguggucugcuucauccagcccuacuggaucggcgacgggguggacacgccccaggccggcuacuucgggcuguuccacuacugcaucggcaacggcuucucccgcgagcugaccugccgggggagcuucaccgacuucuccacccuccccagcggcgccuucaaggccgccuccuucuucaucgggcugagcaugaugcucaucaucgcgugcaucaucugcuucacgcuguucuucuucugcaacaccgccaccguguacaagaucugcgccuggaugcagcugaccuccgccgccugccucguccugggcugcaugaucuucccggacgggugggacagcgacgaggugaagcgcaugugcggcgagaagacggacaaguacacccugggcgcgugcuccgugcggugggccuacauccucgccaucaucgggauccuggacgcccugauccucagcuuccuggccuucguccugggcaaccgccaggacucccucauggcggaggagcugaaggccgagaacaaggugcugcucagccaguacucccuggaguga

SEQ ID NO: 32303 - RNA, 744 nt, Artificial Sequence
  derived and/or modified sequence opt1 from LHFPL4__Homo_sapiens__XP_011531995
augcugcccagccaggaggccuccaagcucuaccacgagcacuacaugcgcaacagccgggccaucggcgugcugugggcgaucuucaccaucugcuucgccaucaucaacgucgugguguucauccagccguacugggucggggacuccgugagcacccccaagcccggcuacuucgggcuguuccacuacugcgugggcuccgggcucgccggccgcgagcugacgugccggggcagcuucaccgacuucuccaccauccccagcuccgccuucaaggccgcggccuucuucguccugcucagcauggugcugauccuggggugcaucacgugcuucucccucuucuucuucugcaacaccgccaccguguacaagaucugcgccuggaugcagcugcuggcggcccucugccugguccugggcugcaugaucuucccggacgggugggacgccgagaccauccgcgacaugugcggcgccaagaccgggaaguacagccucggcgacugcuccgugcggugggccuacauccuggcgaucaucggcauccugaacgcccucauccugagcuuccuggccuucgugcucgggaaccgccagacggaccugcugcaggaggagcucaagcccgagaacaaggacuucgucggcuccaccgugagcuccgugcugcggcccgggggcgacgucagcggcuggggcgugcugcccugcccgguggcccacucccaggggcccuga

SEQ ID NO: 32304 - RNA, 660 nt, Artificial Sequence
  derived and/or modified sequence opt1 from LHFPL5__Homo_sapiens__NP_872354
auggugaagcugcuccccgcccaggaggccgcgaagaucuaccacaccaacuacguccgcaacagccgggccgugggcgugaugugggggacccugacgaucugcuucuccguccuggugauggcccucuucauccagccguacuggaucggcgacagcgugaacacgccccaggccggguacuucggccuguucuccuacugcgucgggaacgugcugagcuccgagcucaucugcaagggcggcccccuggacuucagcuccauccccagccgcgccuucaagaccgcgauguucuucguggcccuggggauguuccucaucaucggcuccaucaucugcuucagccuguucuucaucugcaacaccgccaccgucuacaagaucugcgccuggaugcagcuggcggccgccaccgggcucaugaucggcugccugguguacccggacgggugggacuccagcgaggugcggcgcaugugcggcgagcagaccggcaaguacacccuggggcacugcacgauccggugggccuucaugcucgccauccuguccaucggcgacgcgcugauccucagcuuccuggccuucguccugggguaccgccaggacaagcuccugcccgacgacuacaaggccgacggcaccgaggagguguga

SEQ ID NO: 32305 - RNA, 633 nt, Artificial Sequence
  derived and/or modified sequence opt1 from LHPP__Homo_sapiens__NP_001161352
auggcccccuggggcaagcgccuggccggggugcggggcguccuccuggacaucagcggggugcuguacgacuccggcgccgggggcggcaccgcgaucgccgggagcguggaggccgucgcccgccucaagcggucccgccugaaggugcgguucugcaccaacgagagccagaagucccgcgcggagcuggugggccagcuccagcggcugggguucgacaucagcgagcaggaggucacggccccggcccccgccgcgugccagauccugaaggagcagggccuccgccccuaccugcugauccacgacggggugcgguccgaguucgaccagaucgacaccagcaaccccaacugcguggucaucgccgacgccggcgaguccuucagcuaccagaacaugaacaacgccuuccaggugcucauggagcuggagaagccggugcugaucucccucggcaaggggcgcuacuacaaggagaccagcggccugaugcuggacgucgggcccuacaugaaggcccucgaguacgcgugcggcaucaaggccgagguggugggcaagcccucccccgaguucuucaagagcgcccugcaggccaucggggucgaggcccaccaggcgcaguga

SEQ ID NO: 32306 - RNA, 1221 nt, Artificial Sequence
  derived and/or modified sequence opt1 from LHX1__Homo_sapiens__XP_011545112
auggugcacugcgccggcugcaagcgccccauccuggaccgguuccuccugaacguccuggaccgcgccuggcacgugaagugcgugcagugcugcgagugcaagugcaaccucaccgagaagugcuucagccgggaggggaagcuguacugcaagaacgacuucuuccgcugcuucggcaccaagugcgcggggugcgcccagggcaucucccccagcgaccugguccggcgcgcccgguccaagguguuccaccucaacugcuucacgugcaugaugugcaacaagcagcugagcaccggggaggagcuguacaucaucgacgagaacaaguucgugugcaaggaggacuaccucuccaacagcuccgucgccaaggagaacagccugcacuccgccaccaccggcagcgaccccucccugagccccgacucccaggaccccagccaggacgacgcgaaggacuccgagagcgccaacguguccgacaaggaggccggcagcaacgagaacgacgaccagaaccucggggccaagcgccggggcccgcgcacgaccaucaaggcgaagcagcuggagacccugaaggccgccuucgccgccacccccaagcccacgcggcacauccgcgagcagcucgcgcaggagaccgggcugaacaugcgggugauccaggucugguuccagaaccgccgguccaaggagcgccggaugaagcagcugagcgcccucggcgcccgccggcacgccuucuuccgcagcccccggcgcaugcgcccgcugguggaccggcuggagcccggggagcucauccccaacggccccuucuccuucuacggcgacuaccagagcgaguacuacgggccgggcgggaacuacgacuucuucccccagggcccgcccuccagccaggcccagacccccguggaccugcccuucguccccuccagcggccccuccgggaccccgcugggcgggcucgagcacccccugcccggccaccaccccagcuccgaggcgcagcgcuucacggacauccuggcccacccgcccggggacagccccucccccgagccgagccuccccggcccccugcacuccaugagcgccgagguguucggcccguccccgcccuucagcucccugagcgugaacgggggcgccuccuacgggaaccaccucagccacccgcccgagaugaacgaggccgcggucugguga

SEQ ID NO: 32307 - RNA, 1221 nt, Artificial Sequence
  derived and/or modified sequence opt1 from LHX2__Homo_sapiens__NP_004780
augcuguuccacagccucuccggccccgaggugcacggggucaucgacgagauggaccgccgggccaagagcgaggccccggcgaucuccagcgccaucgaccgcggcgacaccgagaccacgaugcccuccaucagcuccgaccgggccgcccugugcgccgggugcggcgggaagaucagcgaccgcuacuaccugcucgcgguggacaagcaguggcacaugcggugccugaagugcugcgagugcaagcugaaccucgaguccgagcugaccugcuucagcaaggacggcuccaucuacugcaaggaggacuacuaccgccgguucagcgugcagcgcugcgcccggugccaccugggcaucuccgccagcgagauggucaugcgcgcccgggaccucguguaccaccugaacugcuucacgugcacgaccugcaacaagaugcugaccaccggggaccacuucggcaugaaggacucccucguguacugccgccugcacuucgaggcgcugcuccagggggaguaccccgcccacuucaaccacgccgacgucgccgccgcggccgccgccgccgcggccgccaagagcgccggccugggggccgcgggcgccaacccccugggccucccguacuacaacggggugggcaccgugcagaaggggcggccccgcaagcggaagucccccggccccggcgccgaccuggccgccuacaacgcggcccugagcugcaacgagaacgacgccgagcaccucgaccgcgaccagccguaccccuccagccagaagaccaagcggaugcgcaccagcuucaagcaccaccagcugcggaccaugaaguccuacuucgccaucaaccacaaccccgacgcgaaggaccugaagcagcucgcccagaagaccgggcugacgaagcgcguccuccaggugugguuccagaacgcccgggccaaguuccgccgcaaccugcugcggcaggagaacaccggcguggacaagagcaccgacgccgcgcugcagaccgggacgcccuccggcccggccagcgagcucuccaacgccagccugucccccagcuccacccccaccacccugacggaccucaccagccccacccugccgaccgucacguccgugcugaccagcgugcccgggaaccucgagggccacgagccccacucccccagccagaccacccugacgaaccuguucuga

SEQ ID NO: 32308 - RNA, 1209 nt, Artificial Sequence
  derived and/or modified sequence opt1 from LHX3__Homo_sapiens__NP_055379
auggaggcccgcggcgagcuggggcccgcccgggagagcgcgggcggggaccuccugcuggcccuccuggcccgccgggccgaccugcgccgggagaucccgcucugcgccggcugcgaccagcacauccuggaccgcuucauccugaaggcgcucgaccggcacuggcacuccaagugccugaagugcagcgacugccacacgccccuggccgagcgcugcuucucccgcggggagagcguguacugcaaggacgacuucuucaagcgguucggcaccaagugcgccgccugccagcucggcaucccgcccacccaggucgugcggcgcgcgcaggacuucguguaccaccuccacugcuucgccugcgucgugugcaagcggcagcuggccaccggggacgaguucuaccugauggaggacucccgccuggugugcaaggccgacuacgagaccgccaagcagcgggaggcggaggccaccgccaagcgcccccggacgaccaucaccgccaagcagcuggagacccucaagagcgccuacaacacgucccccaagcccgcgcgccacguccgggagcagcugagcuccgagaccggccuggacaugcgcguggugcaggucugguuccagaaccggcgcgccaaggagaagcgccucaagaaggacgccgggcggcagcgcuggggccaguacuuccggaacaugaagcgcagccgcgggggcuccaagagcgacaaggacuccgugcaggagggccaggacagcgacgccgagguguccuuccccgacgagccgagccuggccgagauggggcccgcgaacggccuguacgggucccucggcgagcccacccaggcccugggccggcccagcggggcccugggcaacuucucccucgagcacgggggccuggccgggccggagcaguaccgggagcugcgccccggcagccccuacggcgugcccccgagccccgccgcgccccagucccuccccgggccgcagccccugcugagcucccucgucuaccccgacaccagccugggccuggugcccuccggggccccgggcgggcccccgcccaugcggguccucgccggcaacggccccagcuccgaccugagcacgggguccagcggcggguaccccgacuuccccgccuccccggcgagcuggcuggacgagguggaccacgcccaguucuga

SEQ ID NO: 32309 - RNA, 1173 nt, Artificial Sequence
  derived and/or modified sequence opt1 from LHX4__Homo_sapiens__NP_203129
augaugcagagcgccaccgugcccgccgagggcgcggucaaggggcugcccgagaugcucggcgugcccaugcagcagaucccccagugcgccgggugcaaccagcacauccuggacaaguucauccugaaggugcucgaccgccacuggcacuccagcugccugaagugcgccgacugccagaugcagcuggccgaccggugcuucucccgcgccggcagcgucuacugcaaggaggacuucuucaagcgguucgggaccaagugcacggcgugccagcagggcaucccgcccacccagguggugcgcaaggcccaggacuucgucuaccaccuccacugcuucgccugcaucaucugcaaccggcagcuggccaccggcgacgaguucuaccugauggaggacgggcgccucgugugcaaggaggacuacgagaccgcgaagcagaacgacgacuccgaggccggcgccaagcggccccgcacgaccaucaccgccaagcagcuggagacccugaagaacgccuacaagaacagccccaagcccgcgcggcacgugcgcgagcagcucuccagcgagacggggcuggacaugcgggucguccaggugugguuccagaaccgccgggccaaggagaagcgccugaagaaggacgccggccggcaccgcugggggcaguucuacaaguccgugaagcggagccgcggcuccagcaagcaggagaaggaguccagcgccgaggacugcggcguguccgacagcgagcucuccuuccgggaggaccagauccugagcgagcuggggcacaccaaccgcaucuacggcaacgugggggacgucaccggcggccagcucaugaacggguccuucagcauggacggcaccgggcagagcuaccaggaccugcgggacggcuccccguacgggaucccccagagccccuccagcaucuccagccugcccucccacgccccgcuccugaacggccuggacuacacgguggacagcaaccucggcaucaucgcgcacgccgggcagggcgugucccagacccugcgcgccauggccgggggccccaccagcgacaucuccaccgggagcuccgucggcuaccccgacuuccccacgagcccgggcuccuggcuggacgagauggaccacccgcccuucuga

SEQ ID NO: 32310 - RNA, 1209 nt, Artificial Sequence
  derived and/or modified sequence opt1 from LHX5__Homo_sapiens__NP_071758
augauggugcacugcgccggcugcgagcgccccauccuggaccgguuccuccugaacguccuggaccgcgccuggcacaucaagugcgugcagugcugcgagugcaagaccaaccucagcgagaagugcuucucccgggaggggaagcuguacugcaagaacgacuucuuccgccgguucggcaccaagugcgcggggugcgcccagggcaucagcccguccgaccuggugcgcaaggcccggagcaaggucuuccaccucaacugcuucacgugcauggugugcaacaagcagcuguccaccggggaggagcuguacgugaucgacgagaacaaguucgucugcaaggacgacuaccucagcuccagcucccugaaggagggcagccugaacuccgugagcuccugcaccgaccgcagccucucccccgaccugcaggacgcccugcaggacgaccccaaggagaccgacaacagcacguccagcgacaaggagaccgccaacaacgagaacgaggagcagaacuccggcaccaagcggcgcgggccccggaccacgaucaaggcgaagcagcucgagacccugaaggccgccuucgccgcgaccccgaagcccacccgccacauccgggagcagcuggcccaggagacgggccucaacaugcgcgugauccaggucugguuccagaaccggcgcagcaaggagcggcgcaugaagcagcugagcgcccugggggcccggcgccacgccuucuuccggagcccccgccgcaugcggccccucggcgggcgccuggacgaguccgagaugcugggcuccaccccguacaccuacuacggcgacuaccagggggacuacuacgcgcccggcagcaacuacgacuucuucgcccacgggccgcccucccaggcccagagccccgccgacuccagcuuccucgccgcguccggccccggcagcacgccccugggggcccuggagcccccgcucgccggcccccacgccgccgacaacccccgguucaccgacaugaucucccaccccgacaccccgagccccgagcccgggcugcccggcacccugcacccgaugcccggggagguguucuccggcggccccagcccgcccuuccccauguccgggaccagcggcuacuccgggccccucagccacccgaaccccgagcugaacgaggcggccgugugguga

SEQ ID NO: 32311 - RNA, 1101 nt, Artificial Sequence
  derived and/or modified sequence opt1 from LHX6__Homo_sapiens__NP_001229262
augcgccggggccugugccgccggagcgccgagaaccccgacgccgggccggugauggcccagcccggcuccgggugcaaggccaccacccgcugccucgagggcacggccccgcccgccauggcccagagcgacgcggaggcccuggccggggcccuggacaaggacgagggccaggcgucccccugcacccccagcacccccuccgucugcagcccgcccuccgccgccagcuccgugcccagcgccggcaagaacaucugcuccagcugcgggcucgagauccuggaccgguaccugcucaaggugaacaaccugaucuggcacguccgcugccuggagugcuccgugugccggaccagccuccgccagcagaacuccugcuacaucaagaacaaggagaucuucugcaagauggacuacuucagccgguucggcacgaagugcgcccgcugcgggcggcagaucuacgcguccgacugggugcgccgggcccgcggcaacgccuaccaccuggccugcuucgccugcuucagcugcaagcggcagcuguccaccggggaggaguucggccucgucgaggagaaggugcugugccgcauccacuacgacaccaugaucgagaaccugaagcgggcggccgagaacggcaacgggcucacccuggagggcgccgugcccagcgagcaggacagccagcccaagccggccaagcgcgcccggacguccuucaccgcggagcagcugcaggucaugcaggcccaguucgcccaggacaacaaccccgacgcccagacccuccagaagcuggccgacaugaccgggcugagccgccgggugauccaggugugguuccagaacugccgcgcgcgccacaagaagcacacgccccagcaccccgucccgcccuccggcgccccgcccagccggcuccccuccgcccugagcgacgacauccacuacacccccuucuccagccccgagcgcgcccggauggugacccugcacggcuacaucgagucccaccccuucagcgugcucacccugccggcgcugccccaccuccccgucggggcgccccagcugccgcugucccgcuga

SEQ ID NO: 32312 - RNA, 1167 nt, Artificial Sequence
  derived and/or modified sequence opt1 from LHX9__Homo_sapiens__NP_001014434
augcugaacggcaccacccucgaggccgccaugcuguuccacgggaucagcggcgggcacauccagggcaucauggaggagauggagcgccgguccaagacggaggcgcgccuggccaagggggcccagcucaacggccgggacgccggcaugccgccccugagccccgagaagcccgcccugugcgcggggugcggcgggaagaucuccgaccgcuacuaccuccuggccguggacaagcaguggcaccuccggugccucaagugcugcgagugcaagcuggcccuggagagcgagcugaccugcuucgccaaggacggcuccaucuacugcaaggaggacuacuaccgccgguucagcguccagcgcugcgcgcggugccaccuggggaucuccgccagcgagauggugaugcgcgcccgggacuccguguaccaccugagcugcuucacgugcuccacgugcaacaagacccucaccaccggcgaccacuucggcaugaaggacagccuggucuacugccgcgcccacuucgagacccugcuccagggggaguacccgccccagcuguccuacaccgagcuggccgccaagagcggcgggcucgcgcugcccuacuucaacggcaccggcaccgugcagaaggggcggccccgcaagcggaagucccccgcccugggcguggacaucgucaacuacaacagcgggugcaacgagaacgaggccgaccaccucgaccgcgaccagcagcccuacccgcccucccagaagaccaagcggaugcgcacgagcuucaagcaccaccagcugcggaccaugaaguccuacuucgccaucaaccacaaccccgacgcgaaggaccugaagcagcucgcccagaagaccggccugaccaagcgcgugcuccaggugugguuccagaacgcccgggccaaguuccgccgcaaccugcugcggcaggagaacgggggcgucgacaaggccgacggcacgagccugcccgcgccgcccagcgccgacuccggggcccucacgccgcccggcaccgccaccacccugaccgaccugaccaaccccaccaucacgguggugaccagcgucaccuccaacauggacagccacgaguccgggagccccucccagaccacgcucaccaaccuguucuga

SEQ ID NO: 32313 - RNA, 1119 nt, Artificial Sequence
  derived and/or modified sequence opt1 from LIAS__Homo_sapiens__NP_006850
augagccugcgcugcggcgacgccgcccggacccucgggccccgcguguucggccgguacuucugcuccccgguccgcccccugagcucccugcccgacaagaagaaggagcuccugcagaacgggcccgaccugcaggacuucgugagcggcgaccucgcggaccgguccaccugggacgaguacaaggggaaccugaagcgccagaagggcgagcggcugcgccucccgcccuggcugaagacggagauccccaugggcaagaacuacaacaagcugaagaacacccuccggaaccugaaccugcacaccgugugcgaggaggcccgcugccccaacaucggggagugcuggggcgggggcgaguacgccaccgccacggccaccaucaugcucaugggggacacgugcacccggggcugccgcuucugcagcgucaagaccgcgcggaacccgccgccccuggacgccuccgagcccuacaacaccgccaaggccaucgcggaguggggccuggacuacguggugcucaccagcgucgaccgcgacgacaugcccgacgggggcgccgagcacaucgccaagaccguguccuaccugaaggagcggaaccccaagauccugguggagugccucacgcccgacuuccgcggggaccugaaggccaucgagaaggucgcccugagcggccucgacguguacgcgcacaacguggagaccguccccgagcugcaguccaaggugcgggacccgcgcgccaacuucgaccagagccugcgggugcucaagcacgccaagaagguccagcccgacgugaucuccaagaccagcaucaugcugggccugggggagaacgacgagcaggucuacgccaccaugaaggcccuccgcgaggcggacguggacugccugacgcugggccaguacaugcagcccacccggcgccaccucaagguggaggaguacaucacccccgagaaguucaaguacugggagaagguggggaacgagcugggcuuccacuacaccgccuccgggccgcugguccgcagcuccuacaaggccggcgaguucuuccucaagaaccugguggccaagcggaagacgaaggaccuguga

SEQ ID NO: 32314 - RNA, 609 nt, Artificial Sequence
  derived and/or modified sequence opt1 from LIF__Homo_sapiens__XP_011528474
augaaggugcuggccgccggcgucgugccccuccugcuggugcuccacuggaagcacggggcgggcagcccgcugcccaucacccccgucaacgcgaccugcgccauccgccaccccugccacaacaaccugaugaaccagauccggucccagcucgcccagcugaacgggagcgccaacgcccuguucauccucuacuacacggcccagggcgagccguuccccaacaaccuggacaagcugugcgggcccaacgugaccgacuucccgcccuuccacgccaacggcaccgagaaggccaagcucguggagcuguaccgcaucgucguguaccugggcaccucccucgggaacaucacgcgggaccagaagauccugaaccccagcgcgcugucccuccacagcaagcugaacgccaccgccgacauccugcgcggccuccuguccaacgugcugugccggcucugcagcaaguaccacgucgggcacguggacgugaccuacggccccgacaccuccgggaaggacgucuuccagaagaagaagcugggcugccagcugcucggcaaguacaagcagaucaucgccgugcuggcccaggcguucuga

SEQ ID NO: 32315 - RNA, 3294 nt, Artificial Sequence
  derived and/or modified sequence opt1 from LIFR__Homo_sapiens__XP_011512344
augauggacaucuacgugugccugaagcgccccagcuggauggucgacaacaagcggaugcgcaccgccuccaacuuccaguggcuccugagcaccuucauccugcucuaccugaugaaccaggugaacucccagaagaagggcgccccgcacgaccugaagugcgugacgaacaaccuccaggucuggaacugcagcuggaaggcgcccuccgggaccggccgggggaccgacuacgaggugugcaucgagaaccgcagccgguccugcuaccagcuggagaagaccagcaucaagauccccgcccugucccacggcgacuacgagaucacgaucaacagccuccacgacuucggguccagcaccuccaaguucacccugaacgagcagaacgugagccugauccccgacaccccggagauccucaaccuguccgccgacuucagcacguccacccuguaccucaaguggaacgaccgcggcagcgucuucccccaccgguccaacgugaucugggagaucaaggugcugcgcaaggagagcauggagcuggucaagcucgugacccacaacaccacgcugaacggcaaggacacccugcaccacuggagcugggccuccgacaugccccucgagugcgccauccacuucguggagauccggugcuacaucgacaaccugcacuucagcgggcuggaggagugguccgacuggagccccgucaagaacaucuccuggaucccggacagccagaccaagguguucccccaggacaaggugauccucgucggcuccgacaucaccuucugcugcgugagccaggagaaggugcuguccgcgcugaucgggcacacgaacugcccccucauccaccuggacggcgagaacgucgccaucaagauccgcaacaucagcguguccgccagcuccgggaccaacguggucuucaccaccgaggacaacaucuucggcacggugaucuucgccggcuacccgcccgacacgccccagcagcugaacugcgagacccacgaccucaaggagaucaucugcagcuggaaccccgggcgggugaccgcgcuggucggcccccgcgccaccuccuacacccugguggagagcuucuccgggaaguacguccggcucaagcgcgccgaggccccgaccaacgagagcuaccagcugcuguuccagaugcuccccaaccaggagaucuacaacuucacccugaacgcccacaacccccugggccggucccagagcacgauccucgugaacaucaccgagaagguguacccccacaccccgaccagcuucaaggucaaggacaucaacuccacggcggugaagcugagcuggcaccuccccggcaacuucgccaagaucaacuuccugugcgagaucgagaucaagaaguccaacagcgugcaggagcagcgcaacgucaccaucaaggggguggagaacuccagcuaccugguggcccuggacaagcucaaccccuacacccuguacaccuuccggauccgcugcuccacggagaccuucuggaaguggagcaagugguccaacaagaagcagcaccugaccaccgaggccagccccuccaagggcccggacaccuggcgggaguggagcuccgacgggaagaaccucaucaucuacuggaagccccugcccaucaacgaggccaacggcaagauccugagcuacaacgucuccugcagcuccgacgaggagacgcagagccugagcgagauccccgacccgcagcacaaggcggagauccgccucgacaagaacgacuacaucaucuccgugguggccaagaacagcgucggguccagcccgcccuccaagaucgccagcauggagauccccaacgacgaccugaagaucgagcaggucgugggcaugggcaaggggauccugcucaccuggcacuacgaccccaacaugaccugcgacuacgugaucaaguggugcaacuccagccgguccgagcccugccugauggacuggcgcaaggugcccagcaacuccaccgagacggugaucgagagcgacgaguuccgcccgggcauccgguacaacuucuuccuguacgggugccgcaaccagggcuaccagcuccugcgguccaugaucggguacaucgaggagcuggcccccaucgucgcccccaacuucaccguggaggacaccagcgcggacuccauccucgugaagugggaggacauccccgucgaggagcugcgcggcuuccugcggggcuaccucuucuacuucgggaagggcgagcgcgacaccagcaagaugcgggugcuggaguccgggcgcagcgacaucaaggugaagaacaucacggacaucucccagaagacccugcggaucgccgaccuccagggcaagaccagcuaccaccugguccugcgcgccuacaccgacgggggcgugggcccggagaaguccauguacguggucacgaaggagaacuccguggggcucaucaucgccauccugauccccguggccgucgcggugaucgugggcgucgugaccagcauccugugcuaccggaagcgcgaguggaucaaggagaccuucuaccccgacauccccaacccggagaacugcaaggcccuccaguuccagaaguccgugugcgaggggagcuccgcccugaagacccuggagaugaaccccugcacgcccaacaacgucgaggugcucgagacccggagcgccuuccccaagaucgaggacaccgagaucaucuccccgguggcggagcgccccgaggaccggagcgacgccgagcccgagaaccacgucgugguguccuacugcccgcccaucaucgaggaggagauccccaaccccgccgccgacgaggccggcggcaccgcgcaggucaucuacaucgacgugcagagcauguaccagccccaggccaagccggaggaggagcaggagaacgaccccgucgggggcgccggguacaagccccagaugcaccucccgaucaacuccacgguggaggacaucgccgccgaggaggaccuggacaagaccgcgggcuaccgcccccaggccaacgugaacaccuggaaccuggugagccccgacagcccccggagcaucgacuccaacagcgagaucgucuccuucgggagcccgugcuccaucaacagccgccaguuccugaucccgcccaaggacgaggacagccccaaguccaacggcggcggguggagcuucaccaacuucuuccagaacaagcccaacgacuga

SEQ ID NO: 32316 - RNA, 2667 nt, Artificial Sequence
  derived and/or modified sequence opt1 from LIG1__Homo_sapiens__NP_001275992
augcagcgcagcaucauggccgcccugaaggaguggaacggcguggucuccgagagcgacucccccgugaagcggccggggcgcaaggcggcccgggugcucggcagcgagggggaggaggaggacgaggcccugucccccgccaagggccagaagcccgcccuggacugcagccaggucucccccccgcgccccgcgaccagccccgagaacaacgccucccucagcgacaccucccccauggacagcuccccgagcgggauccccaagcggcgcacggcccggaagcagcugcccaagcgcaccauccaggaggugcuggaggagcaguccgaggacgaggaccgggaggccaagcgcaagaaggaggaggaggaggagacccccaaggagagccucaccgaggcggagguggccacggagaaggagggcgaggacggcgaccagccgaccaccccccccaagccccugaagaccuccaaggccgagacgccgaccgagagcgucuccgagcccgagguggccaccaagcaggagcugcaggaggaggaggagcagaccaagcccccccggcgcgccccgaagacgcucagcagcuucuucaccccccggaagcccgcggugaagaaggaggucaaggaggaggagcccggggccccgggcaaggagggggccgccgagggcccccuggaccccuccggguacaaccccgccaagaacaacuaccacccgguggaggacgcgugcuggaagcccggccagaaggugcccuaccuggccgucgcccgcaccuucgagaagaucgaggaggugagcgcccggcuccgcaugguggagacccuguccaaccugcuccggagcgucguggcccuguccccgcccgaccugcuccccgugcuguaccugagccucaaccaccugggccccccgcagcaggggcuggagcucggcgucggggacggcgugcugcugaaggcgguggcccaggccacgggccgccagcucgaguccguccgggccgaggccgcggagaagggggacgugggccugguggccgagaacagccgcuccacccagcggcugaugcuccccccccccccgcugaccgccagcggggucuucuccaaguuccgcgacaucgcccgccugaccggcagcgcguccacggccaagaagaucgacaucaucaaggggcucuucguggccugccggcacagcgaggcccgcuucaucgcccggucccugagcggccgccugcggcucggccuggcggagcaguccguccuggccgcccucagccaggccgugucccugaccccccccgggcaggaguuccccccggccaugguggacgcgggcaaggggaagaccgccgaggcccgcaagaccuggcuggaggagcagggcaugauccucaagcagacguucugcgagguccccgaccuggaccggaucauccccgugcugcucgagcacgggcuggagcgccugcccgagcacugcaagcucagcccgggcaucccccugaagcccaugcuggcccaccccacccggggcaucagcgaggugcugaagcgcuucgaggaggccgcguucaccugcgaguacaaguacgacgggcagcgggcccagauccacgcccucgagggcggggaggucaagaucuucucccgcaaccaggaggacaacaccggcaaguacccggacaucaucagccggauccccaagaucaagcugcccuccgugacgagcuucauccuggacaccgaggccguggcgugggaccgcgagaagaagcagauccagcccuuccagguccucaccacccggaagcgcaaggagguggacgccuccgagauccaggugcaggucugccuguacgccuucgaccugaucuaccucaacggggagagccuggugcgggagccgcugucccgccggcgccagcuccugcgcgagaacuucguggagacggagggcgaguucgucuucgccaccagccuggacaccaaggacaucgagcagaucgccgaguuccucgagcaguccgugaaggacagcugcgagggccugauggugaagacccuggacgucgacgcgacguacgagaucgccaagcggucccacaacuggcucaagcugaagaaggacuaccuggacggggugggcgacacccucgaccugguggucaucggggccuaccugggccgcggcaagcgggccgggcgcuacggcggguuccuccuggccagcuacgacgaggacuccgaggagcugcaggcgaucugcaagcucggcaccggguucagcgacgaggagcuggaggagcaccaccagucccugaaggcccucgugcugcccagcccccggccguacgugcgcaucgacggcgccgucauccccgaccacuggcuggaccccuccgccgugugggaggugaagugcgccgaccucagccugagccccaucuacccggcggcccggggccuggucgacuccgacaaggggaucagccuccgcuucccccgguucauccgcgugcgggaggacaagcagcccgagcaggccaccaccuccgcccagguggcgugccuguaccgcaagcagagccagauccagaaccagcagggcgaggacuccgggagcgaccccgaggacacguacuga

SEQ ID NO: 32317 - RNA, 3057 nt, Artificial Sequence
  derived and/or modified sequence opt1 from LIG3__Homo_sapiens__XP_005258027
augagcaaguuccgcggccugcgguacaugucccucgccuucaagaucuucuucccccagacccugcgcgcccugagccggaaggagcucugccuguuccgcaagcaccacuggcgggacgugcgccaguucucccaguggagcgagaccgaccugcuccacgggcacccgcuguuccugcggcgcaagcccgugcucuccuuccagggcagccaccuccggucccgcgcgacguaccugguguuccuccccgggcugcacgugggccugugcagcgggcccugcgagauggccgagcagcgguucugcgucgacuacgccaagcgcggcaccgccggcugcaagaagugcaaggagaagaucgugaagggggugugccggaucggcaaggucgugccgaaccccuucuccgagagcgggggcgacaugaaggagugguaccacaucaagugcauguucgagaagcucgagcgcgcccgggcgaccaccaagaagaucgaggaccugacggagcuggaggggugggaggagcucgaggacaacgagaaggagcagaucacccagcacaucgccgaccuguccagcaaggccgccggcacccccaagaagaaggcggugguccaggccaagcugaccacgaccggccaggugaccucccccgugaagggggccagcuucgucaccuccacgaacccgcgcaaguucagcggcuucuccgccaagcccaacaacagcggggaggcccccuccagccccaccccgaagcggagccucuccagcuccaagugcgacccccgccacaaggacugccugcugcgggaguuccgcaagcucugcgcgaugguggccgacaaccccagcuacaacaccaagacccagaucauccaggacuuccugcggaagggcuccgccggcgacggguuccacggcgacguguaccugacggucaagcuccugcugcccggggugaucaagaccguguacaaccucaacgacaagcagaucgucaagcuguucagccgcaucuucaacugcaacccggacgacauggcccgcgaccuggagcagggcgacguguccgagaccauccggguguucuucgagcagagcaaguccuucccgcccgccgccaagagccuccugaccauccaggaggucgacgaguuccugcuccgccuguccaagcugacgaaggaggacgagcagcagcaggcgcuccaggacaucgccagccggugcaccgccaacgaccugaagugcaucauccgccugaucaagcacgaccucaagaugaacuccggggccaagcacgugcuggacgcgcuggaccccaacgccuacgaggccuucaaggccagccggaaccuccaggacguggucgagcgcgugcugcacaacgcccaggaggucgagaaggagcccggccagcggcgcgcgcuguccgugcaggccagccucaugacccccgugcagcccaugcuggccgaggccugcaaguccgucgaguacgcgaugaagaagugccccaacggcauguucagcgagaucaaguacgacggggagcggguccaggugcacaagaacggcgaccacuucuccuacuucagccgcagccugaagccggugcugccccacaagguggcccacuucaaggacuacaucccccaggccuuccccgggggccacuccaugauccucgacagcgaggugcugcugaucgacaacaagaccgggaagccgcuccccuucggcacgcugggcguccacaagaaggccgccuuccaggacgcgaacgugugccuguucguguucgacugcaucuacuucaacgacgucucccucauggaccggccccugugcgagcgccggaaguuccugcacgacaacaugguggagaucccgaaccgcaucauguucagcgagaugaagcgggugaccaaggcccucgaccuggccgacaugaucacccgcgucauccaggaggggcuggagggccucgugcugaaggacgugaaggggaccuacgagcccggcaagcggcacuggcugaaggucaagaaggacuaccucaacgagggggccauggccgacacggcggaccugguggugcugggcgccuucuacggccagggguccaagggcgggaugaugagcaucuuccucaugggcugcuacgaccccggcucccagaaguggugcaccgucaccaagugcgccgggggccacgacgacgccacccuggcccgccugcagaacgagcucgacauggugaagaucagcaaggaccccuccaagaucccgagcuggcugaaggugaacaagaucuacuaccccgacuucaucguccccgaccccaagaaggcggccgugugggagaucacgggggccgaguucuccaagagcgaggcccacaccgcggacggcaucuccauccgguucccgcgcugcacccgcauccgggacgacaaggacuggaaguccgccaccaaccugccccagcucaaggagcuguaccagcugagcaaggagaaggccgacuucacgguggucgccggggacgagggcagcuccaccaccggcgggagcagcgaggagaacaagggccccuccgggagcgccgugucccgcaaggcgcccagcaagccguccgccagcaccaagaaggccgagggcaagcucuccaacagcaacuccaaggacgggaacaugcagaccgccaagcccagcgccaugaaggugggcgagaagcuggcgacgaaguccagccccgucaaggugggcgagaagcggaaggccgccgacgagacccugugccagaccaaggugcuccuggacaucuucaccgggguccgccuguaccugcccccguccacgcccgacuucagccggcugcgccgguacuucguggccuucgacggcgaccuggugcaggaguucgacaugaccuccgccacccacguccucgggagccgcgacaagaaccccgcggcccagcaggucucccccgaguggaucugggccugcauccggaagcgccggcugguggccccgugcuga

SEQ ID NO: 32318 - RNA, 2736 nt, Artificial Sequence
  derived and/or modified sequence opt1 from LIG4__Homo_sapiens__XP_005254115
auggccgccagccagaccucccagaccguggcgagccacguccccuucgccgaccugugcuccacgcucgagcgcauccagaaguccaagggccgggccgagaagauccgccacuuccgggaguuccuggacagcuggcgcaaguuccacgacgcccugcacaagaaccacaaggacgugaccgacagcuucuacccggccaugcggcucauccugccccagcuggagcgcgagcggauggcguacgggaucaaggagaccaugcucgccaagcuguacaucgagcugcucaaccugccccgcgacggcaaggacgcccugaagcuccugaacuaccggacccccacggggacccacggcgacgccggggacuucgcgaugaucgccuacuucgugcugaagccgcgcugccuccagaagggcucccugaccauccagcaggucaacgaccugcucgacagcaucgccuccaacaacagcgccaagcggaaggaccugaucaagaagucccugcuccagcugaucacccagagcuccgcccuggagcagaaguggcucauccgcaugaucaucaaggaccugaagcugggcgugagccagcagacgaucuucuccguguuccacaacgacgcggccgagcuccacaacgucaccaccgaccuggagaaggugugccggcagcugcacgaccccagcguggggcucuccgacaucagcaucacccuguucuccgccuucaagcccaugcuggccgccaucgcggacaucgagcacaucgagaaggacaugaagcaccagagcuucuacaucgagacgaagcucgacggcgagcgcaugcagaugcacaaggacggggacgucuacaaguacuucagccggaacggcuacaacuacaccgaccaguucggggccucccccaccgagggcagccugaccccguucauccacaacgccuucaaggccgacauccagaucugcauccuggacggcgagaugauggccuacaaccccaacacgcagaccuucaugcagaaggggaccaaguucgacaucaagcgcaugguggaggacuccgaccuccagaccugcuacugcguguucgacguccugauggugaacaacaagaagcugggccacgagacgcuccggaagcgcuacgagauccugagcuccaucuucacccccauccccgggcggaucgagaucgugcagaagacccaggcgcacaccaagaacgaggucaucgacgcccugaacgaggccaucgacaagcgcgaggagggcaucauggugaagcagccgcucagcaucuacaagcccgacaagcggggcgagggguggcugaagaucaagcccgaguacguguccggccugauggacgagcucgacauccugaucgucgggggcuacugggggaagggcagccgcggcgggaugaugucccacuuccugugcgccguggccgagaagcccccgcccggcgagaagcccagcguguuccacacgcucucccgcgucgggagcggcugcaccaugaaggagcuguacgaccuggggcugaagcucgcgaaguacuggaagcccuuccaccggaaggccccgcccuccagcauccugugcggcaccgagaagcccgagguguacaucgagcccugcaacuccgugaucguccagaucaaggccgccgagaucgugccgagcgacauguacaagaccggcugcacgcugcgcuucccccggaucgagaagauccgcgacgacaaggaguggcacgagugcaugacccucgacgaccuggagcagcugcgggggaaggcguccggcaagcucgccagcaagcaccuguacaucgggggcgacgacgagccccaggagaagaagcgcaaggccgcccccaagaugaagaaggucaucgggaucaucgagcaccugaaggccccgaaccucaccaacgugaacaagaucuccaacaucuucgaggacguggaguucugcgucaugagcggcaccgacagccagcccaagcccgaccuggagaaccggaucgcggaguucggcggguacaucgugcagaacccgggccccgacacguacugcgugaucgccggguccgagaacauccgcgucaagaacaucauccugagcaacaagcacgacguggugaagcccgccuggcuccuggagugcuucaagaccaaguccuucguccccuggcagccgcgguucaugauccacaugugccccagcaccaaggagcacuucgcccgcgaguacgacugcuacggcgacuccuacuucaucgacaccgaccugaaccagcucaaggagguguucagcggcaucaagaacuccaacgagcagacgcccgaggagauggccagccugaucgcggaccuggaguaccgguacuccugggacugcagcccccucuccauguuccgccggcacaccguguaccuggacagcuacgccgucaucaacgaccuguccaccaagaacgaggggacccgccucgccaucaaggcccuggagcugcgguuccacggcgccaagguggugagcugccucgcggagggggucucccacgugaucaucggcgaggaccacagccgcguggccgacuucaaggccuuccggcgcaccuucaagcggaaguucaagauccugaaggaguccugggucacggacagcaucgacaagugcgagcugcaggaggagaaccaguaccucaucuga

SEQ ID NO: 32319 - RNA, 1470 nt, Artificial Sequence
  derived and/or modified sequence opt1 from LILRA1__Homo_sapiens__NP_006854
augacccccaucgugaccguccugaucugccuccgccugagccugggcccgcggacgcacgugcaggccgggacccuccccaagcccacccugugggccgagcccggcuccgugaucacccaggggagcccggucacgcuguggugccagggcauccucgagacccaggaguaccgccuguaccgggagaagaagaccgcgcccuggaucacccgcaucccccaggagaucgugaagaaggggcaguuccccaucccguccaucacgugggagcacaccggccgguaccgcugcuucuacggcagccacaccgccgggugguccgagcccagcgacccccuggagcucguggucaccggcgccuacaucaagcccacgcuguccgcccugccgagccccguggugaccuccgggggcaacgucacccuccacugcgugagccagguggccuucggguccuucauccugugcaaggagggcgaggacgagcacccccagugccugaacagccagccccggacccacggcuggucccgcgcgaucuucagcgucgggccggugucccccagccggcgcugguccuaccggugcuacgccuacgacagcaacagcccccacguguggucccuccccagcgaccugcuggagcuccugguccugggcguguccaagaagccgagccucuccgugcagcccgggcccaucgucgcccccggcgagagccugacgcugcagugcguguccgacgugagcuacgaccgcuucguccucuacaaggagggcgagcgggacuuccugcagcugccggggccccagccccaggccggccucucccaggcgaacuucacccuggggcccgugagccgcuccuacggcgggcaguaccggugcagcggcgccuacaaccuguccagcgagugguccgccccgagcgacccccucgacauccugaucgccggccaguuccgcgggcggcccuucaucuccgugcacccgggccccaccgucgccagcggggagaacgugacccugcucugccaguccuggggccccuuccacacguuccugcugaccaaggcgggggccgccgacgcgccccuccgccugcggagcauccacgaguacccgaaguaccaggccgaguuccccaugucccccgucaccagcgcccacagcggcaccuaccgcugcuacggcucccugagcuccaaccccuaccuccugagccacccguccgacagccuggagcucaugguguccggggccgccgagacgcugagcccgccccagaacaaguccgacagcaaggccggcgccgcgaacacccugucccccagccagaacaagaccgccucccacccccaggacuacaccguggagaaccucauccggauggggaucgccggccugguccugguggugcucgggauccugcuguucgaggcccagcacagccagcgcucccuguga

SEQ ID NO: 32320 - RNA, 1401 nt, Artificial Sequence
  derived and/or modified sequence opt1 from LILRA2__Homo_sapiens__NP_006857
augacccccauccugaccgugcucaucugccugggccugagccucgggccgcgcacgcacguccaggccggccaccuccccaagcccacccugugggccgagcccggguccgugaucauccagggcagcccggugacccugcggugccaggggucccugcaggcggaggaguaccaccuguaccgcgagaacaagagcgccuccuggguccggcgcauccaggagcccggcaagaacggccaguuccccauccccagcaucaccugggagcacgccgggcgguaccacugccaguacuacucccacaaccacagcuccgaguacagcgacccgcucgagcugguggugacgggcgccuacuccaagcccacccugagcgcccuccccucccccgucgugaccagcgggggcaacgugacccugcagugcgucucccagguggcguucgacggguucauccugugcaaggagggcgaggacgagcacccgcagcgccucaacagccacucccacgcccggggcuggagcugggccaucuucuccguggggcccgucagccccagccgccggugguccuaccgcugcuacgccuacgacagcaacucccccuacguguggagccugccguccgaccugcucgagcugcuggugcccggcgucagcaagaagcccucccucagcgugcagcccgggccgaugguggcgcccggcgagucccugacgcugcagugcgucagcgacgugggcuacgaccgguucgugcucuacaaggagggggagcgcgacuuccugcagcggcccggcuggcagccccaggccgggcugucccaggccaacuucacccucggcccggucagccccucccacgggggccaguaccgcugcuacagcgcccacaaccuguccagcgagugguccgcccccagcgacccccuggacauccucaucaccggccaguucuacgaccggccgucccugagcgugcagcccgugcccaccgucgcgccggggaagaacgugacgcugcucugccagagccgcggccaguuccacaccuuccugcugaccaaggagggggccggccacccgccccuccaccuccgguccgagcaccaggcccagcagaaccaggccgaguuccgcauggggcccgucaccagcgcccacgugggcacguaccggugcuacuccagccuguccagcaaccccuaccugcugucccugcccagcgacccccucgagcugguggucuccgcgagccugggccagcacccccaggacuacaccguggagaaccucauccgcauggggguggccggccugguccugguggugcucgggauccugcuguucgaggcccagcacucccagcggagccugcaggacgccgccggccgcuga

SEQ ID NO: 32321 - RNA, 1128 nt, Artificial Sequence
  derived and/or modified sequence opt1 from LILRA3__Homo_sapiens__NP_001166125
augacccccauccugaccgugcucaucugccugggccugagccucgacccgcgcacgcacguccaggccgggccccugcccaagcccacccugugggccgagccgggcuccgugaucacccaggggagccccgugacccuccggugccagggcucccuggagacgcaggaguaccaccuguaccgcgagaagaagaccgcgcucuggaucacccggaucccccaggagcuggucaagaaggggcaguuccccauccugagcaucaccugggagcacgccggccgcuacugcugcaucuacggcucccacacggccgggcucagcgaguccagcgacccgcuggagcugguggugaccggcgccuacuccaagcccacccucagcgcccugcccucccccgucgugaccagcgggggcaacgugacgauccagugcgacucccaggucgcguucgacggguucauccugugcgugagcaagaagccgucccucagcgugcagcccggccccgucguggcccccggcgagaagcugaccuuccagugcggguccgacgccggcuacgaccgguucgugcuguacaaggagugggggcgcgacuuccuccagcggccgggccgccagccccaggccggccugagccaggcgaacuucacccuggggcccgucucccggagcuacggcgggcaguacacgugcagcggcgccuacaaccucuccagcgagugguccgcccccagcgacccgcuggacauccugaucaccgggcagauccgcgcccggcccuuccucuccgugcgccccggccccaccguggccagcggcgagaacgucacccugcugugccagucccagggcgggaugcacaccuuccuccugacgaaggagggggcggccgacagcccgcugcggcucaaguccaagcgccagagccacaaguaccaggccgaguuccccaugucccccgugaccagcgcccacgccggcaccuaccggugcuacgggucccugagcuccaaccccuaccugcucacccacccgagcgacccccuggagcugguggucuccggcgcggccgagacgcucagcccgccccagaacaaguccgacagcaaggccggcgaguga

SEQ ID NO: 32322 - RNA, 1500 nt, Artificial Sequence
  derived and/or modified sequence opt1 from LILRA4__Homo_sapiens__NP_036408
augacccugauccucaccagccugcuguucuucggccucucccuggggccccgcacgcgggugcaggccgagaaccugcucaagccgauccugugggccgagcccggccccgucaucaccuggcacaaccccgugaccaucuggugccaggggacccuggaggcgcagggcuaccgccucgacaaggaggggaacagcaugucccggcacauccugaagacgcuggagagcgagaacaaggugaagcucuccaucccgagcaugaugugggagcacgccggccgcuaccacugcuacuaccagucccccgccggcuggagcgagcccuccgacccccuggagcuggucgugaccgccuacagccggccgacccucuccgcccugcccagccccguggucaccuccggggugaacgugacgcugcgcugcgcgagccggcucggccuggggcgcuucacccugaucgaggagggcgaccaccggcucuccuggacccugaacagccaccagcacaaccacgggaaguuccaggcccuguuccccaugggcccgcucaccuucuccaaccgcggcacguuccggugcuacggguacgagaacaacacccccuacgucuggagcgagcccuccgacccccugcagcugcucgugagcggcgugagccgcaagccgucccugcugacccuccaggggcccgucgugacccccggcgagaaccugacgcugcagugcggcagcgacgugggguacauccgguacacccucuacaaggagggcgccgacgggcugccccagcgcccgggccggcagccccaggccgggcugucccaggcgaacuucacccucagccccgucucccgcagcuacggcggccaguaccggugcuacggggcccacaacguguccagcgagugguccgcccccagcgacccgcuggacauccugaucgccggccagaucuccgaccgccccagccucuccgugcagcccgggcccaccgucacgagcggcgagaaggugacccugcugugccaguccugggacccgauguucaccuuccuccugaccaaggagggggccgcgcacccgccccugcggcuccgcagcauguacggcgcccacaaguaccaggccgaguuccccaugucccccgugacgagcgcccacgccggcaccuaccggugcuacgggucccgcagcagcaaccccuaccugcugucccaccccagcgagccgcucgagcuggucguguccggcgcgaccgagacccugaaccccgcccagaagaaguccgacuccaagacggcgccccaccuccaggacuacaccguggagaaccucauccgcaugggggucgccggccuggugcugcuguuccuggggauccuccuguucgaggcccagcacagccagcggagcccgccccgcugcagccaggaggccaacucccggaaggacaacgcccccuuccgcgucguggagcccugggagcagaucuga

SEQ ID NO: 32323 - RNA, 900 nt, Artificial Sequence
  derived and/or modified sequence opt1 from LILRA5__Homo_sapiens__NP_067073
auggcccccuggucccacccguccgcccagcugcagcccgugggcggggacgcggucagccccgcccucauggugcugcugugccucggccugucccuggggccccgcacccacgugcaggccggcaaccucagcaaggccacccugugggccgagccgggguccgucaucagccggggcaacuccgugacgauccgcugccagggcacccuggaggcgcaggaguaccggcucgugaaggaggggagccccgagcccugggacacccagaacccccuggagccgaagaacaaggcccgcuucuccauccccagcaugaccgagcaccacgccggccgguaccgcugcuacuacuacucccccgccggguggagcgagcccuccgacccgcuggagcucgucgugacgggcuucuacaacaagcccacccugagcgcgcugcccucccccguggucaccagcggggagaacgugacccuccagugcggcucccggcugcgcuucgaccgguucauccugacggaggagggcgaccacaagcucagcuggacccuggacucccagcugaccccgagcgggcaguuccaggcccucuuccccgugggccccgucacccccagccaccgcuggaugcugcggugcuacgggucccgccggcacauccuccagguguggagcgagccguccgaccugcuggagauccccgugagcggcgccgccgacaaccugucccccagccagaacaaguccgacagcggcacggccucccaccuccaggacuacgcggucgagaaccugauccgcauggggauggccggccugauccucguggugcuggggauccugaucuuccaggacuggcacagccagcggagcccccaggccgccgccggccgcuga

SEQ ID NO: 32324 - RNA, 1956 nt, Artificial Sequence
  derived and/or modified sequence opt1 from LILRB1__Homo_sapiens__NP_001075107
augacccccauccugaccgugcucaucugccugggccugagccucgggccgcgcacgcacguccaggccggccaccuccccaagcccacccugugggccgagcccggguccgugaucacccagggcagcccggugacccugcggugccagggcgggcaggagacgcaggaguaccgccuguaccgggagaagaagaccgcgcccuggaucacccgcaucccccaggagcuggucaagaagggccaguuccccaucccguccaucaccugggagcacacggggcgguaccgcugcuacuacggcagcgacaccgccgggcgguccgagagcuccgacccccucgagcugguggugaccggcgccuacaucaagcccacccugagcgcccagcccuccccggucgugaacagcgggggcaacgugacgcuccagugcgacucccaggucgccuucgacggcuucauccugugcaaggagggggaggacgagcacccccagugccugaacagccagccccacgcgcgcggcuccagccgggccaucuucuccguggggcccgugagcccgucccgccgguggugguaccgcugcuacgccuacgacagcaacucccccuacgaguggagccuccccagcgaccugcuggagcuccugguccugggcguguccaagaagcccagccucuccgugcagccgggccccaucgucgcccccgaggagacccugacccugcagugcgggagcgacgcgggcuacaaccgguucgugcucuacaaggacggggagcgcgacuuccugcagcuggccggcgcccagccccaggccgggcucucccaggccaacuucacccugggcccggugagccgguccuacggcgggcaguaccgcugcuacggcgcgcacaaccugagcuccgaguggagcgcccccuccgacccccucgacauccugaucgccgggcaguucuacgaccgggucagccuguccgugcagcccggcccgacgguggccagcggggagaacgucacccuccugugccagucccagggcuggaugcagaccuuccugcucaccaaggagggcgccgcggacgaccccuggcgccugcggagcacguaccagucccagaaguaccaggccgaguuccccauggggccggugaccagcgcccacgccggcaccuaccgcugcuacgggucccagagcagcaagcccuaccugcucacccaccccuccgacccccuggagcugguggucagcggcccguccgggggccccagcucccccacgaccggccccaccagcaccuccgccgggccggaggaccagccccucacgcccaccggcagcgacccccaguccgggcugggccggcaccugggcguggucaucgggauccucguggcggugauccugcugcuccugcugcugcuccugcuguuccucauccugcgccaccgccggcagggcaagcacuggaccagcacccagcgcaaggccgacuuccagcacccggccggggccgucggccccgagcccacggaccgggggcugcaguggcgcuccagccccgccgcggacgcccaggaggagaaccucuacgccgccgugaagcacacccagccggaggacggcguggagauggacacccggagcccccacgacgaggacccccaggcggucaccuacgccgaggugaagcacucccgcccccggcgcgagauggccuccccgcccagcccccuguccggcgaguuccuggacacgaaggaccggcaggccgaggaggaccgccagauggacaccgaggccgcggccagcgaggcgccccaggacgugaccuacgcccagcuccacagccugacccugcggcgcgaggccaccgagccgccgcccucccaggaggggcccagccccgccguccccuccaucuacgccacgcucgccauccacuga

SEQ ID NO: 32325 - RNA, 1449 nt, Artificial Sequence
  derived and/or modified sequence opt1 from LILRB2__Homo_sapiens__NP_001265333
augaccggcgccuaccccaagcccacccugagcgcccagcccucccccguggucacgagcgggggccgcgugacccuccagugcgagucccagguggcguucgggggcuucauccugugcaaggagggggaggacgagcacccccagugccugaacagccagccccacgcccggggcuccagccgcgccaucuucuccgucggccccgugagccccaaccggcgcuggucccaccggugcuacggguacgaccucaacagccccuacgugugguccagcccguccgaccugcuggagcuccugguccccggcgugagcaagaagcccucccugagcgugcagcccgggccggucauggcccccggcgagucccucacccugcagugcgugagcgacgugggguacgaccgcuucguccuguacaaggagggcgagcgggaccuccgccagcugcccggccggcagccccaggccgggcugucccaggcgaacuucacccucggcccggugagccgcagcuacgggggccaguaccggugcuacggcgcccacaaccuguccagcgagugcuccgcccccagcgacccccuggacauccucaucacggggcagauccgcggcacccccuucaucuccgugcagccggggcccaccgucgccagcggcgagaacgugacccugcugugccaguccuggcggcaguuccacacguuccuccugaccaaggcgggggccgccgacgcgccccugcgccuccggagcauccacgaguaccccaaguaccaggccgaguucccgaugucccccgugaccagcgcccacgccggcaccuaccgcugcuacggcucccugaacagcgaccccuaccugcucucccaccccagcgagccgcuggagcuggucguguccgggcccagcaugggcuccagcccgccgcccacggggcccaucuccacccccgccggcccggaggaccagccccucacccccaccgggagcgacccccagagcggccugggccggcaccuggggguggucaucggcauccucguggccgugguccugcugcuccugcugcuccugcuccuguuccugauccugcgccaccggcgccaggggaagcacuggacguccacccagcggaaggccgacuuccagcacccggcgggcgccguggggcccgagcccaccgaccgcggccuccaguggcgcagcucccccgccgccgacgcccaggaggagaaccuguacgcggccgucaaggacacccagccggaggacggcguggagauggacacgcgggccgccgccagcgaggcgccccaggacgugaccuacgcccagcugcacucccucacccugcgccggaaggccaccgagcccccgcccagccaggagcgcgagccgcccgccgagcccuccaucuacgcgacgcuggccauccacuga

SEQ ID NO: 32326 - RNA, 1446 nt, Artificial Sequence
  derived and/or modified sequence opt1 from LILRB3__Homo_sapiens__XP_006726238
augacccccgcccugaccgcccuccugugccugggccucagccuggggccgcgcacgcgggugcaggcgggccccuuccccaagcccacccugugggccgagccgggguccgucaucagcuggggcucccccgugaccaucuggugccaggggagccucgaggcccaggaguaccagcuggacaaggagggcucccccgagccccuggaccgcaacaacccgcucgagcccaagaacaaggcccgguucagcauccccuccaugacccagcaccacgccggccgcuaccggugccacuacuacagcuccgcgggguggagcgagcccuccgacccgcuggagcuggugaugacgggcuucuacaacaagcccacccucagcgcccugcccucccccgucguggccagcgggggcaacaugacccugcgcugcgggucccagaagggcuaccaccacuucgugcucaugaaggagggcgagcaccagcugccgcggacccuggacagccagcagcuccacuccgggggcuuccaggcccuguuccccgucgggcccgugacgcccagccaccgcuggcgguucacgugcuacuacuacuacaccaacaccccgcgcguguggucccaccccagcgacccccuggagauccuccccagcggcgucucccggaagccgagccugcugacccuccagggccccgugcuggcgcccgggcagucccugacccuccagugcggcagcgacgugggguacgaccgcuucguccuguacaaggagggcgagcgggacuuccugcagcgccccgggcagcagccgcaggccggccucucccaggccaacuucacccugggccccgugagccccucccacgggggccaguaccggugcuacggggcccacaaccugagcuccgaguggagcgccccguccgacccccucaacauccugauggcgggccagaucuacgacaccgugagccuguccgcccagcccgggcccacggucgccagcggcgagaacgugacccuccugugccagucccgcggcuacuucgacaccuuccugcucaccaaggagggggccgcccacccgccccugcggcugcgcagcauguacggcgcgcacaaguaccaggccgaguuccccaugucccccgugacgagcgcccacgccgggaccuaccggugcuacggcuccuacagcagcaacccgcaccuccuguccuuccccagcgagccccuggagcucauggucuccgggcacagcggcggcuccagccugcccccgaccgggccgcccuccacccccgccagccacgcgaaggacuacacgguggagaaccugauccgcaugggcauggccgggcucgugcuggucuuccugggcauccuccuguucgaggcccagcacucccagcggaacccccaggacgccgccggccgcuga

SEQ ID NO: 32327 - RNA, 1473 nt, Artificial Sequence
  derived and/or modified sequence opt1 from LILRB4__Homo_sapiens__XP_011546956
auggagcagccccacgacgagaaggacccggccagcaagcgcccccaccccgugugccuguucguccuccccgcccugcggacccacccguccgcgcagcugggcccccucgggggcgacgccaugauccccaccuucacggcccugcugugccucgggcugagccugggcccccgcacccacaugcaggccgggccgcuccccaagcccacccugugggccgagcccggcuccgugaucagcuggggcaacuccgugaccaucuggugccaggggacgcuggaggcgcgggaguaccgccucgacaaggaggagagcccggcccccugggaccggcagaacccccuggagcccaagaacaaggcccgcuucuccaucccgagcaugaccgaggacuacgccggccgguaccgcugcuacuaccggucccccgucggguggagccagcccuccgacccccuggagcucgugaugaccggcgcguacagcaagccgacccuguccgcccugcccagcccccucgugacguccggcaagagcgucacccugcugugccagucccgcagccccauggacaccuuccuccugaucaaggagcgggccgcccacccgcugcuccaccuccgcuccgagcacggggcccagcagcaccaggcggaguuccccaugagccccgugaccagcgugcacggcgggacguaccggugcuucuccagccacggcuucucccacuaccugcugagccaccccuccgacccgcuggagcugaucgucagcgggucccucgaggacccccgccccagcccgacccgguccgugagcaccgccgccggccccgaggaccagccccugaugcccaccggcuccgugccgcacagcgggcugcgccggcacugggagguccucaucggcgugcugguggucuccauccugcuccugagccugcuccuguuccugcuccugcagcacuggcgccaggggaagcaccggacgcuggcccagcgccaggccgacuuccagcggccgcccggcgcggccgagcccgagcccaaggacgggggccuccagcgccgcuccagccccgccgccgacgugcagggcgagaacuucuccggggccgcggugaagaacacccagcccgaggacggcgucgagauggacacccggcagagcccccacgacgaggacccgcaggccgugaccuacgccaaggugaagcacucccgcccccggcgcgagauggccagcccgcccagcccccuguccggggaguuccuggacacgaaggaccggcaggccgaggaggaccgccagauggacaccgaggcggccgccagcgaggcgccccaggacgucaccuacgcccagcuccacuccuucacccugcggcagaaggccacggagcccccgcccagccaggagggcgccucccccgccgagcccagcguguacgccacccuggcgauccacuga

SEQ ID NO: 32328 - RNA, 1776 nt, Artificial Sequence
  derived and/or modified sequence opt1 from LILRB5__Homo_sapiens__NP_001074911
augacccugacccucagcgugcugaucugccugggccucuccgucgggccccgcacgugcgugcaggccggcacccugccgaagcccacccugugggccgagcccgcgagcgugaucgcccgggggaagcccgucacccucuggugccagggcccgcuggagacggaggaguaccgccuggacaaggaggggcuccccugggcccggaagcgccagaacccccuggagcccggcgccaaggccaaguuccacaucccguccaccguguacgacagcgcgggccgguaccgcugcuacuacgagacccccgccgggugguccgagcccagcgacccccuggagcucguggccaccggcuucuacgccgagccgacgcugcuggcgcuccccucccccgucguggccagcgggggcaacgugacccugcagugcgacacccuggacgggcuccugaccuucguccugguggaggaggagcagaagcucccccggacgcuguacucccagaagcugccgaagggccccagccaggcccucuuccccgugggccccgucaccccguccugccgcuggcgguuccgcugcuacuacuacuaccggaagaacccccagguguggagcaaccccuccgaccugcuggagauccucgugcccggggucagccgcaagccgucccugcugaucccccagggcagcgugguggcccgcgggggcucccucacccugcagugccggagcgacgucggcuacgacaucuucgugcuguacaaggagggggagcacgaccucgugcagggcuccgggcagcagccccaggccggccugagccaggcgaacuucacccuggggcccgucagccggucccacggcggccaguaccgcugcuacggggcccacaaccucagcccgcggugguccgcccccagcgacccccuggacauccugaucgccggccucaucccggacauccccgcccuguccgugcagcccgggcccaagguggcgagcggcgagaacgucacgcugcucugccaguccuggcaccagaucgacaccuucuuccugaccaaggagggggccgcccacccgccccugugccucaagagcaaguaccaguccuaccgccaccaggccgaguucagcaugucccccgugaccagcgcccagggcggcacguaccggugcuacuccgcgauccgcagcuaccccuaccugcuguccagcccguccuacccccaggagcucgucgugagcgggcccuccggcgaccccagccugagcccgaccggguccacccccacccccgccggccccgaggaccagccgcugacgcccaccgggcuggacccccagagcggccucggccggcaccuggggguggucaccggcguguccguggccuucguccugcuccuguuccugcuccuguuccugcuccugcgccaccgccaccagagcaagcaccggaccuccgcccacuucuaccgccccgccggggcggccggcccggagcccaaggaccagggccugcagaagcgggccagccccguggccgacauccaggaggagauccucaacgcggccgugaaggacacgcagcccaaggacggggucgagauggacgcccgcgccgccgcguccgaggccccgcaggacgugaccuacgcccagcugcacagccugacccuccggcgcgaggccaccgagcccccgcccucccaggagcgggagccgcccgccgagcccagcaucuacgcgccccuggccauccacuga

SEQ ID NO: 32329 - RNA, 522 nt, Artificial Sequence
  derived and/or modified sequence opt1 from LIM2__Homo_sapiens__NP_001155220
auguacagcuucaugggcgggggccuguucugcgccuggguggggaccauccuccuggucguggccauggcgaccgaccacuggaugcaguaccgccuguccggcagcuucgcccaccaggggcucuggcgguacugccugggcaacaagugcuaccugcagaccgacuccaucgccuacuggaacgccacccgcgccuucaugauccucagcgcgcugugcgccaucuccggcaucaucauggggaucauggccuucgcccaccagcccaccuucagccggaucucccgcccguucagcgcgggcaucauguucuucuccagcacccuguucgugguccucgcccuggccaucuacacgggggugaccguguccuuccugggccggcgcuucggggacuggcgguucagcugguccuacauccucggcugggucgccgugcugaugaccuucuucgccggcaucuucuacaugugcgcguaccgcgugcacgagugccggcgccugagcacgccccgguga

SEQ ID NO: 32330 - RNA, 1374 nt, Artificial Sequence
  derived and/or modified sequence opt1 from LIMA1__Homo_sapiens__NP_001230704
auggagcagaaggagaacgugcccccgggccccgaggucugcaucacccaccaggagggggagaagaucagcgccaacgagaacucccuggccgugcgcagcacccccgcggaggacgacucccgggacagccaggugaaguccgagguccagcagcccgugcacccgaagccccucagccccgacucccgcgccagcucccugagcgaguccagcccgccgaaggccaugaagaaguuccaggcccccgcccgggagacgugcguggagugccagaagaccgucuaccccauggagcgccugcucgcgaaccagcaggucuuccacaucuccugcuuccggugcagcuacugcaacaacaagcugucccugggcaccuacgccagccuccacgggcgcaucuacugcaagccccacuucaaccagcuguucaaguccaagggcaacuacgacgagggguucggccaccggccgcacaaggaccugugggccagcaagaacgagaacgaggagauccucgagcgccccgcccagcuggcgaacgcccgggagacgccccacucccccggcguggaggacgccccgaucgccaaggugggggugcuggccgcgagcauggaggccaaggccagcucccagcaggagaaggaggacaagcccgccgagaccaagaagcuccgcaucgccuggcccccgcccaccgagcugggcagcuccgggagcgcgcuggaggagggcaucaagauguccaagcccaaguggccgcccgaggacgagaucagcaagcccgaggugcccgaggacgucgaccucgaccugaagaagcugcggcgcuccagcucccucaaggagcggagccgccccuucaccguggccgccuccuuccagagcaccuccgugaagucccccaagacggucuccccgcccauccggaagggguggagcauguccgagcagagcgaggaguccgugggcggccgcguggccgagcggaagcaggucgagaacgccaaggcgagcaagaagaacgggaacgugggcaagaccaccuggcagaacaaggagagcaagggggagaccggcaagcgcuccaaggagggccacagccuggagauggagaacgagaaccugguggagaacggggccgacuccgacgaggacgacaacagcuuccucaagcagcagagcccccaggagcccaagagccugaacugguccagcuucgucgacaacacguucgccgaggaguucaccacccagaaccagaagucccaggacguggagcugugggagggcgagguggucaaggagcucagcguggaggagcagaucaagcggaaccgcuacuacgacgaggacgaggacgaggaguga

SEQ ID NO: 32331 - RNA, 3174 nt, Artificial Sequence
  derived and/or modified sequence opt1 from LIMCH1__Homo_sapiens__NP_001106188
auggccugccccgcccugggccucgaggcgcugcagccgcugcagcccgagcccccgcccgagcccgccuucagcgaggcccagaaguggaucgagcaggucaccgggcgcuccuucggcgacaaggacuuccggaccgggcucgagaacggcauccugcugugcgagcuccugaacgccaucaagcccgggcuggucaagaagaucaaccgccuccccacgccgaucgccggccuggacaacaucauccuguuccuccggggcugcaaggagcuggggcugaaggagagccagcuguucgaccccuccgaccugcaggacaccagcaaccgcgugaccgugaagucccuggacuacagccggaagcucaagaacguccuggugaccaucuacuggcugggcaaggcggccaacuccugcacgagcuacuccgggaccacccucaaccugaaggaguucgagggccugcucgcccagaugcgcaaggacaccgacgacaucgagagccccaagcgguccauccgcgacagcggguacaucgacugcugggacuccgagcggagcgacucccugagcccgccccgccacggccgggacgacuccuucgacagccuggacuccuucggcagccgcagccggcagacgcccucccccgacgugguccuccgcgggagcuccgacggccgggggagcgacuccgagagcgaccugccccaccgcaagcugccggacgugaagaaggacgacauguccgcccggcgcaccagccacggcgagcccaaguccgcggugcccuucaaccaguaccuccccaacaagagcaaccagaccgccuacgucccggcgccccugcggaagaagaaggccgagcgcgaggaguaccggaaguccuggagcaccgccacgagcccccugggcggggagcgccccuuccgcuacggcccgcggacccccguguccgacgacgccgaguccaccagcauguucgacaugcgcugcgaggaggaggccgccgugcagccccacucccgggcccgccaggagcagcuccagcugaucaacaaccagcuccgggaggaggacgacaaguggcaggacgaccucgcccgcuggaagucccggcgccggagcgugagccaggaccugaucaagaaggaggaggagcgcaagaagauggagaagcugcucgcgggggaggacggcaccagcgagcggcgcaaguccaucaagacguaccgggagaucgugcaggagaaggagcgccgggagcgcgagcugcacgaggccuacaagaacgcccggagccaggaggaggccgaggggauccugcagcaguacaucgagcgcuucaccaucuccgaggccgugcucgagcggcuggagaugcccaagauccuggagcgcagccacuccaccgagccgaaccucagcuccuuccugaacgaccccaaccccaugaaguaccugcgccagcagagccucccgccgcccaaguucaccgcgacggucgagaccaccaucgcccgggccuccgugcuggacaccagcauguccgccggcagcggcucccccagcaagacggugacccccaaggccguccccaugcugacccccaagcccuacucccagccgaagaacagccaggacgugcugaagaccuucaagguggacgggaaggucuccgugaacggcgagacggugcaccgcgaggaggagaaggagcgggagugccccaccgucgcgcccgcccacagccucaccaagagccagauguucgaggggguggcccgcguccacggcagcccccuggagcugaagcaggacaacggguccaucgagaucaacaucaagaagccgaacuccgugccccaggagcucgccgcgaccacggagaagaccgagcccaacagccaggaggacaagaacgacggcggcaagucccggaaggggaacaucgagcuggccagcuccgagccccagcacuucaccaccacggugacccgcugcagcccgaccgucgccuucguggaguuccccuccagcccccagcugaagaacgacguguccgaggagaaggaccagaagaagcccgagaacgagaugagcggcaaggucgagcucgugcugucccagaagguggucaagcccaagagccccgagcccgaggccacccugaccuuccccuuccucgacaagaugccggaggccaaccagcugcaccucccgaaccugaacucccagguggacagccccuccagcgagaaguccccggugaugacgccccaguucaaguucugggcgugggaccccgaggaggagcggcgccggcaggagaaguggcagcaggagcaggagcgccugcugcaggagcgguaccagaaggagcaggacaagcucaaggaggagugggagaaggcccagaaggaggucgaggaggaggagcgccgguacuacgaggaggagcgcaagaucaucgaggacaccguggugcccuucaccgucagcagcuccagcgccgaccagcuguccaccagcuccagcaugacggagggguccggcaccaugaacaagaucgaccuggggaacugccaggacgagaagcaggaccggcgcuggaagaaguccuuccagggcgacgacagcgaccuccugcugaagacccgggagagcgaccgccucgaggagaagggcucccugaccgagggggcccuggcccacagcggcaacccgguguccaagggggugcacgaggaccaccagcucgacacggaggcgggcgcgccccacugcggcaccaacccccagcuggcccaggaccccagccagaaccagcagaccuccaacccgacccacagcuccgaggacgucaagcccaagacgcugccccucgacaagagcaucaaccaccagaucgagucccccagcgagcggcgcaagagcaucuccgggaagaagcugugcagcuccugcggccugccgcucgggaagggcgccgccaugaucaucgagacccugaaccuguacuuccacauccagugcuuccggugcgggaucugcaagggccagcucggcgacgccgugagcgggaccgacgugcgcauccgcaacggccugcugaacugcaacgacugcuacaugcggucccgcagcgccgggcagcccaccacgcucuga

SEQ ID NO: 32332 - RNA, 2031 nt, Artificial Sequence
  derived and/or modified sequence opt1 from LIMD1__Homo_sapiens__NP_055055
auggacaaguacgacgaccugggccucgaggccagcaaguucaucgaggaccugaacauguacgaggccuccaaggacgggcuguuccgcguggacaagggcgcggggaacaaccccgaguucgaggagacccggcgcgucuucgccaccaagauggccaagauccaccuccagcagcagcagcagcagcugcugcaggaggagacgcucccccggggcagccgcgggcccgugaacggcggcgggcggcugggcccccaggcccgcugggagguggucggguccaagcugaccguggacggcgccgcgaagcccccgcucgccgccagcaccggggcccccggcgcggugaccacgcuggccgccggccagccgcccuacccgccccaggagcagcggucccgccccuaccugcacgggacccggcacggcagccaggacugcgggucccgcgagagccucgccaccuccgagaugagcgccuuccaccagcccggcccgugcgaggaccccuccugccugacccacggcgacuacuacgacaaccugagccucgcgucccccaaguggggcgacaagcccggggucagcccguccaucgggcugagcgugggcuccggguggcccagcucccccggcagcgacccgccccugcccaagcccugcggcgaccacccccucaaccaccggcagcugagccuguccagcucccgcagcuccgaggggagccucggcgggcagaacuccggcaucgggggccggagcuccgagaagccgacgggccuguggagcaccgccuccagccagcgcgugucccccgggcugcccagccccaaccucgagaacggcgccccggccgucgggcccgugcagccccggaccccguccgugagcgcgccccuggcccuguccugcccccgccagggcgggcucccccggagcaacuccggccugggcggggaggucagcggcgugaugagcaagccgaacguggacccccagcccugguuccaggacgggcccaaguccuaccugagcuccagcgccccguccagcucccccgccggccucgacggcagccagcagggggccguccccggccuggggcccaagccgggcugcaccgaccuggggacgggccccaagcucucccccaccagccuggugcaccccgugauguccacccugccggagcucagcugcaaggagggcccccuggggugguccagcgacggcucccuggggagcguccuccuggacucccccagcagcccccgcgugcggcugccgugccagccccucgugcccggccccgagcugcgcccguccgccgcggagcugaagcucgaggcccugacccagcggcuggagcgcgagauggacgcccaccccaaggccgacuacuucggggccugcgucaagugcagcaagggcguguucggcgcggggcaggccugccaggccaugggcaaccucuaccacgacacgugcuucacgugcgccgcgugcucccgcaagcugcgggggaaggccuucuacuucgugaacggcaaggucuucugcgaggaggacuuccuguacagcggguuccagcaguccgccgaccgcugcuuccugugcggccaccucaucauggacaugauccugcaggcccugggcaagagcuaccaccccgggugcuuccggugcgugaucugcaacgagugccucgacggcgucccguucaccguggacuccgagaacaagaucuacugcgugcgcgacuaccacaagguccuggcccccaagugcgcggccugcgggcugcccauccucccgcccgagggcagcgacgagaccauccgggugguguccauggaccgcgacuaccacgucgagugcuaccacugcgaggacugcgggcuggagcugaacgacgaggacggccaccggugcuacccccucgaggaccaccuguucugccacagcugccacgugaagcgccuggagaagcggcccuccagcaccgcccuccaccagcaccacuucuga

SEQ ID NO: 32333 - RNA, 384 nt, Artificial Sequence
  derived and/or modified sequence opt1 from LIMD2__Homo_sapiens__NP_085053
auguuccaggccgccggcgcggcccaggccacccccagccacgacgccaagggcggcggguccagcaccgugcagcgcuccaagagcuucucccugcgggcccaggucaaggagacgugcgcggccugccagaagaccguguacccgauggagcgccucguggccgacaagcugaucuuccacaacagcugcuucugcugcaagcacugccacaccaagcugucccucgggagcuacgccgcgcugcacggggaguucuacugcaagccccacuuccagcagcuguucaaguccaagggcaacuacgacgagggcuucgggcggaagcagcacaaggagcucugggcccacaaggaggucgaccccggcaccaagacggccuga

SEQ ID NO: 32334 - RNA, 1842 nt, Artificial Sequence
  derived and/or modified sequence opt1 from LIMK1__Homo_sapiens__NP_001191355
augcugcucgccagcgcgccccgccggcgccgguuccugcagcgcgccaagugcugcgacugcuccgccagccugucccaccaguacuacgagaaggacggccagcuguucugcaagaaggacuacugggcccgguacggggagagcugccacggcugcuccgagcagaucaccaaggggcuggugauggucgccggcgagcugaaguaccacccggagugcuucaucugccugaccugcgggacguucaucggcgacggcgacaccuacacccugguggagcacagcaagcuguacugcgggcacugcuacuaccagaccguggucacgcccgugaucgagcagauccuccccgacucccccggcagccaccucccgcacaccgugacccuggucuccauccccgccagcucccacgggaagcgcggccucagcguguccaucgacccgccccacgggccgcccggcugcggcaccgagcacagccacacggugcggguccaggggguggaccccggcugcaugucccccgacgugaagaacagcauccacgucggggaccgcauccuggagaucaacggcacccccauccggaacgugccccuggacgagaucgaccuccugauccaggagaccucccgccugcuccagcugacccuggagcacgacccccacgacacgcucggccacgggcugggccccgagaccagcccgcuguccagccccgcguacacccccagcggggaggccggcuccagcgcccggcagaagcccgugcuccgcuccugcagcaucgaccgguccccgggggccggcagccugggcucccccgcgagccagcgcaaggaccuggggcgguccgagagccuccgcgucgugugccggccccaccgcaucuuccggcccuccgaccugauccacggcgaggugcuggggaagggcugcuucgggcaggccaucaaggucacccaccgcgagacgggcgaggugauggugaugaaggagcucauccgguucgacgaggagacccagcgcaccuuccugaaggaggucaaggugaugcgcugccuggagcacccgaacgugcucaaguucaucggcguccuguacaaggacaagcggcugaacuucaucaccgaguacaucaagggcgggacgcuccgcgggaucaucaagagcauggacucccaguaccccuggagccagcggguguccuucgccaaggacaucgccagcggcauggccuaccugcacuccaugaacaucauccaccgcgaccugaacagccacaacugccucguccgggagaacaagaacgugguggucgcggacuucgggcuggcccgccugaugguggacgagaagacccagcccgagggccuccggucccugaagaagcccgaccgcaagaagcgguacaccguggucggcaacccguacuggauggcccccgagaugaucaacgggcgcagcuacgacgagaagguggacguguucagcuucggcaucguccugugcgagaucaucgggcgggugaacgccgaccccgacuaccucccgcgcaccauggacuucggccugaacgugcggggcuuccuggaccgcuacugcccgcccaacugcccgcccuccuucuuccccaucacgguccggugcugcgaccucgaccccgagaagcgccccagcuucgugaagcuggagcacuggcuggagacccugcggaugcaccucgccgggcaccucccccugggcccccagcucgagcagcuggaccgcggguucugggagaccuaccggcgcggcgaguccgggcugcccgcgcaccccgaggugccggacuga

SEQ ID NO: 32335 - RNA, 2061 nt, Artificial Sequence
  derived and/or modified sequence opt1 from LIMK2__Homo_sapiens__NP_001026971
augggcagcuaccuguccgugcccgccuacuucaccagccgcgaccucuuccggugcuccgagugccaggacagccugaccaacugguacuacgagaaggacgggaagcuguacugcccgaaggacuacuggggcaaguucggggaguucugccacggcugcucccuccugaugaccgggcccuucauggucgccggcgaguucaaguaccaccccgagugcuucgcgugcaugagcugcaaggugaucaucgaggacggcgacgccuacgcccuggugcagcacgccacccucuacugcgggaagugccacaacgaggucgugcuggcccccauguucgagcgccuguccaccgagagcgugcaggagcagcucccguacuccgucacccugaucagcaugcccgcgacgaccgagggccggcgcggguucuccgugagcguggaguccgccugcagcaacuacgccaccaccguccaggugaaggaggugaaccggaugcacaucucccccaacaaccgcaacgccauccaccccggcgaccggauccuggagaucaacgggacgccgguccgcacccuccggguggaggagguggaggacgcgaucagccagaccucccagacccugcagcugcucaucgagcacgaccccgucagccagcgccuggaccagcugcggcucgaggcccgccuggcgccccacaugcagaacgccggccacccccacgcccuguccacgcucgacaccaaggagaaccuggagggcacccugcggcgccggagccuccgccggagcaacuccaucagcaaguccccggggcccagcucccccaaggagccccugcuguucagccgcgacaucucccggagcgagucccuccgcugcagcuccagcuacucccagcagaucuuccggccgugcgaccugauccacggcgaggugcuggggaagggcuucuucggccaggccaucaaggugacccacaaggccacggggaaggucauggugaugaaggagcucauccgcugcgacgaggagacccagaagaccuuccugaccgaggugaaggucaugcgcagccuggaccaccccaacgugcucaaguucaucggcgugcuguacaaggacaagaagcugaaccuccugacggaguacaucgagggcgggacccugaaggacuuccuccgguccauggaccccuuccccuggcagcagaagguccgcuucgccaaggggaucgccagcggcauggccuaccugcacuccaugugcaucauccaccgggaccugaacagccacaacugccucaucaagcuggacaagaccguggucguggcggacuucggccugucccgccucaucguggaggagcggaagcgcgccccgauggagaaggccaccacgaagaagcggacccugcgcaagaacgaccggaagaagcgcuacaccgucguggggaaccccuacuggauggcccccgagaugcugaacggcaagagcuacgacgagaccguggacaucuucagcuucgggaucguccucugcgagaucaucggccagguguacgccgaccccgacugccugccgcggacgcuggacuucgggcugaacgugaagcuguucugggagaaguucguccccaccgacugcccgcccgcguucuucccccucgccgccaucugcugccgccuggagcccgagucccgggcgcccccgggcgccgccggcgaggggcccggcugcgccgacgacgaggggcccgugcgccggcagggcaaggugaccaucaaguacgaccccaaggagcuccgcaagcaccugaaccuggaggaguggauccucgagcagcugacccggcuguacgacugccaggaggaggagaucagcgagcucgagaucgacgucgacgagcugcuggacauggaguccgacgacgccugggccagccgcgugaaggagcuccugguggacugcuacaagccgacggaggcguucaucuccgggcugcucgacaagauccgggccaugcagaagcugagcacgccccagaagaaguga

SEQ ID NO: 32336 - RNA, 990 nt, Artificial Sequence
  derived and/or modified sequence opt1 from LIMS1__Homo_sapiens__NP_001180411
augaccugcaacauggccaacgcccuggcgagcgcgaccugcgagcgcugcaagggcggguucgcccccgccgagaagaucgugaacuccaacggcgagcucuaccacgagcagugcuucgucugcgcccagugcuuccagcaguucccggaggggcuguucuacgaguucgagggccggaaguacugcgagcacgacuuccagaugcuguucgcccccugcugccaccagugcggggaguucaucaucggccgcgugaucaaggccaugaacaacagcuggcaccccgagugcuuccggugcgaccucugccaggaggugcuggccgacaucggcuucgucaagaacgccgggcgccaccugugccggcccugccacaaccgcgagaaggcgcggggccucgggaaguacaucugccagaagugccacgccaucaucgacgagcagccgcugaucuucaagaacgaccccuaccaccccgaccacuucaacugcgccaacugcggcaaggagcugacggccgacgcccgcgagcucaagggggagcuguacugccugcccugccacgacaagaugggcgugccgaucugcggcgcgugccggcgccccaucgaggggcggguggucaacgccaugggcaagcaguggcacguggagcacuucgugugcgccaagugcgagaagcccuuccucgggcaccgccacuacgagcggaagggccuggccuacugcgagacccacuacaaccagcuguucggcgacgucugcuuccacugcaaccgcgugaucgagggggacguggucuccgcccucaacaaggcguggugcgugaacugcuucgccugcagcacgugcaacaccaagcugacccugaagaacaaguucguggaguucgacaugaagcccgucugcaagaagugcuacgagaaguucccgcucgagcugaagaagcggcugaagaagcucgccgagacccugggccgcaaguga

SEQ ID NO: 32337 - RNA, 1092 nt, Artificial Sequence
  derived and/or modified sequence opt1 from LIMS2__Homo_sapiens__NP_001129509
augaccggccgcaagcggaaguggggcgagaccgggacggggagcggcgccgcccccgcggccgcccugcgcugguccaacaugagcgacgcccucgccaacgcggugugccagcggugccaggcccgcuucuccccggccgagcggaucgucaacagcaacggggagcuguaccacgagcacugcuucgugugcgcccagugcuuccgccccuuccccgagggccuguucuacgaguucgagggccggaaguacugcgagcacgacuuccagaugcuguucgcgcccugcugcggguccugcggcgaguucaucaucgggcgcgugaucaaggccaugaacaacaacuggcacccgggcugcuuccggugcgagcucugcgacgucgagcuggccgaccucggguucgugaagaacgccggccgccaccugugccggcccugccacaaccgcgagaaggccaagggccuggggaaguacaucugccagcggugccaccucgugaucgacgagcagccccugauguuccgcagcgacgcguaccaccccgaccacuucaacugcacccacugcggcaaggagcugaccgccgaggcccgggagcucaagggggagcuguacugccugccgugccacgacaagaugggcguccccaucugcggcgccugccgccggcccaucgaggggcgcguggugaacgcccucggcaagcaguggcacgucgagcacuucgugugcgcgaagugcgagaagcccuuccuggggcaccggcacuacgagaagaagggccuggccuacugcgagacccacuacaaccagcuguucggggacgugugcuacaacugcucccacgucaucgagggcgacguggugagcgcccucaacaaggccuggugcgucuccugcuucagcugcuccacgugcaacagcaagcugacccucaagaacaaguucguggaguucgacaugaagccggugugcaagcgcugcuacgagaaguucccccuggagcugaagaagcggcucaagaagcuguccgagcugaccagccgcaaggcccagcccaaggcgaccgaccucaacuccgccuga

SEQ ID NO: 32338 - RNA, 753 nt, Artificial Sequence
  derived and/or modified sequence opt1 from LIN28B__Homo_sapiens__NP_001004317
auggccgagggcggggccagcaagggcgggggcgaggagcccgggaagcugccggagcccgcggaggaggagucccaggugcuccgcggcaccggccacugcaagugguucaacguccggaugggguucggcuucaucagcaugaucaaccgcgaggggagcccccuggacauccccguggacguguucguccaccagagcaagcuguucauggagggcuuccggucccucaaggagggggagccgguggaguucaccuucaagaaguccuccaagggccuggagagcauccgcgugacgggccccgggggcucccccugccuggggagcgagcggcgccccaagggcaagacccuccagaagcggaagccgaagggcgaccgcugcuacaacugcgggggccuggaccaccacgccaaggagugcucccugccgccccagcccaagaagugccacuacugccagagcaucaugcacauggucgccaacugcccccacaagaacguggcccagccgcccgccuccagccaggggcggcaggaggcggagucccagcccugcaccagcacccucccccgcgaggugggcgggggccacggcugcacguccccgcccuucccccaggaggcccgggccgagaucagcgagcgcuccgggcggagcccccaggaggccagcuccaccaagagcuccaucgcgcccgaggagcagagcaagaagggccccuccguccagaagcgcaagaagaccuga

SEQ ID NO: 32339 - RNA, 351 nt, Artificial Sequence
  derived and/or modified sequence opt1 from LIN52__Homo_sapiens__NP_001019845
augggcuggaagauggccagccccaccgacgggaccgaccuggaggccucccuccugagcuucgagaagcuggaccgcgcguccccggaccucuggcccgagcagcugcccggcguggccgaguucgccgccagcuucaagucccccaucacgagcuccccgcccaaguggauggccgagaucgagcgggacgacaucgacaugcugaaggagcucgggagccugaccaccgcgaaccugauggagaagguccgcggccuccagaaccuggccuaccagcuggggcucgacgagucccgggagaugacccgcggcaaguuccugaacauccuggagaagcccaagaaguga

SEQ ID NO: 32340 - RNA, 702 nt, Artificial Sequence
  derived and/or modified sequence opt1 from LIN7A__Homo_sapiens__NP_004655
augcugaagcccagcgugaccuccgccccgaccgccgacauggcgacgcucaccgucgugcagccccugacccuggaccgcgacguggcccgggccaucgagcuccuggagaagcugcaggagagcggcgagguccccgugcacaagcuccagucccugaagaaggugcugcagagcgaguucugcaccgccauccgcgaggucuaccaguacaugcacgagacgaucaccgugaacgggugccccgaguuccgggcccgcgcgaccgccaaggccaccguggccgcguucgccgccuccgagggccacagccacccgcgggucguggagcuccccaagacggacgaggggcugggcuucaacgugaugggcgggaaggagcagaacucccccaucuacaucagccgcaucauccccggcggggucgccgagcggcacggcgggcugaagcgcggcgaccagcuccuguccgugaacggggugagcgucgagggcgagcaccacgagaaggccguggagcugcucaaggcggccaaggacuccgugaagcuggucgugcgguacaccccgaaggugcuggaggagauggaggcccgcuucgagaagcuccggaccgcccgccggcgccagcagcagcagcugcugauccagcagcagcagcagcagcagcagcagcagacccagcagaaccacaugagcuga

SEQ ID NO: 32341 - RNA, 624 nt, Artificial Sequence
  derived and/or modified sequence opt1 from LIN7B__Homo_sapiens__NP_071448
auggccgcccugguggagccccucggccuggagcgcgacgucagccgggcgguggagcugcucgagcgccugcagcgguccggggagcugccgccccagaagcuccaggcccugcagcgcgugcugcagagccgguucugcuccgccauccgcgaggucuacgagcagcucuacgacacccuggacaucaccggcagcgccgagauccgggcccacgcgacggccaaggccaccguggccgcguucaccgccuccgaggggcacgcccacccccgcguggucgagcugcccaagaccgacgagggccucggguucaacaucaugggcggcaaggagcagaacagcccgaucuacaucucccgggugauccccgggggcguggccgaccgccacgggggccugaagcgcggggaccagcugcucagcgucaacggcguguccguggagggcgagcagcacgagaaggccgucgagcugcugaaggcggcccaggggagcgugaagcucgugguccgguacacgccccgggugcuggaggagauggaggcccgcuucgagaagaugcgguccgcccgccggcgccagcagcaccagagcuacuccagccuggagucccggggcuga

SEQ ID NO: 32342 - RNA, 594 nt, Artificial Sequence
  derived and/or modified sequence opt1 from LIN7C__Homo_sapiens__NP_060832
auggccgcccugggcgagcccgugcgccucgagcgggacaucugccgcgcgaucgagcugcuggagaagcuccagcggagcggggaggucccgccccagaagcugcaggcccugcagcgcgugcuccaguccgaguucugcaacgccgugcgggaggucuacgagcacguguacgagaccguggacaucagcuccagccccgagguccgcgccaacgccaccgcgaaggccacgguggccgccuucgcggccuccgagggccacagccacccccggguggucgagcugccgaagaccgaggaggggcugggcuucaacaucaugggcgggaaggagcagaacucccccaucuacaucagccgcaucauccccggcgggaucgccgaccggcacggcgggcucaagcgcggcgaccagcugcuguccgugaacggggugagcgucgagggcgagcaccacgagaaggccguggagcuccugaaggccgcgcagggcaaggugaagcuggucgugcgguacacccccaaggugcucgaggagauggagucccgcuucgagaagaugcggagcgccaagcgccggcagcagaccuga

SEQ ID NO: 32343 - RNA, 1572 nt, Artificial Sequence
  derived and/or modified sequence opt1 from LIN9__Homo_sapiens__NP_001257338
augcaccgcggcgggcagccccugaagaagcggcgcggcagcuucaagauggccgagcucgaccagcugccggacgaguccagcuccgccaaggcgcuggugagccucaaggaggggucccugagcaacaccuggaacgagaaguacuccagccugcagaagacccccgucuggaagggccggaacacguccagcgccguggagaugaaguucaccgccaccauguccacccccgacaagaaggccagccagaagaucggguuccgccuccggaaccugcugaagcuccccaaggcccacaaguggugcaucuacgagugguucuacuccaacaucgacaagccgcuguucgagggcgacaacgacuucugcgugugccugaaggagagcuuccccaaccucaagacgcgcaagcugacccgggucgaguggggcaagauccgccggcugauggggaagccccgccggugcuccagcgcguucuucgaggaggagcgcuccgcccucaagcagaagcggcagaagauccgccugcugcagcagcggaagguggccgacgugagccaguucaaggaccuccccgacgagaucccgcugccccuggucaucggcaccaaggugaccgcccgccuccgcggggugcacgacggccuguucacggggcagaucgacgcggucgacacccugaacgccaccuaccgggugaccuucgaccggacgggccucggcacccacaccauccccgacuacgaggugcuguccaacgagccccacgagaccaugccgaucgccgccuucgggcagaagcagcgccccagccgguucuucaugacgccgccccgccugcacuacaccccgccccuccagagccccaucaucgacaacgacccccugcugggccagucccccuggcgcagcaagaucuccgggagcgacaccgagacccucggcggcuuccccgucgaguuccugauccaggugacgcggcuguccaagauccucaugaucaagaaggagcacaucaagaagcugcgcgagaugaacaccgaggccgagaagcucaagagcuacuccaugcccaucagcaucgaguuccagcggcgcuacgcgaccaucgugcuggagcuggagcagcugaacaaggaccucaacaagguccugcacaaggugcagcaguacugcuacgagcuggcccccgaccaggggcuccagccggccgaccagcccaccgacaugcggcgccggugcgaggaggaggcccaggagaucgugcgccacgccaacuccagcacgggccagcccugcgucgagaacgagaaccugaccgaccugaucucccggcucaccgcgauccugcugcagaucaagugccucgccgagggcggggaccugaacagcuucgaguucaagucccugaccgacagccugaacgacaucaaguccacgaucgacgccagcaacaucuccugcuuccagaacaacguggagauccacguggcccacauccagagcgggcucucccagaugggcaaccugcacgccuucgcggccaacaacaccaaccgcgacuga

SEQ ID NO: 32344 - RNA, 1845 nt, Artificial Sequence
  derived and/or modified sequence opt1 from LINGO1__Homo_sapiens__NP_001288126
augcuggccggcggggugcgcagcaugcccuccccgcuccuggccugcuggcagcccauccugcuccugguccugggcagcgugcucuccgggagcgcgaccggcugcccgccccggugcgagugcuccgcccaggaccgcgccgugcugugccaccggaagcgcuucgucgccgugcccgaggggauccccaccgagacgcggcugcucgaccugggcaagaaccgcaucaagacccugaaccaggacgaguucgccagcuucccccaccucgaggagcuggagcugaacgagaacaucguguccgcggucgagcccggcgccuucaacaaccucuucaaccugcggacccuggggcuccgcagcaaccggcugaagcugaucccgcucggcguguucaccgggcuguccaaccugacgaagcucgacaucagcgagaacaagaucgugauccugcuggacuacauguuccaggaccucuacaaccugaagucccuggaggucggcgacaacgaccucguguacaucagccaccgcgccuucuccgggcugaacagccuggagcagcucacccuggagaagugcaaccugaccuccauccccaccgaggcccucagccaccuccacggccugaucgugcuccggcugcgccaccugaacaucaacgcgauccgggacuacuccuucaagcgccucuaccggcugaagguccuggagaucagccacuggcccuaccucgacacgaugacccccaacugccuguacggccugaaccucaccucccugagcaucacccacugcaaccugacggccgugccguaccuggccgugcgccaccucgucuaccugcgguuccugaaccucagcuacaaccccaucuccaccaucgaggggagcaugcugcacgagcugcuccgccugcaggagauccagcuggugggcgggcagcucgccguggucgagcccuacgccuuccggggccugaacuaccugcgcgugcucaacguguccggcaaccagcugaccacccuggaggagagcgucuuccacuccguggggaaccucgagacgcugauccuggacagcaacccccucgcgugcgacugccggcugcuguggguguuccgccgccgguggcgccucaacuucaaccggcagcagccgaccugcgccacccccgaguucguccagggcaaggaguucaaggacuuccccgacgugcugcugcccaacuacuucacgugccgccgggcccgcauccgggaccgcaaggcccagcaggucuucguggacgaggggcacaccgugcaguucgucugccgggccgacggcgacccgccgcccgcgauccucuggcugagcccccgcaagcaccugguguccgccaaguccaacgggcggcucaccguguuccccgacggcacccuggagguccgcuacgcccaggugcaggacaacggcaccuaccugugcaucgccgccaacgccgggggcaacgacagcaugcccgcccaccuccacgugcgguccuacagccccgacuggccccaccagccgaacaagacguucgccuucaucuccaaccagcccggggagggcgaggccaacagcacccgcgccaccguccccuucccguucgacaucaagacccugaucaucgcgacgaccaugggguucaucuccuuccugggcguggugcuguucugccugguccuccuguuccuguggagccggggcaaggggaacaccaagcacaacaucgagaucgaguacgugccccgcaaguccgacgccggcaucagcuccgccgacgcgccccggaaguucaacaugaagaugaucuga

SEQ ID NO: 32345 - RNA, 1821 nt, Artificial Sequence
  derived and/or modified sequence opt1 from LINGO2__Homo_sapiens__XP_011516032
augcugcacaccgccaucagcugcuggcagcccuuccucggccuggccgugguccugaucuucaugggguccaccaucggcugcccggcgcgcugcgagugcagcgcccagaacaaguccgugagcugccaccggcgccggcucaucgccauccccgaggggauccccaucgagacgaagauccuggaccuguccaagaaccgccucaagagcgugaaccccgaggaguucaucuccuacccgcugcuggaggagaucgaccucagcgacaacaucaucgccaacgucgagcccggcgccuucaacaaccuguucaaccugcggucccuccgccugaaggggaaccggcugaagcucgugccccugggcguguucaccggccugagcaaccucaccaagcuggacaucuccgagaacaagaucgucauccugcucgacuacauguuccaggaccugcacaaccucaagagccuggaggugggggacaacgaccugguguacaucucccaccgcgcguucagcggccugcucucccuggagcagcugacccucgagaagugcaaccugacggccguccccaccgaggcccugagccaccuccggucccugaucagccugcaccucaagcaccugaacaucaacaacaugccgguguacgccuucaagcgccuguuccaccucaagcaccuggagaucgacuacuggccccugcucgacaugaugcccgcgaacucccuguacgggcugaaccucaccagccugagcgugaccaacacgaaccuguccaccguccccuuccucgccuucaagcaccugguguaccugacccaccugaaccucagcuacaacccgaucuccaccaucgaggccggcauguucagcgaccugauccggcugcaggagcuccacaucgugggggcccagcugcgcacgaucgagccccacuccuuccagggccugcgguuccuccgcguccugaacgugagccagaaccugcucgagacccuggaggagaacguguucuccagcccccgggcccuggagguccucuccaucaacaacaacccccuggcgugcgacugccgccugcucuggauccugcagcggcagccgacccugcaguucggcgggcagcagcccaugugcgccggccccgacaccauccgcgagcggagcuucaaggacuuccacuccacggcccucagcuucuacuucacgugcaagaagcccaagauccgcgagaagaagcugcagcaccuccugguggacgaggggcagaccgugcagcuggagugcuccgccgacggcgacccgcagcccgucaucagcugggugacgccccggcgccgcuucaucaccaccaaguccaacggccgggccaccgugcugggggacggcacccucgagauccgcuucgcgcaggaccaggacagcgggauguacgucugcaucgccuccaacgccgccggcaacgacaccuucaccgccagccugaccgugaagggguucgcguccgaccgguuccuguacgccaaccgcacccccauguacaugacggacagcaacgacaccaucagcaacggcaccaacgccaacaccuucucccucgaccugaagacgauccuggucagcaccgccaugggcugcuucaccuuccucgggguggugcuguucugcuuccugcuccuguucgucuggucccggggcaaggggaagcacaagaacagcaucgaccuggaguacgugccgcgcaagaacaacggcgccguggucgagggggagguggcgggcccccggcgcuucaacaugaagaugaucuga

SEQ ID NO: 32346 - RNA, 1782 nt, Artificial Sequence
  derived and/or modified sequence opt1 from LINGO4__Homo_sapiens__NP_001004432
auggacgccgccaccgcccccaagcaggccuggccgcccuggccgccccugcuguuccugcugcuccugcccggcgggagcggcggguccugccccgccgugugcgacugcaccagccagccccaggccguccugugcggccaccgccagcucgaggccgugcccgggggccugccgcuggacacggagcuccuggaccuguccggcaaccggcucugggggcugcagcagggcaugcugagccgccucucccugcugcaggagcucgaccugagcuacaaccagcuguccacccucgagcccggggcguuccacggccugcagagccugcucacccugcggcugcaggggaaccgccuccggaucaugggccccggcguguucuccgggcugagcgcccugacccuccuggaccugcgccucaaccagaucguccuguuccuggacggcgccuucggggagcucggcucccugcagaagcuggaggugggcgacaaccaccucguguucgucgcccccggggcguucgccggccuggccaagcugagcacgcucacccuggagcggugcaaccuguccaccgugccggggcucgcccuggcccgccugcccgcgcucguggcccugcggcugcgcgagcuggacaucggccggcuccccgccggggcccugcgcggccugggccagcucaaggagcuggagauccaccuguggcccagccucgaggcccuggacccggggucccuggucggccucaaccugagcucccuggcgaucacccggugcaaccucagcuccgugcccuuccaggcccuguaccaccugagcuuccuccgcgugcuggaccugagccagaaccccaucuccgccauccccgcccggcgccucagcccgcugguccggcugcaggagcuccgccuguccggggccugccugacgagcaucgcggcccacgccuuccacggccucaccgccuuccaccuccuggacguggccgacaacgcgcuccagacccuggaggagaccgccuuccccucccccgacaagcuggugacgcuccggcugagcgggaacccccugaccugcgacugccgccuccuguggcugcuccggcugcgccgccaccuggacuucggcauguccccgcccgccugcgccggcccccaccacguccagggcaagagccucaaggaguucuccgacauccugcccccggggcacuucacgugcaagcccgcgcugauccgcaagagcgggccccggugggugaucgccgaggagggcgggcacgccguguucuccugcagcggcgacggcgacccggcccccaccgucuccuggaugcggccccacggggccuggcucggccgcgcggggcgggugcgcgugcuggaggacggcacccuggagauccggagcguccagcuccgcgaccggggcgccuacgugugcguggucuccaacguggccgggaacgacagccugcgcaccuggcuggaggucauccagguggagcccccgaacggcacccucuccgaccccaacaucaccgugcccgggauccccggcccguucuuccuggacagccgcggggucgccauggugcuggccgugggcuuccuccccuuccugacguccgucacccugugcuucggccucaucgcgcuguggagcaaggggaagggccgggugaagcaccacaugaccuucgacuucguggcgccccggcccagcggggacaagaacuccggcgggaaccgcgucaccgccaagcuguucuga

SEQ ID NO: 32347 - RNA, 2274 nt, Artificial Sequence
  derived and/or modified sequence opt1 from LINS__Homo_sapiens__NP_001035706
augaagguguucugcgagguccuggaggagcucuacaagaaggugcugcugggcgccacccucgagaacgacagccacgacuacaucuucuaccugaaccccgccguguccgaccaggacugcagcaccgcgacgucccuggagugggccaacacgugcgggauccagggccgccaccagccgaucagcgucgggguggcccccaucgccguggcccccgucugccucaagaccaacucccagaugagcggcucccgggaggugaugcugcugcagcucaccgugaucaaggucaugaccacccgcauccugagcgugaagaccgaguuccacgcgaaggagcaguaccgggacgugaucaagauccugcucgaguccgccaaggucgacagcaagcugaucugcauguuccagaacuccgacaagcugcucagccacauggccgcccagugccuggcgcugcuccuguacuuccagcugcgcgagaagaucacccucuccaacagcuggaucgccuucugccagaagaaccuguccgaguacagcgaguccaacaaggccaucuacugccuguggacgcucaccgccaucaucaaggagaucuucaaggacagcugcucccagaagaccgagauccugaagcaguuccugacccacuucgacacgaucuucgagguguucuacaacagccucuucagccagcacuucgagaacugccgggacaccuccaagaucgugaacauccugaugugcuuccuggaccuccuggagcugcucaucgccagccgcauccaccugaagcugcacuucacgugccagcggauccucuuccugaagcccuccugcaugcuggaggucaucaccuggccgauccaggcguucgugaagcgcaaggugaucaucuuccucaagaagugccugcugugcaaggucggggaggaccucugccggggcagcgugcccgcccugaugccgcccgaccaccacguggccgucgacaugcuggcccucgccaacgcggugcugcaggccgugaacuccggccugcucaagacccugagcgucuacgagaagcacuccuucuucgggggcgacgaggugcagcccgagugcgagcugaucaccagccccgaccacgucauccugcgcgccgccucccucgugaucaugaagucccuggagaucaaguuccagaacuacagcagcgccuccgagaugaagguggaccugcagcgguucaugagcgagcuccugaccuuccugaagccccaccuccagcccucccugcagcugcacaacccgugcaaguggcucagccgcgucuucaucgagcaggacgacgacaugcuggaggcggccaaggccucccuggggaucuaccucacccugacgcggggcugcgaggccaccgagagccugacccaggggaaggagaugugggaccaccacacccacgagaacggcuacaacccccacugcaucuuccucuucuuccugaagaacaucggcuucgacuccacggugcugcucgacuuccugaucagcagcgagaccugcuuccuggaguacuucgugcgcuaccucaagcugcugcagaaggacugggacaacuucuucaccaucugcaacaacuucgacgccaccgaguccaaguacgacaucagcaucugcgggugcguccccucccucgugcaggaccagagcuccaaccagacgaucccccaccggcugaccgcgccgcacagccaccgcgacgugugcgcccggcacuccugggccagcgacgcccccuccgagccccugaaggcggucaugagcaagggcgcccacaccaugugcgccuccagccucuccagcccccgcgccucccagagccugguggacuacgacuccagcgacgacagcgacguggaguccaccgagcagugccuggccaacagcaagcagacgucccuccaccagcaggcgaccaaggagauccaggacgccgccgggaccagccgggacaagaaggaguucucccuggagccgcccagccgcccccugguccucaaggaguucgacaccgccuucuccuucgacugcgagguggcccccaacgacguggucagcgaggugggcaucuucuaccggaucgugaagugcuuccaggagcugcaggacgcgaucugccgccugcagaagaagaaccucuucccguacaaccccacggcccugcugaagcuccugaaguacaucgaggucaucuccaacaagaccaugaacacccuguga

SEQ ID NO: 32348 - RNA, 1200 nt, Artificial Sequence
  derived and/or modified sequence opt1 from LIPA__Homo_sapiens__NP_000226
augaagaugcgcuuccugggccucguggucugccuggugcuguggacccuccacagcgagggguccggcgggaagcugaccgccguggaccccgagacgaacaugaacgucagcgagaucaucuccuacuggggcuucccgagcgaggaguaccugguggagaccgaggacggguacauccucugccugaaccggaucccccacggccgcaagaaccacuccgacaagggccccaagcccguggucuuccugcagcacgggcuccuggccgacagcuccaacugggugaccaaccuggcgaacagcucccucggcuucauccuggccgacgccggguucgacguguggaugggcaacagccgggggaacaccuggucccgcaagcacaagacgcugagcgucucccaggacgaguucugggccuucagcuacgacgagauggccaaguacgaccucccggcguccaucaacuucauccugaacaagaccggccaggagcaggucuacuacgugggccacagccaggggaccaccaucggcuucaucgccuucucccagauccccgagcuggccaagcggaucaagauguucuucgcccucgggcccguggcgagcguggccuucugcacgucccccauggccaagcugggccgccugccggaccaccucaucaaggaccuguucggcgacaaggaguuccugccccagagcgccuuccucaaguggcuggggacccacgugugcacccacgucauccugaaggagcucugcggcaaccugugcuuccugcucugcggguucaacgagcggaaccugaacaugagccgcguggacguguacaccacgcacucccccgccggcaccagcguccagaacaugcugcacuggucccaggcggugaaguuccagaaguuccaggccuucgacugggggagcuccgccaagaacuacuuccacuacaaccagagcuacccgcccaccuacaacgugaaggacaugcucguccccaccgccgugugguccggcggccacgacuggcuggccgacguguacgacgucaacauccugcucacgcagaucaccaaccugguguuccacgagagcauccccgagugggagcaccuggacuucaucugggggcucgacgcgcccuggcggcuguacaacaagaucaucaaccugaugcgcaaguaccaguga

SEQ ID NO: 32349 - RNA, 1500 nt, Artificial Sequence
  derived and/or modified sequence opt1 from LIPC__Homo_sapiens__XP_005254429
auggacaccagcccccugugcuucuccauccuccuggugcugugcaucuucauccagagcuccgcccucggccagagccugaagccggagcccuucgggcgccgggcccaggcggucgagaccaacaagacgcugcacgagaugaagacccgcuuccuccuguucggcgagaccaaccaggggugccagauccggaucaaccaccccgacacccugcaggagugcggcuucaacuccagccucccccuggugaugaucauccacgggugguccguggacggcguccuggagaacuggaucuggcagaugguggccgcccucaagagccagccggcccagcccgugaacgucggccugguggacuggaucacgcuggcccacgaccacuacaccaucgcggugcgcaacacccggcucgucgggaaggagguggccgcccugcugcgcuggcucgaggaguccgugcagcugagccggucccacguccaccugaucggcuacagccucggggcccacguguccggcuucgcggggagcuccaucggcggcacccacaagaucgggcgcaucacgggccuggacgccgccgggccccuguucgagggcagcgcccccuccaaccggcucagcccggacgacgccaacuucguggacgcgauccacaccuucacccgcgagcacaugggccuguccgucgggaucaagcagcccaucggccacuacgacuucuaccccaacgggggcagcuuccagcccgggugccacuuccuggagcucuaccggcacaucgcccagcacggcuucaacgccaucacccagacgaucaagugcagccacgagcgcuccgugcaccuguucaucgacagccugcuccacgccggcacccaguccauggccuacccgugcggggacaugaacagcuucucccagggccugugccugagcugcaagaaggggcggugcaacacccucggcuaccacgugcgccaggagccccgguccaagagcaagcgccuguuccuggucacccgggcgcagucccccuucaagguguaccacuaccaguucaagauccaguucaucaaccagacggagacccccauccagaccaccuucacgaugagccuccuggggaccaaggagaagaugcagaagaucccgaucacccugggcaagggcaucgccuccaacaagaccuacagcuuccucaucacgcuggacguggacaucggggagcugaucaugaucaaguucaagugggagaacuccgccgucugggccaacgugugggacaccgugcagaccaucauccccuggagcaccggcccccgccacuccgggcucguccugaagacgauccgggugaaggccggcgagacccagcagcgcaugaccuucugcagcgagaacaccgacgaccugcuccugcggcccacgcaggagaagaucuucgucaagugcgagaucaaguccaagaccagcaagcgcaagauccgcuga

SEQ ID NO: 32350 - RNA, 3231 nt, Artificial Sequence
  derived and/or modified sequence opt1 from LIPE__Homo_sapiens__NP_005348
auggagcccggcagcaaguccgugagccgcuccgacuggcagccggagccccaccagcggcccaucacgccccuggagccggggcccgagaagacccccaucgcccagcccgagagcaagacccuccagggcuccaacacccagcagaagccggccagcaaccagcgcccccugacccagcaggagacccccgcgcagcacgacgccgagucccagaaggagccccgggcccagcagaaguccgccucccaggaggaguuccuggccccgcagaagcccgcgccccagcagagccccuacauccagcgcguccuccugacgcagcaggaggccgccucccagcaggggccgggccuggggaaggagagcaucacccagcaggagcccgcccuccggcagcgccacguggcgcagcccggccccggcccgggggagcccccgcccgcccagcaggaggccgaguccacccccgccgcccaggcgaagcccggcgccaagcgggagcccagcgcccccaccgaguccacgagccaggagaccccggagcaguccgacaagcagaccacccccgugcagggggccaagagcaagcagggcucccugacggagcugggguuccucaccaagcugcaggagcugagcauccagcgcagcgcccucgaguggaaggcgcuguccgagugggucaccgacagcgaguccgagagcgacgugggcuccagcuccgacaccgacagccccgccacgaugggcgggaugguggcccagggcgucaagcugggguucaagggcaaguccggcuacaaggugaugagcggguacuccggcaccagcccgcacgagaagaccuccgcccggaaccaccgccacuaccaggacaccgccagccggcucauccacaacauggaccugcgcacgaugacccagucccuggugacccucgcggaggacaacaucgccuucuucagcucccaggggcccggcgagaccgcccagcggcugagcggggucuucgccggcgugcgcgagcaggcccugggccucgagcccgcgcuggggcggcugcucggcguggcccaccuguucgaccuggaccccgagacgccggccaacggguaccgcagccucguccacaccgcccggugcugccuggcgcaccuccugcacaagagccgcuacguggccagcaaccggcgcuccaucuucuuccggaccagccacaaccuggccgagcuggaggccuaccucgccgcgcugacccagcugcgcgcccucguguacuacgcccagcgccugcuggucacgaaccggcccggcguccucuucuucgagggggacgagggccugaccgccgacuuccugcgcgaguacgugacccuccacaagggcugcuucuacgggcggugccugggcuuccaguucacccccgccauccgccccuuccugcagacgaucuccaucgggcucgugagcuucggcgagcacuacaagcggaacgagaccgggcuguccguggcggccagcucccuguucaccagcggccgcuucgccaucgacccggagcuccggggcgccgaguucgagcgcaucacccagaaccuggacgugcacuucuggaaggccuucuggaacaucacggagauggagguccuguccagccuggcgaacauggccuccgccaccgugcgggugagccgccuccugucccugccgcccgaggccuucgagaugccccucaccgcggaccccacccugaccgucacgaucagcccgccccuggcccacaccgggcccggccccgugcucguccggcugaucuccuacgaccugcgcgaggggcaggacagcgaggagcucuccagccugaucaagagcaacggccagcggucccuggagcucuggccccgcccccagcaggcgccccggagccgcucccugaucgugcacuuccacggcgggggcuucguggcccagaccagccggucccacgagccguaccucaagagcugggcccaggagcugggggcccccaucaucuccaucgacuacagccuggcccccgaggcccccuucccgcgcgcccuggaggagugcuucuucgccuacugcugggcgaucaagcacugcgcccuccugggcuccaccggggagcggaucugccuggccggcgacagcgccggcgggaaccucugcuucacggucgcccugcgcgcggccgccuacggcgugcgcgugcccgacgggaucauggccgcguaccccgccaccaugcugcagccggccgccucccccagccggcuccugucccugauggacccccuccugccccugagcguccucuccaagugcgugagcgccuacgcgggcgccaagaccgaggaccacuccaacagcgaccagaaggcccuggggaugaugggccuggugcgccgggacaccgcccuccugcugcgcgacuuccggcucggcgccuccagcuggcugaacagcuuccuggagcucuccgggcgcaagagccagaagauguccgagccgaucgcggagcccaugcggcgcagcgucuccgaggccgcccuggcccagccccagggcccccuggggacggacagccucaagaaccugacccugcgggaccucucccugcgcggcaacagcgagaccuccagcgacaccccggagaugucccugagcgccgagacgcucucccccagcacccccuccgacgugaacuuccugcugcccccggaggacgcgggggaggaggccgaggccaagaacgagcucagccccauggaccggggccugggcgugcgcgccgccuuccccgagggguuccacccccggcgcuccagccagggcgcgacccagaugccgcuguacuccagccccaucgucaagaaccccuucaugagcccccuccuggccccggacuccaugcucaagagccugccgcccgugcacaucguggccugcgcccuggaccccaugcuggacgacuccgucaugcucgcgcggcgccugcggaaccuggggcagcccgugacccuccgcguggucgaggaccugccccacggcuuccugacgcucgccgcccugugccgggagacccgccaggccgccgagcugugcguggagcggauccgccucgugcugaccccgcccgcgggggccggccccagcggcgagaccggggccgccggcgucgacgggggcugcggcgggcgccacuga

SEQ ID NO: 32351 - RNA, 1098 nt, Artificial Sequence
  derived and/or modified sequence opt1 from LIPF__Homo_sapiens__NP_001185757
auguggcugcuccugaccauggccagccugaucuccgugcucggcaccacgcacgggcuguucggcaagcugcaccccgggagcccggaggucaccaugaacaucucccagaugaucaccuacuggggcuaccccaacgaggaguacgagguggugaccgaggacggguacauccucgaggucaaccgcauccccuacggcaagaagaacagcggcaacacggacgccggguacgacguguggcugggcaacucccgggggaacaccugggcccgccggaaccuguacuacagccccgacuccguggaguucugggccuucagcuucgacgagauggccaaguacgaccucccggccaccaucgacuucaucgucaagaagaccggccagaagcagcugcacuacguggggcacucccagggcacgaccaucggcuucaucgccuucagcaccaaccccucccuggcgaagcgcaucaagaccuucuacgcccucgcccccguggccacggucaaguacaccaagagccugaucaacaagcugcgguucgugccccagucccucuucaaguucaucuucggggacaagaucuucuacccgcacaacuucuucgaccaguuccuggcgaccgaggugugcagccgcgagaugcugaaccuccugugcuccaacgcccuguucaucaucugcggcuucgacagcaagaacuucaacaccucccggcucgacgucuaccugagccacaaccccgccgggacguccgugcagaacauguuccacuggacccaggccgucaagagcggcaaguuccaggccuacgacuggggcagccccgugcagaaccgcaugcacuacgaccagucccagcccccguacuacaacgugaccgcgaugaacgugcccaucgccgucuggaacgggggcaaggaccugcucgccgacccccaggacguggggcugcugcuccccaagcugccgaaccugaucuaccacaaggagauccccuucuacaaccaccucgacuucaucugggccauggacgcgccccaggagguguacaacgacaucgucagcaugaucuccgaggacaagaaguga

SEQ ID NO: 32352 - RNA, 1503 nt, Artificial Sequence
  derived and/or modified sequence opt1 from LIPG__Homo_sapiens__NP_006024
augagcaacuccgugccccugcucugcuucuggagccugugcuacugcuucgccgccggcuccccgguccccuucgggcccgagggccgccuggaggacaagcuccacaagcccaaggcgacccagaccgaggugaagccgagcgugcgguucaaccugcgcacguccaaggaccccgagcacgaggggugcuaccugagcgucggccacucccagccccucgaggacugcagcuucaacaugaccgccaagaccuucuucaucauccacggguggaccauguccggcaucuucgagaacuggcugcacaagcuggugagcgcccuccacacgcgggagaaggacgccaacguggucgugguggacuggcugccccuggcccaccagcucuacaccgacgcggucaacaacacccgcguggugggccacuccaucgcccggaugcuggacuggcugcaggagaaggacgacuucagccucgggaacguccaccugaucggcuacucccugggggcccacguggccggcuacgcggggaacuucgugaagggcaccgucggccgcaucacggggcucgacccggccggccccauguucgagggggccgacauccacaagcggcugagccccgacgacgccgacuucguggacgugcugcacaccuacacccgcuccuucggccucagcaucggcauccagaugcccgucgggcacaucgacaucuacccgaacggcggggacuuccagcccggcugcgggcugaacgacgugcugggcuccaucgccuacggcaccaucacggagguggucaagugcgagcacgagcgggcggugcaccucuucguggacagccuggucaaccaggacaagcccuccuucgccuuccagugcaccgacagcaaccgcuucaagaaggggaucugccugagcugccggaagaaccgcugcaacuccaucggcuacaacgccaagaagaugcggaacaagcgcaacagcaagauguaccucaagacccgggccgggaugcccuuccgcguguaccacuaccagaugaagauccacgucuucuccuacaagaacaugggcgagaucgagccgaccuucuacgugacgcuguacgggaccaacgccgacagccagacccugccccucgagaucguggagcggaucgagcagaacgcgaccaacacguuccuggucuacaccgaggaggaccugggcgaccuccugaagauccagcugaccugggagggcgccucccagagcugguacaaccucuggaaggaguuccgcuccuaccugagccagccccggaaccccgggcgcgagcugaacauccggcgcauccgcgugaaguccggcgagacccagcggaagcucacguucugcaccgaggacccggagaacaccagcaucucccccgggcgcgagcugugguuccggaagugccgcgacggcuggcggaugaagaacgagaccagccccacgguggagcugcccuga

SEQ ID NO: 32353 - RNA, 1356 nt, Artificial Sequence
  derived and/or modified sequence opt1 from LIPH__Homo_sapiens__NP_640341
augcugcgcuucuaccucuucaucagccugcugugccucucccggagcgacgccgaggagaccugccccuccuucacccgccugagcuuccacuccgccguggucggcacggggcugaacgugcggcucaugcuguacacccgcaagaaccugaccugcgcgcagaccaucaacagcuccgccuucggcaaccucaacgugacgaagaagaccaccuucaucguccacggguuccggccgaccggcagcccgcccguguggauggacgaccuggugaaggggcugcucuccgucgaggacaugaacgugguggucguggacuggaaccgcggcgccacgacccugaucuacacccacgccagcuccaagacccggaagguggccaugguccugaaggaguucaucgaccagaugcucgcggagggcgccagccuggacgacaucuacaugaucggggugucccugggcgcccacaucagcggguucgugggcgagauguacgacggguggcucggccgcaucacgggccuggaccccgccgggccccuguucaacggcaagccccaccaggaccggcucgaccccuccgacgcgcaguucgucgacgugauccacagcgacaccgacgcccugggguacaaggagccccugggcaacaucgacuucuacccgaacggcgggcucgaccagcccggcugccccaagaccauccucgggggcuuccaguacuucaagugcgaccaccagcgcuccguguaccuguaccugagcucccugcgggagagcugcaccaucacggccuaccccugcgacagcuaccaggacuaccgcaacgggaagugcgucuccugcggcaccagccagaaggaguccugcccgcugcucggcuacuacgccgacaacuggaaggaccaccuccgggggaaggacccgcccaugaccaaggccuucuucgacaccgcggaggagagccccuucugcauguaccacuacuucguggacaucaucacguggaacaagaacgugcgccggggcgacaucaccaucaagcugcgcgacaaggccgggaacaccaccgaguccaagaucaaccacgagcccacgaccuuccagaaguaccaccaggucagccugcuggcccgguucaaccaggaccuggacaagguggccgccaucucccucauguucagcaccggcucccugaucgggccccgcuacaagcugcggauccuccgcaugaagcugcggagccuggcgcaccccgagcgcccccagcucugccgcuacgaccuggugcugauggagaacgucgagaccguguuccagccgauccucugccccgagcugcagcuguga

SEQ ID NO: 32354 - RNA, 1383 nt, Artificial Sequence
  derived and/or modified sequence opt1 from LIPI__Homo_sapiens__NP_001289927
augcgcguguacaucuuccugugccucaugugcuggguccggagcgacaacaagcgccccugccuggaguucucccagcugagcgugaaggacuccuuccgggaccucuucaucccgcgcaucgagaccauccugaugauguacacccggaacaaccugaacugcgccgagccccucuucgagcagaacaacagccugaacgugaacuucaacacgcagaagaagaccgucuggcugauccacggcuaccgccccgugggguccaucccccucuggcugcagaacuucgugcggauccugcucaacgaggaggacaugaacgucaucgugguggacuggagccgcggcgccaccaccuucaucuacaaccgggcggucaagaacacgcgcaagguggccgugucccugagcguccacaucaagaaccugcucaagcacggggccucccuggacaacuuccacuucaucggcgugagccugggggcccacaucuccggcuucgugggcaagaucuuccacgggcagcucggccggaucaccgggcuggacccggccggcccccgcuucagccggaagccgcccuacucccgccuggacuacaccgacgcgaaguucgucgacgugauccacagcgacuccaacgggcucggcauccaggagccccugggccacaucgacuucuaccccaacgggggcaacaagcagcccgggugccccaagagcaucuucuccggcauccaguucaucaagugcaaccaccagcgggccgugcaccuguucauggccagccucgagaccaacugcaacuucaucuccuucccgugccgcagcuacaaggacuacaagacgagccugugcgucgacugcgacugcuucaaggagaaguccugcccccggcugggcuaccaggccaagcuguucaagggggugcugaaggagcgcauggagggccggccccugcgcaccaccguguuccucgacaccagcgggacguaccccuucugcaccuacuacuucguccuguccaucaucgugccggacaagaccaugauggacggcagcuucuccuucaagcugcucaaccagcuggggaugaucgaggagccccggcuguacgagaagaacaagcccuucuacaagcuccaggaggugaagauccuggcgcaguucuacaacgacuucgucaacaucagcuccaucggccugaccuacuuccagagcuccaaccuccagugcagcacgugcaccuacaagauccagucccugaugcucaagagccucaccuaccccgagcgcccgccccugugccgcuacaacaucgugcugaaggaccgggaggaggucuuccucaaccccaacacgugcacccccaagaacaccuga

SEQ ID NO: 32355 - RNA, 1197 nt, Artificial Sequence
  derived and/or modified sequence opt1 from LIPN__Homo_sapiens__NP_001095939
augauguggcugcuccugaccaccacgugccugaucugcggcacccucaacgccgggggcuuccuggaccuggagaacgaggugaaccccgaggucuggaugaacaccagcgagaucaucaucuacaacggguacccguccgaggaguacgaggugaccacggaggacggcuacauccuccuggugaaccgcauccccuacgggcggacccacgcccgcagcaccggcccccggcccgucguguacaugcagcacgcgcuguucgccgacaacgccuacuggcucgagaacuacgccaacggcucccugggguuccugcucgccgacgcgggcuacgacguguggauggggaacagccgcggcaacaccuggucccggcgccacaagacgcugagcgagaccgacgagaaguucugggccuucuccuucgacgagauggccaaguacgaccugccgggggucaucgacuucaucgugaacaagaccggccaggagaagcucuacuucaucggccacagccuggggaccaccaucggcuucguggccuucuccaccaugcccgagcuggcgcagcggaucaagaugaacuucgcccucgggcccaccaucagcuucaaguaccccaccggcaucuucacgcgcuucuuccugcugccgaacuccaucaucaaggccgucuucggcaccaagggguucuuccucgaggacaagaagaccaagaucgccagcaccaagaucugcaacaacaagauccuguggcugaucugcuccgaguucaugagccucugggccggcuccaacaagaagaacaugaaccagagccggauggacguguacaugucccacgcgcccacggggagcuccgugcacaacauccugcacaucaagcagcuguaccacagcgacgaguuccgcgccuacgacuggggcaacgacgccgacaacaugaagcacuacaaccagagccacccgcccaucuacgaccucaccgccaugaagguccccaccgccaucugggccgggggccacgacgugcuggugacgccccaggacgucgcgcggauccugccccagaucaagucccuccacuacuucaagcugcugcccgacuggaaccacuucgacuucguguggggccucgacgccccgcagcgcauguacagcgagaucaucgcccugaugaaggccuacuccuga

SEQ ID NO: 32356 - RNA, 1122 nt, Artificial Sequence
  derived and/or modified sequence opt1 from LIPT1__Homo_sapiens__NP_057013
augcugauccccuucagcaugaagaacugcuuccagcuccugugcaacugccaggugccggccgccggcuucaagaagaccgucaagaacgggcugauccuccaguccaucagcaacgacguguaccagaaccuggcgguggaggacuggauccacgaccacaugaaccuggagggcaagcccauccucuucuucuggcagaacucccccagcgucgugaucgggcgccaccagaaccccuggcaggagugcaaccugaaccugaugcgcgaggagggcaucaagcucgcccgccggcgcuccgggggcggcaccguguaccacgacauggggaacaucaaccugacguucuucaccaccaagaagaaguacgaccggauggagaaccugaagcucaucguccgcgcccugaacgccgugcagccgcagcuggacgugcaggccaccaagcgguucgaccuccugcuggacggccaguucaagaucagcgggacggcguccaagaucggccgcaccaccgccuaccaccacugcacccuccugugcagcacggacgggaccuuccuguccagccuccugaagucccccuaccagggcauccggagcaacgccaccgccuccauccccagccuggucaagaaccuccuggagaaggaccccacccugacgugcgaggugcucaugaacgcgguggccaccgaguacgccgccuaccaccagaucgacaaccacauccaccugaucaacccgaccgacgagacccuguuccccggcaucaacuccaaggccaaggagcuccagacgugggaguggaucuacgggaagacccccaaguucagcaucaacaccuccuuccacguccuguacgagcagagccaccuggagaucaagguguucaucgacaucaagaacggccgcaucgagaucugcaacaucgaggcgcccgaccacuggcucccgcuggagauccgggacaagcugaacuccagccucaucgggagcaaguucugccccaccgagacgaccaugcugaccaacauccugcuccggaccugcccccaggaccacaagcugaacuccaaguggaacauccugugcgagaagaucaagggcaucauguga

SEQ ID NO: 32357 - RNA, 696 nt, Artificial Sequence
  derived and/or modified sequence opt1 from LIPT2__Homo_sapiens__NP_001138341
augcgccagcccgccgugcggcugguccgccucggccgggugcccuacgccgagcugcuggggcuccaggaccgcuggcugcggcgccugcaggcggagcccggcaucgaggcccccagcgggaccgaggccggcgcccuccugcugugcgagcccgccgggccgguguacaccgcgggccuccggggcgggcugacgcccgaggagaccgcccgccugcgggcccucggcgccgagguccgcgugaccgggcggggcgggcuggcgaccuuccacggccccggccagcugcucugccaccccgugcuggaccugcgccggcucgggcugcgccugcggaugcacgucgccucccucgaggccugcgccgugcgccugugcgagcugcagggccuccaggacgcccgggcgcgcccgccgcccuacacggggguguggcuggacgaccggaagaucugcgccaucggcguccgcugcggccggcacaucaccagccacgggcuggcccucaacugcuccaccgaccugaccugguucgagcacaucgugcccugcggccugguggggacgggcgucaccagccucuccaaggagcugcagcgccacgugaccguggaggaggucaugccgcccuuccugguggccuucaaggagaucuacaagugcacccucaucagcgaggacucccccaacuga

SEQ ID NO: 32358 - RNA, 459 nt, Artificial Sequence
  derived and/or modified sequence opt1 from LITAF__Homo_sapiens__NP_001129945
augagcgugcccggccccuaccaggccgccaccgggcccuccagcgcgcccuccgcgcccccgagcuacgaggagaccgucgccgugaacuccuacuaccccacgccgcccgcccccaugcccggccccaccaccgggcuggugaccggccccgacgggaagggcaugaacccgcccagcuacuacacgcagcccgcccccaucccgaacaacaaccccaucaccguccagaccguguacgugcagcaccccaucaccuuccucgaccgccccauccagaugugcugcccguccugcaacaagaugaucgucagccagcuguccuacaacgccggcgcccugacguggcucagcugcgggucccugugccugcucggccaggagugcagcgggaccaucguggcccugcgguccuucgaccugcucggcagcugcaacccgcccuccagcgccuccuga

SEQ ID NO: 32359 - RNA, 849 nt, Artificial Sequence
  derived and/or modified sequence opt1 from LIX1__Homo_sapiens__NP_694966
auggaccgcacccuggagagccuccggcacaucaucgcccaggugcugccccaccgcgacccggcccuggucuucaaggaccucaacgugguguccaugcugcaggaguucugggagagcaagcagcagcagaaggcggccuuccccuccgagggcgucgugguguacgagagccugcccgcccccgggccgcccuucgucuccuacgugacccuccccggcgggagcugcuucggcaacuuccagugcugccugucccgggccgaggcccgccgggacgcggccaagguggcccugaucaacagccucuucaacgagcugcccucccgccggaucacgaaggaguucaucauggagagcguccaggaggccguggcguccaccagcgggacccuggacgacgccgacgacccguccaccagcgugggcgccuaccacuacaugcucgaguccaacaugggcaagacgaugcuggaguuccaggagcugaugaccaucuuccagcuccugcacuggaacgggagccugaaggcccuccgcgagaccaagugcucccggcaggaggucaucagcuacuacucccaguacagccuggacgagaagaugcgcagccacauggcccuggacuggaucaugaaggagcgggacucccccggcaucgugagccaggagcuccgcauggcgcugcggcagcuggaggaggcccgcaaggccgggcaggagcuccgguucuacaaggagaagaaggagauccugucccuggcccucacccagaucugcagcgaccccgacacguccagccccuccgacgaccagcugagccugaccgcccucugcggcuaccacuga

SEQ ID NO: 32360 - RNA, 3195 nt, Artificial Sequence
  derived and/or modified sequence opt1 from LLGL1__Homo_sapiens__NP_004131
augaugaaguuccgcuuccggcgccagggcgccgacccccagcgggagaagcugaagcaggagcuguucgccuucaacaagaccguggagcacggguucccgaaccagcccagcgcgcucgccuucgaccccgagcugcgcaucauggccaucggcacccgguccggggccgucaagaucuacggcgcccccgggguggaguucacgggccuccaccgcgacgcggccaccgugacccagaugcacuuccugaccggccaggggcggcugcucagccugcuggacgacuccagccuccaccugugggagaucguccaccacaacggcugcgcccaccuggaggaggcccucuccuuccagcugccgagccgccccggguucgacggcgcguccgcgccccugagccucacgcgggugaccgugguccugcugguggccgccggggacaucgccgcccucggcaccgagggcuccagcguguucuuccuggacgucaccacgcugacccuccuggaggggcagacccuggcccccggcgaggugcuccgcuccgugccggacgacuaccggugcgggaaggcccugggccccgucgagagccugcagggccaccuccgcgaccccaccaagauccugaucggguacucccggggccugcucgugaucuggaaccaggccagccagugcguggaccacaucuuccuggggaaccagcagcuggagucccucugcuggggccgcgacagcuccacggucgugagcucccacagcgacgggagcuacgccgugugguccgucgacgcgggcagcuuccccacccugcagccgaccguggccaccacgcccuacggccccuuccccugcaaggccaucaacaagauccuguggcggaacugcgaguccgggggccacuucaucaucuucagcgggggcaugccgcgcgccuccuacggggaccggcacugcgugagcguccuccgcgccgagacccuggugacccuggacuucaccucccggaucaucgacuucuucacggugcacagcacccgccccgaggacgaguucgacgacccccaggcgcucgccguccugcuggaggaggagcucgugguccuggaccugcagacccccggcuggccggccgugcccgcccccuaccucgcgccccugcacuccagcgccaucacgugcuccgcccacguggccagcgucccggccaagcugugggcgcggaucguguccgccggcgagcagcagagcccccagcccguguccagcgcccucuccuggcccaucaccgggggccgcaaccuggcccaggagccgagccagcgcgggcugcugcucaccggccacgaggacgggaccguccgguucugggacgccuccggcguggcgcugcgcccccuguacaagcucagcaccgccggccuguuccagacggacugcgagcacgccgacagccuggcccaggccgcggaggacgacuggcccccguuccggaagguggggugcuucgaccccuacuccgacgacccccgccucggcguccagaagguggcccugugcaaguacaccgcccagaugguggucgccgggaccgccggccaggugcuggugcucgagcugagcgacguccccguggagcaggcgguguccgucgccaucaucgaccugcuccaggaccgggagggcuucaccuggaaggggcacgagcgccugagcccgcggacgggcccccugcccuggcccgccggguuccagccgcgcgugcucgugcagugccugccgcccgccgcggucaccgccgugacccugcacaccgaguggucccucguggccuucggcacgagccacggguucggccuguucgacuaccagcggaagucccccguccuggcccgcugcacccuccacccgaacgacagccuggccauggagggcccccugucccgggucaagagccucaagaagucccugcgccagagcuuccggcgcauccggaagucccgcgugagcgggaagaagcgggcggccaacgccuccagcaagcugcaggaggccaacgcccagcucgcggagcaggccugcccccacgacguggagaugacccccgugcagcgccggaucgagccgcgcuccgccgacgacagccugagcggcgugguccgcugccuguacuucgccgacaccuuccuccgggacggggcccaccacggccccaccaugugggcggggacgaacuccggcagcguguucgccuacgcccuggaggugcccgccgcggccgucggcggggagaagcgccccgagcaggccguggaggccgugcugggcaaggagguccagcucaugcaccgggccccggugguggcgaucgccguccuggacgggcgcggccggccccugcccgagcccuacgaggccucccgcgaccucgcccaggccccggacaugcagggcgggcacgcggugcugaucgccagcgaggagcaguucaagguguucacccugcccaaggucuccgccaagaccaaguucaagcucaccgcccacgagggcugccgggugcgcaagguggcccuggcgacguucgccagcgucgccugcgaggacuacgccgagaccugccuggccugccucaccaaccugggggacgugcacguguucuccguccccggccugcggccccaggugcacuacagcugcauccgcaaggaggacaucuccgggaucgcgagcugcguguucacccggcacggccagggguucuaccucaucucccccagcgaguucgagcgcuucucccugagcgcccggaacaucacggagccccugugcucccucgacaucaacuggccccgcgacgccacccaggccagcuaccggauccgcgaguccccgaagcugagccaggcgaacggcacccccuccauccugcucgcgccccagagccuggacggcagccccgacccggcccacuccauggggcccgacacccccgagcccccggaggccgcccugagccccauguccaucgacagcgccacguccgccgacaccacccucgacaccacgggcgacgucaccguggaggacgucaaggacuuccuggggagcuccgaggagagcgagaagaaccugcggaaccucgccgaggacgaggcccacgccugcgcgauccugaucaaguga

SEQ ID NO: 32361 - RNA, 1071 nt, Artificial Sequence
  derived and/or modified sequence opt1 from LLGL2__Homo_sapiens__NP_001015002
augcgccgguuccugcgccccggccacgacccggugcgggagcgccucaagcgggaccuguuccaguucaacaagaccgucgagcacggguucccccaccagcccagcgcccugggcuacucccccagccuccgcauccuggccaucgggacccgguccggcgcgaucaagcuguacggggccccgggcguggaguucaugggccuccaccaggagaacaacgccgugacgcagauccaccuccugcccgggcagugccagcuggucacccugcuggacgacaacagccuccaccuguggucccugaaggugaagggcggggccagcgagcuccaggaggacgaguccuucacccugcgcggcccgcccggggccgcgcccagcgccacccagaucacggugguccugccccacuccagcugcgagcuccuguaccugggcaccgaguccggcaacguguucgugguccagcuccccgccuuccgggcccuggaggaccgcaccaucagcuccgacgcggugcugcagcggcuccccgaggaggcccgccaccggcgcguguucgagauggucgaggcccugcaggagcacccgcgggaccccaaccagauccugaucggguacagccgcggccucguggugaucugggaccugcaggggucccggguccuguaccacuuccucagcucccagcagcuggagaacaucugguggcagcgcgacggccggcugcucgugagcugccacuccgacggcagcuacugccaguggcccgugagcuccgaggcccagcagcccgagccgcugcgcagccugguccccuacgggcccuuccccugcaaggccaucacccggauccucuggcugacgacccgccagggccugccguucaccaucuuccagggcgggaugccccgcgcguccuacggggaccggcacugcaucagcgugauccacgacggccagcagaccgccuucgacuucacgucccgcgugaucggcuucaccguccucaccgaggccgaccccgccgccagccggcgcgcguccggggugggcgcccagggguga

SEQ ID NO: 32362 - RNA, 1533 nt, Artificial Sequence
  derived and/or modified sequence opt1 from LMAN1__Homo_sapiens__NP_005561
auggccggcagccgccagcgggggcugcgcgcccgggugcgcccccucuucugcgcgcugcugcucucccugggccgguucguccgcggggacggcgucgggggcgacccggccguggcccugccccaccggcgcuucgaguacaaguacagcuucaagggcccccaccucgugcaguccgacgggaccgugcccuucugggcccacgccggcaacgcgaucccgagcuccgaccagauccggguggcccccagccugaagucccagcgcgggagcgucuggaccaagacgaaggccgccuucgagaacugggagguggaggugaccuuccgggucaccggccgcgggcggaucggcgcggacggccuggccaucugguacgccgagaaccaggggcucgagggccccguguucggguccgccgaccuguggaacggcgugggcaucuucuucgacagcuucgacaacgacgggaagaagaacaaccccgccaucgucaucaucggcaacaacgggcagauccacuacgaccaccagaacgacggcgcgucccaggcccuggccagcugccagcgcgacuuccggaacaagccguaccccgugcgcgccaagaucaccuacuaccagaacacgcucaccgugaugaucaacaacggguucacccccgacaagaacgacuacgaguucugcgccaaggucgagaacaugaucauccccgcgcagggccacuucggcaucuccgccgccaccgggggccuggccgacgaccacgacgugcugagcuuccucacguuccagcugaccgagccggggaaggagccgcccacccccgacaaggagaucuccgagaaggagaaggagaaguaccaggaggaguucgagcacuuccagcaggagcuggacaagaagaaggaggaguuccagaagggccaccccgaccuccaggggcagcccgccgaggagaucuucgagagcgugggcgaccgggagcugcgccaggucuucgagggccagaaccggauccaccuggagaucaagcagcucaaccgccagcuggacaugauccuggacgagcagcggcgcuacguguccagccucaccgaggagaucuccaagcgcggggcgggcaugcccgggcagcacggccagaucacgcagcaggagcuggacaccguggucaagacccagcacgagauccugcgccaggugaacgagaugaagaacagcaugagcgagaccgugcggcucgucuccgggaugcagcaccccggcagcgccggcgggguguacgagacgacccagcacuucaucgacaucaaggagcaccuccacaucgucaagcgggacaucgacaaccuggugcagcgcaacaugccguccaacgagaagcccaagugccccgagcugcccccguuccccagcugccuguccaccgugcacuucaucaucuucgucguggugcagaccguccuguucaucggcuacaucauguaccggagccagcaggaggccgccgccaagaaguucuucuga

SEQ ID NO: 32363 - RNA, 1581 nt, Artificial Sequence
  derived and/or modified sequence opt1 from LMAN1L__Homo_sapiens__NP_068591
augcccgccgugagcggcccggggccccuguucugccuccugcugcuccugcuggacccccacucccccgagaccggcugcccgccccuccgccgguucgaguacaagcugagcuucaaggggccccgccuggcccuccccggcgccgggaucccguucuggucccaccacggcgacgccauccugggccuggaggagguccggcucacccccagcaugcgcaaccgguccggggccguguggagccgcgccuccgugcccuucagcgccugggaggucgaggugcagaugcgggugacgggccuggggcgccggggcgcgcaggggauggccgucugguacacccgcggccggggccacgugggguccgugcugggcgggcucgccagcugggacggcaucggcaucuucuucgacucccccgccgaggacacccaggacagcccggcgauccgcguccuggccuccgacgggcacauccccagcgagcagcccggcgacggggccucccagggccuggggagcugccacugggacuuccggaaccgcccccacccguuccgggcccgcaucaccuacuggggccagcggcuccgcaugucccugaacagcggccugacgcccuccgaccccggggaguucugcguggacgugggcccccuccugcugguccccgggggcuucuucggggugagcgccgcgaccggcacccucgccgacgaccacgacgugcugagcuuccugaccuucucccucagcgagcccucccccgaggugcccccgcagcccuuccuggagaugcagcagcugcggcucgcccgccagcuggagggccugugggcccggcucgggcugggcacgcgcgaggacgucacccccaagagcgacuccgaggcccagggggagggcgagcgccuguucgaccucgaggagacccuggggcggcaccgccggauccugcaggcgcuccgcggccugagcaagcagcuggcccaggccgagcggcaguggaagaagcagcucgggcccccgggccaggcccgccccgacggcgggugggcccuggacgcguccugccagauccccagcaccccgggccggggcgggcaccuguccaugagccucaacaaggacuccgccaaggugggcgcccugcugcacgggcaguggacgcuccugcaggcccugcaggagaugcgcgacgccgcgguccggauggccgccgaggcccaggugagcuaccugcccgugggcaucgagcaccacuuccucgagcuggaccacauccuggggcuccugcaggaggagcugcgcggccccgcgaaggccgccgccaaggcgccccggccgcccggccagccgccccgcgccuccagcugccuccagccggggaucuuccuguucuaccugcucauccagaccgucggcuucuucggguacgugcacuuccggcaggagcugaacaagucccugcaggagugccucagcaccggcucccugccccuggggcccgcgccccacaccccgcgcgcccucggcauccugcggcgccagccccugcccgccagcaugcccgccuga

SEQ ID NO: 32364 - RNA, 1080 nt, Artificial Sequence
  derived and/or modified sequence opt1 from LMAN2L__Homo_sapiens__NP_001135764
auggccgccacccugggcccccucgggagcuggcagcaguggcgccggugccuguccgcgcgcgacggcagccggaugcugcuccugcugcuccugcugggguccggccaggggccgcagcaggucggcgccggccagaccuucgaguaccucaagcgcgagcacagccuguccaagcccuaccagggggugggcacggggagcuccagccuguggaaccucaugggcaacgccauggugaugacccaguacauccggcugacccccgacaugcaguccaagcagggggcccuguggaaccgcgugcccugcuuccuccgggacugggagcugcagguccacuucaagauccacggccagggcaagaagaaccugcacggggacggccucgccaucugguacaccaaggaccgcaugcagccggggcccguguucggcaacauggacaaguucgugggccugggggucuucguggacacguaccccaacgaggagaagcagcaggaggcgcagaagcggcgcuacagccccggcgugcagcgggucuucccguacaucuccgccauggugaacaacgggagccuguccuacgaccacgagcgcgacggccggcccaccgagcucgggggcugcaccgccaucgugcgcaaccugcacuacgacaccuuccuggucauccgguacgugaagcgccaccucacgaucaugauggacaucgacggcaagcacgaguggcgggacugcaucgaggugcccgggguccgccugccccggggcuacuacuucgggaccagcuccaucaccggcgaccugagcgacaaccacgacgugaucucccucaagcuguucgagcugaccguggagcgcacgccggaggaggagaagcuccaccgggacgucuuccugcccagcguggacaacaugaagcugcccgagaugaccgcgccccucccgccccuguccgggcuggcccucuuccugaucguguucuucagccuggucuucagcguguucgccaucgugaucggcaucauccucuacaacaaguggcaggagcagucccgcaagcgcuucuacuga

SEQ ID NO: 32365 - RNA, 1473 nt, Artificial Sequence
  derived and/or modified sequence opt1 from LMBR1__Homo_sapiens__NP_071903
auggagggccaggacgaggugagcgcccgcgagcagcacuuccacucccagguccgggagagcaccaucugcuuccugcuguucgccauccuguacgugguguccuacuucaucaucacccgcuacaagcgcaagagcgacgagcaggaggacgaggacgcgaucgucaaccggaucucccuguuccucagcacguucacccuggccguguccgccggggccgugcugcuccugcccuucagcaucaucuccaacgagauccugcucagcuucccgcagaacuacuacauccaguggcugaacggcucccugauccacgggcucuggaaccuggccagccuguucuccaaccucugccuguucguccugaugcccuucgcguucuucuuccucgagagcgagggcuucgccgggcugaagaagggcauccgggcccgcauccuggagacccucgugaugcugcugcuccuggcccugcucauccugggcaucgugugggucgcguccgcccugaucgacaacgacgccgccagcauggagucccucuacgaccugugggaguucuaccugcccuaccucuacagcugcaucucccugauggggugccugcuccugcugcucugcacccccgugggccugagccggauguucacggugauggggcagcugcucgucaagccgaccauccuggaggaccuggacgagcagaucuacaucaucacccucgaggaggaggcccugcagcgccggcugaacggccucagcuccagcguggaguacaacaucauggagcuggagcaggagcuggagaacgugaagacccugaagacgaagcucgagcgccggaagaaggcguccgccugggagcgcaaccuggucuaccccgccgugauggugcugcuccugaucgagaccagcaucuccguccugcucguggccugcaacauccugugccugcucguggacgagaccgccaugcccaaggggacccggggccccggcaucgggaacgcgagccuguccacguucggcuucgucggggccgcccuggagaucauccucaucuucuaccugauggugagcuccguggucggcuucuacagccugcgcuucuucggcaacuucaccccgaagaaggacgacaccaccaugacgaagaucaucgggaacugcguguccauccucguccugagcuccgcccugcccgugaugagccggacccucggcaucacccgcuucgaccugcugggggacuucggccgguucaacuggcucgggaacuucuacaucgugcuguccuacaaccuccucuucgccaucgucaccacgcugugccuggugcgcaaguucaccagcgcggugcgggaggagcuguucaaggcccugggccugcacaagcuccaccuccccaacaccucccgcgacagcgagaccgccaagcccuccgucaacggccaccagaaggcccuguga

SEQ ID NO: 32366 - RNA, 1623 nt, Artificial Sequence
  derived and/or modified sequence opt1 from LMBRD1__Homo_sapiens__NP_060838
auggccaccagcggcgccgcguccgccgagcuggugaucggguggugcaucuucggccuccugcugcucgccauccuggccuucugcuggaucuacguccgcaaguaccagagccggcgcgaguccgagguggugagcaccaucacggccaucuucucccuggcgaucgcccucaucaccagcgcccugcugcccgucgacaucuuccucguguccuacaugaagaaccagaacgggaccuucaaggacugggccaacgcgaacgugagccggcagaucgaggacaccguccuguacggcuacuacacgcuguacuccgugauccucuucugcguguucuucuggaucccguucgucuacuucuacuacgaggagaaggacgacgacgacaccagcaagugcacccagaucaagaccgcccugaaguacacgcugggguucguggugaucugcgcccuccugcugcucgucggcgccuucgugccccugaacgugcccaacaacaagaacuccaccgagugggagaaggucaagagccuguucgaggagcucggcuccagccacgggcuggccgcgcuguccuucagcaucuccagccucacccugaucggcaugcuggccgccaucaccuacacggccuacgggauguccgcccucccccugaaccugaucaagggcacccgcagcgcggccuacgagcggcucgagaacaccgaggacaucgaggagguggagcagcacauccagaccaucaagagcaaguccaaggacgggcgcccgcugcccgcccgggacaagcgcgcccugaagcaguucgaggagcggcuccgcacgcugaagaagcgggagcgccaccuggaguucaucgagaacagcugguggaccaaguucugcggcgcccuccggccccugaagaucguguggggcaucuucuucauccuggucgcgcuccuguucgugaucucccuguuccucagcaaccuggacaaggcccugcacuccgccgggaucgacagcggcuucaucaucuucggggccaaccucuccaacccccugaacaugcugcucccgcugcugcagaccguguucccccuggacuacauccucaucaccaucaucaucauguacuucaucuucacgagcauggccggcauccgcaacaucggcaucugguucuucuggauccggcuguacaagauccgccgggggcgcacccggccccaggcgcuccuguuccugugcaugauccugcuccugaucguccugcacaccuccuacaugaucuacagccucgcgccccaguacgugauguacggcucccagaacuaccugaucgagaccaacaucacgagcgacaaccacaaggggaacuccacccugagcgugccgaagcgcugcgacgccgacgcccccgaggaccagugcaccgucacccggacguaccucuuccugcacaaguucugguucuucuccgccgccuacuacuucggcaacugggccuuccuggggguguuccucaucggccugaucgucagcugcugcaagggcaagaaguccgugaucgaggggguggacgaggacagcgacaucuccgacgacgagcccagcgucuacagcgccuga

SEQ ID NO: 32367 - RNA, 2088 nt, Artificial Sequence
  derived and/or modified sequence opt1 from LMBRD2__Homo_sapiens__NP_001007528
augagcggcgccgcccuggggcucgagaucguguucgucuucuuccuggcgcuguuccuccugcaccgcuacggcgacuucaagaagcagcaccggcuggugaucaucgggacccuccuggccugguaccugugcuuccucaucguguucauccugccccuggacgucuccaccacgaucuacaaccgcugcaagcacgccgccgccaacagcuccccgcccgagaacagcaacaucaccggccucuacgcgaccgccaaccccgugcccucccagcacccgugcuucaagcccuggagcuacauccccgacgggaucaugcccaucuucuggcggguggucuacuggaccucccaguuccugacguggauccugcucccguucaugcagagcuacgcccgcuccggcggcuucagcaucaccgggaagaucaagaccgcccugaucgagaacgcgaucuacuacggcaccuaccugcucaucuucggggccuuccugaucuacguggccgugaacccccaccuccaccucgaguggaaccagcugcagacgaucggcaucgccgccgcgaacaccugggggcuguuccuccugguccugcuccugggcuacggccugguggagaucccccgguccuacuggaacggggccaagcgcggcuaccuccugaugaagaccuacuucaaggccgccaagcugaugaccgagaaggccgacgcggaggagaaccucgaggacgccauggaggaggugcggaaggucaacgagagcaucaaguacaaccacccccugcgcaagugcguggacacgauccugaagaagugcccgaccgaguaccaggagaagauggggcggaacauggacgacuacgaggacuucgacgagaagcacuccaucuaccccagcgagaagucccucgugaagcugcacaagcaggucaucuacagcgugcagcgccaccggcgcacccaggugcaguggcagauccugcucgagcaggccuucuaccuggaggacgucgccaagaacgagaccuccgccacgcaccaguucgugcacaccuuccagagccccgagcccgagaaccgguucauccaguacuucuacaacccgaccuucgagugguacugggagugccugcuccgccccugguucuacaagauccuggcggugguccuguccaucuucagcgugaucguggucuggagcgagugcaccuucuucuccacgacccccgugcucagccuguucgccgucuucauccagcuggccgagaagaccuacaacuacaucuacaucgagaucgccugcuuccucuccaucuucuuccugagcaucugcguguacuccaccguguuccggauccgcgucuucaacuacuacuaccuggccagccaccaccagacggacgcguacucccugcuguucagcggcaugcuguucugccggcugacgcccccgcucugccugaacuuccugggccucacccacauggacuccagcaucucccacaagaacacccagcccaccgccuacaccagcaucaugggguccaugaaggugcugagcuucaucgccgacggcuucuacaucuacuaccccaugcugguggucauccucugcaucgccaccuacuucucccuggggacccgcugccugaaccuccugggcuuccagcaguucaugggggacgacgacaugacgagcgaccuggugaacgagggcaaggagcucauccggaaggagaagcgcaagcggcagcgccaggaggagggcgagaaccgccggcgcgaguggaaggagcgguacgggcacaaccgcgaggacuccacccggaaccgcaacauccacaccgaccccaaggagagcaacuucuccgacgugaacaccaaccggagcgcguucaaguacacgcgcgccaacaaccggaccgagcgcgaccggaucgagcugcugcaggacgccgagccgcucgacuucaacgccgagaccuucaccgacgacccccuggagagcgaguccggccgcuaccagcccgggggccgguaccugagcaugucccgcagcgacaucuucaacgacgucuga

SEQ ID NO: 32368 - RNA, 879 nt, Artificial Sequence
  derived and/or modified sequence opt1 from LMCD1__Homo_sapiens__NP_001265162
auggacagcaaguacuccacccugaccgcccgcgugaagggcggggacggcauccggaucuacaagcgcaaccggaugaucaugacgaaccccaucgccaccgggaaggaccccaccuucgacaccaucacguacgagugggcgccgcccggcgucacccagaagcucgggcugcaguacauggagcugauccccaaggagaagcagcccgugaccggcaccgagggcgccuucuaccgccggcgccagcucaugcaccagcugcccaucuacgaccaggaccccagccggugccgcgggcugcucgagaacgagcugaagcugauggaggaguucgugaagcaguacaaguccgaggcccucggcgucggggagguggcccugcccggccagggcgggcugccgaaggaggagggcaagcagcaggagaagcccgagggggccgagacgaccgcggccaccaccaacggcagccucuccgaccccagcaaggagguggaguacgucugcgagcugugcaagggggccgcgcccccggacucccccgugguguacagcgaccgggccggcuacaacaagcaguggcaccccacgugcuucgucugcgccaagugcuccgagccccugguggaccucaucuacuucuggaaggacggcgccccguggugcgggcgccacuacugcgagagccugcggccccgcugcuccggcugcgacgagaucaucuucgccgaggacuaccagcggguggaggaccuggccuggcaccgcaagcacuucgucugcgaggggugcgagcagcuccugagcggccgggcguacaucgugaccaaggggcagcugcucugcccgaccugcuccaagagcaagcgcuccuga

SEQ ID NO: 32369 - RNA, 1704 nt, Artificial Sequence
  derived and/or modified sequence opt1 from LMF1__Homo_sapiens__NP_073610
augcgccccgacagcccgaccauggccgcccccgcggagucccugcggcgccggaagaccggcuacagcgaccccgagcccgaguccccgcccgcccccgggcgcggccccgccgggagcccggcccaccuccacacgggcaccuucuggcugacccggaucgugcugcucaaggcccuggcguucgucuacuucguggccuuccugguggccuuccaccagaacaagcagcucaucggggaccgcggccugcugcccugccgggucuuccucaagaacuuccagcaguacuuccaggaccgcaccuccugggagguguucagcuacaugcccacgauccuguggcugauggacugguccgacaugaacagcaaccucgaccugcuggcccuccugggccuggggaucuccagcuucgugcucaucaccggcugcgcgaacaugcugcugauggccgcccucugggggcuguacaugucccuggucaacgugggccacgugugguacagcuucgggugggagucccagcuccuggagaccggcuuccugggcaucuuccucugcccccuguggacccugagccggcucccgcagcacacgcccaccucccgcaucguccuguggggguuccgguggcugaucuuccgcaucaugcucggcgccgggcugaucaagauccggggcgaccgcugcuggcgggaccugaccugcauggacuuccacuacgagacccagcccaugcccaacccgguggccuacuaccuccaccacagccccuggugguuccaccgcuucgagacgcuguccaaccacuucaucgagcugcucgugcccuucuuccuguuccugggccggcgcgcgugcaucauccacgggguccuccagauccuguuccaggccgugcugaucgugagcggcaaccucuccuuccugaacuggcugaccaugguccccagccucgccugcuucgacgacgccacccugggguuccuguucccgagcggccccgggucccugaaggaccgggugcuccagaugcagcgcgacauccggggcgcccgccccgagccccgcuucggcagcgugguccggcgcgcggccaacgugucccugggggugcugcucgccuggcugagcgucccgguggugcugaaccuccuguccagccggcaggucaugaacacccacuucaacucccugcacaucgugaacacguacggcgccuucgggagcaucaccaaggagcgcgccgaggucauccuccagggcaccgcguccagcaacgccuccgcccccgacgccaugugggaggacuacgaguucaagugcaagcccggggaccccagccggcgcccgugccugaucucccccuaccacuaccggcuggacuggcucaugugguucgccgcguuccagaccuacgagcacaacgacuggaucauccaccuggccggcaagcugcucgccagcgacgccgaggcgcugucccugcucgcccacaaccccuucgccggccgcccgccgccccggugggugcgcggggagcacuaccgguacaaguucagccgccccggcgggcggcacgccgccgagggcaaguggugggugcgcaagcggaucggggcguacuucccgccccugucccuggaggagcuccgccccuacuuccgggaccgcggcuggccccugcccggcccccuguga

SEQ ID NO: 32370 - RNA, 2079 nt, Artificial Sequence
  derived and/or modified sequence opt1 from LMLN__Homo_sapiens__NP_001129521
auggugaccacccugggccccaagauggccgccgaguggggcggcggggucggguacagcggguccggcccgggccgcagccgguggcgcugguccgggagcgugugggugcgguccguccuccugcugcucggcgggcugcgcgcgagcgccacguccacccccgugagccugggcuccagcccgcccugccggcaccacgugcccuccgacaccgaggucaucaacaaggugcaccucaaggccaaccacguggucaagcgcgacguggacgagcaccuccggaucaagaccguguacgacaagagcgucgaggagcugcuccccgagaagaagaaccuggugaagaacaagcuguucccccaggccaucuccuaccucgagaagacguuccaggugcgccggcccgccgggaccauccugcugagccgccagugcgcgaccaaccaguaccuccggaaggagaacgacccgcaccgcuacugcaccggcgagugcgccgcccacacgaagugcggccccgucaucgugcccgaggagcaccuccagcagugccggguguaccgcgggggcaaguggccccacggggccgucggcgugccggaccaggagggcaucuccgacgcggacuucgugcuguacgucggggcccuggccaccgagcggugcagccacgagaacaucaucuccuacgccgccuacugccagcaggaggcgaacauggaccgccccaucgccggcuacgccaaccugugccccaacaugaucagcacccagccccaggaguucguggggaugcuguccaccgugaagcacgaggucauccacgcccucggcuucagcgccgggcuguucgcguucuaccacgacaaggacggcaacccgcugacgagccgguucgccgacggccucccgcccuucaacuacucccuggggcuguaccaguggagcgacaaggugguccgcaagguggagcggcucugggacgugcgcgacaacaagaucguccggcacaccguguaccugcuggugacgccccgcgucguggaggaggcccgcaagcacuucgacugccccgugcucgagggcauggagcuggagaaccagggcggggucgggaccgagcugaaccacugggagaagcggcuccuggagaacgaggccaugaccggcucccacacccagaaccgcgugcugagccggaucacccucgcccugauggaggacaccggcugguacaaggcgaacuacuccauggccgagaagcuggacugggggcgcggcauggggugcgacuucgugcgcaagagcugcaaguucuggaucgaccagcagcggcagaagcggcagaugcucucccccuacugcgacacgcugcgcagcaacccccugcagcugaccugccggcaggaccagcgcgccgucgccgugugcaaccugcagaaguuccccaagccgcugccccaggaguaccaguacuucgacgagcucuccggcauccccgccgaggaccugcccuacuacgggggcagcguggagaucgcggacuacugcccguucucccaggaguucagcuggcaccuguccggcgaguaccagcggagcuccgacugccgcauccucgagaaccagcccgagaucuucaagaacuacggggccgagaaguacggcccccacagcgucugccugauccagaaguccgccuucgugauggagaagugcgagcggaagcugagcuacccggacuggggguccggcugcuaccaggugagcugcagcccccagggccugaaggucugggugcaggacaccuccuaccucugcagccgcgccggccaggugcugcccgucuccauccagaugaacggguggauccacgacgggaaccugcucugccccagcugcugggacuucugcgagcugugcccgcccgagaccgacccgcccgcgacgaaccugacccgggcccucccccuggaccugugcuccugcagcuccagccucguggugacccuguggcugcuccugggcaaccuguucccccuccuggccggguuccugcucugcaucuggcacuga

SEQ ID NO: 32371 - RNA, 1725 nt, Artificial Sequence
  derived and/or modified sequence opt1 from LMNA__Homo_sapiens__NP_001244303
augggcaacagcgaggggugcaacaccaagaaggagggcgaccugaucgccgcccaggcgcgccucaaggaccuggaggcccugcucaacuccaaggaggccgcccugagcaccgcccuguccgagaagcggacgcucgagggggagcugcacgaccugcgcggccagguggcgaagcucgaggccgcccugggggaggccaagaagcagcugcaggacgagaugcuccggcgcgucgacgcggagaaccggcugcagaccaugaaggaggagcuggacuuccagaagaacaucuacagcgaggagcuccgcgagaccaagcggcgccacgagacccggcugguggagaucgacaacggcaagcagcgcgaguucgagucccggcuggccgacgcccuccaggagcugcgcgcccagcacgaggaccagguggagcaguacaagaaggagcuggagaagacguacagcgccaagcucgacaacgcgcggcaguccgccgagcgcaacagcaaccuggucggcgccgcccacgaggagcugcagcagucccggauccgcaucgacagccucuccgcccagcugagccagcugcagaagcagcucgcggccaaggaggccaagcugcgggaccuggaggacucccucgcccgcgagcgggacaccagccgccggcugcuggccgagaaggagcgcgagauggcggagaugcgcgcccggaugcagcagcagcucgacgaguaccaggagcugcuggacaucaagcucgcccuggacauggagauccacgccuaccgcaagcugcucgagggggaggaggagcggcugcgccugucccccagcccgaccucccagcggagccgcggccgggccuccagccacagcucccagacccagggcggcgggagcgugacgaagaagcgcaagcucgaguccaccgagagccgguccagcuucucccagcacgcgcgcaccagcggccggguggccgucgaggagguggacgaggagggcaaguucgugcgccugcggaacaaguccaacgaggaccagagcauggggaacuggcagaucaagcgccagaacggcgacgacccccugcucaccuaccgguucccgcccaaguucacgcugaaggccgggcaggucgugaccaucugggccgcgggcgccggcgccacccacuccccgcccaccgaccugguguggaaggcccagaacacgugggggugcggcaacagccuccgcaccgcccugaucaacuccaccggggaggaggucgcgaugcggaagcuggugcgcagcgugaccgucguggaggacgacgaggacgaggacggcgacgaccugcuccaccaccaccacgggucccacugcagcuccagcggcgaccccgccgaguacaaccugcggucccgcacggugcugugcgggaccugcgggcagcccgccgacaaggccagcgccagcggcuccggggcgcaggucggcgggcccaucagcuccggcagcuccgccagcuccgugaccgugacccgcagcuaccgguccgucggcgggagcggcgggggcuccuucggggacaaccucgugacgcgcagcuaccugcugggcaacuccagcccccggacccagagcccccagaacugcuccaucauccaggagaugggcaugcgcugggagguggaggaggggcggcgcaaggucucccucagcugccugcccuga

SEQ ID NO: 32372 - RNA, 1761 nt, Artificial Sequence
  derived and/or modified sequence opt1 from LMNB1__Homo_sapiens__NP_005564
auggccaccgccacccccgugccgccccgcaugggcagccgggccgggggccccacgacgccccuguccccgacccgccucagccggcugcaggagaaggaggagcugcgcgagcucaacgaccggcuggcggucuacaucgacaaggugcgcucccuggagaccgagaacagcgcccuccagcuccaggugaccgagcgggaggagguccgcgggcgggagcugaccggccugaaggcccuguacgagaccgagcuggccgacgcgcgccgggcccucgacgacaccgcccgcgagcgggccaagcugcagaucgagcuggggaagugcaaggcggagcacgaccagcuccugcugaacuacgccaagaaggaguccgaccucaacggcgcccagaucaagcugcgcgaguacgaggccgcccugaacagcaaggacgcggcccucgccacggcccugggcgacaagaagucccuggagggggaccucgaggaccugaaggaccagaucgcccagcuggaggcgagccucgccgccgccaagaagcagcuggccgacgagacccugcucaagguggaccuggagaaccggugccagucccugaccgaggaccucgaguuccgcaagagcauguacgaggaggagaucaacgagacccggcgcaagcacgagacgcggcugguggaggucgacuccggccgccagaucgaguacgaguacaagcuggcgcaggcccuccacgagaugcgggagcagcacgacgcccaggugcgccuguacaaggaggagcuggagcagaccuaccacgccaagcucgagaacgcccgccugagcuccgagaugaacaccagcaccgugaacuccgcgcgggaggagcugauggagagccgcaugcggaucgagucccucagcucccagcugagcaaccugcagaaggagagccgcgccugccucgagcggauccaggagcuggaggaccugcucgccaaggagaaggacaacucccgccggaugcugacggacaaggagcgcgagauggccgagauccgggaccagaugcagcagcagcugaacgacuacgagcagcugcucgacgucaagcuggcgcuggacauggagaucagcgccuaccgcaagcuccuggagggggaggaggagcggcugaagcucucccccagccccuccagccgcgugaccgugucccgggccagcuccagccgcuccguccggaccacccgcggcaagcggaagcgcguggacguggaggagagcgaggccuccagcuccgucagcaucucccacagcgccuccgcgacggggaacgugugcaucgaggagaucgacguggacggcaaguucauccggcugaagaacaccagcgagcaggaccagcccaugggcgggugggagaugauccgcaagaucggcgacaccagcgucuccuacaaguacaccagccgcuacgugcugaaggccgggcagacggugaccaucugggccgccaacgccggcgucaccgcguccccgcccaccgaccucaucuggaagaaccagaacagcuggggcacgggggaggacgugaaggugauccugaagaacucccagggcgaggaggucgcccagcggagcaccguguucaagaccaccauccccgaggaggaggaggaggaggaggaggccgccggggucgugguggaggaggagcuguuccaccagcagggcacgccccgcgccuccaaccggagcugcgcgaucauguga

SEQ ID NO: 32373 - RNA, 1863 nt, Artificial Sequence
  derived and/or modified sequence opt1 from LMNB2__Homo_sapiens__NP_116126
augagcccgcccucccccggccgccggcgcgagcagcggcgcccccgggccgccgcgaccauggccaccccgcugcccgggcgcgccggcgggcccgccacgccccucagccccacccggcugucccgccugcaggagaaggaggagcuccgggagcugaacgaccgccuggcccacuacaucgaccgggugcgcgcgcucgagcuggagaacgaccggcugcuccugaagaucagcgagaaggaggaggucaccacccgcgagguguccggcaucaaggcccuguacgagagcgagcucgccgacgcccggcgcgugcuggacgagacggcgcgggagcgcgcccggcugcagaucgagaucgggaagcuccgcgccgagcuggacgaggucaacaaguccgccaagaagcgggagggcgagcugaccguggcccagggccgcgugaaggaccucgagagccuguuccaccgcuccgaggucgagcuggcggccgcccucagcgacaagcgggggcuggaguccgacguggccgagcugcgcgcccagcucgcgaaggccgaggacggccacgccguggccaagaagcagcuggagaaggagacccugaugcgggucgaccucgagaaccgcugccagagccugcaggaggagcuggacuuccggaaguccguguucgaggaggaggugcgcgagacccggcgccggcacgagcgccggcucgucgagguggacagcucccgccagcaggaguacgacuucaagauggcccaggcgcuggaggagcugcggagccagcacgacgagcagguccgccucuacaagcuggagcuggagcagacguaccaggccaagcucgacuccgccaagcugagcuccgaccagaacgacaaggccgccagcgcggcccgggaggagcugaaggaggcccgcaugcggcucgagagccuguccuaccagcugagcgggcuccagaagcaggccuccgcggccgaggaccgcauccgggagcuggaggaggccauggccggcgagcgcgacaaguuccgcaagaugcuggacgccaaggagcaggagaugaccgagaugcgggacgugaugcagcagcagcucgcggaguaccaggagcugcuggacgugaagcucgcccuggacauggagaucaacgccuaccgcaagcugcuggagggggaggaggagcggcucaagcugagccccucccccagcucccgcgugaccgucagccgggccaccuccagcuccagcggcucccugagcgccacgggccgccucgggcgguccaagcgcaagcggcuggagguggaggagccccugggcagcgggcccuccgugcucggcaccggcaccgggggcagcgggggcuuccaccuggcgcagcaggccuccgccagcgggagcgucuccaucgaggagaucgaccuggagggcaaguucgugcagcucaagaacaacagcgacaaggaccagucccugggcaacuggcgcaucaagcgccaggugcuggagggggaggagaucgccuacaaguucaccccgaaguacauccuccgggccggccagauggucacggugugggcggccggggccggcgucgcccacagcccgcccuccacccugguguggaaggggcagagcuccuggggcaccggcgagagcuuccggaccgugcuggucaacgcggacggggaggagguggccaugcgcacggugaagaaguccagcgucaugcgggagaacgagaacggcgaggaggaggaggaggaggccgaguucggggaggaggaccucuuccaccagcagggcgacccccgcaccaccucccgggggugcuacgugauguga

SEQ ID NO: 32374 - RNA, 978 nt, Artificial Sequence
  derived and/or modified sequence opt1 from LMNTD1__Homo_sapiens__NP_001139199
augcagcagcccgugcgcgccggcgacaucggggucagccgggugcagacccaccacaacgccuccccguucagcgugcccaagaagcaggacgagucccccaugaucggcgacggggaggacuacuuccugagccucuucggcgacuccaagaagcugaccgcgcacagcaacuacacgcagaagacccugaaguacuucuccaugauccucgaggaggucgggcaguucaccagcuccagccugggcgacguggagaucgccgaggugaacgucaagggccuguucgugaagcucaucaacuccagccuggacaaggagauggccaucggggaccacauccugcagcagaacgugaacggccagaccaucucccucuaccgcuuccugcccaacaucgucaugcaggccaacagcacggugaccgugugggccgcggccuccgaggccaagcaccagccgcccagcgacuuccuguggaaggagcaggacaaguuccgggccucccccgacugcaucaccauccucugcaagcccaacgggcaggcgaucgccugguacaccccgauccacuggaagcaggccugggagaagcuggacgccgacgucgaguucaaccgcugcagcguggugucccccacguuccggaagcgcgucuuccaguggaccgccagcaccgcgaccaucacgaaggagaagcaggaccagcccaagaaggacaucagcaacuaccagguggagcaggcccaggugcugcucaagcgggagaaggagaucccgcccaccgucuuccccaaccgcucccccuggugccagaaccccuacgugagcgcccacccguacugcccccugaucgagccccacaacaccuccaccgccggcgggcggcuggaccgccagccccggacgcgcagcacccggccgaaccgcgccuccggcagcaagaagaagaagaccuccgagagccagaagcaguga

SEQ ID NO: 32375 - RNA, 468 nt, Artificial Sequence
  derived and/or modified sequence opt1 from LMO1__Homo_sapiens__NP_001257357
auggugcuggaccaggaggacggcguccccaugcucagcgugcagccgaaggggaagcagaagggcugcgccgggugcaaccgcaagaucaaggaccgguaccugcugaaggcccucgacaaguacuggcacgaggacugccugaagugcgcgugcugcgacugccgccugggcgaggugggguccacccucuacaccaaggccaaccugauccugugccggcgcgacuaccuccggcuguucggcacgaccggcaacugcgccgccugcagcaagcugauccccgccuucgagauggucaugcgcgcgcgggacaacguguaccaccucgacugcuucgccugccagcugugcaaccagcgcuucugcgugggggacaaguucuuccugaagaacaacaugauccucugccagauggacuacgaggagggccagcugaacgggaccuucgagucccagguccaguga

SEQ ID NO: 32376 - RNA, 477 nt, Artificial Sequence
  derived and/or modified sequence opt1 from LMO2__Homo_sapiens__NP_001135787
augagcuccgccaucgagcgcaagagccuggaccccuccgaggagcccguggacgagguccuccagaucccgcccagccugcugaccugcggcgggugccagcagaacaucggcgaccgguacuuccucaaggccaucgaccaguacuggcacgaggacugccuguccugcgaccugugcgggugccgccucggcgagguggggcggcgccuguacuacaagcugggccggaagcucugccgccgggacuaccugcgccuguucggccaggacgggcucugcgcgagcugcgacaagcggauccgcgccuacgagaugaccaugcgggugaaggacaaggucuaccaccuggagugcuucaagugcgccgccugccagaagcacuucugcgugggcgaccgcuaccugcucaucaacuccgacaucgugugcgagcaggacaucuacgaguggacgaagaucaacgggaugaucuga

SEQ ID NO: 32377 - RNA, 438 nt, Artificial Sequence
  derived and/or modified sequence opt1 from LMO3__Homo_sapiens__NP_001001395
augcugagcgugcagcccgacaccaagccgaagggcugcgccgggugcaaccgcaagaucaaggaccgguaccuccugaaggcccuggacaaguacuggcacgaggacugccucaagugcgccugcugcgacugccgccugggcgaggucggguccacccuguacacgaaggccaaccucauccugugccggcgcgacuaccugcgccucuucggcgugaccgggaacugcgccgccugcagcaagcugauccccgccuucgagauggugaugcgggcgaaggacaacgucuaccaccuggacugcuucgccugccagcucugcaaccagcgguucugcgugggcgacaaguucuuccugaagaacaacaugauccugugccagaccgacuacgaggagggccucaugaaggagggguacgcgccccaggugcgcuga

SEQ ID NO: 32378 - RNA, 4050 nt, Artificial Sequence
  derived and/or modified sequence opt1 from LMO7__Homo_sapiens__NP_005349
augaagaagauccgcaucugccacaucuucaccuucuacagcuggauguccuacgacgugcuguuccagcggaccgagcucggcgcccuggagaucuggcgccagcugaucugcgcccacgucugcaucugcgugggguggcucuaccugcgggaccgcgugugcagcaagaaggacaucauccugcggaccgagcagaacuccggccgcaccauccucaucaaggcggucaccgagaagaacuucgagaccaaggacuuccgggccagccuggagaacggggugcugcucugcgaccugaucaacaagcugaagcccggcgugaucaagaagaucaaccgccucuccacgccgaucgccgggcuggacaacaucaacgucuuccugaaggccugcgagcagaucggccucaaggaggcccagcuguuccaccccggcgaccugcaggaccucagcaaccgggugaccgugaagcaggaggagaccgaccgccgggucaagaacgugcugaucacccuguacuggcucgggcgcaaggcgcaguccaaccccuacuacaacggcccccaccugaaccugaaggccuucgagaaccuccuggggcaggcccugacgaaggcccucgaggacagcuccuuccugaagcggagcggccgcgacuccggguacggcgacaucuggugcccggagcggggcgaguuccuggcgccgccccgccaccacaagcgggaggacagcuucgagucccucgacagccuggggucccgcagccugaccuccugcagcuccgacaucacccuccggggcgggcgcgagggcuucgagagcgacaccgacagcgaguucacguucaagaugcaggacuacaacaaggacgacauguccuaccggcgcaucagcgccguggagcccaagaccgcccugcccuucaaccgcuuccugcccaacaagucccggcagcccagcuacguccccgccccgcuccgcaagaagaagcccgacaagcacgaggacaaccggcgcuccugggccagccccguguacaccgaggcggacggcaccuucucccggcuguuccagaagaucuacggggagaacggcagcaaguccaugagcgacguguccgccgaggacguccagaaccugcgccagcuccgguacgaggagaugcagaagaucaagagccagcugaaggagcaggaccagaaguggcaggacgaccuggccaaguggaaggaccgccggaaguccuacacgagcgaccuccagaagaagaaggaggagcgcgaggagaucgagaagcaggcccuggagaaguccaagcggagcuccaagaccuucaaggagaugcugcaggaccgcgagagccagaaccagaaguccaccgugcccagccggcgccggauguacagcuucgacgacgugcucgaggaggggaagcgcccgcccaccaugacggucuccgaggccagcuaccaguccgagcggguggaggagaagggcgcgaccuaccccagcgagauccccaaggaggacuccaccaccuucgccaagcgcgaggaccgggugacgaccgagauccagcugccgagccagucccccgucgaggagcagagccccgccucccugagcucccuccgcagccgcuccacccagauggagagcacccggguguccgccagccugccccgcuccuaccggaagacggacaccgugcgccugaccagcgucgugaccccgcggcccuucgggagccagacgcgcggcaucuccagccugccccgguccuacaccauggacgacgccuggaaguacaacggcgacgucgaggacaucaagcgcacccccaacaacguggugagcaccccggcgcccucccccgacgccagccagcucgccuccagccuguccagccagaaggaggucgccgccacggaggaggacgugacccggcugccgucccccaccagccccuucuccagccucucccaggaccaggcggccaccagcaaggccacccuguccagcacguccgggcuggaccucaugagcgagagcggcgagggggagaucagcccccagcgcgaggugucccggucccaggaccaguucagcgacaugcgcaucuccaucaaccagaccccgggcaagagccuggacuucggguucaccaucaagugggacauccccggcaucuucgucgccuccguggaggcgggcagccccgccgaguucucccagcuccagguggacgacgagaucaucgccaucaacaacaccaaguucagcuacaacgacuccaaggagugggaggaggccauggccaaggcgcaggagacggggcaccuggucauggacgugcggcgcuacggcaaggccgggagccccgagaccaaguggaucgacgccaccuccggcaucuacaacagcgagaaguccagcaaccuguccgugaccacggacuucagcgagucccugcagagcagcaacaucgaguccaaggagaucaacgggauccacgacgagagcaacgccuucgaguccaaggccagcgaguccaucagccucaagaaccugaagcggcgcucccaguucuucgagcagggcagcuccgacagcgucgugccggaccugcccgugcccaccaucuccgcgcccagccggugggucugggaccaggaggaggagcgcaagcggcaggagcgcuggcagaaggagcaggaccggcuccugcaggagaaguaccagcgcgagcaggagaagcugcgcgaggaguggcagcgggccaagcaggaggccgagcgcgagaacuccaaguaccucgacgaggagcugauggugcugagcuccaacagcaugucccucaccacccgggagccgagccuggccacgugggaggccaccugguccgagggcagcaagagcuccgaccgcgaggggacccgggcgggcgaggaggagcgccggcagccccaggaggaggugguccacgaggaccaggggaagaagccccaggaccagcuggugaucgagcgcgagcggaagugggagcagcagcuccaggaggagcaggagcagaagcgccugcaggccgaggccgaggagcagaagcggcccgccgaggagcagaagcgccaggcggagaucgagcgggagaccagcgugcgcaucuaccaguaccggcgcccggucgacuccuacgacauccccaagacggaggaggccagcuccggcuuccugcccggcgaccggaacaagagccgcuccaccaccgagcucgacgacuacagcaccaacaagaacgggaacaacaaguaccuggaccagaucggcaacaugacguccagccagcggcgcuccaagaaggagcagguccccagcggggccgagcuggagcgccagcagauccuccaggagaugcggaagcgcaccccgcugcacaacgacaacuccuggauccggcagcgcagcgccuccgugaacaaggagcccgugagccugcccggcaucaugcggcgcggggagucccucgacaaccuggacagcccccgguccaacagcuggcgccagccgcccuggcugaaccagcccaccggcuucuacgccagcuccagcgugcaggacuucucccggccgccgccccagcucgugagcaccuccaaccgcgcguacaugcggaaccccagcuccagcgugcccccgcccuccgccggcagcgucaagacguccaccaccgggguggccaccacgcagagccccacgccccgcucccacagccccuccgccagccaguccggcagccagcugcggaaccgcuccgucagcgggaagcggaucugcagcuacugcaacaacauccugggcaagggggccgcgaugaucaucgagucccucggccugugcuaccaccuccacugcuucaagugcguggccugcgagugcgaccugggcgggagcuccagcggcgccgaggugcgcauccggaaccaccagcuguacugcaacgacugcuaccugcgcuucaaguccgggcggcccaccgccauguga

SEQ ID NO: 32379 - RNA, 1803 nt, Artificial Sequence
  derived and/or modified sequence opt1 from LMOD1__Homo_sapiens__NP_036266
augagccgcguggccaaguaccggcgccaggucuccgaggaccccgacaucgacagccugcucgagacccugucccccgaggagauggaggagcuggagaaggagcucgacgugguggaccccgacggcagcguccccguggggcugcggcagcgcaaccagaccgagaagcaguccacgggcguguacaaccgggaggccaugcugaacuucugcgagaaggagaccaagaagcucaugcagcgcgagaugagcauggacgaguccaagcaggucgagaccaagaccgacgcgaagaacggggaggagcggggccgcgacgccagcaagaaggcccuggggccccggcgcgacuccgaccugggcaaggagcccaagcggggcgggcucaagaaguccuucucccgcgaccgggacgaggccggcggcaagagcggcgagaagcccaaggaggagaagaucauccgcgggaucgacaagggccgggugcgcgccgcgguggacaagaaggaggccggcaaggacgggcggggcgaggagcgcgccgucgccacgaagaaggaggaggagaagaagggguccgaccggaacaccggccugagccgcgacaaggacaagaagcgggaggagaugaaggagguggcgaagaaggaggacgacgagaaggugaagggggagcgccgcaacaccgacacccggaaggagggggagaagaugaagcgcgccggcgggaacacggacaugaagaaggaggacgagaaggucaagcggggcaccgggaacaccgacaccaagaaggacgacgagaaggugaagaagaacgagccccugcacgagaaggaggccaaggacgacagcaagacgaagacccccgagaagcagacccccagcggccccaccaagcccuccgagggccccgccaagguggaggaggaggccgcgccgagcaucuucgacgagccccucgagcgcgucaagaacaacgaccccgagaugacggaggugaacgugaacaacuccgacugcaucaccaacgagauccugguccgguucaccgaggcccuggaguucaacaccguggugaagcuguucgcccucgccaacacgcgcgccgacgaccacgucgcguucgccaucgccaucaugcugaaggccaacaagaccaucaccagccucaaccuggacagcaaccacaucaccgggaagggcauccuggccaucuuccgggcgcuccugcagaacaacacgcugaccgagcuccgcuuccacaaccagcggcacaucugcgggggcaagaccgagauggagaucgccaagcugcugaaggagaacaccacgcuccugaagcugggguaccacuucgagcucgccggcccccgcaugaccgugaccaaccugcugucccggaacauggacaagcagcgccagaagcggcuccaggagcagcgccaggcccaggaggccaagggcgagaagaaggaccugcuggaggugccgaaggcgggggccgucgccaagggcagccccaagcccagcccccagccgucccccaagcccucccccaagaacagcccgaagaagggcggggcccccgcggccccgccgcccccgccgccgccccucgccccgccccugaucauggagaaccugaagaacucccucagccccgccacccagcggaagaugggggacaaggugcugcccgcccaggagaagaacucccgcgaccagcugcucgcggccauccggagcuccaaccugaagcagcugaagaaggucgaggugcccaagcuccugcaguga

SEQ ID NO: 32380 - RNA, 1683 nt, Artificial Sequence
  derived and/or modified sequence opt1 from LMOD3__Homo_sapiens__NP_001291347
augagcgagcacucccgcaacagcgaccaggaggagcugcucgacgaggagaucaacgaggacgagauccuggccaaccuguccgccgaggagcucaaggagcugcagagcgagauggaggugauggcgcccgacccgucccugcccgucggcaugauccagaaggaccagaccgacaagccgcccaccgggaacuucaaccacaagagccucguggacuacauguacugggagaaggccucccggcgcaugcuggaggaggagcgggugcccgucacguucgugaaguccgaggagaagacccaggaggagcacgaggagaucgagaagcgcaacaagaacauggcccaguaccugaaggagaagcucaacaacgagaucguggccaacaagcgggagagcaagggcagcuccaacauccaggagaccgacgaggaggacgaggaggaggaggacgacgacgacgacgacgagggggaggacgacggcgaggagagcgaggagaccaaccgcgaggaggaggggaaggccaaggagcagauccggaacugcgagaacaacugccagcaggucacggacaaggcguucaaggagcagcgcgaccggcccgaggcccaggagcaguccgagaagaagaucagcaagcuggaccccaagaagcuggcccucgacaccuccuuccugaaggugagcacccgccccuccggcaaccagaccgaccuggacggcagccuccggcgcgugcggaagaacgacccggacaugaaggagcugaaccugaacaacaucgagaacauccccaaggagaugcuccuggacuucgucaacgccaugaagaagaacaagcacaucaagacguucucccuggcgaacgugggggccgacgagaacguggccuucgcccucgccaacaugcugcgcgagaaccggagcaucaccacccugaacaucgagagcaacuucaucaccggcaaggggaucgucgcgaucaugcgcugccuccaguucaacgagacgcugaccgagcugcgguuccacaaccagcgccacaugcucggccaccacgccgagauggagaucgcccggcugcugaaggccaacaacacccuccugaagaugggguaccacuucgagcugcccggcccccgcaugguggugaccaaccuccugacgcggaaccaggacaagcagcgccagaagcgccaggaggagcagaagcagcagcagcugaaggagcagaagaagcucaucgccaugcuggagaacggccuggggcucccgcccggcaugugggagcugcucgggggccccaagcccgacucccggaugcaggaguucuuccagccgcccccgccccggccgcccaacccccagaacguccccuucagccagcgguccgagaugaugaagaagcccagccaggcgcccaaguaccgcaccgaccccgacuccuuccggguggugaagcugaagcgcauccagcgcaagagccgcaugcccgaggcccgggagccgcccgagaagaccaaccugaaggacgucaucaagacccugaagcccgugccgcgcaaccggcccccgccccucguggagaucacgccccgcgaccagcugcugaacgacauccggcacuccagcgucgccuaccucaagcccgugcagcugcccaaggagcuggccuga

SEQ ID NO: 32381 - RNA, 4512 nt, Artificial Sequence
  derived and/or modified sequence opt1 from LMTK2__Homo_sapiens__NP_055731
augcccggcccgcccgcccugcgccggcgccuccugcugcuccugcuggugcuccugaucgccgggagcgcgggcgccgcgccccugccccagaccggggccggcgaggccccgcccgccgccgaggucuccagcuccuucgugauccucugcgugugcagccugaucauccugaucguccucaucgccaacugcguguccugcugcaaggaccccgagaucgacuucaaggaguucgaggacaacuucgacgacgagaucgacuucacgcccccggccgaggacacccccagcgugcagucccccgcggaggucuucacccugagcgugcccaacaucucccugccggcccccagccaguuccagcccuccguggaggggcucaagagccaggucgcccggcacucccugaacuacauccaggagaucggcaacggcugguucgggaaggugcugcucggcgagaucuacaccgggaccagcguggcccgcgucaucgugaaggagcugaaggccuccgcgaaccccaaggagcaggacacguuccugaagaacggcgagccguacuacauccuccagcaccccaacauccugcagugcguggggcagugcgucgaggccauccccuaccugcucguguucgaguucugcgaccugggcgaccugaaggccuaccuccggagcgagcaggagcacaugcgcggcgacucccagaccaugcugcugcagcggauggccugcgagguggccgcggggcucgccgccaugcacaagcugcacuuccugcacagcgaccucgcccugcgcaacugcuuccugaccuccgaccucaacgucaaggugggcgacuacgggaucggcuucagccgguacaaggaggacuacaucgagaccgacgacaagaagguguucccccugcgcuggacggccccggagcuggucaccagcuuccaggaccggcuccugaccgcggaccagaccaaguacuccaacaucuggagccugggcgugacgcucugggagcuguucgacaacgccgcccagcccuacuccaaccugagcaaccucgacgugcugaaccaggucauccgcgagcgggacaccaagcugcccaagccccagcucgagcagccguacuccgaccgcugguacgaggugcugcaguucugcuggcugagccccgagaagcggcccgccgccgaggacguccaccgccugcucaccuaccugcggcugcagucccagcgcgacagcgagguggacuucgagcagcaguggaacgcgcucaagcccaacaccaacucccgggacagcuccaacaacgccgccuucccgauccuggaccacuucgcccgcgaccggcuggggcgcgagauggaggaggugcucacggucaccgagaccagccagggccuguccuucgaguacgugugggaggcggccaagcacgaccacuucgacgagcgcagccgggggcaccuggacgagggccucuccuacaccagcaucuucuaccccguggaggucuucgaguccagccuguccgaccccgggccgggcaagcaggacgacagcggccaggacgugccccugcgcgugcccggggucgugcccguguucgacgcccacaaccucagcgucggcuccgacuacuacauccagcuggaggagaaguccggguccaaccuggagcucgacuacccgcccgcccugcugacgaccgacauggacaaccccgagcggaccggccccgagcucagccagcugaccgcccugcgcuccguggagcucgaggagagcuccacggacgaggacuucuuccagagcuccaccgacccgaaggacagcucccugcccggggaccugcacgugaccagcggccccgagucccccuucaacaacaucuucaacgacgucgacaagagcgaggaccucccgucccaccagaagaucuucgaccugauggagcugaacggcgugcaggcggacuucaagcccgccacccucagcuccagccuggacaaccccaaggagagcgugaucacggggcacuucgagaaggagaagccccggaagaucuucgacuccgagccgcugugccucagcgacaaccugaugcaccaggacaacuucgacccccugaacguccaggagcucuccgagaacuuccuguuccugcaggagaagaaccuccugaagggcagccuguccagcaaggagcacaucaacgaccuccagaccgagcugaagaacgccggguucaccgaggccaugcuggagaccuccugccgcaacagccucgacacggagcugcaguucgccgagaacaagcccggccugucccuccugcaggagaacgugagcaccaagggggacgacaccgacgugaugcugaccggcgacacgcucuccaccagccugcaguccagccccgagguccaggugccgcccaccuccuucgagaccgaggagacgccccggcgcgugcccccggacagccugcccacccagggcgagacccagccgaccugccucgacgucaucgugcccgaggacugccugcaccaggacaucucccccgacgcggugaccguccccguggagauccugagcacggacgcccggacccacucccucgacaaccgcagccaggacagccccggggaguccgaggagacccugcggcugaccgagagcgacuccgugcucgccgacgacauccuggccagccgcgucuccgugggcagcucccugccggagcucgggcaggagcugcacaacaagcccuucagcgaggaccaccacucccaccggcgccuggagaagaaccucgaggccguggagacgcugaaccagcugaacagcaaggacgcggccaaggaggccggccucgucuccgcccugagcuccgacagcaccucccaggacagccugcucgaggacucccugagcgcgcccuuccccgccuccgagccgagccuggagacccccgacagccucgaguccguggacgugcacgaggcccugcuggacagccucggcucccacacgccccagaagcuggugcccccggacaagcccgccgacagcggguacgagaccgagaaccuggagucccccgaguggacccuccaccccgccccggagggcaccgcggacagcgagcccgccaccacgggggacggcgggcacuccggccugccgcccaaccccgucaucgugaucagcgacgccggcgacgggcaccggggcaccgaggucacccccgagaccuucacggccgggucccagggcagcuaccgcgacuccgccuacuucagcgacaacgacuccgagcccgagaagcggagcgaggaggugcccgggaccuccccgagcgcgcuggugcucguccaggagcagccccugcccgagcccgugcugccggagcagucccccgccgcccaggacagcugccucgaggcccgcaagucccagcccgacgagagcugccugagcgcccugcacaacuccagcgaccucgagcugcgggcgaccccggagcccgcccagaccggcgugccccagcagguccaccccacggaggacgaggccuccagcccgugguccgugcugaacgccgagcucagcuccggcgacgacuucgagacccaggacgaccgccccugcacccuggcgagcaccgggacgaacaccaacgagcugcucgccuacaccaacuccgcccuggacaagagccuguccagccacuccgagggccccaagcugaaggagcccgacaucgaggggaaguaccucggcaagcugggggugagcggcaugcuggaccucuccgaggacggcauggacgccgacgaggaggacgagaacagcgacgacuccgacgaggaccugcgcgccuucaaccugcacagccucuccagcgagagcgaggacgagaccgagcacccgguccccaucauccuguccaacgaggacgggcggcaccuccgcagccugcugaagcccacggcggccaacgcccccgacccgcugcccgaggacuggaagaaggagaagaaggccgugaccuucuucgacgacgugaccgucuaccucuucgaccaggagacccccacgaaggagcugggccccugcgggggcgaggccugcgggccggaccuguccggccccgcgcccgccagcggcucccccuaccucagccggugcaucaacuccgagagcuccaccgacgaggagggcggcggguucgagugggacgacgacuucagcccggaccccuucauguccaagaccaccagcaaccugcuguccagcaagcccucccuccagaccagcaaguacuucagcccgcccccgcccgcccgcagcacggagcaguccuggccccacagcgcccccuacagccgguucuccaucagccccgccaacaucgcguccuucagccugacccaccugaccgacuccgacaucgagcagggcgggagcuccgaggacggggagaaggacuga

SEQ ID NO: 32382 - RNA, 4470 nt, Artificial Sequence
  derived and/or modified sequence opt1 from LMTK3__Homo_sapiens__NP_001073903
augcgccaggugcuguggcugugcaacgucugcgugaccgcccgggagacccgccaccaccuccaccuccccgccauccuggacaagaugcccgcccccggcgcccugauccugcucgccgccgugagcgccuccgggugccuggccucccccgcccaccccgacggcuucgcccuggggcgggccccgcucgcgccgcccuacgccgucgugcugaucuccugcagcggccugcucgccuucaucuuccugcugcugaccugccugugcugcaagcgcggggacgugggcuucaaggaguucgagaaccccgagggcgaggacugcuccggggaguacaccccgcccgccgaggagaccagcuccagccagucccugcccgacgucuacauccucccccuggccgaggugagccugcccaugcccgcgccccagcccucccacagcgacaugaccacgccccucggccugucccggcagcaccugagcuaccuccaggagaucggguccggcugguucgggaaggugauccugggcgagaucuucagcgacuacacccccgcccaggucguggugaaggagcugcgcgccuccgccggcccccucgagcagcggaaguucaucagcgaggcccagcccuaccgcucccugcagcaccccaacguccugcagugccucgggcugugcguggagacccugcccuuccuccugaucauggaguucugccagcugggcgaccucaagcgguaccugcgcgcccagcggccgcccgaggggcugagccccgagcugccgccccgcgaccugcggacccugcagcgcaugggccucgagaucgcccggggccuggcccaccuccacagccacaacuacgugcacuccgaccucgcccugcgcaacugccugcucaccagcgaccugaccguccggaucggggacuacggccuggcccacuccaacuacaaggaggacuacuaccugacccccgagcgccucuggaucccccugcggugggccgcccccgagcugcucggggagcugcacggcaccuucauggugguggaccagagccgcgaguccaacaucuggagccugggggucacccucugggagcuguucgaguucggcgcccagcccuaccggcaccuguccgacgaggaggugcucgccuucgugguccgccagcagcacgugaagcuggcccgcccccggcugaagcuccccuacgccgacuacugguacgacauccugcagagcugcuggcggccgcccgcccagcggcccuccgccagcgaccugcagcuccagcugaccuaccugcucuccgagcggccgccccggcccccgcccccgcccccgccgccccgcgacggccccuuccccuggcccuggccgcccgcccacagcgcgccccgccccgggacccuguccagccccuucccccugcucgacggcuuccccggggccgaccccgacgacgugcugaccgucacggaguccagccgcggccucaaccucgagugccugugggagaaggcccggcgcggggccggccggggcgggggcgcccccgccuggcagcccgccuccgccccgcccgcgccccacgccaaccccagcaaccccuucuacgaggcccuguccacccccagcgugcuccccgucaucagcgcccgcucccccagcguguccagcgaguacuacauccggcuggaggagcacgggagcccgcccgagccccuguucccgaacgacugggacccccucgaccccggcgugcccgccccgcaggcgccccaggcccccagcgaggucccccagcugguguccgagaccugggcgagcccgcuguuccccgcgccccgccccuucccggcccaguccagcgccuccgggagcuuccuccuguccggcugggaccccgagggccgcggcgccggcgagacccuggccggggaccccgccgaggugcucggcgagcgcggcacggcccccugggucgaggaggaggaggaggaggaggaggggagcuccccgggcgaggacagcuccagccucgggggcgggcccagccggcgcggcccccugccgugcccccucugcucccgggagggcgccugcagcugccugccccuggagcgcggggacgcgguggccggcuggggcgggcaccccgcccucgggugcccgcacccgcccgaggacgacuccagccugcgcgccgagcggggcucccuggccgaccuccccauggcgccgcccgccagcgcgccgcccgaguuccuggacccccugaugggcgccgccgcgccccaguaccccgggcgcgggcccccgcccgcgcccccgcccccgccgccgccgccccgggcccccgccgaccccgcggccucccccgacccgcccagcgccguggccucccccggcagcggccucuccagccccgggcccaagcccggcgacuccggcuacgagaccgagacccccuucagccccgagggggccuuccccggcgggggcgcggccgaggaggagggggucccccgcccccgggccccgcccgagccgcccgaccccggcgcgccccgcccgccgcccgaccccggcccccugccccugcccgggccccgggagaagcccaccuucguggugcaggucuccacggagcagcuccugaugagccugcgcgaggacgugacccggaaccuccugggcgagaagggggccaccgcgcgcgagaccggcccccggaaggccggccgcgggcccggcaaccgggagaaggugcccgggcugaaccgcgaccccacgguccucggcaacgggaagcaggcccccucccugagccugcccgugaacggcgugaccguccucgagaacggcgaccagcgggcccccgggaucgaggagaaggccgcggagaacggcgcccugggguccccggagcgcgaggagaaggugcuggagaacggcgagcucacgccgccccggcgcgaggagaaggcccuggagaacggggagcugcggagccccgaggccggcgagaaggugcucgucaacggcgggcugaccccgcccaagagcgaggacaagguguccgagaacggcgggcugcgcuucccccggaacacggagcgcccgcccgagaccggccccuggcgcgcccccgggcccugggagaagacccccgagagcuggggccccgcgcccaccaucggcgagcccgccccggagacgucccucgagcgggcccccgcccccagcgcgguggucuccagccgcaacgggggcgagaccgcccccgggccgcugggccccgcccccaagaacggcacccuggagcccgggaccgagcggcgcgccccggagaccggcggggcgccccgggcgcccggcgccgggcgccucgaccugggcuccggcgggcgggccccggugggcacggggaccgcccccggcgggggccccggcagcgggguggacgccaaggcgggcugggucgacaacacccgcccccagccgccgccgccgccccugcccccgccgcccgaggcccagccccggcgccucgagcccgcgccgccccgggcccgccccgagguggcccccgagggggagcccggcgcgcccgacucccgggccgggggcgacaccgcccugagcggcgacggggacccgcccaagcccgagcgcaagggccccgagaugccccggcuguuccucgaccuggggccgccccagggcaacuccgagcagaucaaggcccgccugagccggcucucccuggcgcugccgccccucacgcugacccccuucccggggcccggcccccgccggcccccgugggagggcgccgacgccggggccgccggcggggaggcgggcggcgccggggcccccggccccgccgaggaggacggggaggacgaggacgaggacgaggaggaggacgaggaggccgcggcccccggcgccgccgccgggccgcgcggccccggccgcgcgcgggccgcccccgugcccgucguggugagcuccgccgacgcggacgccgcccgcccgcugcgggggcuccucaagagcccccgcggcgccgacgagcccgaggacuccgagcuggagcggaagcgcaagauggucagcuuccacggggacgugaccguguaccuguucgaccaggagacccccacgaacgagcuguccguccaggccccgcccgagggcgacaccgaccccagcacgccgcccgcgccgcccacgccgccccaccccgccacgcccggggacggcuuccccagcaacgacuccggcuucgggggcagcuucgagugggccgaggacuucccccugcugcccccgcccgggccgccccugugcuucucccgguucagcgugucccccgcccuggagacccccgggccgcccgcccgcgcgcccgacgcccggccggccgggcccguggagaacuga

SEQ ID NO: 32383 - RNA, 1149 nt, Artificial Sequence
  derived and/or modified sequence opt1 from LMX1A__Homo_sapiens__NP_001167540
augcuggacggccucaagauggaggagaacuuccagagcgccaucgacaccuccgccagcuucuccagccugcuggggcgcgcggugucccccaagagcgucugcgagggcugccagcgggugauccucgaccgcuuccugcugcggcucaacgacuccuucuggcacgagcagugcgugcagugcgccagcugcaaggagccgcuggagaccacgugcuucuaccgcgacaagaagcuguacugcaaguacgacuacgagaagcuguucgccgucaagugcgggggcugcuucgaggccaucgcccccaacgaguucgugaugcgggcgcagaaguccguguaccaccucagcugcuucugcugcugcgucugcgagcgccagcugcagaagggggacgaguucgugcucaaggagggccagcugcugugcaagggcgacuacgagaaggagcgggagcuccugucccuggugagccccgccgccuccgacagcgggaaguccgacgacgaggagagccucugcaaguccgcccacggcgcggggaagggcaccgccgaggaggggaaggaccacaagcgccccaagcggccgcgcaccauccugaccacgcagcagcggcgcgccuucaaggccagcuucgaggucuccagcaagcccugccggaaggugcgcgagacccuggccgcggagaccggccucagcgugcgggucguccaggugugguuccagaaccagcgcgccaagaugaagaagcuggcccggcgccagcagcagcagcagcaggaccagcagaacacccagcggcuguccagcgcccagacgaacggcgggggcuccgccgggauggagggcaucaugaaccccuacaccgcgcuccccaccccgcagcagcugcuggccaucgagcagagcguguacuccagcgaccccuuccgccagggccucaccccgccccagaugcccggggaccacaugcaccccuacggcgccgagccccuguuccacgaccuggacuccgacgacacgagccucuccaaccugggggacugcuuccuggccaccagcgaggccggcccccuccagucccggguggggaacccgaucgaccaccuguacagcaugcagaacuccuacuucaccagcuga

SEQ ID NO: 32384 - RNA, 1221 nt, Artificial Sequence
  derived and/or modified sequence opt1 from LMX1B__Homo_sapiens__NP_001167617
auggacaucgccaccggccccgagagccuggagcgcugcuucccgcgggggcagaccgacugcgccaagaugcucgacggcaucaagauggaggagcacgcgcugcgccccgggcccgccacgcugggcgugcuccugggguccgacugcccccacccggccgucugcgagggcugccagcggcccaucagcgaccgcuuccugaugcgggugaacgaguccagcuggcacgaggagugccuccagugcgccgccugccagcaggcgcugaccaccuccugcuacuuccgcgaccggaagcuguacugcaagcaggacuaccagcagcuguucgccgccaagugcagcggcugcauggagaagaucgcccccaccgaguucgugaugcgcgcgcucgagugcgucuaccaccuggggugcuucugcugcugcgugugcgagcggcagcuccgcaagggcgacgaguucgugcugaaggaggggcagcugcucugcaagggcgacuacgagaaggagaaggaccugcuguccagcgucucccccgacgagagcgacuccgucaagagcgaggacgaggacggggacaugaagccggccaagggccagggcucccagagcaagggguccggcgacgacgggaaggacccccggcgccccaagcggccccgcacgauccucaccacccagcagcggcgcgccuucaaggccagcuucgagguguccagcaagccgugccggaaggugcgcgagacccuggccgcggagacgggccuguccgugcgggugguccaggugugguuccagaaccagcgcgccaagaugaagaagcucgcccggcgccaccagcagcagcaggagcagcagaacagccagcgccugggccagggggagcccggccccgggcagggccuggggcaggaggugcucagcucccggauggagggcaugauggccagcuacacgccccuggccccgccccagcagcagaucgucgcgauggagcagucccccuacggcagcuccgaccccuuccagcaggggcugaccccgccccagaugcccggcaacgacagcaucuuccacgacaucgacuccgacaccagccucaccucccugagcgacugcuuccugggguccagcgacgugggcucccuccaggcccgcguggggaaccccaucgaccggcuguacagcaugcaguccagcuacuucgccuccuga

SEQ ID NO: 32385 - RNA, 3078 nt, Artificial Sequence
  derived and/or modified sequence opt1 from LNPEP__Homo_sapiens__NP_005566
auggagcccuucaccaacgaccgccugcagcucccgcggaacaugaucgagaacagcauguucgaggaggagcccgacguggucgaccuggccaaggagcccugccugcacccccucgagccggacgagguggaguacgagccccgcggcucccggcugcuggugcgcgggcucggcgagcacgagauggaggaggacgaggaggacuacgagagcuccgccaagcugcuggggaugagcuucaugaaccgguccagcggccuccgcaacuccgcgaccggguaccggcagagccccgacggcgccugcuccguccccagcgcccgcacgaugguggugugcgccuucgucaucgugguggccgucuccgugaucauggugaucuaccugcugccgcggugcaccuucaccaaggagggcugccacaagaagaaccagagcaucgggcucauccagcccuucgcgaccaacggcaagcuguuccccugggcccagauccgccugcccacggccgucgugccgcuccgguacgagcugucccugcaccccaaccucaccagcaugaccuuccgcggguccgugaccaucagcguccaggcccuccaggugacguggaacaucauccugcacuccaccggccacaacaucagccgggugaccuucauguccgcggucagcagccaggagaagcaggccgagauccuggaguacgccuaccacgggcagaucgccaucguggcccccgaggcgcugcuggccggccacaacuacacccucaagaucgaguacuccgccaacaucagcuccagcuacuacggcuucuacggguucuccuacacggacgagagcaacgagaagaaguacuucgccgccacccaguucgagccccuggcggcccgcuccgccuucccgugcuucgacgagcccgccuucaaggccaccuucaucaucaagaucauccgggacgagcaguacaccgcgcugagcaacaugcccaagaaguccagcgugguccucgacgacggccuggugcaggacgaguucuccgagagcgugaagauguccacguaccuggucgccuucaucgugggggagaugaagaaccucagccaggacgucaacggcacccugguguccaucuacgccgugcccgagaagaucggccagguccacuacgcccuggagaccaccgugaagcuccuggaguucuuccagaacuacuucgagauccaguacccgcugaagaagcucgaccugguggccauccccgacuucgaggcgggggccauggagaacuggggccugcucacguuccgcgaggagacccugcuguacgacagcaacaccuccagcauggccgaccggaagcucgucaccaagaucaucgcccacgagcuggcgcaccagugguucgggaaccuggugacgaugaagugguggaacgaccucuggcugaacgagggcuucgccaccuucauggaguacuucucccuggagaagaucuucaaggagcucagcagcuacgaggacuuccuggacgcccgcuucaagaccaugaagaaggacucccugaacagcucccaccccaucagcuccagcgugcaguccagcgagcagaucgaggagauguucgacucccugagcuacuucaagggguccagccuccugcugaugcucaagaccuaccuguccgaggacgucuuccagcacgccguggugcuguaccuccacaaccacagcuacgccuccauccagagcgacgaccugugggacuccuucaacgaggucacgaaccagacccuggacgugaagcggaugaugaagaccuggacccuccagaagggcuucccccuggugacgguccagaagaagggcaaggagcuguucauccagcaggagcgcuucuuccucaacaugaagccggagauccagcccagcgacaccagcuaccuguggcacaucccccuguccuacgugaccgaggggcggaacuacagcaaguaccaguccgugagccuccuggacaagaaguccggcgucaucaaccugaccgaggaggugcucugggugaaggucaacaucaacaugaacggguacuacaucgugcacuacgcggacgacgacugggaggcccugauccaccagcugaagaucaaccccuacgugcucagcgacaaggaccgcgccaaccugaucaacaacaucuucgagcuggccggccucgggaaggucccgcugaagcgcgccuucgaccugaucaacuaccucggcaacgagaaccacacggcgcccaucaccgaggcccuguuccagaccgaccugaucuacaaccuccuggagaagcugggcuacauggaccucgccucccggcuggugacccgcguguucaagcugcuccagaaccagauccagcagcagaccuggacggacgaggggacccccagcaugcgggagcugcgcuccgcccugcucgaguucgccugcacccacaaccugggcaacugcagcaccacggcgaugaagcuguucgacgacuggauggccuccaacgggacccagagccucccgaccgacgucaugaccacgguguucaaggugggcgccaagaccgacaaggggugguccuuccugcugggcaaguacaucagcaucggcuccgaggccgagaagaacaagauccucgaggcgcuggccagcuccgaggacguccggaagcuguacuggcucaugaaguccagccugaacggggacaacuuccgcacccagaagcugagcuucaucauccggaccgugggccgccacuuccccgggcaccuccuggccugggacuucgugaaggagaacuggaacaagcugguccagaaguucccccucggcagcuacacgauccagaacaucguggccggcuccaccuaccuguucagcaccaagacccaccuguccgaggugcaggccuucuucgagaaccagagcgaggcgacguuccggcuccgcugcguccaggaggcccuggaggugauccagcugaacauccaguggauggagaagaaccucaagucccugaccugguggcuguga

SEQ ID NO: 32386 - RNA, 1899 nt, Artificial Sequence
  derived and/or modified sequence opt1 from LNX1__Homo_sapiens__NP_116011
augaaggcccugcuccugcuggugcuccccuggcugagcccggccaacuacaucgacaacgucggcaaccugcacuuccucuacuccgagcugugcaagggggcgagccacuacggccugaccaaggaccgcaagcggcgcucccaggacgggugccccgacggcugcgccagccucaccgccacggcccccucccccgaggugagcgccgcggccaccaucucccugaugaccgacgagccggggcuggacaaccccgccuacgugagcuccgccgaggacggccagcccgcgaucagccccgucgacuccggccggagcaaccgcacccgggcccgcccguucgagcgguccacgauccgcagccgguccuucaagaagaucaaccgcgcccucagcgugcugcggcgcaccaaguccgggagcgccguggccaaccacgcggaccagggccgggagaacuccgagaacaccaccgcccccgaggucuucccccgccuguaccaccucauccccgacggggagaucacgagcaucaagaucaaccggguggacccgagcgagucccugagcauccgccuggugggcggguccgagacgccccucguccacaucaucauccagcacaucuaccgggacggcgugaucgcccgcgacggccggcugcugcccggggacaucauccucaaggugaacggcauggacaucagcaacgucccccacaacuacgccgugcgccugcugcggcagccgugccaggugcucuggcugaccgucaugcgcgagcagaaguuccgcucccggaacaacgggcaggcccccgacgcguaccgcccccgggacgacagcuuccacgugauccugaacaaguccagccccgaggagcagcucggcaucaagcuggugcgcaaggucgacgagccgggcguguucaucuucaacgugcuggacgggggcgucgccuaccggcacgggcagcucgaggagaacgaccgcgugcuggccaucaacggccacgaccugcgguacgggucccccgagagcgccgcccaccucauccaggcguccgagcgccgggugcaccuggucgugagccgccagguccggcagcgcucccccgacaucuuccaggaggccggcuggaacagcaacggcuccuggagccccgggccgggcgagcgguccaacacccccaagccccugcaccccaccaucacgugccacgagaagguggugaacauccagaaggacccgggggagagccucggcaugaccgucgccgggggcgccucccaccgcgagugggaccugcccaucuacgugaucagcguggagcccggcggggucaucagccgggacggccgcaucaagaccggggacauccugcucaacguggacggcguggagcugaccgaggucucccggagcgaggccguggcgcugcucaagcgcaccuccagcuccaucgugcugaaggcccuggaggucaaggaguacgagccgcaggaggacugcagcucccccgccgcccucgacagcaaccacaacauggcgccgcccuccgacuggagccccuccugggugauguggcuggagcugccccggugccucuacaacugcaaggacaucgugcugcgccgcaacaccgccgggagccugggcuucugcaucgucggcggguacgaggaguacaacggcaacaagcccuucuucaucaaguccaucguggaggggacccccgccuacaacgacggccggauccgcugcggcgacauccugcucgccgugaacgggcggagcacguccggcaugauccacgccugccuggcgcgccugcucaaggagcugaaggggcggaucacccugaccaucgucagcuggccgggcaccuuccucuga

SEQ ID NO: 32387 - RNA, 2073 nt, Artificial Sequence
  derived and/or modified sequence opt1 from LNX2__Homo_sapiens__NP_699202
augggcaccaccagcgacgagaugguguccgucgagcagacgagcuccagcucccugaacccccucugcuucgagugcgggcagcagcacuggacccgcgagaaccaccuguacaacuaccagaacgagguggacgacgaccuggugugccacaucugccuccagccgcugcugcagccccucgacacccccugcggccacaccuucugcuacaagugccugcggaacuuccugcaggagaaggacuucugcccccucgaccgcaagcggcugcacuucaagcugugcaagaaguccuccauccucguccacaagcugcuggacaagcuccuggugcugugcccguucagcuccgugugcaaggacgucaugcagcgcugcgaccucgaggcccaccugaagaaccggugccccggggccagccaccgccggguggcgcuggagcgccggaagacgucccgcacccaggccgagaucgagaacgagaacggccccacccuccuggaccccgccgggacccugagcccggaggccgacugccucggcacgggcgccgugcccgucgagcggcaccugaccuccgcgagccuguccaccuggagcgaggagcccgggcucgacaaccccgccuucgaggaguccgccggcgccgacaccacgcagcagccgcugagccugcccgagggggagaucaccaccaucgagauccaccgcuccaaccccuacauccagcucggcaucagcaucgucgggggcaacgagacgccccugaucaacaucgugauccaggagguguaccgggacggcgugaucgcgcgcgacgggcggcugcucgccggcgaccagauccuccaggugaacaacuacaacaucagcaacgucucccacaacuacgcccgcgccgugcugagccagccgugcaacacccugcaccugaccgugcugcgggagcgccgguucgggaaccgcgcccacaaccacuccgacagcaacagcccccgggaggagaucuuccaggucgcgcuccacaagcgcgacagcggcgagcagcugggcaucaagcuggugcgccggaccgacgagcccgggguguucauccucgaccugcuggagggcgggcucgccgcccaggacggccgccuguccagcaacgaccggguccuggccaucaacgggcacgaccucaaguacggcacccccgagcuggccgcgcagaucauccaggccuccggcgagcgcgugaaccugacgaucgcccggccggggaagccccagcccggcaacaccauccgcgaggccgggaaccacagcuccagcucccagcaccacacgcccccgcccuacuacagccggcccuccagccacaaggaccugacccagugcgugaccugccaggagaagcacaucaccgucaagaaggagccccacgagucccucggcaugaccguggccgggggccgcggcagcaaguccggggagcugccgaucuucgucaccagcgugccgccccacggcugccuggcgcgggacgggcgcaucaagcggggcgacgugcuccugaacaucaacgggaucgaccugacgaaccucagccacuccgaggccgucgccaugcugaaggccagcgccgcgucccccgccguggcccugaaggcccucgaggugcagaucgucgaggaggcgacccagaacgccgaggagcagcccagcaccuucuccgagaacgaguacgacgccagcuggucccccagcugggugauguggcugggccugcccuccacccuccacagcugccacgacaucgugcugcgccgguccuaccugggcagcuggggguucuccaucgucggcggguacgaggagaaccacacgaaccagccguucuucaucaagaccaucgugcucggcacccccgccuacuacgacggccgccugaagugcggggacaugaucguggccgucaacggccugagcaccguggggaugucccacagcgcgcucgugcccaugcugaaggagcagcggaacaaggucacgcugaccgugaucugcuggcccggcucccucguguga

SEQ ID NO: 32388 - RNA, 1755 nt, Artificial Sequence
  derived and/or modified sequence opt1 from LOC100288966__Homo_sapiens__NP_001244291
augguggccgaggucugcagcaugcccaccgccuccaccgugaagaagccguucgaccugcgcagcaagaugggcaaguggugccaccaccgguuccccugcugccgcggguccggcaagagcaacauggggacguccggcgaccacgacgacagcuucaugaagaugcuccgguccaagauggggaagugcugccgccacugcuuccccugcugccggggcagcggcaccuccaacguggggaccagcggcgaccacgagaacuccuucaugaagaugcugcgcagcaagauggggaaguggugcugccacugcuuccccugcugccggggcuccagcaaguccaacgucggggcguggggcgacuacgaccacagcgccuucauggagccgcgcuaccacgugcggcgcgaggaccuggacaagcuccaccgggccgccugguggggcaaggugccccgcaaggaccugaucgucaugcugcgggacaccgacaugaacaagcgcgacaaggagaagcggacggcccuccaccuggcguccgccaacgggaacagcgagguggugcagcugcuccuggaccgccggugccagcugaacguccucgacaacaagaagcgcaccgcccugaucaaggccauccagugccaggaggacgagugcgugcugaugcuccuggagcacggcgcggaccggaacauccccgacgaguacgggaacaccgcccugcacuacgccaucuacaacgaggacaagcucauggccaaggcccugcugcucuacggcgcggacaucgaguccaagaacaagugcggccugacgccccugcuccugggggugcacgagcagaagcagcaggucgugaaguuccugaucaagaagaaggccaaccucaacgugcuggaccgcuacggccggaccgcccugauccucgccgucugcugcgggagcgccagcaucgugaaccugcugcucgagcagaacguggacgucuccagccaggaccuguccggccagaccgcgcgcgaguacgccgugagcucccaccaccacgugaucugcgagcugcucagcgacuacaaggagaagcagaugcugaagaucuccagcgagaacuccaacccggagcaggaccugaagcucaccagcgaggaggagucccagcgccugaaggucagcgagaacucccagcccgagaagaugagccaggagcccgagaucaacaaggacugcgaccgggagguggaggaggagaucaagaagcacggguccaaccccgugggccugccggagaaccucaccaacggcgccagcgccgggaacggcgacgacgggcugaucccccagcgccggucccgcaagcccgagaaccagcaguuccccgacacggagaacgaggaguaccacagcgacgagcagaacgacacccggaagcagcuguccgaggagcagaacaccggcaucagccaggacgagauccucaccaacaagcagaagcagaucgaggucgccgagcagaagaugaacagcgagcugucccugagccacaagaaggaggaggaccuccugcgcgagaacuccgugcugcaggaggagaucgcgguccugcggcucgagcuggacgagacgaagcaccagaaccagcugcgcgagaacaagauccucgaggagaucgagagcgugaaggagaagaccgacaagcugcugcgggccaugcagcucaacgaggaggcccugaccaagaccaacaucuga

SEQ ID NO: 32389 - RNA, 1650 nt, Artificial Sequence
  derived and/or modified sequence opt1 from LOC101060321__Homo_sapiens__NP_001278391
auggacguggucgagguggccggcagcuggugggcccaggagcgcgaggacaucaucaugaaguacgagaaggggcaccgggcgggccugcccgaggacaaggggcccaagcccuuccgcuccuacaacaacaacguggaccaccucggcaucguccacgagaccgagcugccgccccugaccgcccgggaggccaagcagauccgccgggagaucagccgcaaguccaaguggguggacaugcucggggacugggagaaguacaagagcucccggaagcugaucgaccgcgccuacaagggcaugcccaugaacauccggggccccauguggagcgugcugcucaacaucgaggagaugaagcugaagaaccccgggcgcuaccagaucaugaaggagaagggcaagcgguccagcgagcacauccagcgcaucgaccgggacaucuccgggacgcugcgcaagcacauguucuuccgggaccgcuacggcaccaagcagcgggagcuccugcacauccugcucgccuacgaggaguacaaccccgaggucggguacugccgcgaccugagccacaucgcggcccuguuccuccuguaccugccggaggaggacgccuucugggcccucgugcagcugcuggcguccgagcggcacagccuccagggcuuccacucccccaacggcgggaccgugcagggccugcaggaccagcaggagcacgucguggccaccagccagcccaagacgauggggcaccaggacaagaaggaccugugcggccagugcagcccccucggcugccugauccgcauccugaucgacgggaucucccucggccugacccugcggcucugggacguguaccuggucgagggggagcaggcccugaugccgaucacccgcaucgccuucaaggugcagcagaagcgccucaccaagacgucccggugcggccccugggcccgcuucugcaaccgguucguggacaccugggcgcgcgacgaggacaccguccugaagcaccuccgggccagcaugaagaagcugacccgcaagcagggggaccugcccccgcccgccaagcccgagcagggcuccagcgccagccggcccgugcccgccucccgcggcgggaagacgcugugcaagggcgaccggcaggcgccgcccgggccgcccgcccgcuucccccggcccaucuggagcgccuccccgccccgcgcgccccggagcuccacccccugccccggcggggccgugcgcgaggacaccuacccggucggcacccagggcgugcccagccccgcccucgcccagggcgggccccagggguccuggcgguuccugcaguggaacagcaugccgcgccugcccacggaccucgacguggagggccccugguuccggcacuacgacuuccgccaguccugcuggguccgggccaucagccaggaggaccagcuggcccccugcuggcaggccgagcacccggcggagcgcgugcgcuccgccuucgccgcccccagcaccgacuccgaccaggggacccccuuccgggcgcgcgacgagcagcagugcgcccccaccagcggcccgugccugugcggccuccaccuggaguccagccaguucccgcccggguucuga

SEQ ID NO: 32390 - RNA, 453 nt, Artificial Sequence
  derived and/or modified sequence opt1 from LOC102723475__Homo_sapiens__XP_006724009
auggccuaccuggaggugugccugggcagccuguccugcagcuccgggacccugaugccccgcaugauccucagcaacaccacggccgucaccccguuccugaccaagcuguggcaggagaccgugcagcagggcgggaacauguccggccucgcgcggcgcagcccccgguccggggacggcaagcuggaggcccuguacgugcucaugguccugggcuucuucggguucuucacgcugggcaucaugcucagcuacauccgcuccaagaagcuggagcacagcaacgaccccuucaacguguacaucgaguccaacgccuggcaggagaaggacaaggccuacgugcaggcccggguccuggagagcuaccgcuccugcuacgugguggagaaccaccucgcgaucgagcagcccaacacccaccucccggagaccaagcccagccccuga

SEQ ID NO: 32391 - RNA, 1551 nt, Artificial Sequence
  derived and/or modified sequence opt1 from LOC102723996__Homo_sapiens__XP_006723962
augcgccugggcagccccgggcuccuguuccuccuguucuccagccugcgggccgacacccaggagaaggaggugcgcgccauggucggcuccgacguggagcugagcugcgcgugcccggaggggucccgguucgaccucaacgacguguacgucuacuggcagaccagcgaguccaagacgguggugaccuaccacaucccccagaacagcucccuggagaacgucgacagccgcuaccggaaccgcgcccugaugucccccgccggcaugcuccgcggggacuucagccugcggcuguucaacgugacgccccaggacgagcagaaguuccacugccucgugcugucccagagccugggcuuccaggagguccucuccguggaggugacccugcacgucgccgccaacuucagcgugccgguggucuccgcgccccacagccccucccaggacgagcugaccuucacgugcaccagcaucaacggcuacccccggccgaacguguacuggaucaacaagaccgacaacagccuccuggaccaggcccugcagaacgacaccguguuccucaacaugcgcgggcuguacgacgucguguccgugcugcggaucgcccgcacccccagcgucaacaucggcugcugcaucgagaacgugcuccugcagcagaaccugaccguggggucccagaccggcaacgacaucggggagcgggacaagaucacggagaaccccgucagcaccggcgagaagaacgccgcgaccugguccauccucgccgugcugugccugcucgucgugguggccgucgccaucggcugggugugccgcgaccggugccugcagcacagcuacgccggggcgugggccgugucccccgagaccgagcugacgggcgaguucgccgucgggagcucccgcuucuggggcgcccagggccggcucgggugccagcugagcuuccgcguguccaagaacuuccagaaggccgaggugccgugccuggagcagcuccuguuccuggagacccagcggagcccccgcuggugcgcgcggcacuuccuccagccgccccugggcaugggguggcaccccggcguccacuucgugacccugcgcugggacuuccccaacaugcaccgcucccgggagaccagcgcccgccucccccggucccccgugccgagccccgaccaggggguccagggcggcucccgccaccggcgccccgcccccauggggugcccggagugggugcaggcccccgcccccagcccccggggcgugucccgcgcggggccgggcacgggggcccagccgcccuggggcguccagggcgggagccggcaccgccggcccgcccccaugggcugccccgagugggugcaggcccccgccccgagcccccgcggggugugccgggcgggccccgggaccggcgcccagccccuguggggcguccgcuccgggagcggccaccggcagcugcucuccguggccgccaccccggcggcccuggugugccccagcguccccggggccaccuga

SEQ ID NO: 32392 - RNA, 399 nt, Artificial Sequence
  derived and/or modified sequence opt1 from LOC102724127__Homo_sapiens__XP_011544335
augcgcgccagccccugcaucucccagccggccgcgagcuggcacccccggcccuccgcccugcgccccaccgccggcagcgggccggacacccggacgcccggcaccguggaggacggguccgcccccugccccgccuuccgcagcccggcggucucccccugcggcgaggagcccugcugcuuccagaucagccccgccgaggagacccucgagcuggggcggcugguguccccgggcaacugcgacacccucagcccccgcgccgccggcuucuacgcgugccacgugcggucccugauccccugccgcagcacgaaggggcgguggccccugaccgccuccgccgccggccucagccgccacgcccagugcgggccgucccugggccugggguga

SEQ ID NO: 32393 - RNA, 1656 nt, Artificial Sequence
  derived and/or modified sequence opt1 from LOC102724560__Homo_sapiens__XP_011544402
augcccagcgagaccccgcaggccgaggugggccccaccgggugcccccaccgcuccggcccccacagcgccaaggggucccuggagaagggcagcccggaggacaaggaggcgaaggagccccucuggauccggcccgacgcccccucccgcugcacguggcagcuggggcggccggccagcgagagcccccaccaccacaccgcccccgccaagucccccaagauccugccggacauccucaagaagaucggcgacacccccaugguccgcaucaacaagaucggcaagaaguucgggcugaagugcgagcugcucgcgaagugcgaguucuucaacgccggcggguccgugaaggaccggaucagccugcgcaugaucgaggacgccgagcgggacggcacccugaagcccggggacacgaucaucgagcccaccuccggcaacaccggcaucgggcucgcccuggcggccgccgugcgcggcuaccggugcaucaucgucaugccggagaagaugagcuccgagaagguggacgugcugcgcgcccucggggccgagaucguccggacccccacgaacgcgcgcuucgacagccccgagucccacgugggcguggccuggcggcugaagaacgagauccccaacagccacauccuggaccaguaccgcaacgccuccaacccgcucgcccacuacgacaccaccgccgacgagauccugcagcagugcgacggcaagcuggacaugcucgucgcgagcguggggaccggcgggacgaucaccggcaucgcccggaagcugaaggagaagugccccgggugccgcaucaucggcguggaccccgagggcuccauccuggccgagcccgaggagcucaaccagaccgagcagaccacguacgaggucgaggggaucggcuacgacuucaucccgaccgugcuggaccggaccguggucgacaagugguucaagagcaacgacgaggaggccuucaccuucgcccgcaugcugaucgcgcaggaggggcuccugugcggcgggagcgccggcuccacgguggccguggccgucaaggccgcgcaggagcugcaggagggccagcggugcguggugauccuccccgacagcguccgcaacuacaugaccaaguuccuguccgaccgguggaugcugcagaagggguuccucaaggaggaggaccugaccgagaagaagcccuggugguggcaccuccgcgugcaggagcugggccugagcgcgccccugaccgugcucccgacgaucacgugcgggcacaccaucgagauccugcgcgagaagggcuucgaccaggcccccgucguggacgaggccggggucauccugggcauggugacccucggcaacaugcuguccagccugcucgccgggaaggugcagcccuccgaccaggucggcaaggugaucuacaagcaguucaagcagauccggcugaccgacacccuggggcgccucagccacauccuggagauggaccacuucgcccuggugguccacgagcagauccaguaccacuccaccggcaagagcucccagcggcagaugguguucggcguggucaccgccaucgaccuccugaacuucguggccgcccaggagcgcgaccagaaguga

SEQ ID NO: 32394 - RNA, 663 nt, Artificial Sequence
  derived and/or modified sequence opt1 from LOC102724770__Homo_sapiens__XP_006724997
auggagcgcuacgccggcgcccuggaggagguggcggacggggcccggcagcaggagcgccacuaccagcuccugagcgcccugcagucccucgucaaggagcugcccagcuccuuccagcagcggcugagcuacaccacccucuccgaccuggcccuggcccuccuggacggcacgguguucgagaucgugcaggggcugcucgagauccagcaccugaccgagaagucccuguacaaccagcgccuccggcugcagaacgagcaccgcguccugcggcaggcgcuccgccagaagcaccaggaggcccagcaggccugccggccccacaaccugcccgugcugcaggccgcgcagcagcgcgagcucgaggccguggagcaccggauccgcgaggagcagcgggccauggaccagaagaucguccuggagcuggaccgcaagguggccgaccagcagagcacccucgagaaggccggcguggcgggguucuacgucaccacgaacccccaggagcugaugcugcagaugaaccuccuggagcugauccggaagcuccagcagcgcggcugcugggccggcaaggccgcccuggggcugggcgggcccuggcagcucccggccgcgcagugcgaccagaagggcagccccgugccgcccuga

SEQ ID NO: 32395 - RNA, 2292 nt, Artificial Sequence
  derived and/or modified sequence opt1 from LOC102725016__Homo_sapiens__XP_006725712
augcacggcgccugcagcaugcgccgguuccacccccugcucgcccuggcggggacccacugcgccugcucccacuuccgcagcucccggaccgccacgccgcccugggccgcgccccugaagauccucaacgccgagcgcgcccgggccgugcggcccccgcagccccugccccggccccaccgcagccgguccgccccgcccaagccgcccgcgaaggccccgcgcgccgccggccgggccuggcuggcggccgccagcccccgcgacgacaucgucgccaugacccggcgcuccgacgugaacgccggggcgcucgugugggagcggggccgccgggcccgcuucgaggccgcccugagcuccgccgggcggaccgcgcccccgccccgcagcccccggcccgccagcccccgcuccucccgcggcgccggccccguccccugcgccgccccgccccagcgggcggugcuggccagcccccgcuccgugcgcgggggccccaagccgcccgggcgcggcggggcccgggccagcggcggcgcggccgggcccgcccccgccaugcccccgggcaagguccuccagcccgugcugaagaugaagguggacgagcuguuccucuacuggcuguccgaggccagcacccagcgcaugcugcaggacugccuccggcgcaucaaggcgcccgggcgggaccagcccacgccgggcgacggcgagcagcccggggccuggcccaccgcgccccuggccgccccgcgccccuccggccuggagccgcccgggacccccggccccgggcccgcccucccccugggcgccgccagcagcccgcggaacgcgccccacguccgcggcacccggcgcuccgccgggacgcggguggugcagacccgcaaggaggagccccugcccccggccaccagccaguccauccccaccuucuacuucccccggggccgcccccaggacagcgucaacguggacgccgugaucuccaagaucgagagcacguucgcccgguucccgcacgagcgcgccaccauggacgacauggggcucgucgcgaaggccugcggcugcccccuguacuggaaggggccccuguucuacggcgccggcggggagcgcaccggcuccgugagcgugcacaaguucgucgccauguggcggaagauccuccagaacugccacgacgacgccgcgaaguucgugcaccuccugauguccccggggugcaacuaccuggugcaggaggacuucguccccuuccugcaggacguggugaacacccaccccggccugagcuuccucaaggaggccuccgaguuccacagccgcuacaucacgaccgucauccagcggaucuucuacgccgugaaccgcuccuggagcgggcggaucacgugcgccgagcugcgccgguccagcuuccugcagaacgucgcccuccuggaggaggaggcggacaucaaccagcugaccgaguucuucuccuacgagcacuucuacgugaucuacugcaaguucugggagcucgacaccgaccacgaccugcugaucgacgccgacgaccucgcccgccacaacgaccacgcccugagcaccaagaugaucgaccggaucuucuccggcgccgugacccgcggccggaagguccagaaggaggggaagaucagcuacgcggacuucgugugguuccugaucagcgaggaggacaagaagacccccacguccaucgaguacugguuccgcugcauggaccucgacggcgacggggcccugagcauguucgagcuggaguacuucuacgaggagcagugccggcgccucgacuccauggccaucgaggcccugccguuccaggacugccugugccagaugcucgaccuggugaagccccggaccgagggcaagaucacccugcaggaccugaagcgcugcaagcucgcgaacgucuucuucgacaccuucuucaacaucgagaaguaccuggaccacgagcagaaggagcagaucagccugcuccgggacggcgacuccgggggccccgagcugagcgacugggagaaguacgccgccgaggaguacgacauccugguggccgaggagacggugggggagcccugggaggacggcuucgaggccgagcucuccccggucgagcagaagcugagcgcgcugcgcagcccccucgcccagcggcccuucuucgaggcccccuccccgcugggggccguggaccuguacgaguacgccugcggcgacgaggaccucgagccccuguga

SEQ ID NO: 32396 - RNA, 1899 nt, Artificial Sequence
  derived and/or modified sequence opt1 from LOC102725035__Homo_sapiens__XP_006726376
augacccccgcccugaccgcccuccugugccugggccucagccuggggccccgcacgcgggugcaggcgggccccuuccccaagcccacccugugggccgagccgggguccgucaucagcuggggcucccccgugaccaucuggugccaggggagccucgaggcccaggaguaccgccuggacaaggagggcucccccgagccccuggaccggaacaacccgcucgagcccaagaacaaggcccgcuucagcauccccuccaugaccgagcaccacgccggccgguaccgcugccacuacuacagcuccgcgggguggagcgagcccuccgacccgcuggagcuggugaugacgggcuucuacaacaagcccacccucagcgcccugcccucccccgucguggccagcgggggcaacaugacccugcggugcgggucccagaagggcuaccaccacuucgugcucaugaaggagggcgagcaccagcugccgcgcacccuggacagccagcagcuccacuccgggggcuuccaggcccuguuccccgucgggcccgugaaccccagccaccgguggcgcuucacgugcuacuacuacuacaugaacaccccgcaggucuggucccaccccagcgacccccuggagauccuccccagcggcgugucccggaagccgagccugcugacccuccagggccccgugcuggcgcccgggcagucccugacccuccagugcggcagcgacgugggguacgaccgcuucguccuguacaaggagggcgagcgggacuuccugcagcgccccgggcagcagccgcaggccggccucucccaggccaacuucacgcugggccccgugagccccucccacgggggccaguaccggugcuacggggcccacaaccugagcuccgaguggagcgccccguccgacccccucaacauccugauggcgggccagaucuacgacaccgugagccuguccgcccagcccgggcccaccgucgccagcggcgagaacgugacccuccugugccaguccugguggcaguucgacacguuccugcucaccaaggagggcgccgcccacccgccccugcgccugcggagcauguacggggcgcacaaguaccaggccgaguuccccaugucccccgugaccagcgcccacgccggcaccuaccgcugcuacggguccuacagcagcaacccgcaccuccuguccuuccccagcgagccccuggagcucauggucuccggccacagcgggggcuccagccugcccccgacgggcccgcccuccacccccgggcugggccgguaccucgaggugcugaucggggugagcgucgccuucgugcugcugcuguuccugcuccucuuccugcugcuccgccggcagcgccacuccaagcaccgcaccagcgaccagcggaagaccgacuuccagcgccccgcgggcgccgccgagacggagcccaaggaccggggccugcugcgccgguccagccccgccgccgacgugcaggaggagaaccucuacgcggccgucaaggacacccaguccgaggaccgcguggagcuggacagccagcagagcccccacgacgaggacccgcaggccgucaccuacgcccccgugaagcacuccagcccccggcgcgagauggcguccccgcccagcucccugagcggggaguuccucgacaccaaggaccgccagguggaggaggaccggcagauggacacggaggccgccgccuccgaggccagccaggacgucaccuacgcgcagcugcacucccugacccuccggcgcaaggccaccgagcccccgcccagccaggagggcgagccgcccgccgagcccuccaucuacgccacgcuggccauccacuga

SEQ ID NO: 32397 - RNA, 9861 nt, Artificial Sequence
  derived and/or modified sequence opt1 from LOC400499__Homo_sapiens__XP_006721060
augaccgccugcaccggcagcgccgggccccaccuccccgugggcacgcgguacaccuaccacuucuccaccaacaccagcacgucccuccaggacguccugguggaggggagcggccuggggcugcagggccuggcggugcuggacgugcugggccugugccagauggcccuguggcugcaggacuuccaggugaccuccauccugggggccaagguggagcugcugaaggagagcgagucccugagcgccacccugggccggaacccccuccgguucauccugcacuccgggcgggucgcccaccugugcccccaccccaccgagccgcggugggugcucaacgugaagcgggcgguccugagccugcuccagggccaccccggggcccacucccccaagacguucgacgagguggacauccugggccggugccccaccaccuaccagcaccacggcgacuggcugcacaagaccaaggaccucgcccggugcagccugcggcgggggcgcuccagccugcacucccaggcccucccgggcguggcgcccgggcugacgagccggcugaccugcguccaguccuuccgcgccggcgugcuccgggaggccagcugcaccgagcuggacuccgccggcccccugcccgccaaggcgagcgccgugcagaugcgcacccucagcucccugagccugcuccacgagaugccgcaggaccccgccgggacggaccccgacgaccgggacgacgaggacaugacccccuccagccugcuguacgagugggaggagaccccgucccaggccauggucgccaccgcggccacgcucgugcgccggcugugccuggcccagaccaccagccucgaggccauggaccuguuccugacccucgugucccagcugcagggccugagcgggggcgagcucauggagcuguggcaguacuccagcuucaagugccgcgacaacgggcagccccugcuggacgcccuccccuccugcggcacggagcacugcgucggccugaugaaggagcugaucgcgagcgccgccguggaggccgacgagguggaggccuggcucuccagccuggcguuccugccccagccgaccgacgccaugguccacaugcuccugccccugcuccagacgccccgggccucccccggggccuuccugggcaucagcgcgcuggugcacaaccucugcgccucccuggacgggccgugcggccagcugcccggggugggcagccucguccgcauccugggcgacgcccugggggagaacugcaccauccaggagcccuccgacgacgacaagcuccagcuggugcugaaggccgucggcaacgccgggcucgcggccauggcccugacgcccacccugagcgccugcgccagccuccgguccagcaccccggagauccgccugggcgcgauccaggccuuccgccgggugcccugcuccgccgaccgcagcgugcugucccggcucuaccagagccuggaggaggacgccgagauccgcaucaacgccuaccuggcgcucaugcggugccccuccgaggaggucuucgcccaggugcgccggacccaggccggggagcugagcacccaggugggcuccuucgucuggagccacauccugcagcuccuggagacccacgacccgcugaagcgcgcccuccgggacacccugcccgaggacauccugucccaggaguuccaccccgagauguggaagcacagcuccuacagcgacgugaccuuccgcuccgugagcggcucccucggggcgaaccuggagggcacgcuccuguucagccccgccagcuuccugccgcgguccgccaccgucaaccugaccauccacaccauggggcgcgccuucaaccuccuggagcugggccuccggcuggagaacgccgaggagaucgcgcaccgccuguucggccgcaagagcuucugggggcaggaggacggccgcgagcccgagcccgaggagcccccggggcccgagcccggccccgccccgcagcccgccucccccgagugccccggggaccgggaccgccggaugcgcuaccuccagcagaaggugacccgccggcgcggcgcccggcaggcccugcgcugcgagcugagcgugaagcuccugggccaggagcuguccuucgucaacugcggggcgacgggcagccacgugaaccacuggccgcucaaccuggccgagcuggccaucaagcucaugaaggggcaggaggugcagaugaaccggcgccugucccuggccgcccaggagcucgucuuccccaccgugagcggccugcccgcgcggcugacccucaacgccuccgccgccaucagcauccgcgugcgggggaccacggacuuccagcagcgcuccgacuucagcgucaacggcuacgugaagcccuccgcgcugcugcagaucagcgcccagaugggcaccgccgggauccucggccaggccgggcugcggugggugaccuccguccgcagcgccgcgucccuggacggcgggauccaggugcagaagggccgggugcucaagguccaccugaacaccccggaggaggccguggagcugcucagcuucuccagccagcuguaccugaucacgcgcgacggcgugcggagccuccgccacguccccgggcccuccgaggugcagagcugcaccggcgaggagguguccuacaccuggggguggcggcugugcaccggcgucacguggcccgugccggggcagcccuaccugcucagccugcccguguucgccgccgucacccugcagaagcgcgacccgggccuccggcaguaccugcuggaggccgcguacacccuccagccccagaagggcuccugguucccccaggaggccaccgcccacguguucauggggacgcccggcagcgaggugcugcgcgacgucgggguggacauguccuacagccugccgcagaacaaguuccggcucaagcugcugcaccccaagaagaagaucgagcucgacggcaagauggaggcccugggcuccgcccacaccgggcaccuggagcuggugcucgacgaccgcgacgucuacuacaucaagggcuggagcgaccugcagcccgcgaugggcggggaggccgagcgcuuccaggcccagcuggaggugaagcucgugaccgggggcucccccgucguguucaccggcaaccugacgcgccagguggggagcaagcuggccuucuccgccagccucucccaccuccugagcgaccaggcgaacgucaccgcccuccuggagcgcaaggaggagaacggccggcgcguggccgcccugggggcggagcuguucgugccgggccuggucgggcugcgggcccucggccugcugcagcagcgcggccagcucuggaccaacucccugcggauccaguacagccugcucgggcaggccaagcaggccgcccacgagugcuccaccagccagaagcugcgcgcggacagcggcuccgacggggccuaccggcuggagcuccgccacgagcugcacugcacgcagauccuggccuucagccacaaggugcagcucuggcacgaggaggacuccggccaccuccacagccagcuggagguguccuacgggaagcacugggacaagaacagcaacaagcggcaccuccgcgucucccagaccuucaagaacgacagcggccccgcccuguccaaccacuucauggaguucgugcugcagguccccgagcgccagguggacugccgcgugcagcucuaccaccugagccugcggcuccccuacgucgaguccagcucccaccugaaggugcaguacaacggccgcccgcuguucguggccgggggccaguggaaggacaccagccgggcgacccucuggaagugggagggggcccugaaccuggacucccccuggcucauggucagcgccgcccaccgccuguacuggccccaccgggccguguuccaggcggugcuggagcucacgcugggcaaggccuggacccugaaggaccucgucguguccgugggcugccgcagccaggggcccaaccgcgagggcaagauccaggucuacaccgccgccaccacguaccugcggguguccaccgugaccguccuggcgcagagccucuuccacagcugguccgagcuggagagcgccuggaacgccgccgugcagggggagauccacgccgagaacucccgcgaccggaagauccugaacugcuggcucaagggcccgcagcaggagcugaaccugaccgcggccuaccgccaccucgaguggccccggaagacccaggugagccugaccgccguccgcaucggggcccagggccagccccggggccugcagcucgagggggagcuggaggagcugcgccaggaccggacccucuaccgcaagcggggcgcccugcugcuccgccacccccugcaccuccccaucccccagucccugcugcugcaggagaccuucaccgcggaccggcgccaccagcgguacagccucgagacgcgcguggugcugaacgggcgggaggagacccugcagaccaugguccucggcugccaggccgggcaccccuacgugugcgccggccugaugcaccccuacgacggcaaggugaucccgcgcaacaccgaggggugccuggucacguggaaccagcacaccgccaagaaccgggagguggaggccacccucaaggugcaccgcaaggucgugcugcaccugaagggccuccaccacgaccggucccagcacggggagauccgccacagccuggcgcuggaccucgcccacuccuaccagcugagcuucccccaggcccugucccucgacggcgggaucaucuuccgccagagcccccagggcaccuucaacuucggcauggacgcccgggcggccgugaaccacaacgucacgucccaggccagcgugcagcugaacggguccgacagcgacuucgccuucuucuuccagcugcgccacccccacggcccgaccuucccgcccaacuuccaggugcaggccgcggccgggcgguaccgcguccggucccucaacggcagccuguccgugcagaugagcgggcgcgagcuggugcuccuggaggucgacgccagccaggacacccggcgcuccagccggggcuggggcguguccgugcugcuccaccaggccguccugagcgccccgcgcgcggugcggcugcagcucuccgccaagaucacccccgcccgcaucuggcuguucagcaaggcccugcuggaccagaacacggcccagcuccugcugaaggcguccgaggaguggcgcggcgggcgcauccucaccuuccagagccagacccggcacaccguggccgggugggccgccaugccccgccugcugacgcucaccgggcggcugaagcagaaggagacccugcaggagggcacccucuccgucacggccgacagcgcggugcugggguuccugcuccgcgaccagcacgagaaggccggcaacgggaccuccgugcggagcgugacgugcgugcuggcccagaacuccagccaggcccugcccggcgagcuccagcugaaggggcgccugcaggcgcagacccgcaaccuccgggcccaggccuccauccgcgcccacgccgcgagccuggcccugggcggcgccugcuccugggggccgcggcacggccagcucgccgggggccccacgcacaacaucagcacccuguccgacgccgggcugcccagcgaggcgggcaugcuccugagccugacccacguggccuccaacugcagcgcccgccucgcccuguggaacgccggcgcgcagcuggacggggccaucggccucgaggacgucacccccgaguccagcgggcugcagcugcacgccucccuccggcacacgcacaccaugccgagccugaagcacuggggccugcccuucucccucgacgggcacggccacuuccagagcgugggccgcucccuggccgcggggcugaccgugauccucgacggcgagcagcugcgggccgcccuggagcgcaaggccgagggcgggcggcaggggcucguccugggccugcaccacggccucagcgggcugcagggcacccugcccucccagcucgaggugaacugcagcggggacgccucccccacgcagcugcugggcuggugccgcggcgacaucgcggggcagccgcucgaggucagcguggacauccacaacggcuccagcggguucgagcacuccggccggauccugauggggcccaccuuccugaacuacagcgugagcugcuacuaccacgacggccaccucgagcuguccggccgcagcuggcacaacuccgaggcccugcucugggccggguuccccggcgaggccugccugagcgccgagcugcagauccacgagacccagacccaggcgcgggucgcccuccacgggggcgacuccggggugagcauggaccuggccgcccugguggcccgcccccggcgcggcccgcuccagcuggucgcguccgccagccacacggugcccgcccugcagcggcucggccugcccuucaccaaccagcugguguuccaggggcucugggaggccgaggagauguccagcucccugcagcugaccugcgacagccaggcgacccucguccuggacgugcgcggccagaaccaggccguguccaaggagcuccuguucagcgggcggcaccgccugcccuuccugcucggccugugcccguccagcgccuccgccagcgccaagcugcacuacuccaagggggagguccagagcauguucgcgcucggcguggaggagcggcacuuccacaucagcacccgccagguggccgccaaggccggccugaacaacuucaucaagcuggagcagacguuccuccagcuguccgcccugccccgcgagcuguuccugcagaccgcguacgagcgggcccacgggacccgcguccugcgccagguggugcucugggacggccaggaggucgcccugaccgggagccuguccggccccuuccccaagccgacgcgcaaccucagccuccagguggagcugacccacccccucccccugccccugccgcggcacugcucccugcgccucagcuccgagcaccugggcgggagccaccgggacggccugguggucgggugggacggccgcgaccaggugcucguguccagcucccuguggcugggcaagagcgagcucgccgcccggcuggcgcuggcccaccccuucaaccuccccuggcgccaggccgaggccuccggccuggccgagagccggggcgggcgccagucccggcagguccagcugaccuggaaccgcggccagccggcgacccuccagcugacgugggccgacgggagccuggcccacuccaccgccugggacggcugccucgcggccagccccgggcagcugcaggagaccuggggccugaacucccuccaggccugcggcgccuucacccagacgcccgccguguucguggagcagcugaacgucagcugggggcagcaccggaugcgccagaaccugaccuacgagcggcacuggcccagccagccggacaagaucaucauggaggcgacccucgagcacgugcugggcgccuccugcacccgccagagcuucuggggcgaggugcagacggacuacgcccgguggcugcgccacucccuccaccugggccugugcgaccucccccgcgcccugcuggucgugggggagcacacccucggccagggcgggcugcugcuccggagccgcugccaccugggccuggcccccgaccccgaccacgggcuccaccugucccugacccuccagaaccacagccggccgcgcuccgcggacuucagcggcgcccuggagcugcggggguccaaggcccagcgcgugggccuccugggccgggucagcaccuccacgagccagucccuggugcgccucgaggggagcguggacaaccgggaggagaagguccgccuguccguguuccgggcccccagcugccugcaggccuccguggcgcacgaggagggcgggcgcgaggagagcgucgugcuccgggccugcgcccacggccgcaccgccgaggcggaggugcuguuccgggacggccgccagcccucccagccccuggggcggcucacccugcaggccgccaaccagagccugcuccuggccgcccgcggcugccagggcgggcugcucgggcacgucgagagccggaucgcggccgugggcucccaggugcaggcccgccuggaggagaagguccagggccugggggccagcgugcggcgcuuccagcagcucgugcagccggccggcacccuggacggggucgcgggccugcuccugcagcugucccaggccgggcgcgaggccaugcaggccagcggcugggccguggcgacgcucugggcccggucccaggcccugacccagcaccucccccucuaccuggaguggcuccaggugggccucgagcagcugcgcgaggagcuggaguggccccucgccacccugaaggacgccuaccuggaggucacccuccggccccuggaggagguguggcgcgagcgggcggaggaggccaugcgccggcugcaggccugggucccggggaugcccggcaagggcgggccccgccccauccgggccgcgcucggggccaugaagggcgcccuggagcuggccgcccagcagaugcucagcugggcggaggccacguucucccgcgcccugaagcggcugugcaagccgcuccuggaccuguacagccucuccgcccgcaaccggagcgugguggucaugcugccccugcuccccgccggcgacgagccccuggacguggcgcgcgugaccuccuaccugauggaggagaagcugcuccggccgcugcgcgagcugagcggggccaacguccucgccgaguacuacuggcugcggcgccggcugcucgccggccccugggaguaccacgcccugguggcgggggcccagcacguggucaccuucgacggccgcgugugggaccuguccacccagugcggcagcauccuccuggcccaggacuucgcccacaacacguucucccugacccucagccgcaccggguccggccugaccgcgcuguucguggagcucaaccacaagacgcugauccuguaccccagccuccaggccuaccggcuguacaacuccagccugccgggggacagcugccccgaccucaagcugcaccccgccaccacccgcaaggacgucucccggaucgagcuggccagcgaggacggcguguccgugagcugcgacguccccaccgggcucugcucccugacgcugggccucuggcagcacggcaucagcgccgggcugcugggcaccaacgacaacgaggcggggaacgagcucaugcugccggacggcuccauggcccgcagccuggaggagcucucccuggccuggcaggucggcggggacugccgggccaccgagaagccccagcaggagcaggccugccccgggcagcugcccgcgugcugggccuucuucgaggggccgcacagcucccuccgcgacugcuuccggguggucgaccccacccccuuccugagccugugcguccaggugcccugcggcacccaggagcuccagccggccugcaaccuggccgccgcguacauccaccugugcgcccgcggguucgucccccucgccccgccgccccagugcgcccccuga

SEQ ID NO: 32398 - RNA, 1251 nt, Artificial Sequence
  derived and/or modified sequence opt1 from LOC400927-CSNK1E__Homo_sapiens__NP_001276841
auggagcugcgcgugggcaacaaguaccggcucgggcgcaagaucggcagcggguccuucggcgacaucuaccugggggccaacaucgccagcggcgaggaggucgcgaucaagcuggagugcgugaagaccaagcacccccagcuccacaucgaguccaaguucuacaagaugaugcagggcggggugggcaucccgagcaucaaguggugcggggccgagggcgacuacaacgucauggugauggagcugcuggggcccucccucgaggaccuguucaacuucugcagccggaaguucucccugaagaccgugcuccugcuggccgaccagaugaucagccgcaucgaguacauccacuccaagaacuucauccaccgggacgucaagcccgacaacuuccucaugggccugggcaagaaggggaaccugguguacaucaucgacuucggccucgccaagaaguaccgcgacgcccggacgcaccagcacauccccuaccgcgagaacaagaaccugaccgggaccgcgcgguacgccagcaucaacacccaccugggcaucgagcagucccgccgggacgaccucgagagccugggcuacgugcugauguacuucaaccucgggucccugccguggcagggccugaaggccgccacgaagcgccagaaguacgagcggaucagcgagaagaagauguccacccccaucgagguccucugcaagggguaccccagcgaguucuccaccuaccugaacuucugccgcagccugcgguucgacgacaagcccgacuacuccuaccuccgccagcuguuccggaaccuguuccaccgccagggcuucagcuacgacuacguguucgacuggaacaugcucaaguucggggcggcccggaacccggaggacguggaccgcgagcggcgcgagcacgagcgcgaggagcggaugggccagcugcgcggcagcgccacccgggcccugccgcccgggccgcccacgggcgccaccgcgaaccgccuccgguccgccgccgagcccgucgccagcacccccgccucccgcauccagcccgcggggaacaccagcccccgggccaucucccgcguggaccgggagcgcaaggugagcaugcggcugcaccgcggcgcccccgccaacgucuccagcuccgaccugacggggcggcaggaggugagccgcauccccgccucccagaccagcgugcccuucgaccaccucggcaaguga

SEQ ID NO: 32399 - RNA, 2583 nt, Artificial Sequence
  derived and/or modified sequence opt1 from LOC645177__Homo_sapiens__XP_011519208
auggccagcccccgcaaggugaccgagaagcggcacaacccggucgaguccaucugccgcaagauccgggccauccacaagcgcgaggcgaucagcaaccccauccagcagaucaucaaguaccaguccagcuccuucgacagcccccagaccaacacgaagaaguacuucgaggaggugcugcggaagaugaccgccgccugcgugcccaccccgggcucccacuggagcuccagcgaggaggucgacgccuucaucuccagcccccagaucaucagcccccgcacccccagcacgucccaccucagcuccccggagaccgccaccuacagcgugauccugaccuccagcgagaacgugagcaagcccaagucccagagcaacaagaacuacacgucccugaugagccagauccggaaggcggaguucuucuccaacaaggaccucaacaacuacugcagcgagaacaacuucuccacccugacccuggacuucgacagcaccuucguccagucccucaagugcuucgacccccaggacagcguggugaagaagcugucccugaacgaggacggguggaagcaggaggccgacgacggcaaggaggacgucaucuacagcaucaaccgcgccugcaaggaggaggcccucacguccaucuucaacgcgugcgacaucaagcggaaggggagcgugggcguggccaagaucaucaacuuccugcgccagaccaccucccagaacagcgaggacuccgggcuggagcagcucuggaacaugcuggaccccgagaagcgggacccgcacgucgaccuggagaccuuccaggccaugaugaaggacuggauggccuacugcggcaacacgugggagggcgugaaccaccgccucagcuccaucaucgacgacagcgugugcgagcaggacgggaucaagagcgacggcaccaugaagauguccaccgacaucaccgacagcacgcugggguccuucgaggcccugggcggggagaccagcaagggcguccucgagguguccgaccugaucgcguacguggccgaccugcacuucaacaagcggaagcucgaggaggagaacaacaaguucaagcuggcccuggagacccucgaggagaccaacagccagcuguccgaggacugcacggagcugcgccuccaggucaagagcgcccaccaggccaucaugcggaccaaccugcugaaggaggagcucgaggagcugaagcuguccaugaacgcgagcgaggagcagaaguccaugaucguggcccagagcaagcagcucgagaccgagaaccgcgcccugauccugaagauccggauccuccaggaggagaacuucaagaacaucauggacaucgaccgccuggagaagaagaucgaggaccuguccaagaccgagacggagcaccaggugagcaccucccagauccucaugcagcugcacaccuacgagaacacccugcucaacaaggacacgagccugcagaagaagggccuguacaucgaggagcucaaguccaccaucaucgaguacgggagcaucaucgagaaccugcggggcgagaaguccaagcuggcccacgagcuccagcaccuccagcaggcccugaucaccaacgggauccagcugaacgucaacggcgagugcaacuccaucaucagcgagggcgagaagucccugcacuacgagcugacccuggcgcagagcgccgagaacacggagaccgagcgccagcacaacgugaucaaccucuccagccuggacgccaugauggaccaggagaugcugcuccugcugcgggagcccgcccagaaggccguggaguucaccgcgacccuccagaagcugcacgaggagaucuccaagaucgccacccugaucgagaacagccgccgcugggucacgaaccccgagaucaccgugaaggagaagugggaggagcagcucaccgaguucaacaacaucauggaggagaagcuggaccugugcauccucaugcugaacauccuggggaaccacaaggagucccucgacaaggaguucgccaagcugaucgagauccugaagcgguuccgccaggaguacuucuacuuccggaaggaguuccucgcccgcaaccccaccagcggccagaagcagcuggaggcgaucaagcagcugcaggaggacgccgucaaccaggaggggauccuccggaagcgccugcaggagacgucccagcggcuggaggacguggaggagcagggcaaggaccgcgaccgggaggcccacaccgccagcgagaaggccaccucccuccugcacaagcuggaggaggcgaucagcgagcagcgcaaccuccagaccaucaacacggagcuguccaacacgugccaggcccugcagcagaagacccggaagcucaagaacgcccugagccuggacuccuucaccgccgugccgacccucgagagcacccccuucuccggggucgccaaccagauccacacccugugcgagcgccccaccuacggcgaggugaaggacggcgcgcuggacgugaagcggcagcacaaguga

SEQ ID NO: 32400 - RNA, 2688 nt, Artificial Sequence
  derived and/or modified sequence opt1 from LONP1__Homo_sapiens__NP_001263408
auggccgccagcaccggcuacgugcgccuguggggcgcggcccggugcuggguccuccgccggcccaugcuggccgccgccggcgggcgcgugccgaccgcggccggcgccuggcugcuccgggggcccgugaucacggcccugacccccaugaccauccccgacgucuucccgcaccucccccugaucgcgaucacccgcaaccccguguucccccgguucaucaagaucaucgaggugaagaacaagaagcuggucgagcugcuccgccggaaggugcgccuggcccagccguacgugggcgucuuccugaagcgggacgacuccaacgagagcgacgugguggagucccucgacgagaucuaccacacgggcaccuucgcccagauccacgagaugcaggaccugggggacaagcugcgcaugaucgucaugggccaccggcgcgugcacaucagccggcagcucgagguggagcccgaggagcccgaggccgagaacaagcacaagccccgccggaaguccaagcgcgggaagaaggaggccgaggacgagcugagcgcgcggcacccggccgagcuggccauggagcccacccccgagcuccccgccgagguccugaugguggagguggagaacgucgugcacgaggacuuccaggugaccgaggaggucaaggcccugacggcggagaucgugaagaccauccgcgacaucaucgcccucaacccgcuguaccgggaguccgugcugcagaugaugcaggccggccagcgcgucguggacaaccccaucuaccucagcgacaugggggccgcccugaccggcgcggagucccacgagcugcaggacguccucgaggagaccaacauccccaagcgccuguacaaggcccugagccuccugaagaaggaguucgagcuguccaagcuccagcagcggcugggccgcgagguggaggagaagaucaagcagacgcaccggaaguaccugcuccaggagcagcugaagaucaucaagaaggagcuggggcucgagaaggacgacaaggacgccaucgaggagaaguuccgcgagcggcugaaggagcuggugguccccaagcacgugauggacguggucgacgaggagcucagcaagcugggccugcucgacaaccacuccagcgaguucaacgugacccgcaacuaccuggacuggcugaccuccaucccgugggggaaguacagcaacgagaaccucgaccuggcccgggcccaggcggugcuggaggaggaccacuacggcauggaggacgucaagaagcgcauccuggaguucaucgccgugucccagcuccggggcagcacccaggggaagauccugugcuucuacgggccgcccggggugggcaagacguccaucgcccgcagcaucgcccgggcgcugaaccgcgaguacuuccgguucagcgucgggggcaugaccgacguggccgagaucaagggccaccgccggaccuacgugggggccaugcccggcaagaucauccagugccucaagaagaccaagacggagaacccccugauccugaucgacgaggucgacaagaucgggcgcggcuaccagggggaccccuccagcgcccuccuggagcugcucgaccccgagcagaacgccaacuuccuggaccacuaccuggacgugcccguggaccucuccaagguccuguucaucugcaccgcgaacgugaccgacaccaucccggagccccugcgggaccgcauggagaugaucaacgugagcggcuacgucgcccaggagaagcucgccaucgccgagcgguaccuggugccccaggcccgcgcgcugugcggccucgacgaguccaaggccaagcugagcuccgacgugcugacgcuccugaucaagcaguacugccgcgagagcgggguccggaaccugcagaagcaggucgagaaggugcuccgcaaguccgccuacaagaucgucagcggcgaggccgaguccguggaggugaccccggagaaccugcaggacuucgucgggaagcccguguucaccguggagcggauguacgacgucaccccgcccggcguggugauggggcuggccuggacggcgaugggcggcagcacccucuucgucgagaccucccugcgccggccccaggacaaggacgccaagggggacaaggacggcagccuggaggugaccgggcagcucggcgaggugaugaaggaguccgcccgcaucgccuacacguucgcgcgggccuuccugaugcagcacgcccccgccaacgacuaccuggucaccagccacauccaccuccacgugcccgagggcgccacccccaaggacgggccguccgcgggcugcaccaucgugacggcccugcugagccucgccauggggcgccccguccggcagaaccuggccaugaccggcgaggugucccugaccgggaagauccuccccgugggcggcaucaaggagaagaccaucgccgcgaagcgcgccggggugaccugcaucgugcugcccgccgagaacaagaaggacuucuacgaccuggccgccuucaucacggagggccucgaggugcacuucgucgagcacuaccgggagaucuucgacaucgcguucccggacgagcaggccgaggcccuggccguggagcgcuga

SEQ ID NO: 32401 - RNA, 2322 nt, Artificial Sequence
  derived and/or modified sequence opt1 from LONRF1__Homo_sapiens__NP_689484
augagcucccccgccguggcccgcaccagcccgggcgggucccgggagauggcgcccgcgccccagggccgcgggcgguucugggaggucggcgggggcagcggccaccgccuggagcgggccgccgccgaguccgagcgcugggagcuccugcugcggcgcggggagcuccuggcccugggcgggcaccucaagggcgcccuggaggccuucgccgcggcccugcggcgcggggcccccgcccggccggagugccucggcgcccugguggacugccugguguucaacuaccgccuccggcacggccugggguggagcgcggcccccgucgccggcgccgacgggggcgccggcgggcugcuccgcugccugggcugccggggguuccuguccgagcccgugaccgugcccugcggccacagcuacugccgccggugccuccgccgggagcugcgcgcgcggugccgccugugccgcgaccggcucccgcccgccacggccuccgccaccgacgccgaggggaccgcgccccggcccccgccccuggccgccgccaucgccgcgagcgacuuccgcaccuccgucgugcugaaccaccucgccgagaagugguuccccggccagcgcgagcgggcccgcgccgcgggccggcugggggagcugcuccaccagggccgcuaccgggaggcccuggccgccgccugcgaggcgcugcgcgccgagcccagcgaccucaucgugaagaucuaccgggccgaguccuacgccgggcugcaggaguucaaggccgcgaucgaggaccugaacgccguccucuuccagcugccggacuggcccgagguguacuuccgcaagggcaaggugcugugcgacgccggguuccucggcgacgcccugcagcuguuccuccagugccuggcccuggacgaggacuucgcgcccgccaagcuccagguccagaagauccugugcgaccugcuccugcccgagaaccugaaggagggccucaaggagagcuccuggagcucccugccgugcacgaagaaccggcccuucgacuuccacagcgugauggaggagucccagagccugaacgagcccagccccaagcaguccgaggagaucccggaggugaccagcgagcccgucaaggggucccugaaccgcgcccagagcgcccaguccaucaacagcaccgagaugcccgcgcgggaggacugccucaagcgcguguccagcgagcccgugcuguccguccaggagaagggcgugcugcucaagcggaagcugagccugcucgagcaggacgugaucgucaacgaggacgggcgcaacaagcugaagaagcagggcgagaccccgaacgaggugugcauguucucccuggccuacggggacauccccgaggagcucaucgacgugagcgacuucgagugcucccugugcaugcggcuguucuucgagcccgucacgaccccgugcggccacagcuucugcaagaacugccucgagcgcugccuggaccacgcccccuacugcccccugugcaaggagucccucaaggaguaccuggccgaccgccgguacugcgugacccagcugcucgaggagcugaucgucaaguaccugcccgacgagcucagcgagcgcaagaagaucuacgacgaggagaccgccgagcugucccaccugacgaagaacgugccgaucuucgugugcaccauggcguaccccaccguccccugcccccuccacguguucgagccgcgguaccgccugaugauccggcgcagcauccagaccggcacgaagcaguucgggaugugcguguccgacacccagaacagcuucgccgacuacggcugcaugcugcagauccggaacguccacuuccuccccgacgggcgcagcgugguggacaccgucggcggcaagcgguuccgcgugcugaagcgggggaugaaggacggcuacugcaccgccgacaucgaguaccuggaggacgugaaggucgagaacgaggacgagaucaagaaccuccgcgagcugcacgaccugguguacucccaggccugcagcugguuccagaaccuccgggaccgcuuccggucccagauccugcagcacuucgggagcaugcccgagcgcgaggagaaccugcaggccgcgcccaacggcccggccuggugcugguggcuccuggccgugcugcccgucgacccccgguaccagcucuccgugcugagcaugaagucccugaaggagcgccucacgaagauccagcacauccugaccuacuucagccgggaccaguccaaguga

SEQ ID NO: 32402 - RNA, 939 nt, Artificial Sequence
  derived and/or modified sequence opt1 from LOR__Homo_sapiens__NP_000418
augagcuaccagaagaagcagcccaccccgcagccgcccguggacugcgucaagaccuccggcgggggcgggggcgggggcggcagcgggggcgggggcugcggguucuucggcggcgggggcuccgggggcggcagcuccgggagcggcugcggguacuccggcgggggcggcuacagcgggggcgggugcggcgggggcuccagcggcgggggcgggggcgggggcaucggcgggugcggcgggggcuccggcgggagcgugaaguacuccggcgggggcgggagcuccggcggcgggagcggcugcuucuccagcgggggcgggggcuccggcugcuucagcagcgggggcgggggcuccagcgggggcggcuccgggugcuucagcuccggcgggggcgggagcuccggcggcgggagcggcugcuucuccagcgggggcggcggguucuccggccaggccgugcagugccagagcuacgggggcgucuccagcgggggcuccagcggcgggggcuccgggugcuucagcuccggcgggggcggcgggagcgugugcggcuacagcgggggcggguccggcugcggcgggggcagcuccgggggcagcggcuccggguacgugagcucccagcaggucacgcagaccagcugcgcgccccagcccuccuacggcgggggcagcuccgggggcggcgggagcggcggguccggcugcuucagcuccgggggcggcgggggcagcuccgggugcggcgggggcagcagcggcaucggguccggcugcaucaucagcgggggcggguccgugugcggcggcgggagcuccggcgggggcggcgggggcagcuccgucgggggcagcggguccggcaagggcgugcccaucugccaccagacccagcagaagcaggcccccaccuggcccagcaaguga

SEQ ID NO: 32403 - RNA, 3345 nt, Artificial Sequence
  derived and/or modified sequence opt1 from LOXHD1__Homo_sapiens__NP_001138944
augaacaacgagaucaccuacuacuuccccugccagcgcuggcuggccguggaggaggacgacggccagcucagccgggagcugcugccggucgacgaguccuacgugcucccccagagcgaggaggggcgcggcgggggcgacaacaacccccuggacaaccuggcccucgagcagaaggacaaguccaccacguucagcgugaccaucaagaccggggucaagaagaacgcgggcaccgacgccaacguguucaucacgcuguucggcacccaggacgacaccgggaugacccugcucaaguccagcaagacgaacuccgacaaguucgagcgggacagcaucgagaucuucaccguggagacccuggaccugggcgaccucuggaagguccgccuggggcacgacaacaccggcaaggcccccgggugguucguggacuggguggaggucgacgccccgucccugggcaagugcaugacguuccccugcggccgguggcucgccaagaacgaggacgacgggagcaucauccgcgaccuguuccacgcggagcugcagacccggcucuacacccccuucgugcccuacgagaucacccuguacacguccgacguguucgccgccggcaccgacgccaacaucuucaucaucaucuacgggugcgacgcggucugcacccagcagaaguaccugugcaccaacaagcgcgagcagaagcaguucuucgagcgcaagagcgccucccgguucaucguggagcucgaggacgugggcgagaucaucgagaagauccggaucggccacaacaacacggggaugaacccgggcuggcacugcagccacgucgacauccgccggcugcugcccgacaaggacggggccgagacccucaccuuccccugcgaccgcuggcuggccaccuccgaggacgacaagaagacgauccgggagcuggugcccuacgacaucuucaccgagaaguacaugaaggacggcagccuccgccagguguacaaggaggucgaggagccgcuggacaucgugcuguacuccgugcagaucuucaccgggaacauccccggcgccggcaccgacgcgaaggucuacaucacgaucuacggggaccucggcgacaccggggagcgguaccugggcaagagcgagaaccgcaccaacaaguucgagcgggggaccgccgacacguucaucaucgaggccgccgaccugggcgugaucuacaagaucaagcuccgccacgacaacuccaaguggugcgccgacugguacguggagaaggucgagaucuggaacgacaccaacgaggacgaguuccuguuccugugcggccgguggcucagccugaagaaggaggacgggcgccuggagcgccucuucuacgagaaggaguacaccggcgaccggagcuccaacugcagcucccccgcggacuucugggagaucgcccugagcuccaagauggccgacguggacaucagcaccgucacggggcccauggccgacuacgugcaggagggcccgaucauccccuacuacguguccgucaccaccgggaagcacaaggacgccgcgaccgacagccgcgccuucaucuuccugaucggcgaggacgacgagcgguccaagcgcaucuggcucgacuacccccggggcaagcgcggguucagccggggcuccguggaggaguucuacguggccgggcuggacgucggcaucaucaagaagaucgagcugggccacgacggggccagccccgaguccugcuggcucguggaggagcugugccuggccgugccgacccagggcacgaaguacaugcucaacugcaacugcuggcuggcgaaggaccgcggggacggcaucaccagccgggucuucgaccugcuggacgccaugguggugaacaucggggucaaggugcucuacgagaugaccguguggaccggcgacgucgugggcgggggcacggacuccaacaucuucaugacccuguacgggaucaacggcagcaccgaggagaugcagcuggacaagaagaaggcccgcuucgagcgggagcagaacgacaccuucaucauggagauccucgacaucgcccccuucacgaagaugcgcauccggaucgacgggcugggcucccgccccgagugguuccuggagcggauccuccugaagaacaugaacaccggcgaccugaccauguucuacuacggggacuggcucagccagcgcaagggcaagaagacccuggugugcgagaugugcgcggucaucgacgaggaggagaugauggaguggacguccuacaccguggccgugaagaccagcgacauccugggggccggcaccgacgccaacgucuucaucaucaucuucggggagaacggcgacagcggcacgcucgcccugaagcaguccgcgaacuggaacaaguucgagcggaacaacaccgacaccuucaacuuccccgacaugcugagccucgggcaccugugcaagcugcgcguguggcacgacaacaagggcaucuucccgggguggcaccucuccuacguggacgucaaggacaacagccgggacgagaccuuccacuuccagugcgacugcuggcuguccaagagcgagggcgacgggcagacggugcgcgacuucgccugcgccaacaacaagaucugcgacgagcuggaggagaccaccuacgagaucgugaucgagaccggcaacggcggggagacgcgcgagaacgucuggcucauccuggagggccggaagaaccgcuccaaggaguuccugauggagaacagcucccggcagcgcgccuuccggaaggggaccaccgacaccuucgaguucgacagcaucuaccucggcgacaucgccucccugugcgugggccaccuggcgcgcgaggaccgguucauccccaagcgcgagcucgccuggcacgugaagacgaucaccaucaccgagauggaguacgggaacgucuacuucuucaacugcgacugccugaucccccugaagcggaagcgcaaguacuucaagguguucgaggugaccaagacgaccgagagcuucgccuccaagguccagagccucgugcccgugaaguacgaggucaucgugaccaccggcuacgagccgggggccggcacggacgccaacguguucgucaccaucuucggggcgaacggcgacaccggcaagcgggagcugaagcagaagaugcgcaaccuguucgagcggggguccaccgaccgcuucuuccucgagacccuggagcugguggugacgcggcucggccuggccgccgagugcggguga

SEQ ID NO: 32404 - RNA, 1254 nt, Artificial Sequence
  derived and/or modified sequence opt1 from LOX__Homo_sapiens__NP_002308
augcgcuucgccuggaccgugcugcuccugggcccccugcagcucugcgcccugguccacugcgcgccgcccgccgccgggcagcagcagccgccccgggagccgcccgccgcccccggcgcguggcgccagcagauccagugggagaacaacggccagguguucagccugcucucccuggggagccaguaccagccccagcggcgccgggaccccggggccgccgugcccggcgccgcgaacgccuccgcccagcagccccgcacccccauccugcucauccgggacaaccgcacggccgccgcgcggacccgcaccgccggcagcuccggggucaccgccggccggccgcgccccacggcccggcacugguuccaggccggguacagcaccucccgcgcgcgggaggccggcgccagccgcgccgagaaccagaccgcccccggggaggugcccgcgcuguccaaccugcggccgcccagccgcguggacggcauggucggcgacgaccccuacaaccccuacaaguacuccgacgacaacccguacuacaacuacuacgacaccuacgagcggccccgccccgggggccgguaccgccccggguacggcacgggcuacuuccaguacgggcucccggaccugguggccgaccccuacuacauccaggccagcaccuacgugcagaagauguccauguacaaccugcgcugcgccgccgaggagaacugccucgcgagcaccgccuaccgggccgacguccgcgacuacgaccaccgggugcugcugcgcuucccccagcgggugaagaaccagggcaccuccgacuuccuccccagccgcccgcgguacuccugggaguggcacagcugccaccagcacuaccacuccauggacgaguucagccacuacgaccugcuggacgccaacacgcagcgccgggucgcggaggggcacaaggccagcuucugccucgaggacaccuccugcgacuacggcuaccaccgccgguucgccugcaccgcccacacccaggggcugagccccggcugcuacgacacguacggcgccgacaucgacugccaguggaucgacaucaccgacgugaagcccgggaacuacauccugaagguguccgucaacccgagcuaccucgugcccgaguccgacuacaccaacaacgugguccgcugcgacauccgguacaccggccaccacgcguacgccagcgggugcacgaucucccccuacuga

SEQ ID NO: 32405 - RNA, 1725 nt, Artificial Sequence
  derived and/or modified sequence opt1 from LOXL1__Homo_sapiens__NP_005567
auggcccuggcccgcggcagccggcagcucggggcgcugguguggggcgccugccugugcguccucgugcacgggcagcaggcccagcccggccagggguccgaccccgcccgcuggcggcagcugauccagugggagaacaacggccagguguacagccugcucaacuccggcagcgaguacguccccgccgggccccagcgcuccgagagcuccagccgggugcugcuggcgggcgcgccccaggcccagcagcgccggucccacgggagcccgcgccggcgccaggcccccucccucccccugcccggccggguggggagcgacaccguccgcggccaggcccggcacccguucggcuucggccaggugcccgacaacuggcgcgagguggccgucggggacuccaccgggauggcccgggcccgcacgagcgugucccagcagcggcacggcggcagcgccuccagcguguccgcgagcgccuucgccagcaccuaccgccagcagcccuccuacccccagcaguucccguacccccaggcccccuucgucagccaguacgagaacuacgaccccgccucccggaccuacgaccagggguucguguacuaccgcccggcgggcgggggcgugggggccggcgccgccgccgucgcgagcgccggcgugaucuaccccuaccagccccgggcccgcuacgaggaguacgggggcggggaggagcugcccgaguacccgccccagggcuucuaccccgcccccgagcgcccguacgugcccccgccgcccccgccgcccgacgggcucgaccggcgcuacucccacagccuguacuccgagggcacccccggcuucgagcaggccuaccccgaccccgggcccgaggcggcccaggcccacggcggggacccccggcugggcugguacccgcccuacgccaacccgccgcccgaggcguacgggccgccccgcgcccucgagccgcccuaccugcccguccggagcuccgacacgcccccgcccggcggcgagcgcaacggggcccagcagggccggcugagcgugggguccguguaccgccccaaccagaacggccggggccuccccgaccugguccccgaccccaacuacgugcaggccagcaccuacgugcagcgcgcccaccuguacucccuccggugcgcggccgaggagaagugccuggccagcaccgccuacgcccccgaggcgaccgacuacgacguccgcgugcugcuccgguucccccagcgcgucaagaaccaggggacggccgacuuccugcccaaccggccccgccacaccugggaguggcacuccugccaccagcacuaccacagcauggacgaguucucccacuacgaccugcucgacgccgccaccggcaagaagguggccgaggggcacaaggcgagcuucugccuggaggacuccacgugcgacuucggcaaccugaagcgguacgccugcaccagccacacccaggggcucagccccggcugcuacgacaccuacaacgccgacaucgacugccaguggaucgacaucaccgacgugcagcccggcaacuacauccugaagguccacgugaaccccaaguacaucgugcuggaguccgacuucacgaacaacgucgugcgcugcaacauccacuacaccgggcgguacgugagcgccaccaacugcaagaucguccaguccuga

SEQ ID NO: 32406 - RNA, 2325 nt, Artificial Sequence
  derived and/or modified sequence opt1 from LOXL2__Homo_sapiens__NP_002309
auggagcgcccccugugcagccaccucugcuccugccuggccaugcuggcccuccugagcccgcugucccucgcgcaguacgacagcuggccccacuaccccgaguacuuccagcagcccgccccggaguaccaccagccccaggcccccgccaacguggccaagauccagcugcggcuggcgggccagaagcgcaagcacuccgaggggcgggucgagguguacuacgacggccagugggggaccgugugcgacgacgacuucagcauccacgccgcccacgucgugugccgcgagcucggcuacguggaggccaaguccuggaccgcgagcuccagcuacgggaagggcgagggccccaucuggcuggacaaccugcacugcacggggaacgaggccacccucgccgccugcaccuccaacggcuggggcgucaccgacugcaagcacacggaggacguggggguggucugcagcgacaagcggaucccgggguucaaguucgacaacucccugaucaaccagaucgagaaccugaacauccagguggaggacauccgcauccgggccauccucagcaccuaccgcaagcggacccccgugauggagggcuacgucgaggugaaggagggcaagaccuggaagcagaucugcgacaagcacuggacggcgaagaacucccgcguggucugcgggauguucggcuuccccggggagcggaccuacaacaccaagguguacaagauguucgccagccgccggaagcagcgcuacuggcccuucuccauggacugcaccggcacggaggcccacaucagcuccugcaagcugggcccgcaggucagccuggaccccaugaagaacgugaccugcgagaacgggcuccccgccguggugagcugcguccccggccagguguucuccccggacgggcccagccgguuccgcaaggccuacaagcccgagcagccccuggugcggcugcgcggcggggcguacaucggcgagggccgggucgaggugcucaagaacggggaguggggcaccgucugcgacgacaagugggaccugguguccgccagcguggucugccgcgagcugggguucggcuccgccaaggaggccgugaccgggagccggcucggccagggcaucgggccgauccaccugaacgagauccagugcacgggcaacgagaaguccaucaucgacugcaaguucaacgccgagagccaggggugcaaccacgaggaggacgcgggcgugcgcugcaacacccccgccauggggcugcagaagaagcuccgccugaacggcggccggaaccccuacgaggggcgcgucgaggugcugguggagcggaacggcucccucgucugggggauggugugcggccagaacuggggcaucguggaggccauggucgugugccgccagcuggggcugggcuucgccagcaacgccuuccaggagaccugguacuggcacggggacgugaacuccaacaaggucgugaugagcggcgugaagugcuccgggaccgagcucagccuggcgcacugccggcacgacggcgaggacgucgccugcccccagggcggggugcaguacggcgccgggguggccugcuccgagacggcgccggaccugguccucaacgccgagauggugcagcagaccaccuaccuggaggaccgccccauguucaugcugcagugcgccauggaggagaacugccucagcgccuccgccgcgcagaccgaccccacgaccggcuaccggcgccugcugcgguucagcucccagauccacaacaacgggcagagcgacuuccgccccaagaacggccggcacgccuggaucuggcacgacugccaccgccacuaccacagcauggagguguucacccacuacgaccuccugaaccugaacggcaccaaggucgccgaggggcacaaggccuccuucugccucgaggacacggagugcgagggcgacauccagaagaacuacgagugcgccaacuucggggaccagggcaucaccauggggugcugggacauguaccggcacgacaucgacugccaguggguggacaucaccgacgugccgcccggcgacuaccuguuccaggucgugaucaaccccaacuucgagguggcggagagcgacuacuccaacaacaucaugaagugccgcagccgguacgacggccaccgcaucuggauguacaacugccacaucgggggcuccuucagcgaggagaccgagaagaaguucgagcacuucuccgggcugcucaacaaccagcugagcccgcaguga

SEQ ID NO: 32407 - RNA, 1827 nt, Artificial Sequence
  derived and/or modified sequence opt1 from LOXL3__Homo_sapiens__NP_001276093
augcgccccgugagcgucuggcagugguccccguggggccugcuccugugccugcucugcagcuccugccuggggagccccucccccagcaccggccccgagaagaaggccgggucccagggccugcgguuccgccucgccggguucccgcggaagcccuacgagggccgcguggagauccagcgggcgggcgagugggggaccaucugcgacgacgacuucacgcugcaggccgcccacauccugugccgcgagcucggcuucaccgaggccaccggguggacccacagcgccaaguacggccccgggacgggccggaucuggcuggacaaccuguccugcagcggcaccgagcaguccgugaccgagugcgcgagccgcggguggggcaacuccgacugcacccacgacgaggacgccggggucaucugcaaggaccagcggcuccccggcuucagcgacuccaacgugaucgaggcccgcgugcggcugaagggcggggcccacccgggcgaggggcgcgucgaggugcugaaggcgagcacguggggcaccgugugcgaccggaagugggaccuccacgccgccuccgucgugugccgcgagcugggguucggcagcgcccgggaggcccuguccggcgcgcgcauggggcagggcaugggggccauccaccucagcgaggugcggugcagcggccaggagcugucccuguggaagugcccccacaagaacaucaccgccgaggacugcagccacucccaggacgccgggguccgcugcaaccuccccuacaccggcgccgagacgcggauccgccugagcggcgggcggucccagcacgagggccgcguggaggugcagaucgggggccccgggccgcugcgcuggggccucaucugcggcgacgacugggggacccuggaggcgauggucgccugccggcagcugggccucggguacgccaaccacggccugcaggagaccugguacugggacagcggcaacaucaccgagguggugauguccgggguccgcugcacgggcaccgagcugagccucgaccagugcgcccaccacgggacccacaucacgugcaagcggaccggcacccgcuucaccgccggggugaucugcuccgagaccgcgagcgaccugcugcuccacuccgcccuggugcaggagacggccuacaucgaggaccggccccugcacaugcucuacugcgccgccgaggagaacugccuggcgagcuccgcccgcagcgccaacuggcccuacggccaccggcgccugcuccgguucuccagccagauccacaaccugggccgcgccgacuuccggcccaaggcggggcgccacuccugggucuggcacgagugccacggccacuaccacagcauggacaucuucacccacuacgacauccugaccccgaacgggaccaagguggccgagggccacaaggccuccuucugccucgaggacacggagugccaggaggacgugagcaagcgguacgagugcgccaacuucggggagcagggcaucaccgucggcugcugggaccuguaccgccacgacaucgacugccaguggaucgacaucaccgacgugaagcccgggaacuacauccugcaggucgugaucaaccccaacuucgagguggccgagagcgacuucaccaacaacgcgaugaagugcaacugcaaguacgacggccaccggaucuggguccacaacugccacaucggggacgccuucuccgaggaggccaaccgccgguucgagcgcuaccccggccagacgagcaaccagaucaucuga

SEQ ID NO: 32408 - RNA, 2271 nt, Artificial Sequence
  derived and/or modified sequence opt1 from LOXL4__Homo_sapiens__NP_115587
auggccuggagcccgcccgccacccuguuccucuuccugcugcuccugggccagcccccgcccucccgcccccagagccuggggaccacgaagcuccggcuggugggccccgaguccaagcccgaggaggggcgccuggagguccuccaccagggccagugggggaccgugugcgacgacaacuucgcgauccaggaggccaccguggccugccggcagcugggcuucgaggccgcccugaccugggcgcacagcgccaaguacggccagggggagggccccaucuggcucgacaacguccgcugcguggggacggaguccagccuggaccagugcggcuccaacggguggggcgugagcgacugcucccacagcgaggacgucggcgugaucugccacccgcggcgccaccggggguaccuguccgagaccgugagcaacgcccucggcccccaggggcgccggcuggaggagguccgccugaagcccauccucgccuccgcgaagcagcacagccccgugaccgagggcgccguggaggucaaguacgagggccacuggcgccaggugugcgaccagggguggaccaugaacaacucccggguggucugcggcaugcugggguucccgagcgaggugcccguggacucccacuacuaccggaaggucugggaccugaagaugcgcgaccccaagagccggcucaagucccugacgaacaagaacagcuucuggauccaccaggugaccugccugggcaccgagccccacauggccaacugccaggugcaggucgccccggcccgcgggaagcuccggcccgcgugccccggcggcaugcacgccguggugagcugcgucgccgggccccacuuccgcccgcccaagaccaagccccagcggaagggcuccugggccgaggagccccgcgugcggcugcgcagcggggcccaggucggcgaggggcgcguggaggugcugaugaaccggcaguggggcacggucugcgaccaccgcuggaaccucaucuccgcgagcguggugugccggcagcugggcuucggguccgcccgcgaggcccuguucggcgcccggcucgggcagggccuggggccgauccaccugagcgagguccgcugccggggcuacgagcgcacccucuccgacugccccgcccuggagggcagccagaacgggugccagcacgagaacgacgcggccgugcggugcaacgugcccaacaugggcuuccagaaccagguccgccuggccgggggccggauccccgaggagggccuccuggagguccagguggaggugaacggggugccgcgcuggggcuccgugugcagcgagaacugggggcugaccgaggccauggucgccugccggcagcucggccugggguucgcgauccacgccuacaaggagaccugguucugguccggcacgccccgcgcccaggagguggugaugagcggcguccggugcuccgggaccgagcuggcccuccagcagugccagcgccacggccccgugcacugcagccacgggggcgggcgguuccuggcgggcguguccugcauggacagcgccccggaccuggucaugaacgcccagcucgugcaggagaccgccuaccuggaggaccgcccccugucccagcucuacugcgcccacgaggagaacugccugagcaaguccgcggaccacauggacuggcccuacggcuaccggcgccugcugcgcuucagcacccagaucuacaaccucgggcggacggacuuccgccccaagaccggccgggacagcuggguguggcaccagugccaccgccacuaccacuccaucgaggucuucacccacuacgaccugcugacccucaacgggagcaagguggccgagggccacaaggccuccuucugccuggaggacacgaacugcccgaccgggcugcagcggcgcuacgccugcgccaacuucggcgagcagggcgugaccgucgggugcugggacaccuaccggcacgacaucgacugccaguggguggacaucacggacgugggccccgggaacuacaucuuccaggucaucgugaacccccacuacgagguggcggagagcgacuucuccaacaacaugcuccagugccgcugcaaguacgacggccaccgggucuggcugcacaacugccacaccgggaacagcuaccccgccaacgccgagcugucccucgagcaggagcagcgccugcggaacaaccugaucuga

SEQ ID NO: 32409 - RNA, 6123 nt, Artificial Sequence
  derived and/or modified sequence opt1 from LPA__Homo_sapiens__NP_005568
auggagcacaaggagguggugcugcuccugcuccuguuccucaagagcgccgcccccgagcagagccacguggugcaggacugcuaccacggcgacgggcagagcuaccgcggcaccuacuccaccacggucaccgggcggaccugccaggccuggagcagcaugacgccccaccagcacaaccgcaccaccgagaacuaccccaacgccggccugaucaugaacuacugccgcaaccccgacgccguggccgcccccuacugcuacacccgcgaccccggggugcgcugggaguacugcaaccucacccagugcagcgacgccgagggcaccgccgucgcgccgcccaccgugacccccgugcccucccuggaggcccccagcgagcaggcccccaccgagcagcgccccggcguccaggagugcuaccacgggaacggccaguccuaccgcgggaccuacagcaccaccgugaccggccggaccugccaggccugguccagcaugaccccgcacucccacagccgcacccccgaguacuaccccaacgccgggcugaucaugaacuacugccgcaaccccgacgccguggccgcccccuacugcuacacccgcgaccccggcguccgcugggaguacugcaaccucacccagugcuccgacgccgagggcaccgccguggcgccgcccaccgugaccccgguccccagccuggaggcccccuccgagcaggcgcccaccgagcagcgcccgggggugcaggagugcuaccacggcaacgggcagagcuaccgcggcaccuacuccaccaccgugaccggccggaccugccaggccuggagcagcaugacgccccacucccacagccgcacccccgaguacuaccccaacgccgggcugaucaugaacuacugccggaacccggacgccgucgccgcgcccuacugcuacacgcgcgaccccggcgugcggugggaguacugcaaccucacccagugcuccgacgccgaggggaccgccguggccccgcccaccgucacgcccgugcccagccuggaggccccguccgagcaggcgcccaccgagcagcgccccggcgugcaggagugcuaccacgggaacggccagagcuaccggggcaccuacuccaccaccgucacggggcggaccugccaggccuggagcuccaugacgccccacagccacucccgcaccccggaguacuaccccaacgccggccugaucaugaacuacugccggaaccccgacgccguggcggcccccuacugcuacacgcgcgacccggggguccggugggaguacugcaaccucacccagugcagcgacgccgagggcaccgccguggcgccgcccaccgugacgcccgucccgucccuggaggcgcccagcgagcaggcccccaccgagcagcgccccggggugcaggagugcuaccacggcaacggccaguccuaccgggggaccuacagcaccacggugaccggccggaccugccaggccugguccagcaugaccccgcacucccacagccggacgcccgaguacuaccccaacgccgggcugaucaugaacuacugccgcaaccccgacgccgucgcggccccguacugcuacacccgggaccccggcgugcgcugggaguacugcaaccucacccagugcagcgacgccgaggggaccgccguggcgccgcccacggucacccccgugcccucccuggaggcgcccagcgagcaggcccccaccgagcagcggcccggcgugcaggagugcuaccacggcaacgggcaguccuaccgcggcaccuacagcacgaccgucaccgggcggaccugccaggccugguccagcaugacgccccacucccacagccgcacccccgaguacuacccgaacgccggccugaucaugaacuacugccggaaccccgacgcgguggccgcccccuacugcuacacccgcgaccccggcgugcggugggaguacugcaaccucacccagugcuccgacgccgaggggacggccgucgcgccgcccaccgugacccccgugcccagccuggaggccccguccgagcaggcccccaccgagcagcgccccggcguccaggagugcuaccacgggaacggccagagcuaccgggggacguacuccaccaccgugaccggccggaccugccaggccuggagcuccaugacgccccacagccacucccgcaccccggaguacuaccccaacgccggccugaucaugaacuacugccggaaccccgacgcgguggccgcccccuacugcuacacccgcgacccggggguccggugggaguacugcaaccucacccagugcagcgacgccgagggcacggccguggcgccgcccaccgugacccccgucccgagccuggaggcccccuccgagcaggcccccaccgagcagcgcccgggggugcaggagugcuaccacggcaacgggcagagcuaccggggcacguacuccaccaccgugaccggccgcacgugccaggccuggagcuccaugacgccccacagccacucccggacccccgaguacuaccccaacgcggggcugaucaugaacuacugccgcaacccggaccccgucgccgcccccuacugcuacacccgggaccccagcgugcgcugggaguacugcaaccucacccagugcuccgacgccgagggcaccgccguggcgccgcccaccaucacccccauccccagccuggaggccccguccgagcaggcccccacggagcagcggcccgggguccaggagugcuaccacggcaacgggcagagcuaccagggcaccuacuucaucaccgugaccggccgcacgugccaggccugguccagcaugacgccccacucccacagccggaccccggccuacuaccccaacgcggggcugaucaagaacuacugccgcaaccccgaccccguggccgccccguggugcuacaccacggaccccuccguccggugggaguacugcaaccucacccgcugcagcgacgccgaguggaccgccuucgugccgcccaacgugauccuggcgccgucccuggaggccuucuucgagcaggcccucaccgaggagacgcccggcguccaggacugcuacuaccacuacgggcagagcuaccggggcaccuacagcaccaccgugacggggcggaccugccaggccugguccagcaugacgccccaccagcacucccggacccccgagaacuacccgaacgccggccugacccgcaacuacugccggaaccccgacgcggagauccgccccuggugcuacacgauggacccgagcgugcgcugggaguacugcaaccugacccagugccucgucaccgaguccagcgugcuggccacccugacggugguccccgaccccuccaccgaggccagcuccgaggaggcccccaccgagcagagcccgggcgugcaggacugcuaccacggggacggccaguccuaccgggggagcuucuccaccacggugaccggccggaccugccagagcugguccagcaugacgccccacuggcaccagcgcaccaccgaguacuaccccaacggcgggcucacccgcaacuacugccggaaccccgacgcggagaucuccccguggugcuacaccauggaccccaacguccgcugggaguacugcaaccugacgcagugccccgugaccgagagcuccgugcuggccaccagcaccgccgucagcgagcaggcccccacggagcaguccccgaccgugcaggacugcuaccacggcgacgggcagagcuaccggggcuccuucagcaccaccgugacggggcggaccugccaguccuggagcuccaugacgccccacuggcaccagcggaccacggaguacuaccccaacggcggccucacccgcaacuacugccggaaccccgacgccgagauccgcccguggugcuacaccauggaccccagcguccggugggaguacugcaaccugacccagugccccgugauggaguccacgcugcucaccacccccaccgucgugccggugcccagcacggagcugcccuccgaggaggcgcccaccgagaacagcaccgggguccaggacugcuaccgcggcgacgggcaguccuaccggggcacccugagcacgaccaucaccgggcggaccugccaguccuggagcuccaugaccccgcacuggcaccggcgcaucccccucuacuaccccaacgccggccugacgcggaacuacugccgcaacccggacgccgagauccgccccuggugcuacaccauggaccccagcgugcggugggaguacugcaaccugacccgcugccccgugaccgaguccagcguccugacgaccccgaccguggcccccgugcccagcaccgaggcccccuccgagcaggcgccgcccgagaagucccccgucgugcaggacugcuaccacggcgacgggcgguccuaccgcggcaucagcuccacgaccgugaccgggcggaccugccagagcugguccagcaugaucccccacuggcaccagcgcacgccggagaacuaccccaacgccggccucaccgagaacuacugccggaaccccgacuccgggaagcagcccuggugcuacaccaccgacccgugcguccgcugggaguacugcaaccugacgcagugcagcgagaccgaguccggcgugcuggagacccccaccgugguccccgugcccagcauggaggcccacuccgaggccgccccgacggagcagacccccgugguccggcagugcuaccacggcaacgggcagagcuaccgcggcaccuucuccaccacggugaccgggcggaccugccagagcugguccagcaugacgccccaccgccaccagcggacgcccgagaacuacccgaacgacggccucaccaugaacuacugccgcaaccccgacgcggacaccggccccuggugcuucaccauggaccccuccauccggugggaguacugcaaccugacgcgcugcagcgacaccgaggggaccguggucgccccgcccaccgugauccaggugcccagccugggcccgcccuccgagcaggacugcauguucgggaacggcaagggguaccggggcaagaaggccacgaccgucaccggcacccccugccaggagugggccgcgcaggagccccaccgccacagcaccuucaucccggggacgaacaagugggccggccucgagaagaacuacugccggaaccccgacggggacaucaacggccccuggugcuacaccaugaacccccgcaagcuguucgacuacugcgacaucccgcugugcgccuccagcuccuucgacugcgggaagccccagguggagcccaagaagugccccggcagcaucgugggcgggugcgucgcccacccgcacuccuggcccuggcaggucagccuccggacccgcuucggcaagcacuucugcgggggcacccugaucucccccgagugggugcugacggccgcgcacugccucaagaaguccucccgccccagcuccuacaaggucauccugggggcccaccaggaggugaaccuggagagccacgugcaggagaucgaggucucccgccuguuccuggagccgacccaggccgacaucgcccugcucaagcugagccgccccgccgugaucaccgacaaggugaugcccgcgugccugcccuccccggacuacauggucaccgcccggacggagugcuacaucaccggcuggggcgagacccaggggaccuucggcacggggcuccugaaggaggcccagcugcucgugaucgagaacgaggugugcaaccacuacaaguacaucugcgccgagcaccuggcccgcggcaccgacagcugccagggggacuccggcggcccccuggucugcuucgagaaggacaaguacauccuccagggggugaccagcuggggccuggggugcgcgcggcccaacaagcccggcguguacgcccgcgucagccgguucgugaccuggaucgagggcaugaugcgcaacaacuga

SEQ ID NO: 32410 - RNA, 1095 nt, Artificial Sequence
  derived and/or modified sequence opt1 from LPAR1__Homo_sapiens__XP_005251839
auggccgccaucagcaccuccauccccgugaucagccagccgcaguucaccgcgaugaacgagccccagugcuucuacaacgaguccaucgccuucuucuacaaccgcagcggcaagcaccuggccacggaguggaacaccgucuccaagcucgugauggggcugggcaucaccgugugcaucuucaucaugcuggccaaccuccuggucaugguggccaucuacgugaaccggcgcuuccacuuccccaucuacuaccugauggcgaaccucgccgccgccgacuucuucgcggggcuggccuacuucuaccugauguucaacaccggccccaacacgcggcgccucaccgucagcaccuggcugcugcggcaggggcucaucgacaccucccugacggccagcguggccaaccugcucgccaucgcgaucgagcgccacaucaccguguuccggaugcagcugcacacccgcauguccaaccggcgcgucgugguggucaucguggugaucuggaccauggccaucgucaugggcgccaucccgagcgugggcuggaacugcaucugcgacaucgagaacugcuccaacauggcgccccuguacagcgacuccuaccucguguucugggccaucuucaaccuggucacguucguggugauggucgugcuguacgcccacaucuucggguacgugcggcagcgcaccaugcggaugagccgccacuccagcggcccccggcgcaaccgggacaccaugaugucccuccugaagaccgucgugaucguccugggggccuucaucaucugcuggacgcccggccucgugcugcugcuccuggacgugugcugcccgcagugcgacguccuggccuacgagaaguucuuccuccugcuggccgaguucaacagcgccaugaaccccaucaucuacuccuaccgcgacaaggagaugagcgcgaccuuccggcagauccucugcugccagcgcagcgagaaccccaccgggcccaccgagggcuccgaccggagcgccuccagccugaaccacacgauccuggccggcgugcacuccaacgaccacagcguggucuga

SEQ ID NO: 32411 - RNA, 1056 nt, Artificial Sequence
  derived and/or modified sequence opt1 from LPAR2__Homo_sapiens__XP_011526723
auggugaucaugggccagugcuacuacaacgagaccaucggguucuucuacaacaacagcggcaaggagcuguccagccacuggcgccccaaggacgucgugguggucgcccucgggcugaccguguccgugcugguccuccugacgaaccugcucgugaucgccgcgaucgccagcaaccggcgcuuccaccagccgaucuacuaccugcugggcaaccucgccgccgccgaccuguucgcggggguggccuaccuguuccucauguuccacaccggcccccggaccgcccgccugucccuggagggcugguuccuccggcaggggcugcuggacaccagccucacggccuccgucgcgacccugcuggccaucgccguggagcgccaccggagcgugauggccguccagcuccacucccgccugccccggggccgcguggugaugcugaucgucgggguguggguggccgcgcucggccuggggcugcuccccgcccacagcuggcacugccugugcgcccuggaccggugcucccgcauggccccgcuccugagccgguccuaccuggccgucugggcgcucagcucccugcugguguuccuccugaugguggccgucuacacccgcaucuucuucuacgugcggcgccgggugcagcgcauggccgagcacgucagcugccacccccgguaccgcgagaccacgcugucccucgugaagaccgucgugaucauccugggcgccuucguggucugcuggacccccggccagguggugcugcuccuggacgggcugggcugcgagagcugcaacguccucgccguggagaaguacuuccugcugcucgcggaggccaacucccuggugaacgccgccgucuacagcugccgggacgccgagaugcgccgcaccuuccggcgccugcugugcugcgcgugccuccggcagagcacgcgcgaguccgugcacuacaccagcuccgcccagggcggggccagcacccggaucaugcugcccgagaacggccacccgcugauggacuccacccucuga

SEQ ID NO: 32412 - RNA, 1062 nt, Artificial Sequence
  derived and/or modified sequence opt1 from LPAR3__Homo_sapiens__XP_011539451
augaacgagugccacuacgacaagcacauggacuucuucuacaaccgcagcaacaccgacaccguggacgacuggacgggcaccaagcuggucaucgugcucugcguggggaccuucuucugccuguucaucuucuucuccaacagccuggucaucgccgccgugaucaagaaccggaaguuccacuuccccuucuacuaccuccuggcgaaccuggccgccgccgacuucuucgccggcaucgcguacguguuccucauguucaacaccgggccggucuccaagacgcugaccgugaaccgcugguuccugcggcagggccuccuggacagcucccugaccgccagccucaccaaccugcuggugaucgccgucgagcgccacauguccaucaugcggaugcgcgugcacagcaaccucacgaagaagcgggugacccugcugauccuccuggucugggccaucgcgaucuucaugggggccgugcccacccugggcuggaacugccucugcaacaucuccgccugcagcucccuggcccccaucuacagccgcuccuaccugguguucuggaccgucagcaaccucauggccuuccugaucauggugguggucuaccugcggaucuacguguacgugaagcgcaagacgaacguccucagcccccacaccuccggcuccaucagccggcgccggaccccgaugaagcugaugaagaccgugaugacggugcugggggcguucgucgugugcuggacccccggccucgucgugcugcugcucgacgggcugaacugccgccagugcggcgugcagcacgucaagcggugguuccugcuccuggcccugcucaacuccguggugaaccccaucaucuacagcuacaaggacgaggacauguacgggaccaugaagaagaugaucugcugcuucagccaggagaaccccgagcgccggccgucccgcauccccagcaccguccugucccggagcgacacgggcucccaguacaucgaggacagcaucucccagggcgccgugugcaacaagagcaccuccuga

SEQ ID NO: 32413 - RNA, 1035 nt, Artificial Sequence
  derived and/or modified sequence opt1 from LPAR6__Homo_sapiens__NP_001155970
auggugagcgucaacuccagccacugcuucuacaacgacuccuucaaguacacccuguacggcugcauguucagcaugguguucgugcucgggcugaucuccaacugcgucgccaucuacaucuucaucugcgugcugaaggugcgcaacgagaccacgaccuacaugaucaaccucgccaugagcgaccugcuguucgucuucacccuccccuuccggaucuucuacuucaccacgcgcaacuggccguucggcgaccugcugugcaagaucuccgugaugcuguucuacaccaacauguacgggagcauccucuuccugaccugcaucuccguggaccgguuccucgcgaucgucuaccccuucaagagcaagacccugcgcacgaagcggaacgccaagaucgugugcaccggcguguggcugaccgucaucgggggcuccgcccccgccguguucgugcagagcacccacucccagggcaacaacgccagcgaggcgugcuucgagaacuuccccgaggccacguggaagaccuaccucucccgcaucgucaucuucaucgagaucgugggguucuucaucccgcugauccugaacgugaccugcagcuccaugguccucaagacccugacgaagcccgugacccugagccgguccaagaucaacaagaccaaggugcucaagaugaucuucguccaccugaucaucuucugcuucugcuucgugcccuacaacaucaaccugauccucuacagccuggugcgcacccagacguucgucaacugcagcguggucgccgccgugcggaccauguaccccaucacccugugcaucgcgguguccaacugcugcuucgacccgaucgucuacuacuucaccagcgacacgauccagaacuccaucaagaugaagaacuggagcgugcgccgguccgacuuccgcuucagcgaggugcacggcgccgagaacuucauccagcacaaccuccagacccugaaguccaagaucuucgacaacgagagcgccgccuga

SEQ ID NO: 32414 - RNA, 1605 nt, Artificial Sequence
  derived and/or modified sequence opt1 from LPCAT1__Homo_sapiens__NP_079106
augcgccugcggggcugcgggccccgcgccgccccggcgagcuccgccggcgccagcgacgcccggcuccuggccccgcccgggcgcaaccccuucgugcacgagcugcggcucuccgcgcugcagaaggcccaggucgcccugaugacccucacccuguuccccgugcgccugcucguggccgcggccaugaugcugcuggccuggccccucgcccuggucgccagccugggcuccgcggagaaggagcccgagcagcccccggcccucuggcggaaggugguggacuuccugcugaaggccaucaugcgcacgaugugguucgccgggggcuuccaccgggucgccgugaagggccgccaggcgcuccccaccgaggccgccauccugacccuggcgccccacagcuccuacuucgacgccauccccgugaccaugacgaugagcuccaucgucaugaaggccgagagccgggacaucccgaucugggggacccucauccaguacauccgccccguguucgugucccggagcgaccaggacucccgccggaagaccgucgaggagaucaagcgccgggcccagagcaacggcaaguggccccagaucaugaucuuccccgaggggaccugcacgaaccggaccugccugaucaccuucaagccgggcgccuucauccccggggcccccgugcagcccgugguccugcgcuacccgaacaagcucgacaccaucacguggaccuggcagggccccggcgcccuggagauccuguggcucacccugugccaguuccacaaccagguggagaucgaguuccugcccguguacucccccagcgaggaggagaagcgcaacccggcgcucuacgccuccaacguccggcgcgugauggccgaggcccugggggugagcgucaccgacuacacguucgaggacugccagcuggcgcucgccgagggccagcugcgccugcccgccgacacgugccuccuggaguucgcccggcuggugcgcgggcucggccugaagcccgagaagcuggagaaggaccucgaccgguacuccgagcgcgcccggaugaagggcggggagaagaucggcaucgcggaguucgccgccagccuggaggugcccgucagcgaccugcucgaggacauguucucccuguucgacgagagcggguccggcgagguggaccugcgcgagugcgucguggcccucagcguggucugccggccggcccgcacccuggacaccauccagcuggcguucaagauguacggggcccaggaggacggcuccgugggcgagggggaccugagcugcauccucaagaccgcccugggcguggccgagcugaccgucaccgaccucuuccgggccaucgaccaggaggagaaggggaagaucaccuucgcggacuuccaccgcuucgccgagauguaccccgccuucgccgaggaguaccuguaccccgaccagacgcacuucgaguccugcgcggagaccagcccggcccccauccccaacggcuucugcgccgacuucucccccgagaacagcgacgccgggcggaagccggugcgcaagaagcuggacuga

SEQ ID NO: 32415 - RNA, 1635 nt, Artificial Sequence
  derived and/or modified sequence opt1 from LPCAT2__Homo_sapiens__NP_060309
augagccgcugcgcccaggccgcggagguggccgccaccguccccggcgccggggugggcaacguggggcugcggccgcccauggucccccgccaggccuccuucuucccgccgcccgugcccaaccccuucgugcagcagacccagaucggcagcgcgcggcgcguccagaucgugcuccuggggaucauccugcuccccauccgggugcugcuggucgcccucauccugcugcucgccuggcccuucgccgcgaucuccacggugugcugccccgagaagcugacccaccccaucaccggcuggcgccggaagaucacccagacggcccugaaguuccucggccgcgccauguucuucagcaugggguucaucguggccgucaagggcaagaucgccuccccgcuggaggcgcccguguucguggccgcgccccacagcaccuucuucgacgggaucgccugcgucguggccggccugcccuccauggugagccggaacgagaacgcccaggucccgcucaucgggcgccugcugcgggccgugcagcccgugcucgucucccgcguggaccccgacagccggaagaacaccaucaacgagaucaucaagcgcaccacguccggcggcgaguggccccagauccugguguucccggaggggaccugcaccaaccggagcugccugaucaccuucaagcccggcgccuucauccccgggguccccgugcagccgguccuccugcgcuaccccaacaagcuggacacggugaccuggaccuggcagggcuacaccuucauccagcucugcaugcugacguucugccagcuguucaccaagguggaggucgaguucaugcccguccaggugcccaacgacgaggagaagaacgacccgguccucuucgccaacaaggugcggaaccugauggccgaggcgcugggcauccccgugaccgaccacaccuacgaggacugccgccucaugaucuccgccgggcagcugacgcugcccauggaggccggccucguggaguucaccaagaucagccggaagcugaagcuggacugggacggggugcgcaagcaccucgacgaguacgccuccaucgccagcuccagcaagggcgggcggaucggcaucgaggaguucgcgaaguaccugaagcugccgguguccgacguccuccgccagcuguucgcccuguucgaccgcaaccacgacggcagcaucgacuuccgggaguacgugaucgggcucgccgugcugugcaaccccagcaacaccgaggagaucauccaggucgccuucaagcuguucgacguggacgaggacggcuacaucaccgaggaggaguucuccacgauccuccaggcgagccugggggugcccgaccuggacgucuccggccucuucaaggagaucgcccagggggacagcaucuccuacgaggaguucaagagcuucgcccugaagcaccccgaguacgccaagaucuucaccaccuaccuggaccugcagaccugccacguguucucccucccgaaggaggugcagacgacccccagcaccgccuccaacaaggucagccccgagaagcacgaggaguccaccagcgacaagaaggacgacuga

SEQ ID NO: 32416 - RNA, 1464 nt, Artificial Sequence
  derived and/or modified sequence opt1 from LPCAT3__Homo_sapiens__NP_005759
auggccagcuccgccgagggcgacgaggggaccguggucgcgcuggccggcgugcuccagagcggguuccaggagcugucccugaacaagcucgccaccagccugggcgccuccgagcaggcccugcgccucaucaucagcaucuuccugggguaccccuucgcgcuguucuaccggcacuaccucuucuacaaggagacguaccugauccaccuguuccacaccuucaccggccucuccaucgccuacuucaacuucggcaaccagcuguaccacagccugcucugcaucgugcugcaguuccugauccuccgccugauggggcggaccaucacggccguccugaccaccuucugcuuccagauggccuaccuccuggcgggcuacuacuacaccgccacggggaacuacgacaucaaguggaccaugccgcacugcgugcugacccucaagcugaucggccuggccguggacuacuucgacgggggcaaggaccagaacucccucagcuccgagcagcagaaguacgccauccgcggcguccccagccugcuggagguggccggguucuccuacuucuacggcgcguuccucguggggccccaguucagcaugaaccacuacaugaagcugguccagggcgagcugaucgacauccccggcaagaucccgaacuccaucauccccgcccucaagcggcugagccugggccucuucuaccuggugggguacacccugcucagcccccacaucacggaggacuaccugcugaccgaggacuacgacaaccaccccuucugguuccgcugcauguacaugcucaucugggggaaguucgugcuguacaaguacgugaccugcuggcuggucaccgagggcgugugcauccucacggggcugggcuucaacggcuucgaggagaaggggaaggccaagugggacgccugcgccaacaugaaggucuggcuguucgagaccaacccgcgguucaccggcaccaucgcguccuucaacaucaacacgaacgccuggguggcccgcuacaucuucaagcggcucaaguuccuggggaacaaggagcugucccagggccugagccuccuguuccuggcccucuggcacgggcugcacagcggcuaccuggugugcuuccagauggaguuccucaucgucaucguggagcgccaggccgcgcggcugauccaggagucccccacccugagcaagcucgccgccaucaccgugcugcagcccuucuacuaccugguccagcagaccauccacuggcuguucaugggcuacuccaugacggccuucugccuguucaccugggacaaguggcugaagguguacaagagcaucuacuuccucgggcacaucuucuuccugucccuccucuucauccugcccuacauccacaaggccauggugccgcgcaaggagaagcugaagaagauggaguga

SEQ ID NO: 32417 - RNA, 1575 nt, Artificial Sequence
  derived and/or modified sequence opt1 from LPCAT4__Homo_sapiens__NP_705841
augagccagggcucccccggggacugggccccgcuggaccccacccccgggcccccggccagccccaaccccuucgugcacgagcuccaccugucccgccugcagcgggucaaguucugccuccugggcgcgcugcucgcccccauccgcgugcugcuggccuucaucgugcuguuccugcuguggccguucgccuggcuccaggucgccggccugagcgaggagcagcugcaggagcccaucaccggguggcggaagacggugugccacaacggcgugcucggccugucccgccuccucuucuuccugcugggguuccuccggauccgcguccggggccagcgcgcgagccggcugcaggcccccgugcugguggccgcgccccacuccaccuucuucgacccgaucguccuccugcccugcgaccugcccaagguggugagccgcgccgagaaccucuccguccccgugaucggggcccugcugcgguucaaccaggccauccucgugagccgccacgacccggccucccggcgccgggucguggaggaggugcgccggcgcgccaccagcggcgggaaguggccccagguccuguucuuccccgaggggaccugcuccaacaagaaggcgcugcucaaguucaagcccggcgccuucaucgccggcgugccggugcagcccguccugauccgguaccccaacagccuggacacgaccuccugggccuggcgcggccccggggugcucaaggugcuguggcugaccgccagccagccgugcuccaucgucgacguggaguuccuccccgucuaccaccccagccccgaggagucccgggacccgacccuguacgcgaacaacgugcagcgcgugauggcccaggcccugggcauccccgccacggagugcgaguucgucggcagccuccccgugaucguggucgggcgccugaagguggcccuggagccgcagcucugggagcugggcaaggugcugcggaaggcggggcucagcgccggcuacgucgacgccggggccgagcccggccgcucccggaugaucagccaggaggaguucgcccgccagcugcagcuguccgacccccagaccguggcgggcgccuucggguacuuccagcaggacaccaagggccugguggacuuccgggacgucgcccucgcccuggcggcccuggacgggggccgcagccucgaggagcugacccggcuggccuucgagcuguucgccgaggagcaggccgaggggcccaaccgccugcuguacaaggacggcuucuccacgauccuccaccuccugcucggcagcccgcaccccgcggccaccgcccugcacgccgagcugugccaggccggguccagccagggccucucccugugccaguuccagaacuucagccugcacgacccccucuacgggaagcuguucuccaccuaccugcggcccccgcacaccagccgcggcacgucccagacccccaacgcgagcucccccgggaaccccaccgcccucgccaacggcaccgugcaggccccgaagcagaagggcgacuga

SEQ ID NO: 32418 - RNA, 1113 nt, Artificial Sequence
  derived and/or modified sequence opt1 from LPGAT1__Homo_sapiens__NP_055688
auggccaucacccuggaggaggcccccuggcucggcuggcugcuggugaaggcgcucaugcgcuucgccuucauggucgugaacaaccugguggccaucccgagcuacaucugcuacgucaucauccugcagccccuccgggugcuggacuccaagcgcuucugguacaucgaggggaucauguacaaguggcugcucggcaugguggccagcugggggugguacgccggcuacaccgucauggaguggggcgaggacaucaaggcgguguccaaggacgaggccgugaugcuggucaaccaccaggccacgggggacgugugcacccugaugaugugccuccaggacaagggccugguggucgcccagaugauguggcugauggaccacaucuucaaguacaccaacuucgggaucgugagccucgugcacggcgacuucuucauccggcaggggcgcuccuaccgggaccagcagcugcugcuccugaagaagcaccuggagaacaacuaccgcagccgggaccgcaaguggaucguccucuuccccgagggcggguuccugcggaagcgccgggagaccucccaggcguucgccaagaagaacaaccugcccuuccucacgaacgugacccugccgcgcagcggcgccaccaagaucauccugaacgcccucguggcccagcagaagaacggcucccccgccgggggcgacgcgaaggagcuggacagcaaguccaaggggcugcaguggaucaucgacaccacgaucgccuaccccaaggccgagcccaucgacauccagaccuggauccucggcuaccggaagccgaccgucacccacgugcacuaccgcaucuuccccaucaaggacgugccccuggagacggacgaccugaccaccuggcucuaccagcgguucgucgagaaggaggaccugcugagccacuucuacgagaccggcgccuucccgcccuccaaggggcacaaggaggcggugagccgcgagaugacgcucuccaaccuguggaucuuccugauccagagcuucgccuuccucuccggcuacaugugguacaacaucauccaguacuucuaccacugccuguucuga

SEQ ID NO: 32419 - RNA, 2691 nt, Artificial Sequence
  derived and/or modified sequence opt1 from LPIN1__Homo_sapiens__NP_001248356
augagccgcgugcagaccaugaacuacgucggccagcuggccggccagguguucgugaccgucaaggagcucuacaaggggcugaaccccgccacgcuguccgggugcaucgacaucaucgugauccggcagccgaacggcaaccuccagugcagccccuuccacgugcgcuucgggaagaugggcguccugcggucccgcgagaaggugguggacaucgagaucaacggcgagagcgucgaccugcacaugaagcucggggacaacggcgaggcguucuucgugcaggagaccgacaacgaccaggaggugauccccaugcaccuggccaccucccccauccugagcgagggggccucccggauggagugccagcucaagcgcggcagcgucgaccggaugcgcgggcuggacccguccacccccgcccaggugaucgcccccagcgagacgcccuccagcuccagcguggucaagaagcggcgcaagcggcgccggaagucccagcuggacagccucaagcgcgacgacaacaugaacaccuccgaggacgaggacauguucccgaucgagaugagcuccgacgaggcgauggagcugcuggagagcagccggacccuccccaacgacaucccgcccuuccaggacgacauccccgaggagaaccugucccuggccgugaucuacccccagagcgccuccuaccccaacagcgaccgcgaguggucccccaccccgagccccuccggcagccggcccuccacgcccaagagcgacuccgagcucgugagcaaguccaccgagcgcaccggccagaagaacccggagaugcuguggcuguggggcgagcucccccaggccgccaagagcuccagcccccacaagaugaaggaguccagcccccuguccagccggaagaucugcgacaagagccacuuccaggcgauccacuccgagagcuccgacaccuucagcgaccaguccccgacgcuggucggcggggcccuccuggaccagaacaagccccagaccgagaugcaguucgugaacgaggaggaccuggagacccucggggccgccgcgccccugcugcccaugaucgaggagcucaagccgcccagcgccuccgugguccagaccgccaacaagacggacagccccucccgcaagcgggacaagcgcagccgccaccugggcgccgacgggguguaccuggacgaccucaccgacauggacccggagguggccgcgcuguacuuccccaagaacggcgaccccuccgggcuggccaagcacgccagcgacaacggcgcccgguccgccaaccagagcccccaguccgucgggagcuccggcguggacagcggcgucgagagcaccuccgacgggcuccgcgaccugccgagcaucgcgaucucccugugcggcgggcucagcgaccaccgggagaucaccaaggacgccuuccuggagcaggccguguccuaccagcaguucguggacaaccccgccaucaucgacgaccccaaccuggucgugaagaucggcagcaaguacuacaacuggacgaccgccgcgccccuccugcuggccaugcaggccuuccagaagccgcuccccaaggccaccguggaguccaucaugcgcgacaagaugcccaagaagggcgggcgguggugguucagcuggcgcggccggaacaccacgaucaaggaggaguccaagcccgagcagugccuggcggggaaggcccacagcaccggcgagcagccgccccagcugucccucgccacccgcgucaagcacgagagcuccagcuccgacgaggagcgggccgccgcgaagcccagcaacgccgggcaccucccccugcugccgaacguguccuacaagaagacccugcgccugacgagcgagcagcugaagucccucaagcugaagaacggccccaacgacguggucuucagcgugaccacccaguaccaggggaccugccggugcgagggcacgaucuaccuguggaacugggacgacaaggugaucaucagcgacaucgacggcaccaucacccgcuccgacacccucgggcacauccugcccacgcugggcaaggacuggacccaccaggggaucgccaagcucuaccacaaggucagccagaacggcuacaaguuccuguacugcuccgcccgggccaucggcauggcggacaugacccgcggguaccugcacugggugaacgagcggggcaccgugcucccccaggggccgcugcugcucagccccuccagccuguucuccgcccugcaccgcgaggucaucgagaagaagcccgagaaguucaaggugcagugccucaccgacaucaagaaccuguucuuccccaacacggagccguucuacgccgccuucggcaaccggcccgccgacguguacagcuacaagcaggucggggugucccugaaccgcaucuucaccgugaaccccaagggcgagcucguccaggagcacgcgaagaccaacaucagcuccuacgugcggcugugcgagguggucgaccacguguucccgcugcucaagcgcagccacuccagcgacuuccccugcuccgacaccuucagcaacuucacguucuggcgcgagccccugcccccguucgagaaccaggacauccacuccgccagcgccuga

SEQ ID NO: 32420 - RNA, 2691 nt, Artificial Sequence
  derived and/or modified sequence opt1 from LPIN2__Homo_sapiens__NP_055461
augaacuacgugggccagcuggccgggcaggucaucgugaccgugaaggagcucuacaagggcaucaaccaggccacccugagcgggugcaucgacgucaucguggugcagcagcaggacggcuccuaccagugcagccccuuccacguccgcuucgggaagcugggcgugcuccgguccaaggagaaggugaucgacaucgagaucaacggcagcgcggucgaccugcacaugaagcugggggacaacggcgaggccuucuucguggaggagacggaggaggaguacgagaagcucccggccuaccuggccaccucccccauccccaccgaggaccaguucuucaaggacaucgacacgccccuggucaagagcgggggcgacgagaccccgucccagagcuccgacaucagccacgugcucgagaccgagaccaucuucacccccuccagcgugaagaagaagaagcgccggcgcaagaaguacaagcaggacuccaagaaggaggagcaggccgcgagcgccgccgccgaggacacgugcgacgugggggucuccagcgacgacgacaagggcgcgcaggccgcccggggcuccagcaacgccucccugaaggaggaggagugcaaggagccccuccuguuccacagcggggaccacuacccccugagcgacggcgacugguccccgcuggagaccaccuacccccagaccgccugccccaagagcgacuccgagcucgaggugaagcccgcggagagccugcugcgcuccgagagccacauggaguggacguggggcggcuucccggaguccaccaaggugagcaagcgggagcgcuccgaccaccacccccggaccgccaccaucacgcccagcgagaacacccacuuccgcgucauccccuccgaggacaaccucaucagcgagguggagaaggacgccuccauggaggacaccgugugcaccaucgucaagccgaagccccgggcccugggcacgcagaugagcgaccccaccuccguggccgagcugcucgagcccccgcuggagagcacccagaucuccagcaugcuggacgcggaccaccuccccaacgccgcccuggccgaggcccccuccgagagcaagcccgcggccaagguggacagcccguccaagaagaaggggguccacaagcgcagccagcaccagggccccgacgacaucuaccuggacgaccucaaggggcuggagcccgagguggccgcccuguacuuccccaaguccgagagcgagccgggcucccggcaguggcccgagagcgacacccucuccgggagccagagcccccagagcgucggcuccgccgcggccgacagcggcacggagugccuguccgacagcgccauggaccugccggacgugacccucucccugugcgggggccugagcgagaacggggagaucuccaaggagaaguucauggagcacaucaucaccuaccacgaguucgccgagaaccccggccucaucgacaaccccaaccuggugauccgcaucuacaaccgguacuacaacugggcgcuggccgcccccaugauccucagccugcaggucuuccagaagucccugccgaaggccaccguggaguccugggugaaggacaagaugcccaagaaguccgggcgcuggugguucuggcggaagcgcgagagcaugacgaagcagcuccccgagagcaaggagggcaaguccgaggcgcccccggccagcgaccugcccuccagcuccaaggagcccgccggcgcccggcccgccgagaacgacagcuccagcgacgaggggucccaggagcuggaggagagcaucaccgucgacccgauccccaccgagccccucucccacggcagcaccacguccuacaagaagucccugcgccugagcagcgaccagaucgccaagcucaagcugcacgacgggcccaacgacgugguguucagcaucaccacccaguaccaggggaccugccggugcgcggggacgaucuaccuguggaacuggaacgacaagaucaucaucuccgacaucgacggcaccaucaccaagagcgacgcccugggccagauccucccgcagcuggggaaggacuggacccaccagggcaucgccaagcuguaccacuccaucaacgagaacggguacaaguuccucuacugcagcgcccgcgccaucggcauggcggacaugacccgcggcuaccugcacugggucaacgacaaggggacgauccugccccggggcccccucaugcugucccccagcucccuguucagcgccuuccaccgcgaggugaucgagaagaagccggagaaguucaagaucgagugccucaacgacaucaagaaccuguucgcccccuccaagcagcccuucuacgccgcguucgggaaccggcccaacgacguguacgccuacacccaggucggcgugccggacugccgcaucuucaccgugaaccccaagggggagcugauccaggagcggaccaagggcaacaagagcuccuaccaccgccucagcgagcuggucgagcacguguucccccugcucuccaaggagcagaacagcgccuucccgugccccgaguucuccagcuucugcuacuggcgggaccccauccccgagguggaccuggacgaccuguccuga

SEQ ID NO: 32421 - RNA, 1428 nt, Artificial Sequence
  derived and/or modified sequence opt1 from LPL__Homo_sapiens__NP_000228
auggagagcaaggcccugcucgugcugacccuggccgucuggcuccagagccugaccgcgagccgcggcgggguggccgccgccgaccagcggcgcgacuucaucgacaucgaguccaaguucgcccugcggacgcccgaggacaccgcggaggacacgugccaccucaucccgggcguggccgagagcgucgcgaccugccacuucaaccacuccagcaagaccuucauggugauccacggguggaccgugaccggcauguacgaguccuggguccccaagcugguggccgcccuguacaagcgcgagcccgacagcaacgugaucgucguggacuggcucucccgggcccaggagcacuaccccgugagcgccggguacaccaagcuggucggccaggacguggcccgcuucaucaacuggauggaggaggaguucaacuacccgcuggacaacgugcaccuccugggcuacucccugggggcccacgcggccggcaucgccgggagccucacgaacaagaaggucaaccggaucaccggccuggaccccgccgggcccaacuucgaguacgccgaggcgcccucccgccugagcccggacgacgccgacuucguggacgugcuccacaccuucacccggggcucccccggccgcagcaucgggauccagaagcccgucggccacguggacaucuaccccaacgggggcacguuccagccgggcugcaacaucggggaggccauccgggugaucgccgagcgcggccugggggacgucgaccagcuggugaagugcucccacgagcggagcauccaccucuucaucgacucccugcugaacgaggagaaccccagcaaggccuaccgcugcagcuccaaggaggcguucgagaagggccucugccugagcugccggaagaaccgcugcaacaaccugggguacgagaucaacaaggugcgggccaagcgcuccagcaagauguaccucaagacccggucccagaugcccuacaaggucuuccacuaccaggugaagauccacuucagcggcaccgaguccgagacccacacgaaccaggccuucgagaucagccuguacggcaccgucgccgaguccgagaacauccccuucacccugccggaggugagcaccaacaagacguacuccuuccucaucuacaccgagguggacaucggggagcugcugaugcucaagcugaaguggaaguccgacagcuacuucagcugguccgacugguggagcucccccggcuucgccauccagaagauccgcgucaaggcgggggagacccagaagaaggugaucuucugcagccgggagaaggugucccaccuccagaagggcaaggcccccgccgucuucgugaagugccacgacaagagccugaacaagaaguccggguga

SEQ ID NO: 32422 - RNA, 1890 nt, Artificial Sequence
  derived and/or modified sequence opt1 from LPO__Homo_sapiens__NP_001153574
augcgcgugcugcuccaccuccccgcccugcucgccagccugauccugcuccaggcggccgccuccaccacccgggacccgagccuggaccugacgucccucagccuggaggucggcugcggggcccccgcccccguggugcgcugcgaccccugcuccccguaccggaccaucaccggcgacugcaacaaccgccggaagcccgcgcugggggccgccaaccgcgcccucgcgcgguggcugcccgccgaguacgaggacggccugagccuccccuucggguggaccccgggcaagacgcgcaacggcuucccccugccccuggcccgggaggucuccaacaagaucgugggguaccucaacgaggagggcgugcuggaccagaaccgcagccugcuguucaugcagugggggcagaucgucgaccacgaccuggacuucgcccccgacaccgagcugggcuccagcgaguacuccaaggcccagugcgacgaguacugcauccagggggacaacugcuucccgaucauguucccgcccaacgaccccaaggcgggcacccagggcaagugcaugcccuucuuccgggccggguucgugugccccaccccgcccuacaagagccucgcccgcgagcagaucaacgcccugacguccuuccuggacgccagcuucguguacuccagcgagcccucccucgcgagccggcugcgcaaccuguccagcccccucggccugauggccgucaaccaggaggugagcgaccacgggcugcccuaccuccccuacgacuccaagaagccgagccccugcgaguucaucaacaccaccgcccgggugcccugcuuccuggccggcgacucccgcgccagcgagcacauccugcucgcgaccucccacacgcuguuccugcgggagcacaaccgccucgcccgggagcugaagcgccugaacccccagugggacggcgagaagcucuaccaggaggcccggaagauccugggggccuucguccagaucaucaccuuccgcgacuaccugccgauccuccugggcgaccacaugcagaaguggaucccgcccuaccagggguacagcgaguccguggacccccgcaucagcaacguguucaccuucgccuuccgguucggccaccuggagguccccuccagcauguuccgccucgacgagaacuaccagcccugggggcccgagccggagcugccccugcacacccuguucuucaacacguggcggauggugaaggacggcggcaucgacccccucgugcgcgggcugcuggcgaagaaguccaagcucaugaagcagaacaagaugaugaccggcgagcugcggaacaagcuguuccagcccacccaccgcauccacggguucgaccucgccgccaucaacacccagcggugccgcgaccacggccagccgggguacaacagcuggcgggccuucugcgaccugucccagccccagacgcuggaggagcucaacaccguccucaagagcaagaugcuggcgaagaagcugcugggccuguacggcacccccgacaacaucgacaucuggaucggggccaucgccgagccccucguggagcgcggccggguggggccgcugcuggccugccuccugggcaagcaguuccagcagauccgcgacggggaccgguucuggugggagaaccccggcgucuucaccaacgagcagaaggacucccugcagaagaugagcuucucccgccucgugugcgacaacacgcggaucaccaaggugccccgcgaccccuucugggccaacagcuacccguacgacuucgucgacugcuccgcgaucgacaagcuggaccugagccccugggccagcgugaagaacuga

SEQ ID NO: 32423 - RNA, 1839 nt, Artificial Sequence
  derived and/or modified sequence opt1 from LPP__Homo_sapiens__NP_001161143
augagccaccccuccuggcugccgcccaagagcaccggcgagccccucgggcacgugcccgcccgcauggagaccacgcacuccuucggcaacccgagcaucuccgucagcacccagcagccgcccaagaaguucgcccccgugguggcgccgaagcccaaguacaaccccuacaagcagcccgggggcgagggggacuuccugccgcccccgccgccgccccuggacgacuccagcgcccuccccuccaucagcggcaacuucccgcccccgccgccccuggacgaggaggccuucaagguccagggcaaccccgggggcaagacccuggaggagcggcgcuccagccucgacgccgagaucgacucccugaccagcauccuggccgaccucgagugcuccagccccuacaagccccggccgccccaguccagcacgggguccaccgcgagcccgcccgugagcacccccgugaccggccacaagcgcauggucauccccaaccagccgccccugacggccaccaagaaguccacccugaagccccagcccgcgccccaggccgggcccauccccguggcccccaucggcacccucaagccccagccccagcccgugcccgccagcuacacgaccgccuccaccagcucccggcccaccuucaacguccaggucaagagcgcccagcccagcccccacuacauggccgcgcccuccuccggccagaucuacgggagcggcccccagggguacaacacgcagcccgugcccguguccggccagugcccgccgcccagcacccgcggcgggauggacuacgccuacaucccgccgcccggccugcagcccgagcccggguacggcuacgcccccaaccaggggcgguacuacgagggcuacuacgccgccggccccggguacggcgggcgcaacgacuccgaccccaccuacggccagcaggggcaccccaacaccuggaagcgggagcccggcuacacgccgcccggcgcggggaaccagaacccgcccggcauguaccccgugaccgggcccaagaagaccuacaucaccgaccccgugagcgcccccugcgcgccgccccugcagcccaagggcgggcacuccggccagcucggccccagcuccgucgcccccagcuuccgccccgaggacgagcuggagcaccugacgaagaagaugcucuacgacauggagaacccgcccgccgacgaguacuucgggcggugcgcccgcugcggcgagaacguggugggggagggcaccggcugcaccgccauggaccaggucuuccacguggacugcuucacgugcaucaucugcaacaacaagcugcgggggcagcccuucuacgccguggagaagaaggccuacugcgagcccugcuacaucaacacccuggagcagugcaacgucugcuccaagcccaucauggagcgcauccuccgggccaccggcaaggcguaccacccccacugcuucacgugcgugaugugccaccgcagccuggacgggauccccuucaccguggacgccggcgggcugauccacugcaucgaggacuuccacaagaaguucgccccgcggugcagcgucugcaaggagcccaucaugcccgccccgggccaggaggagaccgugcgcaucgucgcgcucgaccgggacuuccacgugcacugcuaccgcugcgaggacugcggcgggcugcuguccgagggcgacaaccaggggugcuacccccucgacggccacauccugugcaagaccugcaacagcgcccggauccgcgugcugaccgccaaggccuccaccgaccucuga

SEQ ID NO: 32424 - RNA, 1284 nt, Artificial Sequence
  derived and/or modified sequence opt1 from LPPR2__Homo_sapiens__NP_001164106
auggccggcgggcgcccccaccugaagcggagcuucuccaucaucccgugcuucguguucgucgagggcuucuucugcuacgacagcaccuacgccaagcccuaccccgggcccgaggcggccucccgcgugccgcccgcccucguguacgcccuggucaccgccggccccacccugaccauccuccugggggagcuggcgcgggccuucuuccccgccccgcccagcgccgugcccgugaucggcgaguccaccaucgucagcggcgcgugcugccgcuucuccccgccggugcggcgccucgugcgguuccugggggucuacagcuucggccuguucaccacgaccaucuucgccaacgccggccagguggugaccgggaaccccacgccccacuuccucuccgucugccgccccaacuacaccgcccuggggugccugccgcccagccccgaccggcccggcccggaccgcuucgugaccgaccagggcgccugcgcggggucccccagccucguggccgccgcccggcgcgccuuccccugcaaggacgcggcccugugcgccuacgccgucaccuacaccgccauguacgugacgcugguguuccgggucaagggcucccgccucgugaagcccagccugugccuggcgcuccugugcccggccuuccuggugggggucgugcggguggccgaguaccgcaaccacugguccgacguccucgccggcuuccugaccggcgccgcgaucgccaccuuccuggugaccugcgucgugcacaacuuccagagccggccgcccuccgggcgccggcucagccccugggaggaccugggccaggcccccacgauggacagcccccuggagaagcucuccguggcccaggagcccgaggucugccgcccgcacagcacccccgcgcggcugacccccuccaagagccagaacugcgcccgccgcgggcaccugauccccuccugcgugagcucccgggccccggccaugugcagcagcccccgcgugccccggccccgccuccgguccgagccgacgccccugccccugccccucccgcugcccgcccccacccccucccagggcccgagccccuccagccccgggcccggcggccccgggggcgggggcgggcgcggccggaagcugcuccugcccacgccccugcuccgcgaccuguacacccuguccggccucuaccccagcccguuccaccgggacaacuucucccccuaccuguucgcgagccgcgaccaccuccuguga

SEQ ID NO: 32425 - RNA, 1965 nt, Artificial Sequence
  derived and/or modified sequence opt1 from LPPR4__Homo_sapiens__XP_011540800
augcccuacaucgagccgacccaggaggccauccccuuccugaugcuccugagccuggccuucgcgggccccgccaucaccaucauggugggggagggcauccucuacugcugccuguccaagcgccggaacggggucggccuggagcccaacaucaacgccgggggcugcaacuucaacagcuuccuccgccgggccgugcgcuucgugggcguccacguguucgggcugugcuccacggcccugaucaccgacaucauccagcucagcaccggcuaccaggcgccguacuuccugaccgugugcaagcccaacuacacgucccugaacgucagcugcaaggagaacuccuacaucguggaggacaucugcagcggguccgaccucaccgugaucaacagcggccggaaguccuuccccagccagcacgccacccuggccgccuucgcggccgucuacguguccauguacuucaacagcacccugacggacuccagcaagcuccugaagccccugcucguguucaccuucaucaucugcgggaucaucugcggccugacccgcaucacccaguacaagaaccacccggucgacguguacugcggcuuccugaucgggggcgggaucgcccucuaccugggccuguacgccgugggcaacuuccuccccuccgacgagagcauguuccagcaccgggacgcccugcgcucccugacggaccucaaccaggaccccaaccggcugcugagcgcgaagaacgggagcuccagcgacggcaucgcccacaccgaggggauccucaaccgcaaccaccgggacgccuccagccugaccaaccugaagcgcgccaacgccgacgucgagaucaucaccccgcgguccccgaugggcaaggagaacauggugacguucagcaacacccucccccgcgcgaacacccccuccguggaggaccccguccggcgcaacgccagcauccacgccuccauggacagcgcccgguccaagcagcugcugacccaguggaagaacaagaacgagagccgcaagcucucccuccaggugaucgagccggagcccgggcagagcccgccccgguccaucgagaugcgcagcuccagcgagccgucccgggugggcgucaacggcgaccaccacgggcccggcaaccaguaccugaagauccagcccggggccgugcccggcugcaacaacagcaugcccgggggcccccgcgugagcauccagucccgccccggcagcucccagcugguccacauccccgaggagacgcaggagaacaucagcaccucccccaagagcuccagcgcgcgggccaaguggcugaaggccgccgagaagaccguggccugcaaccgcuccaacagccagccccggaucaugcaggucaucgcgauguccaagcagcagggggugcugcagagcucccccaagaacaccgagggcagcacgguguccugcaccgggagcauccgcuacaagacccucaccgaccacgagccguccggcaucguccggguggaggcccaccccgagaacaaccgccccaucauccagauccccagcacggagggggagggcagcggcuccuggaaguggaaggccccggagaaggggagccugcggcagaccuacgagcugaacgaccucaaccgcgacuccgagagcugcgagucccugaaggacagcuucggcuccggggaccggaagcgcagcaacaucgacuccaacgagcaccaccaccacggcaucaccaccauccgggugacgcccgucgagggcagcgagaucggguccgagacccugagcaucuccagcucccgcgacagcacccuccggcgcaagggcaacaucauccugauccccgagcgguccaacagccccgagaacacccgcaacaucuucuacaaggggacguccccgacccgggccuacaaggacuga

SEQ ID NO: 32426 - RNA, 1176 nt, Artificial Sequence
  derived and/or modified sequence opt1 from LPXN__Homo_sapiens__NP_001137467
augagcacccugcucaucuccagcuccgacgcccugcuggaggagcucgagcgcagcacccugcaggacuccgacgaguacagcaaccccgccccgcugccccucgaccagcacucccggaaggagacgaaccuggacgagaccagcgagauccuguccauccaggacaacaccagcccccuccccgcgcagcugguguacaccacgaacauccaggagcugaacgucuacuccgaggcccaggagccgaaggagagcccgccgcccuccaagaccagcgccgccgcccagcucgacgagcugauggcgcaccugaccgagaugcaggccaagguggccgugcgcgccgacgcgggcaagaagcaccuccccgacaagcaggaccacaaggccucccuggacagcaugcucgggggccuggagcaggagcugcaggaccuggggaucgccaccguccccaagggccacugcgccuccugccagaagcccaucgccgggaaggugauccacgcgcucggccagagcuggcaccccgagcacuucgugugcacgcacugcaaggaggagaucggcuccagccccuucuucgagcggagcgggcuggccuacugccccaacgacuaccaccagcuguucagcccccgcugcgccuacugcgccgcccccauccucgacaagguccugaccgcgaugaaccagaccuggcacccggagcacuucuucugcucccacugcggcgagguguucggggccgagggcuuccacgagaaggacaagaagcccuacugccggaaggacuuccuggccauguucucccccaagugcgggggcugcaaccgccccgugcucgagaacuaccugagcgccauggacaccgucuggcacccggagugcuucgugugcggcgacugcuucacguccuucagcaccggguccuucuucgagcuggacggccggcccuucugcgagcuccacuaccaccaccgccgggggacccugugccacggcugcggccagcccaucaccgggcgcugcaucagcgccaugggcuacaaguuccaccccgagcacuucgugugcgcguucugccugacgcagcucuccaaggggaucuuccgggagcagaacgacaagaccuacugccagccgugcuucaacaagcuguucccccuguga

SEQ ID NO: 32427 - RNA, 693 nt, Artificial Sequence
  derived and/or modified sequence opt1 from LRAT__Homo_sapiens__NP_001288574
augaagaaccccaugcuggagguggucagccuccugcuggagaagcuccugcugaucuccaacuucacccucuucagcuccggcgccgccggggaggacaagggccgcaacagcuucuacgagaccuccagcuuccaccgcggggacgugcuggaggugccgcggacgcaccugacccacuacggcaucuaccucggggacaaccgggucgcgcacaugaugcccgacauccugcuggcccucaccgacgacaugggccgcacccagaaggugguguccaacaagcggcugauccugggcgucaucgugaagguggccagcauccgcgucgacacgguggaggacuucgccuacggggccaacauccucgugaaccaccuggacgagucccugcagaagaaggcgcuccugaacgaggaggucgcccggcgcgccgagaagcugcucggcuucacccccuacagccugcuguggaacaacugcgagcacuucgugaccuacugccgguacgggacccccaucuccccgcagagcgacaaguucugcgagacggugaagaucaucauccgcgaccagcgguccguccucgccagcgcggugcugggccuggccuccaucgugugcaccgggcucgucagcuacaccacccugcccgccaucuucauccccuucuuccuguggauggccggcuga

SEQ ID NO: 32428 - RNA, 8592 nt, Artificial Sequence
  derived and/or modified sequence opt1 from LRBA__Homo_sapiens__NP_006717
auggccagcgaggacaaccgcgugcccagcccgccgcccaccggggacgacgggggcgggggcgggcgggaggagacccccacggagggcggcgcccugagccucaagcccgggcugcccauccgcggcauccggaugaaguucgccgugcugaccgggcucguggaggugggcgaggucagcaaccgcgacaucguggagaccguguucaaccugcuggucgggggccaguucgaccucgagaugaacuucaucauccaggagggcgagagcaucaacugcaugguggaccugcuggagaagugcgacaucacgugccaggccgaggugugguccauguucaccgccauccucaagaaguccauccggaaccugcaggucugcaccgagguggggcugguggagaagguccucggcaagaucgagaagguggacaacaugaucgccgaccugcugguggacaugcucgggguccuggccuccuacaaccugaccgugcgcgagcucaagcuguucuucagcaagcugcagggcgacaagggccgguggccgccccacgccgggaagcuccuguccgugcugaagcacaugccccagaaguacggccccgacgccuucuucaacuuccccggcaagagcgccgccgccaucgcccucccgcccaucgccaaguggcccuaccagaacggcuucaccuuccacacguggcugcgcauggaccccgucaacaacaucaacguggacaaggacaagcccuaccuguacugcuuccggaccuccaaggggcucggcuacagcgcccacuucgugggcgggugccugaucgucaccuccaucaagagcaagggcaagggguuccagcacugcgugaaguucgacuucaagccccagaagugguacauggugaccaucguccacaucuacaaccgcuggaagaacuccgagcugcggugcuacgugaacggcgagcucgccagcuacggggagaucacgugguucgucaacaccuccgacaccuucgacaagugcuuccugggcagcuccgagaccgcggacgccaaccgcguguucugcggccagaugacggccguguaccuguucagcgaggcccucaacgccgcgcagaucuucgccaucuaccagcuggggcugggcuacaaggggaccuucaaguucaaggccgagagcgaccucuuccuggccgagcaccacaagcugcuccuguacgacggcaagcuguccagcgccaucgcguucaccuacaacccccgggccaccgacgcccagcucugccuggaguccagccccaaggacaaccccuccaucuucguccacagcccccacgcccugaugcuccaggacgugaaggccgugcugacgcacuccauccagagcgcgaugcacuccaucgggggcguccaggugcuguucccccucuucgcccagcuggacuaccgccaguaccugagcgacgagaucgaccugaccaucugcuccacccuccuggccuucaucauggagcugcucaagaacagcaucgccaugcaggagcagaugcuggcgugcaagggcuuccuggugaucggguacucccucgagaaguccuccaagagccacgucucccgggccgugcuggagcugugccucgccuucagcaaguaccuguccaaccugcagaacggcaugccccuccugaagcagcugugcgaccacgugcuccugaaccccgccaucuggauccacacccccgccaagguccagcugaugcucuacacguaccugagcaccgaguucaucgggaccgugaacaucuacaacaccauccgccgggugggcacgguccugcucaucaugcacacccugaaguacuacuacugggcggugaacccccaggaccgcagcggcaucacccccaaggggcuggacggcccccggccgaaccagaaggagaugcucucccugcgcgccuuccugcucauguucaucaagcagcuggugaugaaggacagcggggucaaggaggacgagcugcaggccauccucaacuaccugcugaccaugcacgaggacgacaaccucauggacgugcugcagcugcucguggcccugauguccgagcaccccaacagcaugauccccgccuucgaccagcggaacggccugcgcgucaucuacaagcuccuggcguccaagagcgaggggauccgcgugcaggcccugaaggccaugggcuacuuccucaagcaccuggccccgaagcggaaggccgaggugaugcugggccacggccucuucucccugcuggcggagcgccucaugcugcagacgaaccugaucaccaugaccaccuacaacguccucuucgagauccugaucgagcagaucggcacccaggugauccacaagcagcaccccgaccccgacagcuccgugaagauccagaacccccagauccugaaggucaucgccacccuccugcggaacagcccgcagugccccgaguccauggaggugcgccgggccuuccugagcgacaugaucaagcuguucaacaacucccgcgagaaccggcgcagccugcugcagugcuccguguggcaggaguggaugcucagccugugcuacuucaaccccaagaacuccgacgagcagaagaucaccgagauggucuacgccaucuuccggauccugcucuaccacgcggugaaguacgaguggggcggguggcgcgugugggucgacacccugagcaucacccacagcaaggugacguucgagauccacaaggagaaccuggccaacaucuuccgggagcagcaggggaagguggacgaggagaucggccucugcuccagcaccuccguccaggccgccagcggcauccgccgggacaucaacguguccguggggagccagcagcccgacaccaaggacuccccggucugcccccacuucaccacgaacggcaacgagaacagcuccaucgagaagaccagcucccuggagagcgccuccaacaucgagcugcagaccaccaacacgagcuacgaggagaugaaggcggagcaggagaaccaggagcuccccgacgaggggacccuggaggagacccugaccaacgagacgcgcaacgccgacgaccucgagguguccagcgacaucaucgaggccguggccaucuccagcaacuccuucaucaccaccggcaaggacagcaugaccgucagcgaggugacggccuccaucagcucccccagcgaggaggacgcguccgagaugccggaguuccuggacaagagcaucguggaggaggaggaggacgacgacuacgucgagcugaagguggaggggucccccaccgaggaggccaaccuccccaccgagcugcaggacaacagccugucccccgccgccagcgaggccggcgagaagcucgacauguucggcaacgacgacaagcugaucuuccaggaggggaagccggugaccgagaagcagacggacaccgagacccaggacuccaaggacagcggcauccagaccaugacggcguccgggagcuccgccaugagccccgagaccaccgucucccagaucgccguggagagcgaccugggccagaugcucgaggaggggaagaaggccaccaaccugacgcgggagaccaagcugaucaacgacugccacggcuccgugagcgaggcgagcuccgagcagaagaucgccaagcucgacgucagcaacguggccaccgacaccgagcgccuggagcugaaggccucccccaacgucgaggcgccccagccgcaccggcacgugcucgagaucagccgccagcacgagcagcccggccaggggaucgcgcccgacgccgugaacggccagcggcgcgacucccgcagcacggucuuccggauccccgaguucaacuggucccagaugcaccagcgccugcugaccgaccuccuguucagcaucgagaccgacauccagauguggcggucccacagcaccaagacggugauggacuucgugaacuccagcgacaacgucaucuucgugcacaacaccauccaccugaucucccaggugauggacaacauggucauggccugcgggggcauccucccgcugcugagcgccgccaccuccgcgacccacgagcuggagaacaucgagcccacccagggccucagcaucgaggccuccgugacguuccugcagcgccugaucagccucguggacguccugaucuucgccuccagccugggguucaccgagaucgaggccgagaaguccauguccagcggcgggauccuccggcagugccugcgccuggugugcgccguggcgguccggaacugccucgagugccagcagcacucccagcugaagacccgcggcgacaaggcccugaagcccaugcacagccucaucccgcuggggaaguccgccgccaagagccccguggacaucgugaccggcggcaucucccccguccgggaccuggaccgccuccugcaggacauggacaucaaccggcugcgcgccgugguguuccgggacaucgaggacagcaagcaggcgcaguuccucgcccuggccgucguguacuucaucuccgugcugauggucagcaaguaccgcgacauccucgagccccagaacgagcggcacucccagagcugcacggagaccggguccgagaacgagaacgugagccuguccgagaucaccccggccgcguucagcacccugacgaccgccuccguggaggagagcgaguccaccagcagcgcccgccggcgcgacuccggcaucggggaggagaccgccacgggccucgggagccacgucgaggugacgccccacaccgcgccgcccggcguguccgcgggcccggacgccaucagcgagguccuguccacccugagccucgaggugaacaagucccccgagacgaagaacgaccgggggaacgaccuggacaccaaggccacccccagcguguccgucagcaagaacgugaacgugaaggacauccugcgcucccucgucaacauccccgccgacggcgugaccguggacccggcccugcugccgcccgcgugccucggggcccugggcgaccugagcgucgagcagcccgugcaguuccgguccuucgaccgcagcgugaucgucgccgccaagaaguccgccgugagcccguccacguucaacaccagcauccccaccaacgcgguguccgucgugagcagcguggacuccgcccaggccagcgacaugggcggggagucccccgggagccgcuccagcaacgccaagcuccccuccgucccgaccguggacagcgugucccaggaccccgucagcaacauguccaucacggagcggcuggagcacgcgcuggagaaggccgcgccccuccugcgcgagaucuucguggacuucgcccccuuccugagccggacccuccuggggucccacggccaggagcugcucaucgaggggaccagccuggucugcaugaaguccagcuccagcgugguggagcuggucaugcuccugugcagccaggaguggcagaacuccauccagaagaacgccggccuggcguucaucgagcucgugaacgagggccgccugcugagccagaccaugaaggaccaccucgugcgggucgccaacgaggccgaguucauccugucccgccagcgggccgaggacauccaccgccacgccgaguucgagagccugugcgcgcaguacuccgccgacaagcgggaggacgagaagaugugcgaccaccucauccgcgccgccaaguaccgggaccacgugacggccacccagcugauccagaagaucaucaacauccugaccgacaagcacggggcguggggcaacagcgccgugucccgcccgcucgaguucuggcggcuggacuacugggaggacgaccugcgccggcgccggcgcuucguccggaacccccucgggagcacccaccccgaggccacgcugaagaccgccguggagcacgugugcaucuucaagcugcgcgagaacuccaaggcgaccgacgaggacauccucgccaagggcaagcagagcauccgcucccaggcccuggggaaccagaacagcgagaacgagauccugcucgagggcgacgacgacacccuguccagcgucgacgagaaggaccuggagaaccucgccggccccgugucccugagcacgccggcccagcugguggcgcccuccgucguggugaaggggacccucagcgucaccuccagcgagcuguacuucgagguggacgaggaggaccccaacuucaagaagaucgacccgaagauccuggccuacaccgagggccuccacgggaaguggcuguucaccgagauccggagcaucuucucccgccgguaccugcuccagaacacggcccuggagaucuucauggccaaccgcguggccgucauguucaacuuccccgaccccgcgaccgugaagaagguggucaacuaccugccccgggugggcguggggaccagcuucggccucccgcagacccgccggaucucccuggccagcccccgccagcuguucaaggccuccaacaugacgcagcgguggcagcaccgcgagaucagcaacuucgaguaccucauguuccugaacaccaucgccggccgguccuacaacgaccugaaccaguaccccgucuuccccugggugaucaccaacuacgagagcgaggagcucgaccugacccugccgacgaacuuccgcgaccucuccaagcccaucggggcccugaaccccaagcgggcggccuucuucgccgagcgcuacgagagcugggaggacgaccaggugcccaaguuccacuacggcacccacuacuccaccgccagcuucguccuggccuggcuccugcggaucgagccguucaccacguacuuccugaaccuccagggcgggaaguucgaccacgcggaccgcaccuucuccagcaucucccgggccuggcgcaacagccagcgggacaccuccgacaucaaggagcugauccccgaguucuacuaccugcccgagauguucgugaacuucaacaacuacaaccugggggugauggacgacggcaccgucgugagcgacguggagcugcccccgugggccaagacguccgaggaguucguccacaucaaccgccucgcccuggagagcgaguucgugagcugccagcuccaccaguggaucgaccugaucuucggcuacaagcagcaggggcccgaggcggugcgggcccugaacgucuucuacuaccucaccuacgagggcgccgugaaccugaacuccaucaccgaccccgugcugcgcgaggccgucgaggcccagauccgcagcuucgggcagacccccucccagcuccugaucgagccgcacccgccccggggcagcgcgaugcaggucagcccccucauguucacggacaaggcccagcaggacgugaucaugguccucaaguucccgagcaacucccccgugacccacguggccgccaacacccagcccgggcuggccacccccgcggucaucacggugaccgccaaccgccuguucgccgugaacaaguggcacaaccucccggcccaccagggcgccguccaggaccagcccuaccagcugcccguggagaucgacccgcugaucgcgagcaacaccggcaugcaccggcgccagaucaccgaccuccuggaccaguccauccagguccacagccagugcuucgugaucacguccgacaaccgguacauccuggugugcggguucugggacaagagcuuccgcgucuacuccaccgacaccggccggcucauccaggugguguucgggcacugggacgucgugaccugccuggcccgcagcgaguccuacaucggcggcaacugcuacauccugagcgggucccgggacgccacgcuccugcugugguacuggaacggcaagugcagcgggaucggcgacaaccccggguccgagaccgccgcgccccgcgccauccucaccggccacgacuacgaggugaccugcgccgccgucugcgccgagcugggccuggugcucagcgggagccaggagggccccugccugauccacuccaugaacggggaccugcuccggacgcuggagggcccggagaacugccugaagcccaagcucauccaggcgagccgcgaggggcacugcgugaucuucuacgagaacggccuguucugcaccuucuccgucaacggcaagcugcaggccaccauggagaccgacgacaacauccgggccauccagcucagccgcgacgggcaguaccugcugacgggcggggaccggggcgugguggucgugcgccagguguccgaccucaagcagcuguucgccuaccccgggugcgacgccggcauccgggcgauggcccugagcuacgaccagcgcugcaucaucuccggcauggccagcggguccaucguccucuucuacaacgacuucaaccgguggcaccacgaguaccagacccgcuacuga

SEQ ID NO: 32429 - RNA, 2292 nt, Artificial Sequence
  derived and/or modified sequence opt1 from LRCH1__Homo_sapiens__NP_001157683
auggccacccccggcagcgagccccagcccuucgugcccgcccuguccgucgcgacccuccacccccugcaccacccgcaccaccaccaccaccaccaccagcaccacgggggcacgggggcccccggcggggccggcggcgggggcgggggcagcgggggcuucaaccugccccucaaccgcggccuggagcgggcccuggaggaggccgcgaacuccgggggccucaaccugagcgcccgcaagcugaaggaguucccccggaccgccgccccggggcacgaccucuccgacaccgugcaggcggaccugagcaagaaccgccugguggagguccccauggagcucugccacuucgugucccuggagauccugaaccucuaccacaacugcauccgggugauccccgaggccaucgucaaccugcagaugcugaccuaccucaaccugagccgcaaccagcuguccgcccuccccgccugccugugcggccugccgcucaaggugcugaucgccagcaacaacaagcugggcucccuccccgaggagaucgggcagcugaagcagcugauggagcucgacgugagcugcaacgagaucacggcgcugccccagcagaucggccagcugaagucccuccgggagcugaacguccgccggaacuaccugaaggugcucccccaggagcugguggaccugccgcucgucaaguucgacuucagcugcaacaaggugcuggugauccccaucugcuuccgcgagaugaagcagcugcagguccuccugcuggagaacaacccccuccaguccccgcccgcccagaucugcaccaaggggaaggugcacaucuucaaguaccugagcauccaggccugccagaucaagaccgccgacucccuguaccuccacaccauggagcggccccaccuccaccagcacguggaggacggcaagaaggacagcgacuccggggucggcagcgacaacggcgacaagcgccugagcgccacggagcccuccgacgaggacaccgugagccugaacgugcccauguccaacaucauggaggaggagcagaucaucaaggaggacagcugccaccggcuguccccggucaagggggaguuccaccaggaguuccagcccgagcccagccugcugggcgacuccaccaacagcggggaggagcgcgaccaguucaccgaccgggcggacggccuccacuccgaguucaugaacuacaaggcccgcgccgaggacugcgaggagcugcugcggaucgaggaggacgugcacuggcagacggaggggaucaucagcuccagcaaggaccaggacauggacaucgccaugaucgagcagcuccgcgaggccguggaccugcugcaggaccccaacggccucuccaccgacaucaccgagcggagcguccugaaccuguacccgaugggcuccgcggaggcccucgagcugcaggacagcgcccugaacgggcagauccagcucgagaccucccccgugugcgagguccagagcgaccugacgcugcaguccaacggcagccaguacagccccaacgagauccgcgagaacuccccggccgugagccccaccaccaacuccaccgcccccuucgggcucaagccccggagcgacccggcgcugauccugccgcccaucuccuucaacacgcucacccaggcccagaccugggacagcuccagcuacuccgugcccagcgagggcgacuccgacaacgucuuccugcgcccccagcgcaaccuggagagcaucgacccccaguucaccauccggcgcaagauggagcagaugcgggaggagaaggagcucguggagcagcugcgcgaguccaucgagaugcggcugaaggugagccuccacgaggaccugggggccgcccugauggacggcgucgugcucugccaccuggugaaccacauccgcccccgguccgucgcgagcauccacgugcccuccccggccgugcccaagcugagcauggccaagugccgccggaacgucgagaacuuccucgaggccugccgcaagcugggcgugcccgaggccgaccugugcagccccugcgacauccuccagcuggacuuccggcacauccgcaagacgguggacacccugcucgcgcugggggagaaggccccgccgcccaccuccgcccugcggagccgcgaccucaucggcuucugccugguccacauccuguucaucgugcucguguacaucaccuaccacuggaacgcccuguccgccuga

SEQ ID NO: 32430 - RNA, 2052 nt, Artificial Sequence
  derived and/or modified sequence opt1 from LRCH4__Homo_sapiens__NP_002310
auggccgccgcgguggccgcgccccuggccgccggcggggaggaggccgccgccaccaccagcguccccggcucccccgggcuccccggccgccggagcgccgagcgcgcgcuggaggaggccguggccacggggacccugaaccucuccaaccggcgccugaagcacuucccccggggcgccgcccgcagcuacgaccuguccgacaucacccaggcggaccucagccggaaccgcuucccggaggugcccgaggccgccugccagcuggucucccuggagggccucagccuguaccacaacugccugcggugccucaaccccgcccuggggaaccugaccgcccucacguaccugaaccugucccgcaaccagcucagccugcugcccccguacaucugccagcucccccugcgggugcugaucguguccaacaacaagcucggcgcgcugccgcccgacaucgggacccugggcagccuccgccagcuggacgucuccagcaacgagcugcagucccuccccagcgagcugugcgggcuguccagccuccgggaccugaacgugcgccggaaccagcuguccacccuccccgaggagcugggcgaccugccccucgugcgccuggacuucagcugcaaccgggucagccgcauccccguguccuucugccggcugcgccaccuccaggugauccugcuggacagcaacccgcuccaguccccgcccgcccaggucugccugaagggcaagcugcacaucuucaaguaccucagcaccgaggccgggcagcggggcuccgcccugggggaccuggcccccagccgcccgcccuccuucagccccugccccgcggaggaccuguuccccggccaccgcuacgacggcgggcucgacuccggcuuccacagcguggacuccgggagcaagcggugguccggcaacgagagcacggacgaguucuccgagcugagcuuccgcaucuccgagcuggcccgggagccccgcgggccccgggagcgcaaggaggacggcagcgccgacggcgaccccgugcagaucgacuucaucgacucccacgucccgggggaggacgaggagcggggcaccguggaggagcagcgcccgcccgagcucagccccggggccggcgaccgggagcgcgcccccagcucccggcgcgaggagcccgcgggggaggagcggcgccggcccgacacccugcagcuguggcaggagcgcgagcggcgccagcagcagcagagcggcgccuggggcgccccgcggaaggacucccuccugaagcccgggcugcgcgccguggucggcggggcggccgccgugagcacccaggccaugcacaacggcucccccaagagcuccgccagccaggcgggggccgccgccggccagggcgcccccgcgccggcccccgccucccaggagccccuccccaucgccgggccggccacggcgcccgcgccccgcccccugggcagcauccagcggccgaacuccuuccuguuccgcagcuccagccaguccgggagcggccccuccagccccgacagcgugcuccggccccgccgguacccgcagguccccgacgagaaggaccugaugacccagcugcgccaggugcucgagucccggcugcagcgcccccugcccgaggaccucgccgaggcccuggccagcggcgugauccugugccagcucgccaaccagcugcggccgcgcuccguccccuucauccacgugcccagcccggccguccccaagcuguccgcccucaaggcccggaagaacguggagagcuuccuggaggcgugccgcaagaugggggugcccgaggccgaccugugcucccccagcgaccuccugcagggcaccgcccgggggcugcgcaccgcccucgaggccgucaagcgggugggcgggaaggcgcugccgccccuguggccgcccuccggccucggcggguucguggucuucuacguggugcugaugcugcuccuguacgucacguacacccgccugcucggcagcuga

SEQ ID NO: 32431 - RNA, 2370 nt, Artificial Sequence
  derived and/or modified sequence opt1 from LRFN2__Homo_sapiens__NP_065788
auggagacccugcucggcgggcugcuggccuucggcauggccuucgcgguggucgacgccugccccaaguacugcgugugccagaaccucagcgagucccuggggacccugugccccagcaagggccuccuguucgugccgcccgacaucgaccgccggacggucgagcugcgccucgggggcaacuucaucauccacaucucccggcaggacuucgccaacaugaccggccugguggaccugacccucagccgcaacaccaucucccacauccagcccuucagcuuccuggaccuggagucccuccggagccugcaccuggacuccaaccgccuccccagccugggggaggacacgcugcggggccucgugaaccugcagcaccugaucgucaacaacaaccagcucgggggcaucgccgacgaggccuucgaggacuuccugcugacccucgaggaccuggaccuguccuacaacaaccuccacgggcugcccugggacagcgugcgccggauggugaaccugcaccagcucucccuggaccacaaccugcucgaccacaucgcggagggcaccuucgccgaccugcagaagcuggcccgccucgaccugaccagcaaccggcugcagaagcucccgcccgaccccaucuucgcccgcucccaggcgagcgcccugacggccacccccuucgccccgccccuguccuucagcuucggcgggaacccccuccacugcaacugcgagcugcuguggcuccggcgccuggagcgggacgacgaccuggagaccugcggcucccccgggggccugaagggccgcuacuucuggcacguccgggaggaggaguucgugugcgagccgccccucaucacccagcacacgcacaagcugcuggugcucgaggggcaggccgcgacccugaagugcaaggccaucggcgaccccagcccccugauccacugggucgcccccgacgaccgccucguggggaacagcucccggaccgccguguacgacaacggcacccuggacaucuucaucacgaccagccaggacuccggggccuucacgugcaucgcggccaacgccgccggcgaggccaccgcgauggucgaggugagcaucgugcagcugccccaccucuccaacagcaccucccgcaccgccccgcccaagagccggcuguccgacaucaccggcagcuccaagaccagccgcgggggcgggggcuccgggggcggcgagccgcccaagagcccgcccgagcgcgccguccugguguccgaggugacgaccaccagcgcccucgucaagugguccgugagcaaguccgcgccccgggugaagauguaccagcugcaguacaacugcagcgacgacgagguccugaucuaccgcaugauccccgccagcaacaaggccuucguggucaacaaccucguguccgggaccggcuacgaccugugcgugcuggccaugugggacgacacggccaccacccucaccgcgacgaacaucgucgggugcgcccaguucuucaccaaggccgacuacccccagugccagagcaugcacucccagauccugggcgggaccaugauccuggugaucggcggcaucaucguggccacccuccuggucuucaucgugauccugauggugcgguacaaggucugcaaccacgaggcccccagcaagauggcggccgccguguccaacguguacagccagacgaacggggcccagcccccgccgcccuccagcgcccccgcgggcgccccgccccaggggccgcccaaggucguggugcgcaacgagcuccuggacuucaccgccucccuggcccgggccagcgacuccagcuccagcuccagccucggcuccggcgaggcggccgggcugggccgcgcccccuggcggaucccgcccagcgcgccccgccccaagcccagccuggaccggcucaugggggccuucgccucccuggaccucaagagccagcgcaaggaggagcugcuggacucccggacccccgccggccgcggggccggcaccagcgcccggggccaccacuccgaccgcgagccccugcucgggccgcccgcggcccgggcccgcagccugcugccccucccccuggagggcaaggccaagcggucccacagcuucgacaugggggacuucgccgcggccgccgccggcggggucgugcccggcggcuacuccccgccccgcaaggugagcaacaucuggaccaagcggucccugagcgucaacgggaugcuccugcccuucgaggaguccgaccuggugggcgcccgcgggacguucggcagcuccgagugggugauggagagcaccgucuga

SEQ ID NO: 32432 - RNA, 2160 nt, Artificial Sequence
  derived and/or modified sequence opt1 from LRFN5__Homo_sapiens__NP_689660
auggagaagauccuguucuaccucuuccugaucggcaucgccgugaaggcccagaucugccccaagcgcugcgucugccagauccugagcccgaaccucgcgacccugugcgccaagaaggggcuccucuucgugccgcccaacaucgaccggcgcaccguggagcugcggcuggccgacaacuucgucacgaacaucaagcgcaaggacuucgccaacaugaccucccucguggaccugacccugagccggaacaccaucuccuucaucacgccccacgccuucgcggaccuccgcaaccugcgggcccugcaccucaacagcaaccgccugaccaagaucaccaacgacauguucuccggccugagcaaccuccaccaccugauccugaacaacaaccagcucacccugaucuccagcacggccuucgacgacguguucgcccuggaggagcucgaccuguccuacaacaaccuggagaccauccccugggacgcggucgagaagauggugagccuccacacccugucccuggaccacaacaugaucgacaacauccccaaggggaccuucagccaccuccacaagaugacgcggcuggacgugaccuccaacaagcugcagaagcucccgcccgacccccuguuccagcgcgcccagguccuggccaccagcggcaucaucucccccagcaccuucgcccucuccuucgggggcaacccccugcacugcaacugcgagcugcucuggcugcggcgccugagccgggaggacgaccucgagacgugcgccuccccgccccugcugaccggccgcuacuucuggagcauccccgaggaggaguuccucugcgagccgccccugaucacccggcacacccacgagaugcgcgugcuggaggggcagcgggcgacgcuccgcugcaaggcccggggcgaccccgagcccgccauccacuggaucagccccgaggggaagcugaucuccaacgccacccgcagccugguguacgacaacggcacccuggacauccucaucaccacggucaaggacaccggggccuucacgugcaucgcguccaaccccgccggcgaggccacccagaucguggaccugcacaucaucaagcugccgcaccuccugaacagcaccaaccacauccacgagcccgaccccggcuccagcgacaucuccaccagcaccaaguccgggagcaacaccuccagcuccaacggcgacacgaagcugagccaggacaagaucguggucgccgaggccaccuccagcaccgcgcuccugaaguucaacuuccagcggaacauccccgggauccgcauguuccagauccaguacaacggcaccuacgacgacacgcugguguaccgcaugaucccgcccaccuccaagaccuuccucgugaacaaccuggccgccggcaccauguacgaccugugcguccucgccaucuacgacgacgggaucaccagccugacggccacccggguggugggcugcauccaguucaccaccgagcaggacuacguccgcugccacuucaugcagucccaguuccucgggggcacgaugaucaucaucaucgggggcaucaucguggcgagcgugcuggucuucaucaucauccugaugauccgguacaaggugugcaacaacaacggccagcacaaggucaccaaggugagcaacguguacucccagaccaacggggcccagauccagggcugcagcgucacccugccccaguccgugagcaagcaggccguggggcacgaggagaacgcccagugcugcaaggcgacguccgacaacgucauccagagcuccgagaccugcagcucccaggacagcuccaccaccacgagcgcccugcccccguccuggaccagcuccaccagcgugucccagaagcagaagcgcaagaccggcacgaagcccagcaccgagccccagaacgaggccgugaccaacgucgagagccagaacaccaaccggaacaacuccacggcccugcagcuggccagccgcccgcccgacuccgugaccgaggggcccaccagcaagcgggcgcacaucaagcccaacgcccuccugaccaacguggaccagaucguccaggagacgcagcgccuggagcucaucuga

SEQ ID NO: 32433 - RNA, 1044 nt, Artificial Sequence
  derived and/or modified sequence opt1 from LRG1__Homo_sapiens__NP_443204
augagcuccuggagccgccagcggcccaaguccccgggcgggauccagccccacgugagccgcacccuguuccuccugcugcuccuggccgccuccgcguggggcgucacccugagccccaaggacugccagguguuccgguccgaccacgggagcuccaucagcugccagcccccggccgagauccccggcuaccuccccgccgacacggugcaccuggccgucgaguucuucaaccugacccaccuccccgccaaccugcugcagggggcguccaagcuccaggagcugcaccugagcuccaacggccucgagagccuguccccggaguuccugcgccccgugccccagcuccgggugcuggaccugacccgcaacgcccucaccggccugcccccggggcuguuccaggccagcgccacgcucgacacccugguccugaaggagaaccagcucgaggugcuggagguguccuggcugcacggccucaaggcgcuggggcaccuggaccucagcggcaaccggcugcgcaagcugccgcccgggcuccuggccaacuucacccugcuccggacccuggaccugggcgagaaccagcucgagacgcugccgcccgaccugcuccgcggcccccugcagcuggagcggcuccaccuggaggggaacaagcugcagguccugggcaaggaccuccugcugccccagcccgaccuccgcuaccuguuccugaacgggaacaagcucgcccggguggccgccggcgcguuccagggccugcgccagcuggacaugcucgaccuguccaacaacagccuggccagcgugcccgaggggcucugggccucccugggccagcccaacugggacaugcgggacggguucgacaucagcggcaaccccuggaucugcgaccagaaccuguccgaccucuaccgcuggcugcaggcccagaaggacaagauguucagccagaacgacacccggugcgccgggcccgaggcggucaagggccagacccugcucgccguggccaagucccaguga

SEQ ID NO: 32434 - RNA, 2478 nt, Artificial Sequence
  derived and/or modified sequence opt1 from LRGUK__Homo_sapiens__NP_653249
auggccaccagcgagcgcgcccugcuccggacccgcgcggccucccugcugcggggccucgggcgcagccggacgggcgcccgcucccugcaguuccgggccgagaaggagcgccagcccugcuggagcuuccccauggggcagaagaccaagggcuccagcaacaucgccuccagcuaccugcuccagcagcugaugcaccgguaccaggagcuggacuccgacggggacgaggaccagggcgagggcgaggcggggagcgaggaguccagcgaguccgagaugcucaaccuggaggaggaguucgacggcgugcugcgcgaggaggccgucgccaaggcccuccaccaccuggggcggagcggcuccgggaccgagcaggucuaccugaaccucacccugagcggcugcaaccugaucgacguguccauccucugcggcuacgugcaccuccagaagcuggaccugagcgcgaacaagaucgaggaccuguccugcgugagcugcaugcccuaccugcucgagcugaacgccagccagaacaaccugacgaccuucuucaacuucaagccgcccaagaaccucaagaaggccgacuucucccacaaccagaucagcgagaucugcgaccuguccgccuaccacgcccugaccaagcucauccuggacgggaacgagaucgaggagaucagcggccuggagaugugcaacaaccucauccaccugucccuggcgaacaacaagaucaccacgaucaacgggcucaacaagcugcccaucaagauccugugccucagcaacaaccagaucgagaugaucaccggccuggaggaccugaaggcccuccagaaccuggaccugucccacaaccagaucagcucccuccagggccuggagaaccacgaccugcucgaggugaucaaccuggaggacaacaagaucgccgagcugcgcgagaucgaguacaucaagaaccugcccauccuccggguccugaaccugcucgagaaccccauccaggagaaguccgaguacugguucuucgugaucuucaugcugcugcgccucaccgagcuggaccagaagaagaucaagguggaggagaaggucagcgccgugaacaaguacgacccgccgcccgagguggucgccgcgcaggaccaccugacccacguggugaacagcgucaugcagccccagcggaucuucgacuccacgcuccccagccuggacgcccccuaccccaugcugauccucgccgggcccgaggccugcggcaagcgcgagcuggcccaccggcugugccgccaguucuccaccuacuuccgguacggggcgugccacaccacccggcccccguacuucggcgagggggaccgcguggacuaccacuucaucagccaggacguguucgacgagauggucaacaugggcaaguucauccucacguucuccuacggcaaccacaaguacgggcugaaccgcgacaccguggagggcaucgcccgcgacgggcuggccagcugcauccacauggagaucgagggcgugcggucccucaaguacagcuacuucgagccccgcuacauccuggucgugcccaugaacaaggagaaguacgagggguaccugcggcgcaagggccucuucagccgggccgagaucgaguucgccgugucccgcgucgaccuguacaucaagaucaaccagaacuuccccggcuacuucgacgaggugaucaacgcggacgaccuggacgucgccuaccagaagcucagccagcugauccgggaguaccuggggcucaccgaggagccggccaagucccuggccaccacggcggacgugaagaccagccaccugaagcccgaggcccaccccaccaaguacaucuccagcaacaugggcgacuuccuccacuccaccgaccgcaacuaccugaucaaguucugggccaagcugagcgccaagaagacgcccgccgagcgggacuccauccaccgccagcacgaggcggcccggcaggcccucauggggcgcauccggccggaccacacccugcuguuccagcgcggccccgugcccgcgccccucaccagcgggcugcacuacuacaccacgcuggaggagcucuggaaguccuucgaccugugcgaggacuacuucaagccgcccuucggccccuacccggagaaguccggcaaggacagccuggucagcaugaagugcucccucuuccgguucugccccuggagcaaggagcugcccuuccagcccccggagggguccaucagcagccaccugggcuccggggccagcgacuccgagaccgaggagacccgcaaggcccuccccauccagagcuucucccacgagaaggagagccaccagcaccggcagcacuccgugcccgugaucagccgccccggcuccaacgucaagccgacccugccgcccaucccccagggccggcgcuga

SEQ ID NO: 32435 - RNA, 2229 nt, Artificial Sequence
  derived and/or modified sequence opt1 from LRIF1__Homo_sapiens__XP_011540070
auguaccagguggugcagaccaucggcagcgacgggaagaaccugcuccagcugcugcccaucccgaaguccagcggcaaccucaucccccuggugcaguccagcgugauguccgacgcccugaaggggaacaccggcaagcccguccaggugaccuuccagacccagaucagcuccagcuccaccagcgccuccgugcagcuccccaucuuccagccggcgagcuccagcaacuacuuccugacccgcacggucgacaccuccgagaaggggcgggugaccagcgugggcaccggcaacuucuccagcuccgucagcaaggugcagagccacggggugaagaucgacggccugacgaugcagaccuucgccgucccgcccuccacccagaaggacagcuccuucaucguggugaacacccagagccuccccgucacggugaagucccccgugcugcccagcgggcaccaccuccagauccccgcccacgccgaggucaaguccgugcccgccagcucccugccgcccagcgugcagcagaagauccuggcgaccgccaccaccuccacgagcggcauggucgaggccucccagaugcccaccgugaucuacgugagccccgucaacaccgugaagaacgucgugaccaagaacuuccagaacaucuacccgaagcccgugacggagaucgccaagcccgucauccugaacaccacccagauccccaagaacguggcgaccgagacgcagcucaagggcgggcagcacucccaggccgccccggugaaguggaucuuccaggacaaccugcagcccuucacccccagccugguccccgugaaguccagcaacaacguggccuccaagauccucaagaccuucgucgaccgcaagaaccugggcgacaacaccaucaacaugccgccccugagcacgaucgaccccagcgggacccgguccaagaacaugcccaucaaggacaacgcccucgugauguucaacggcaagguguaccugcuggcgaagaaggggaccgacguccucccgagccagaucgaccagcagaacuccgugagccccgacacccccgugcgcaaggacacgcugcagaccgucuccagcuccccggugaccgagaucagccgggagguggucaacaucgugcuggccaaguccaagagcucccagauggagaccaagagccucuccaacacgcagcuggccagcauggccaaccugcgcgccgagaagaacaagguggagaagcccucccccagcaccaccaacccccacaugaaccaguccagcaacuaccucaagcagagcaagacccuguucaccaacccgaucuuccccgucggcuucuccacgggccacaacgcgccccggaaggugaccgccgugaucuacgcccgcaaggggagcguccugcaguccaucgagaagaucagcuccagcguggacgccaccaccgugacgucccagcagugcgucuuccgggaccaggagcccaagauccacaacgagauggccagcaccuccgacaagggcgcgcaggggcgcaacgacaagaaggacagccagggccgguccaacaaggcccuccaccucaagagcgacgccgaguucaagaagaucuucgggcugaccaaggaccugcgcgugugccugacccggaucccggaccaccugacguccggcgagggcuucgacagcuucuccagccucgugaaguccgggaccuacaaggagaccgaguucauggucaaggagggcgagcgcaagcagcagaacuucgacaagaagcggaaggccaagaccaacaagaagauggaccacaucaagaagcgcaagacggagaacgccuacaacgcgaucaucaacggggaggccaacgugaccggcagccagcugcuguccagcauccuccccaccagcgacgugucccagcacaacauccugaccagccacuccaagacgcggcaggagaagcgcaccgagauggaguacuacacccacgagaagcaggagaaggggacccugaacagcaacgccgccuacgagcagucccacuucuucaacaagaacuacacggaggacaucuuccccgucacgcccccggagcucgaggagaccauccgggacgagaagauccgccggcugaagcagguccugcgcgagaaggaggcggcccucgaggagaugcgcaagaagaugcaccagaaguga

SEQ ID NO: 32436 - RNA, 3282 nt, Artificial Sequence
  derived and/or modified sequence opt1 from LRIG1__Homo_sapiens__NP_056356
auggcccgccccgugcggggcgggcugggcgccccgcgccggagccccugccuccugcugcucuggcugcugcuccugcgccuggagcccgucaccgcggccgccgggccccgggccccgugcgccgcggccugcacgugcgccggcgacucccucgacugcgggggccgcggccuggccgcgcugcccggggaccuccccagcuggacccggucccugaaccugagcuacaacaagcucuccgagaucgaccccgccggcuucgaggaccugccgaaccugcaggagguguaccucaacaacaacgagcugaccgccgugcccagccugggggccgccuccagccacgucgugucccucuuccugcagcacaacaagauccgcagcguggagggcucccagcugaaggcguaccucagccuggagguccuggaccucucccugaacaacaucaccgaggugcggaacacgugcuucccccacgggcccccgaucaaggagcugaaccucgccggcaaccgcaucggcacccuggagcugggggccuucgacggccucagccggucccugcugacccuccgccugagcaagaaccggaucacccagcugcccgugcgcgccuucaagcucccccggcugacccagcuggaccucaaccgcaaccggauccgccugaucgaggggcugacguuccagggccucaacucccuggagguccugaagcuccagcggaacaacaucagcaagcugaccgacggcgccuucugggggcuguccaagaugcacgugcugcaccucgaguacaacagccugguggaggucaacagcggcucccuguacgggcucaccgcgcugcaccagcugcaccucagcaacaacuccaucgcccgcauccaccggaagggcuggagcuucugccagaagcugcacgagcuggugcucuccuucaacaaccugacccgccuggacgaggagagccucgccgagcuguccagccuguccgugcuccgccugagccacaacuccaucagccacaucgccgagggggccuucaagggccugcggucccuccgcguccuggaccuggaccacaacgagaucagcggcacgaucgaggacaccuccggggcguucagcggccucgacucccugagcaagcugacccucuucgggaacaagaucaaguccguggccaagcgggccuucagcggccuggaggggcuggagcaccucaaccugggcggcaacgccauccgcagcgugcaguucgacgccuucgucaagaugaagaaccugaaggagcuccacaucuccagcgacuccuuccugugcgacugccagcugaaguggcugcccccguggcugaucgggcggaugcugcaggcguucgugaccgccacgugcgcccaccccgagagccucaagggccaguccaucuucagcgugccgcccgaguccuucgucugcgacgacuuccugaagccccagaucaucacccagcccgagaccaccauggccaugguggggaaggacauccgcuucacgugcagcgcggccuccagcuccagcucccccaugaccuucgccuggaagaaggacaacgaggugcugaccaacgccgacauggagaacuucguccacgugcacgcccaggacggcgaggucauggaguacaccacgauccuccaccuccgccaggugaccuucgggcacgagggccgguaccagugcgugaucaccaaccacuucggcagcaccuacucccacaaggcgcggcugacggucaacgugcuccccagcuucaccaagaccccgcacgacaucaccauccgcacgaccaccauggcccggcuggagugcgccgccaccgggcaccccaacccccagaucgccuggcagaaggacggcgggacggacuuccccgcggcccgcgagcggcgcaugcacgugaugccggacgacgacgucuucuucaucaccgacgugaagaucgacgacgccggcguguacuccugcaccgcccagaacagcgccggcagcaucuccgcgaacgccacccugaccguccucgagacgcccagccugguggugccccuggaggaccgggucguguccgugggggagaccgucgcccuccagugcaaggccaccggcaacccgccgccccgcaucaccugguucaagggggaccggccccugagccugacggagcgccaccaccucacccccgacaaccagcugcugguggugcagaacgucguggcggaggacgccggccgguacacgugcgagauguccaacacccucgggaccgagcgcgcccacagccagcuguccgugcugcccgccgccggcugccgcaaggacggcaccaccgucgggaucuucaccaucgcgguggugagcuccaucguccucacgagccuggugugggugugcaucaucuaccagacccggaagaaguccgaggaguacagcgucaccaacaccgacgagacgguggugccgcccgacguccccuccuaccugagcucccagggcacccucagcgaccgccaggagaccguggugcggaccgagggcgggccccaggccaacgggcacaucgaguccaacggcgucugcccccgcgacgccagccacuuccccgagccggacacgcacuccguggccugccggcagcccaagcugugcgccggcagcgcguaccacaaggagcccuggaaggccauggagaaggccgaggggacccccggcccgcacaagauggagcacgggggccgcguggucugcagcgacugcaacaccgagguggacugcuacucccgggggcaggccuuccacccccagcccgugagccgcgacuccgcccagcccagcgcgccgaacggccccgagcccggcggguccgaccaggagcacagcccccaccaccagugcucccggaccgccgccggcagcugcccggagugccaggggucccuguaccccagcaaccacgaccgcaugcucacggccgucaagaagaagcccauggcgucccuggacggcaagggggacagcuccuggacccuggcccggcucuaccacccggacagcaccgagcugcagcccgccuccagccugaccuccggcagccccgagcgcgccgaggcccaguaccuccugguguccaacggccaccuccccaaggcgugcgacgccagcccggagagcacgccccugaccgggcagcugcccggcaagcagcgggugccccugcuccuggccccgaaguccuga

SEQ ID NO: 32437 - RNA, 3180 nt, Artificial Sequence
  derived and/or modified sequence opt1 from LRIG3__Homo_sapiens__NP_001129523
augguggacguccugcuccuguucagccugugccuccuguuccacaucucccgccccgaccugagccacaaccggcucuccuucaucaaggccagcuccaugagccaccuccagucccugcgcgaggugaagcugaacaacaacgagcuggagaccaucccgaaccugggccccgugagcgccaacaucacccuccugucccuggcggggaaccggaucgucgagauccuccccgagcaccugaaggaguuccagagccuggagacgcucgaccuguccagcaacaacaucuccgagcugcagaccgccuuccccgcccuccagcugaaguaccuguaccucaacagcaaccgcgugaccuccauggagccgggcuacuucgacaaccuggccaacacccugcucgugcugaagcugaaccggaaccgcaucagcgccaucccgcccaagauguucaagcucccccagcugcagcaccuggagcucaaccggaacaagaucaagaacgucgacgggcugacguuccagggccugggggcgcucaagucccugaagaugcagcgcaacggcgugaccaagcugauggacggcgccuucugggggcucagcaacauggagauccugcagcuggaccacaacaaccucaccgagaucaccaagggcuggcuguacgggcugcucaugcugcaggagcugcaccucucccagaacgccaucaaccggaucagccccgacgccugggaguucugccagaagcugagcgagcuggaccugacguucaaccaccucucccgccuggacgacagcuccuuccugggccucagccugcugaacacccuccacaucgggaacaaccggguguccuacaucgcggacugcgccuuccgcggccugagcucccugaagacccucgaccugaagaacaacgagaucagcuggaccaucgaggacaugaacggcgccuucuccgggcuggacaagcuccggcgccugauccugcagggcaaccggauccgcagcaucacgaagaaggccuucaccgggcucgacgcccuggagcaccuggaccucuccgacaacgcgaucaugagccugcagggcaacgccuucucccagaugaagaagcugcagcagcuccaccugaacaccagcucccugcucugcgacugccagcugaaguggcugccccagugggucgccgagaacaacuuccagagcuucgugaacgccuccugcgcccacccccagcuccugaagggccggagcaucuucgcggugucccccgacggguucgucugcgacgacuucccgaagccccagaucaccgugcagcccgagacgcagagcgccaucaagggcagcaaccuguccuucaucugcagcgccgccuccagcuccgacagccccaugaccuucgccuggaagaaggacaacgagcuccugcacgacgcggagauggagaacuacgcccaccuccgcgcccagggcggcgaggugauggaguacaccaccauccugcggcugcgcgaggucgaguucgccuccgaggggaaguaccagugcgugaucagcaaccacuucggcuccagcuacuccgugaaggccaagcugacggucaacaugcucccgagcuucaccaagacccccauggaccugaccauccgggcgggcgccauggcccgccuggagugcgccgcgguggggcaccccgcgccccagaucgccuggcagaaggacggcgggacggacuucccggccgcccgcgagcggcgcaugcacgugaugcccgaggacgacgucuucuucaucguggacgugaagaucgaggacaucggcgucuacuccugcaccgcccagaacagcgccggguccaucagcgccaacgccacccucaccgugcuggagacgcccuccuuccugcggccccuccuggaccgcaccgucaccaagggcgagaccgccgugcugcagugcaucgcgggcgggagcccgccgcccaagcucaacuggacgaaggacgacagcccccugguggucaccgagcggcacuucuucgccgccggcaaccagcugcucaucaucguggacuccgacgugagcgacgccgggaaguacacgugcgagauguccaacacccugggcaccgagcgcgggaacguccggcugagcgugauccccaccccgaccugcgacagcccccagaugaccgcccccucccucgacgacgacggcugggcgaccgugggcgucgugaucaucgccguggucugcugcgugguggggacgucccuggucuggguggugaucaucuaccacacccgccggcgcaacgaggacugcagcaucaccaacaccgacgagacgaaccugcccgccgacauccccuccuaccucagcucccagggcacccuggccgaccggcaggacggguacgucagcuccgagagcggcucccaccaccaguucgugaccagcuccggcgcgggguucuuccugccccagcacgacagcuccgggaccugccacaucgacaacagcagcgaggccgacguggaggccgccacggaccucuuccugugcccguuccugggguccaccggccccauguaccucaaggggaacgucuacggcagcgaccccuucgagaccuaccacaccggcugcucccccgacccgcgcacggugcugauggaccacuacgagcccagcuacaucaagaagaaggagugcuaccccugcucccaccccagcgaggaguccugcgagcggagcuucuccaacaucagcuggccgucccacgugcgcaagcugcucaacaccagcuacucccacaacgaggggcccggcaugaagaaccugugccugaacaagagcucccucgacuucagcgccaaccccgagcccgcguccgucgccagcuccaacagcuucauggggaccuucggcaaggcccugcggcgcccgcaccuggacgccuacagcuccuucgggcagcccagcgacugccagccccgggccuucuaccucaaggcgcacuccagccccgaccuggacuccggcagcgaggaggacggcaaggagcgcaccgacuuccaggaggagaaccacaucugcacguucaagcagacccuggagaacuaccggaccccgaacuuccaguccuacgaccucgacaccuga

SEQ ID NO: 32438 - RNA, 1872 nt, Artificial Sequence
  derived and/or modified sequence opt1 from LRIT1__Homo_sapiens__NP_056428
augcgcguggcccugggcaugcucuggcugcuggcccucgcguggcccccgcaggcccggggguucugccccagccagugcuccugcagccugcacaucaugggcgacggguccaaggcccgcaccgucgugugcaacgaccccgacaugacccugcccccggccagcaucccgcccgacacgucccggcuccgccuggagcggaccgccauccgccgggugcccggcgaggcguuccgcccccuggggcggcucgagcagcuguggcugcccuacaacgcccucagcgagcugaacgcccugaugcuccgcggccugcggcgccugcgggagcuccgccugcccggcaaccggcuggccgcguuccccugggccgcccuccgcgacgccccgaagcugcggcugcucgaccugcaggccaaccgccuguccgcgguccccgccgaggccgcccgguuccucgagaaccugaccuuccuggaccucagcuccaaccagcugaugcgccugccccaggagcucaucgugagcugggcccaccuggagaccgggaucuucccgcccggccaccacccccggcgcgugcuggggcuccaggacaaccccugggcgugcgacugccgccuguacgaccugguccaccuccuggacggcugggcccccaaccuggccuucaucgagacggagcuccggugcgccuccccgcgcagccuggccgggguggcguucucccagcuggagcuccggaagugccagggccccgagcugcaccccggcguggccagcauccgcucccugcucgggggcaccgcccugcugcggugcggggccaccggcguccccggcccggagaugagcuggcgccgggccaacgggcgcccccugaacggcaccgugcaccaggagguguccagcgacgggacguccuggacccuccugggccugcccgcggucagccaccucgacagcggggacuacaucugccaggccaagaacuuccugggcgccuccgagaccgugaucagccugaucgugaccgagcccccgacguccaccgagcacagcggcucccccggggcccucugggcgcggaccggcgggggcggggaggccgccgccuacaacaacaagcuggucgcccgccacgugccccagaucccgaagcccgcggugcuggccaccggccccagcguccccuccacgaaggaggagcucacccuggagcacuuccagauggacgcccugggcgagcucagcgacgggcgggccggcccguccgaggcccgcauggugcggagcgugaaggucgugggggacaccuaccacuccgugagccuggucuggaaggcgccccaggccaagaacaccacggccuucuccgugcuguacgccgucuucggccagcacagcaugcgccgggugaucgugcagcccgggaagacccgcgucaccaucaccggccuccugcccaagacgaaguacguggccugcgugugcguccagggccuggugccgcggaaggagcagugcgugaucuucuccaccaacgaggucguggacgcggagaacacccagcagcucaucaacguggucgugaucagcguggccaucgucaucgcccugccccugacccuccuggugugcugcuccgcccugcagaagcgcugccggaagugcuucaacaaggacagcacggaggcgaccgugaccuacgucaaccucgagcgccugggguacuccgaggacggccuggaggagcucagccgccacagcguguccgaggccgaccggcugcugagcgcccgcuccagcguggacuuccaggccuucggggucaagggcggccggcgcaucaacgaguacuucugcuga

SEQ ID NO: 32439 - RNA, 2040 nt, Artificial Sequence
  derived and/or modified sequence opt1 from LRIT3__Homo_sapiens__NP_940908
augcaccuguucgccugccucugcaucgugcugagcuuccuggagggcgucgggugccucugccccucccagugcacgugcgacuaccacggccgcaacgacgggagcggcucccggcuggugcugugcaacgacauggacaugaacgagcucccgaccaaccugcccguggacaccgucaagcugcgcaucgagaagaccgugauccggcgcaucagcgccgaggcguucuacuaccucguggagcugcaguaccugugggucaccuacaacuccguggccagcaucgaccccuccagcuucuacaaccucaagcagcugcacgagcugcggcucgacgggaacucccuggccgccuuccccugggccagccugcucgacaugccgcugcugcgcacccucgaccugcacaacaacaagaucacguccgugcccaacgaggcgcugcgguaccucaagaaccuggccuaccuggaccucagcuccaaccgccugaccacccugccgcccgacuuccucgagagcuggacccaccuggucuccacgcccagcggcgugcuggaccucucccccagccggaucauccugggccugcaggacaaccccugguucugcgacugccacaucuccaagaugaucgagcucagcaagguggucgaccccgccaucgugcugcuggacccgcucaugaccugcagcgagcccgagcgccugaccgggauccuguuccagcgggccgagcucgagcacugccugaagcccuccgugaugaccagcgcgacgaagaucauguccgcccugggcagcaacguccuccugcgcugcgacgccaccggguuccccaccccgcagaucaccuggacgcgguccgacagcucccccgugaacuacaccgugauccaggagagccccgaggagggcguccgcugguccaucaugagccugaccgggaucuccagcaaggacgccggcgacuacaagugcaaggccaagaaccucgcgggcauguccgaggccguggugaccgucacggugcuggggaucaccaccacccccaucccgcccgacacgagcgagcggaccggcgaccaccccgagugggacgugcagcccggguccggccgcagcaccuccgucagcuccgccagcagcuaccugugguccagcuccuucagcccgaccuccagcuucuccgccagcacgcuguccccgcccagcaccgccuccuucagccucucccccuucagcuccagcaccguguccagcaccacgacccugagcaccuccaucagcgcguccaccacgauggccaacaagcggagcuuccagcugcaccagggcgggaagcgcaaccucaaggucgccaagaacggcuccaagcugccgcccgccagcaccuccaagaaggaggagcuggcccuccuggaccagaccaugcugaccgagaccaacgcggccaucgagaaccuccggguggugagcgagacgaaggaguccgucacccugaccuggaacaugaucaacaccacgcacaacagcgccgugaccgugcuguacuccaaguacgggggcaaggaccuccugcugcucaacgccgacagcuccaagaaccaggucaccaucgacgggcuggagcccggcggccaguacauggccugcgugugccccaagggggugccgccccagaaggaccagugcaucaccuucagcacggagcgcgucgagggcgacgacucccaguggagccugcuccugguggugaccuccaccgcgugcgucgugauccugccccucaucugcuuccugcuguacaaggugugcaagcuccagugcaagagcgagcccuucugggaggacgaccuggccaaggagaccuacauccaguucgagacgcuguucccccggucccagagcgucggggagcucuggacccgcagccaccgcgacgacuccgagaagcugcugcucugcagccgguccagcguggagucccaggugaccuucaagagcgagggcucccgccccgaguacuacugcuga

SEQ ID NO: 32440 - RNA, 1500 nt, Artificial Sequence
  derived and/or modified sequence opt1 from LRMP__Homo_sapiens__NP_006143
augaacgacgaccccagcauggaggagaacggcguggagcgcgucugccccgagucccugcuccagagccgggaguacuccagccugccccugccccgccacaccuccagcaccgacgggacgaucaccuccagcgaccccggccucgagauccugaacauggccuccugcgaccuggaccggaacagccucugcaagaaggaggaggacacccgcuccgccagcccgaccaucgaggcgcaggggacgucccccgcccacgacaacaucgccuuccaggacagcaccuccaaggacaagaccauccugaaccuggaggccaaggaggagcccgagaccaucgaggagcacaagaaggagcacgccagcggcgacuccguggugagcccccucccggucacgaccgugaaguccgugaaccugcggcagagcgagaacaccagcgcgaacgagaaggaggucgaggccgaguuccugcgccucucccugggguucaagugcgacugguucacccuggagaagcgggugaagcucgaggagcgcagccgggaccuggccgaggagaaccugaagaaggagaucacgaacugccucaagcugcuggagucccucacgccccugugcgaggacgacaaccaggcccaggagaucaucaagaagcuggagaaguccaucaaguuccucagccagugcgcggcccgcguggccagccgggccgagaugcugggcgccaucaaccaggagucccgcgucagcaaggcgguggaggugaugauccagcacgucgagaaccugaagcggauguacgccaaggagcacgccgagcucgaggagcugaagcagguccugcuccagaacgagcgcuccuucaacccccuggaggacgacgacgacugccagaucaagaagcggagcgccucccugaacagcaagcccuccagccuccgccgggugaccaucgccucccugccgcgcaacaucggcaacgcggggaugguggccggcauggagaacaacgaccgguucagccgccgguccagcuccuggcgcauccuggggagcaagcagagcgagcaccgccccucccucccccgguucaucagcaccuacuccugggccgacgccgaggaggagaagugcgagcugaagaccaaggacgacagcgagcccuccggcgaggagaccguggagcgcacccggaagccgagccuguccgagaagaagaacaaccccagcaagugggacguguccagcgucuacgacaccaucgccuccugggcgacgaaccucaagagcuccauccgcaaggccaacaaggcccuguggcugagcaucgccuucaucguccucuucgccgcgcugauguccuuccugaccgggcagcuguuccagaaguccguggacgccgcccccacccagcaggaggacagcuggaccagccucgagcacauccuguggcccuucacgcggcuccgccacaacggcccgccgcccguguga

SEQ ID NO: 32441 - RNA, 2142 nt, Artificial Sequence
  derived and/or modified sequence opt1 from LRP10__Homo_sapiens__NP_054764
augcugcucgccacccugcugcuccugcugcucggcggggcccuggcgcaccccgaccgcaucaucuucccgaaccacgccugcgaggacccccccgccgugcugcucgagguccagggcacccugcagcggccccuggugcgcgacagccggacguccccggccaacugcaccuggcucauccuggggagcaaggagcagaccgugaccauccgcuuccagaagcugcaccucgccugcggcuccgagcggcugacgcugcgcagcccccuccagccccugaucucccugugcgaggcgcccccgagcccccuccagcugcccgggggcaacgucaccaucaccuacuccuacgccggcgcccgggcccccauggggcagggcuuccugcucagcuacucccaggacuggcugaugugccugcaggaggaguuccagugccucaaccaccgcugcgugagcgcggugcagcggugcgacggggucgacgccugcggcgacggguccgacgaggccggcugcagcuccgacccguuccccggccugaccccccgccccgugccgagccugcccugcaacgugacgcucgaggacuucuacggggucuucuccagccccggcuacacccaccuggccuccgugagccacccccaguccugccacuggcugcucgacccgcacgacgggcggcgccuggccgugcgguucaccgcgcuggaccucggcuucggcgacgccguccacguguacgacgggcccggcccccccgagagcagccgccugcugcggucccucacccacuucagcaacgggaaggccgugacggucgagacccuguccggccaggccguggugagcuaccacaccgucgccugguccaacgggcgcggcuucaacgcgaccuaccacgugcggggcuacugccugccgugggaccgccccugcgggcucggcagcgggcugggcgccggggagggccugggcgagcggugcuacuccgaggcccagcgcugcgacgggagcugggacugcgccgacggcacggacgaggaggacugccccgggugccccccgggccacuuccccugcggggccgcgggcaccuccggcgccaccgccugcuaccuccccgccgaccggugcaacuaccagaccuucugcgccgacggggcggacgagcgccgcugccggcacugccagccgggcaacuuccgcugccgggacgagaagugcguguacgagacgugggucugcgacgggcagcccgacugcgccgacggcagcgacgagugggacugcuccuacgugcugccccgcaaggugaucaccgccgccgucaucggcagccuggugugcgggcuccugcuggucaucgcgcugggcugcaccugcaagcucuacgccauccggacccaggaguacuccaucuucgccccccugagccgcauggaggccgagaucgugcagcagcaggccccgcccuccuacgggcagcugaucgcgcagggcgccaucccccccguggaggacuucccgacggagaaccccaacgacaacagcguccucgggaaccugcggucccugcuccagauccugcgccaggacaugacccccggcggcgggcccggcgcccggcgccggcagcgcgggcggcugaugcgccggcucgugcgccggcugcgccgguggggccugcucccgcgcaccaacacccccgcccgcgccagcgaggcgcggucccaggugacgcccagcgccgccccccuggaggcccuggacgggggcaccggcccggcccgcgaggggggcgcggucgggggccaggacggggagcaggcccccccccuccccaucaaggccccgcugcccagcgccuccaccagccccgcgcccaccacggugccggaggcccccggcccccugccgucccucccccuggagcccagccugcucuccggcgugguccaggcccugcgggggcgccugcuccccagccugggcccgcccgggcccacccggucccccccgggcccccacaccgccgugcuggcccucgaggacgaggacgacgugcugcuggucccccucgcggagcccgggguguggguggccgaggccgaggacgagccgcugcugaccuga

SEQ ID NO: 32442 - RNA, 2523 nt, Artificial Sequence
  derived and/or modified sequence opt1 from LRP12__Homo_sapiens__NP_001129175
auggccugccgcuggagcaccaaggagagcccccgguggcgcuccgcccugcuccugcuguuccucgcgggcguguacgccugcggggagaccccggagcagauccgggcccccuccggcaucaucacgagccccggguggcccuccgaguacccggccaagaucaacugcagcugguucauccgcgccaaccccggcgagaucaucaccaucuccuuccaggacuucgacauccaggggagccggcgcugcaaccuggacuggcugaccaucgagaccuacaagaacaucgaguccuaccgggcgugcggcagcacgaucccgccgcccuacaucuccagccaggaccacaucuggauccgcuuccacuccgacgacaacaucagccggaagggcuuccgccucgccuacuucuccggcaagagcgaggagcccaacugcgccugcgaccaguuccggugcggcaacgggaagugcauccccgaggccuggaagugcaacaacauggacgagugcggcgacuccagcgacgaggagaucugcgcgaaggaggccaacccgcccaccgccgccgccuuccagcccugcgcguacaaccaguuccagugccugucccgcuucaccaaggucuacacgugccugcccgagagccucaagugcgacgggaacaucgacugccuggaccugggcgacgagaucgacugcgacgugcccacgugcggccaguggcucaaguacuucuacgggaccuucaacagccccaacuaccccgacuucuacccgcccggcuccaacugcaccuggcugaucgacaccggggaccaccggaaggugauccugcgcuucaccgacuucaagcucgacgggaccggcuacggggacuacgucaagaucuacgacggccuggaggagaacccccacaagcugcuccgggugcugaccgccuucgacagccacgcgccccugaccguggucuccagcuccgggcagauccgcgugcacuucugcgccgacaaggugaacgccgcccggggcuucaacgccacguaccaggucgacggguucugccuccccugggagauccccugcggcggcaacugggggugcuacaccgagcagcagcgcugcgacggcuacuggcacugcccgaacgggcgggacgagaccaacugcaccaugugccagaaggaggaguuccccugcagccgcaacggcgugugcuacccccgguccgaccgcugcaacuaccagaaccacugccccaacgggagcgacgagaagaacugcuucuucugccagccgggcaacuuccacugcaagaacaaccgcugcguguucgaguccugggucugcgacagccaggacgacugcggcgacggguccgacgaggagaacugccccgugaucgugcccacgcgggucaucaccgccgccgugaucggcagccugaucugcgggcugcuccuggugaucgcccugggcugcacgugcaagcucuacucccugcgcauguucgagcggcgcagcuucgagacccagcugucccgggucgaggcggagcuccugcgccgggaggccccgcccagcuacgggcagcugaucgcccagggccucaucccgcccguggaggacuuccccgugugcucccccaaccaggccagcguccuggagaaccugcgccucgccgugcggucccagcugggcuucaccagcgugcgccugcccauggcggggcggagcuccaacaucuggaaccgcaucuucaacuucgcccggagccgccacuccggcagccucgcccuggucuccgccgacggggacgaggugguccccagccaguccaccagccgggagccggagcgcaaccacacccaccggucccuguucagcguggaguccgacgacaccgacacggagaacgagcgccgggacauggcgggcgccagcggcgggguggccgcgccccucccccagaaggugcccccgaccaccgccgucgaggccaccgugggcgccugcgccuccagcuccacgcagagcacccgcgggggccacgccgacaacgggcgcgacgucaccuccguggagccgcccagcgugagccccgcccggcaccagcugaccuccgcgcugagccgcaugacgcagggccuccgguggguccgcuucacccugggccgguccagcucccugagccagaaccagagcccccuccgccagcuggacaacgggguguccggccgggaggacgacgacgacguggagaugcugauccccaucuccgacgggagcuccgacuucgacgucaacgacugcagccgcccccugcucgaccuggccuccgaccagggccaggggcugcggcagcccuacaacgccaccaacccgggcgugcgccccagcaaccgggacggccccugcgagcgcugcgggaucgugcacaccgcccagauccccgacacgugccucgaggucacccugaagaacgagaccuccgacgacgaggcccugcuccugugcuga

SEQ ID NO: 32443 - RNA, 13800 nt, Artificial Sequence
  derived and/or modified sequence opt1 from LRP1B__Homo_sapiens__NP_061027
augagcgaguuccugcucgcccugcugacccucagcggccugcugcccaucgcccgcgugcucaccgucggcgcggaccgggaccagcagcugugcgaccccggcgaguuccugugccacgaccacgugaccugcgugagccaguccuggcucugcgacggcgaccccgacugccccgacgacagcgacgagucccuggacacgugccccgaggaggucgagaucaagugcccccugaaccacaucgccugccucggcaccaacaagugcgugcaccugagccagcugugcaacggggugcucgacugccccgacggcuacgacgagggcguccacugccaggagcugcuguccaacugccagcagcucaacugccaguacaagugcaccauggugcgcaacagcacccggugcuacugcgaggacggguucgagaucaccgaggacggccgcuccugcaaggaccaggacgagugcgccguguacgggaccugcagccagaccugccggaacacccacggcuccuacacgugcagcugcgucgagggguaccugaugcagcccgacaaccgcuccugcaaggccaagaucgagcccaccgaccggccgcccauccugcucaucgccaacuucgagaccaucgagguguucuaccugaacggcagcaagauggcgacccuguccagcgugaacggcaacgagauccacacccucgacuucaucuacaacgaggacaugaucugcuggaucgagucccgcgagagcuccaaccagcugaagugcauccagaucaccaaggccgggggccugaccgacgaguggaccaucaacauccuccagagcuuccacaacguccagcagauggccaucgacuggcugacccggaaccuguacuucguggaccacgugggggaccgcaucuucgucugcaacagcaacggcuccgugugcgugacccucaucgaccuggagcugcacaaccccaaggccaucgcggucgaccccaucgccggcaagcuguucuucaccgacuacgggaacguggccaagguggagcggugcgacauggacggcaugaaccgcacgcggaucaucgacagcaagaccgagcagccggccgcccuggcgcuggaccucgucaacaagcugguguacuggguggaccuguaccucgacuacgucgggguggucgacuaccagggcaagaaccgccacaccgugauccaggggcggcagguccgccaccuguacggcaucaccgucuucgaggacuaccuguacgccacgaacuccgacaacuacaacaucgugcggaucaaccgcuucaacggcaccgacauccacagccucaucaagaucgagaacgccugggggauccggaucuaccagaagcgcacccagcccaccgugcggucccacgccugcgaggucgaccccuacggcaugcccgggggcugcagccacaucugccugcuguccagcuccuacaagacgcggaccugccgcugccgcaccggguucaaccucggcagcgacggccgcuccugcaagcggccgaagaacgagcuguuccuguucuacgggaagggccgccccgggaucgugcggggcauggaccucaacaccaagaucgccgacgaguacaugauccccaucgagaaccuggugaacccccgcgcgcuggacuuccacgccgagacgaacuacaucuacuucgccgacaccaccagcuuccugaucgggcggcagaagaucgacggcaccgagcgcgagacgauccucaaggacgaccuggacaacgucgagggcaucgccguggacuggaucgggaacaaccuguacuggaccaacgacggccaccggaagaccaucaacguggcccgccucgagaaggcgucccagagccggaagacccugcuggagggggagaugucccacccgcgcggcaucgucguggaccccgugaacggcuggauguacuggaccgacugggaggaggacgagaucgacgacagcgucgggcggaucgagaaggccuggauggacggcuucaaccgccagaucuucgugacguccaagaugcucuggcccaacgggcugacccuggacuuccacaccaacacccucuacuggugcgacgccuacuacgaccacaucgagaagguguuccugaacggcacgcaccggaagaucgucuacagcgggcgcgagcugaaccaccccuucggccucucccaccacggcaacuacguguucuggaccgacuacaugaacgggagcaucuuccagcuggaccugaucaccagcgaggugacccuccugcggcacgagcgcccgccccuguucggccuccagaucuacgacccccggaagcagcagggggacaacaugugccgcgucaacaacggcgggugcuccacgcugugccuggccauccccggcggccgcgugugcgccugcgcggacaaccagcuccuggacgagaacgggacgaccugcaccuucaacccgggcgaggcccugccccacaucugcaaggccggggaguuccggugcaagaaccgccacugcauccaggcccgguggaagugcgacggcgacgacgacugccucgacgggagcgacgaggacuccgugaacugcuucaaccacagcugccccgacgaccaguucaagugccagaacaaccgcugcaucccgaagcgguggcugugcgacggcgcgaacgacugcggcuccaacgaggacgagagcaaccagacgugcaccgcccggaccugccaggucgaccaguucuccugcgggaacggccggugcaucccccgcgccuggcugugcgaccgggaggacgacugcggggaccagaccgacgagauggccagcugcgaguuccccacgugcgagccccucacccaguucgugugcaaguccggccgcugcaucagcuccaaguggcacugcgacagcgacgacgacugcggggacggcuccgacgaggugggcugcguccacagcugcuucgacaaccaguuccggugcuccagcgggcgcugcaucccgggccacugggccugcgacggggacaacgacugcggcgacuucuccgacgaggcgcagaucaacugcaccaaggaggagauccacagccccgccggcugcaacgggaacgaguuccagugccaccccgacggcaacugcgugcccgaccuguggcggugcgacggggagaaggacugcgaggacggcagcgacgagaaggggugcaacggcaccauccgccugugcgaccacaagacgaaguucuccugcuggagcaccggccggugcaucaacaaggccugggugugcgacggggacaucgacugcgaggaccaguccgacgaggacgacugcgacagcuuccucugcggcccgcccaagcaccccugcgccaacgacaccuccgucugccugcagcccgagaagcugugcaacgggaagaaggacugcccggacggcagcgacgagggguaccucugcgacgagugcucccugaacaacggcggcugcagcaaccacugcuccguggugcccgggcgcggcaucgucugcagcugccccgaggggcugcagcucaacaaggacaacaagaccugcgagaucguggacuacugcuccaaccaccugaagugcagccaggugugcgagcagcacaagcacacggucaagugcuccugcuacgagggcuggaagcuggacguggacggggagagcugcaccuccguggaccccuucgaggccuucaucaucuucagcauccggcacgagauccgccggaucgaccuccacaagcgcgacuacucccugcuggucccgggccuccggaacaccaucgcgcuggacuuccacuucaaccagagccugcucuacuggaccgacgugguggaggaccgcaucuaccgcggcaagcuguccgagagcgggggcgucagcgccaucgaggugguggucgagcacgggcuggccacgcccgagggccucaccguggacuggaucgccggcaacaucuacuggaucgacuccaaccuggaccagaucgagguggccaagcuggacgggagccuccggaccacccugaucgcgggcgccauggagcacccccgcgccaucgcccuggacccccgguacgggauccucuucuggacggacugggacgcgaacuucccgcgcaucgaguccgccagcauguccggcgccgggcggaagaccaucuacaaggacaugaagaccggcgccuggcccaacggccugaccgucgaccacuucgagaagcgcaucguguggacggacgcccggagcgacgcgaucuacuccgcccuguacgacgggaccaacaugaucgagaucauccgcggccacgaguaccucagccaccccuucgccgugucccuguacgggagcgaggucuacuggaccgacuggcggaccaacacccuguccaaggccaacaaguggacgggccagaacgugagcgucauccagaagaccuccgcccagcccuucgaccuccagaucuaccacccgagccgccagccccaggcgcccaacccgugcgccgccaacgacgggaagggccccugcucccacaugugccugaucaaccacaaccggagcgccgccugcgcgugcccccaccugaugaagcucuccagcgacaagaagaccugcuacgagaugaagaaguuccugcuguacgcccgccgguccgagauccgcggcguggacaucgacaaccccuacuucaacuucaucaccgccuucacggugccggacaucgacgacgucaccgugaucgacuucgacgccagcgaggagcggcucuacuggaccgacaucaagacccagacgaucaagcgcgcguucaucaacgggaccggccuggagaccgugaucagccgggacauccaguccauccgcgggcuggccgucgacugggugagccggaaccucuacuggaucuccagcgaguucgacgagacccagaucaacguggcccgccuggacggcucccugaagacgagcaucauccacgggaucgacaagccccagugccucgccgcccaccccguccgcggcaagcuguacuggaccgacggcaacaccaucaacauggcgaacauggacggguccaacagcaagauccuguuccagaaccagaaggagcccgugggccucuccaucgacuacguggagaacaagcuguacuggaucagcuccgggaacggcaccaucaaccggugcaaccuggacgggggcaaccucgaggucaucgagagcaugaaggaggagcugacgaaggccaccgcccugaccaucauggacaagaagcucuggugggccgaccagaaccuggcccagcuggggaccugcuccaagcgcgacgggcggaacccgacgauccuccgcaacaagaccagcggcguggugcacaugaaggucuacgacaaggaggcgcagcagggguccaacagcugccagcugaacaacggcggcugcucccagcugugccuccccaccagcgagaccacgcggaccugcaugugcaccgugggguacuaccugcagaagaaccgcauguccugccagggcaucgagagcuuccugauguacagcgugcacgaggggauccggggcaucccccucgagcccuccgacaagauggacgcccugaugccgaucagcgggaccuccuucgccgucggcaucgacuuccacgccgagaacgacacgaucuacuggaccgacaugggcuucaacaagaucagccgcgccaagcgggaccagaccuggaaggaggacaucaucaccaacgggcugggccgcguggaggggaucgcgguggacuggaucgccggcaacaucuacuggacggaccacggguucaaccucaucgaggucgcccggcugaacggcuccuuccgcuacgugaucaucagccagggccuggaccagccccgguccaucgccgugcaccccgagaaggggcuccuguucuggaccgaguggggccagaugcccugcaucgggaaggcccgccuggacggcagcgagaaggucgugcugguguccauggggaucgcguggccgaacggcaucagcaucgacuacgaggagaacaagcucuacuggugcgacgcccggaccgacaagaucgagcgcaucgaccuggagaccggcgggaaccgggagaugguccuguccggcagcaacguggacauguucuccguggccgucuucggggccuacaucuacuggagcgaccgcgcgcacgccaacggcuccgugcggcgcgggcacaagaacgacgccacggagaccaucaccaugcggaccggccucggcgugaaccugaaggaggucaagaucuucaaccgcgugcgcgagaaggggaccaacgugugcgcccgggacaacggcgggugcaagcagcugugccucuaccgcggcaacagccggcgcacgugcgccugcgcgcacggcuaccuggccgaggacggggugaccugccugcggcacgagggcuaccuccuguacuccgggcgcaccauccucaagagcauccaccucuccgacgagaccaaccugaacagccccauccggcccuacgagaacccccgcuacuucaagaacgugaucgcccuggccuucgacuacaaccagcggcgcaagggcacgaaccggaucuucuacagcgacgcccacuucgggaacauccagcucaucaaggacaacugggaggaccgccaggugaucgucgagaacgugggcuccguggagggccuggcguaccaccgggccugggacacccuguacuggaccagcuccaccacgagcuccaucacccgccacaccgucgaccagacccggccgggggccuucgaccgcgaggccgugaucacgaugagcgaggacgaccacccccacgugcucgcccuggacgagugccagaaccugauguucuggaccaacuggaacgagcagcaccccuccaucaugcggagcacccucaccggcaagaacgcgcaggucgugguguccacggacauccugacccccaacgggcugaccaucgacuaccgcgccgagaagcucuacuucagcgacggcucccuggggaagaucgagcggugcgaguacgacggcagccagcgccacgucaucgugaaguccggcccggggaccuuccugagccucgccguguacgacaacuacaucuucugguccgacuggggccgccgggccauccugcgcagcaacaaguacaccggcggcgacaccaagauccugcgguccgacaucccccaccagcccauggggaucaucgcggucgccaacgacaccaacagcugcgagcucucccccugcgcccugcugaacggcggcugccacgaccucugccugcugaccccgaacgggcgcgugaacugcagcugccggggcgaccgcauccuccuggaggacaaccggugcgucacgaagaacagcuccugcaacgccuacagcgaguucgagugcgggaacggcgagugcaucgacuaccagcugaccugcgacggcaucccccacugcaaggacaaguccgacgagaagcuccuguacugcgagaaccgcagcugccggcgcggguucaagcccugcuacaaccggcgcugcaucccgcacggcaagcugugcgacggggagaacgacugcggcgacaacuccgacgagcucgacugcaagguguccacgugcgccaccguggaguuccggugcgcggacgggaccugcaucccccgcuccgcccggugcaaccagaacaucgacugcgccgacgccagcgacgagaagaacugcaacaacaccgacugcacccacuucuacaagcugggcgucaagaccacgggcuucauccgcugcaacuccaccagccugugcgugcuccccaccuggaucugcgacggguccaacgacugcggcgacuacagcgacgagcugaagugccccgugcagaacaagcacaagugcgaggagaacuacuucuccugcccgagcgggcggugcauccugaacaccuggaucugcgacggccagaaggacugcgaggacgggcgcgacgaguuccacugcgacuccagcugcuccuggaaccaguucgccugcagcgcgcagaagugcaucagcaagcacuggaucugcgacggcgaggacgacugcggcgacgggcucgacgaguccgacagcaucugcggcgccaucacgugcgccgccgacauguucuccugccaggggagccgggccugcgucccccgccacuggcugugcgacggcgagcgggacugccccgacggguccgacgagcugagcaccgcgggcugcgcccccaacaacacgugcgacgagaacgccuucaugugccacaacaaggugugcaucccgaagcaguucgugugcgaccacgacgacgacugcggcgacggguccgacgagagcccccagugcggcuaccgccagugcgggaccgaggaguucuccugcgccgacggccgcugccuccugaacacgcaguggcagugcgacggggacuucgacugccccgaccacagcgacgaggcgccccugaacccgaagugcaaguccgccgagcagagcugcaacuccagcuucuucaugugcaagaacggccggugcauccccuccggcgggcucugcgacaacaaggacgacugcggcgacgggagcgacgagcgcaacugccacaucaacgagugccuguccaagaaggucagcggcugcucccaggacugccaggaccugcccgugagcuacaagugcaagugcuggcccggcuuccagcucaaggacgacgggaagaccugcguggacaucgacgagugcagcuccggcuucccgugcagccagcagugcaucaacaccuacgggaccuacaagugccugugcaccgacggcuacgagauccagcccgacaaccccaacgggugcaagucccugagcgacgaggagcccuuccucauccuggccgaccaccacgagauccggaagaucuccacggacggcagcaacuacacccugcucaagcagggccugaacaacgucaucgccaucgacuucgacuaccgcgaggaguucaucuacuggaucgacuccagccggccgaacgggucccgcaucaaccggaugugccugaacggcagcgacaucaagguggugcacaacaccgccguccccaacgcgcucgccguggacuggaucgggaagaaccuguacugguccgacaccgagaagcgcaucaucgaggugagcaagcugaacggccucuaccccacgauccuggucuccaagcggcugaaguucccccgcgaccucagccuggacccgcaggccggguaccuguacuggaucgacugcugcgaguacccccacaucggccgggugggcauggacgggaccaaccaguccguggucaucgagaccaagaucagccgccccauggcccucaccaucgacuacgugaaccggcgccuguacugggccgacgagaaccacaucgaguucuccaacauggacggcagccaccggcacaaggugcccaaccaggacaucccgggggucaucgcgcugacccucuucgaggacuacaucuacuggaccgacggcaagaccaagucccugagccgcgcccacaagaccagcggggccgaccggcugucccucaucuacagcuggcacgccaucacggacauccagguguaccacuccuaccgccagcccgacgugagcaagcaccugugcaugaucaacaacggcggcugcucccaccugugccuccuggcccccgggaagacccacacgugcgcgugcccgaccaacuucuaccuggccgccgacaaccggacgugccucagcaacugcaccgccucccaguuccgcugcaagaccgacaagugcauccccuucugguggaagugcgacaccgucgacgacugcggcgacgggagcgacgagcccgacgacugccccgaguuccgcugccagccgggccgguuccagugcggcacggggcugugcgcccugcccgcguucaucugcgacggcgagaacgacugcggggacaacuccgacgagcucaacugcgacacccacgugugccugagcggccaguucaagugcaccaagaaccagaagugcauccccgugaaccugcgcugcaacgggcaggacgacugcggcgacgaggaggacgagcgggacugccccgagaacuccugcagcccggacuacuuccagugcaagaccacgaagcacugcaucuccaagcucugggucugcgacgaggaccccgacugcgccgacgccagcgacgaggccaacugcgacaagaagaccugcggcccccacgaguuccagugcaagaacaacaacugcauccccgaccacuggcgcugcgacucccagaacgacugcagcgacaacuccgacgaggagaacugcaagccgcagaccugcacccugaaggacuuccugugcgcgaacggggacugcgugagcucccgguucuggugcgacggcgacuucgacugcgccgacgggagcgacgagcgcaacugcgagacgagcugcuccaaggaccaguuccggugcagcaacggccagugcauccccgccaaguggaagugcgacgggcacgaggacugcaaguacggcgaggacgagaaguccugcgagcccgccagcccgaccugcuccagccgcgaguacaucugcgccuccgacggcugcaucagcgcgucccucaagugcaacggggaguacgacugcgccgacggcagcgacgagauggacugcgugaccgagugcaaggaggaccaguuccggugcaagaacaaggcccacugcaucccgauccgcuggcugugcgacgggauccacgacugcgucgacggcuccgacgaggagaacugcgagcgcggcggcaacaucugccgcgccgacgaguuccugugcaacaacagccugugcaagcuccacuucugggugugcgacggcgaggacgacugcggggacaacuccgacgaggcccccgacaugugcgugaaguuccugugccccagcacccggccccaccgcugccggaacaaccgcaucugccugcaguccgagcagaugugcaacggcaucgacgagugcggggacaacagcgacgaggaccacugcggcgggaagcucacguacaaggcgcggccgugcaagaaggacgaguucgccugcuccaacaagaagugcauccccauggaccugcagugcgaccgccuggacgacugcggcgacggcagcgacgagcaggggugccggaucgcccccaccgaguacacgugcgaggacaacgucaaccccugcggcgacgacgccuacugcaaccagaucaagaccuccguguucugccgcugcaagccgggguuccagcggaacaugaagaaccgccagugcgaggaccucaacgagugccugguguucggcacgugcagccaccagugcaucaacgucgagggcagcuacaagugcgugugcgaccagaacuuccaggagcgcaacaacacgugcaucgccgagggguccgaggaccaggugcuguacaucgcgaacgacaccgacauccucggcuucaucuaccccuucaacuacagcggggaccaccagcagaucucccacaucgagcacaacagccggaucaccggcauggacgucuacuaccagcgcgacaugaucaucugguccacccaguucaaccccgggggcaucuucuacaagcggauccacggccgcgagaagcggcaggccaacagcgggcugaucugcccggaguucaagcgcccccgggacaucgccguggacuggguggccggcaacaucuacuggacggaccacucccgcaugcacugguucagcuacuacaccacccacuggaccucccugcgguacagcaucaacgucgggcagcucaacggccccaacugcacgcgccugcugaccaacauggcgggggagcccuacgccaucgccgugaacccgaagcggggcaugauguacuggaccguggucggcgaccacucccacaucgaggaggccgccauggacgggacccuccgccggauccuggugcagaagaaccugcagcgccccacgggccucgcgguggacuacuucagcgagcggaucuacugggccgacuucgagcuguccaucaucgggagcguccuguacgacggcuccaacagcguggucuccgugagcuccaagcaggggcuccugcacccccaccgcaucgacaucuucgaggacuacaucuacggcgccggccccaagaacgggguguuccggguccagaaguucggccacgggagcguggaguaccuggcccucaacaucgacaagaccaagggcgugcugaucagccaccgcuacaagcagcuggaccucccgaaccccugccuggaccuggccugcgaguuccucugccugcugaaccccuccggcgcgaccugcgucugccccgaggggaaguaccucaucaacgggaccugcaacgacgacagccugcuggacgacuccugcaagcucacgugcgagaacgggggccggugcauccugaacgagaagggggaccugcgcugccacugcuggccgagcuacuccggcgagcgcugcgaggugaaccacugcagcaacuacugccagaacggcgggaccugcgugcccuccguccucggccggccgaccugcagcugcgcccugggguucaccggccccaacugcgggaagacggugugcgaggacuucugccagaacggcgggaccugcaucgugaccgccgggaaccagccguacugccacugccagcccgaguacaccggcgaccgcugccaguacuacgucugccaccacuacugcgugaacuccgagagcugcacgaucggggacgacggcuccguggagugcgucugccccacccgguacgaggggcccaagugcgagguggacaagugcgugcgcugccacggcggccacugcaucaucaacaaggacagcgaggacaucuucugcaacugcaccaacgggaagaucgccuccagcugccagcugugcgacggcuacugcuacaacggcgggaccugccagcucgacccggagacgaacguccccgugugccugugcuccaccaacuggagcgggacccagugcgagcggcccgcccccaaguccagcaagagcgaccacaucuccacccgcagcaucgcgaucaucgugccgcugguccuccuggugacgcugaucaccacccucgugaucgggcugguccugugcaagcggaagcgccggaccaagacgauccgccggcagcccaucaucaacggcgggaucaacguggagaucggcaaccccuccuacaacauguacgagguggaccacgaccacaacgacgggggccuccuggaccccggcuucaugaucgacccgaccaaggcccgcuacaucgggggcgggcccagcgccuucaagcugccccacaccgccccgcccaucuaccucaacuccgaccugaagggcccccugaccgcggggcccacgaacuacagcaacccggucuacgccaagcucuacauggacggccagaacugccggaacucccugggcagcguggacgagcgcaaggagcugcuccccaagaagaucgagaucgggauccgggagaccguggccuga

SEQ ID NO: 32444 - RNA, 13635 nt, Artificial Sequence
  derived and/or modified sequence opt1 from LRP1__Homo_sapiens__NP_002323
augcugacgcccccgcuccugcugcuccugccccugcucagcgcccugguggccgccgccaucgacgcccccaagaccugcucccccaagcaguucgccugccgcgaccagaucacgugcaucagcaagggcuggcgcugcgacggcgagcgcgacugccccgacggcuccgacgaggcccccgagaucugcccccagagcaaggcccagcggugccagcccaacgagcacaacugccuggggaccgagcugugcguccccaugucccgccugugcaacggcgugcaggacugcauggacgggagcgacgagggcccccacugccgggagcugcagggcaacugcucccgccucgggugccagcaccacugcgugcccacccuggacggcccgaccugcuacugcaacagcuccuuccagcugcaggccgacgggaagaccugcaaggacuucgacgagugcagcgucuacgggaccugcucccagcucugcaccaacaccgacgggagcuucaucugcggcugcguggagggcuaccugcugcagcccgacaaccgguccugcaaggccaagaacgagcccguggaccggccgcccguccuccugaucgccaacagccagaacauccuggccaccuaccucuccggggcccaggugagcaccaucacccccaccuccacccggcagaccaccgccauggacuucagcuacgccaacgagaccgugugcuggguccacgugggcgacuccgccgcgcagacccagcugaagugcgcccgcaugcccgggcugaagggcuucguggacgagcacaccaucaacaucagccucagccugcaccacgucgagcagauggccaucgacuggcugaccggcaacuucuacuucguggacgacaucgacgaccggaucuucgugugcaaccgcaacggggacacgugcgucacccuccuggaccuggagcucuacaaccccaagggcaucgcccuggaccccgccauggggaagguguucuucaccgacuacggccagauccccaagguggagcggugcgacauggacgggcagaaccgcaccaagcuggucgacuccaagaucguguucccccacggcaucacccucgaccuggugagccggcuggucuacugggcggacgccuaccucgacuacaucgaggugguggacuacgagggcaaggggcgccagaccaucauccagggcauccugaucgagcaccuguacgggcucaccgucuucgagaacuaccuguacgccaccaacuccgacaacgccaacgcccagcagaagaccagcgugauccgggucaaccgcuucaacuccacggaguaccagguggugacccgggucgacaagggcggggcgcugcacaucuaccaccagcgccggcagccccgcgugcgcagccacgccugcgagaacgaccaguacggcaagcccggcgggugcuccgacaucugccuccuggccaacagccacaaggcccggaccugccgcugccgguccggcuucagccugggguccgacggcaagagcugcaagaagcccgagcacgagcuguuccugguguacgggaagggccgccccggcaucauccgggggauggacaugggcgccaagguccccgacgagcacaugauccccaucgagaaccugaugaacccccgcgcgcucgacuuccacgccgagaccggguucaucuacuucgccgacacgaccuccuaccugaucggccggcagaagaucgacggcaccgagcgcgagaccauccugaaggacgggauccacaacguggagggcguggccgucgacuggaugggggacaaccuguacuggacggacgacggccccaagaagaccaucagcguggcgcggcucgagaaggccgcccagacccgcaagacccugaucgaggggaagaugacccacccccgggccaucguggucgacccccugaacggcuggauguacuggacggacugggaggaggaccccaaggacucccgccggggccgccucgagcgggccuggauggacgggagccaccgcgacaucuucgugaccuccaagaccgugcuguggcccaacggccugagccucgacauccccgcggggcggcuguacugggucgacgccuucuacgaccgcaucgagaccauccugcucaacggcacggaccggaagaucguguacgaggggcccgagcugaaccacgccuucggccugugccaccacggcaacuaccucuucuggaccgaguaccgcuccgggagcguguaccgccuggagcggggcgucgggggcgcgccgcccaccgugacccugcuccgcagcgagcggcccccgaucuucgagauccgcauguacgacgcccagcagcagcaggucgggacgaacaagugccgggucaacaacggcggcugcuccagccugugccuggcgacccccgggucccgccagugcgccugcgccgaggaccaggugcucgacgccgacggcgugaccugccuggccaaccccagcuacgugcccccgccccagugccagcccggggaguucgcgugcgccaacucccggugcauccaggagcgcuggaagugcgacggcgacaacgacugccuggacaacagcgacgaggcccccgcccucugccaccagcacacgugccccuccgaccgguucaagugcgagaacaaccgcugcauccccaaccgguggcugugcgacggggacaacgacugcggcaacagcgaggacgaguccaacgcgacgugcagcgcccggaccugcccgcccaaccaguucuccugcgccagcggccgcugcauccccaucuccuggaccugcgaccuggacgacgacugcggggaccgcagcgacgaguccgccagcugcgccuacccgaccugcuucccccucacgcaguucacgugcaacaacggccggugcaucaacaucaacuggcgcugcgacaacgacaacgacugcggggacaacuccgacgaggcgggcugcagccacagcugcuccagcacccaguucaagugcaacuccggccggugcauccccgagcacuggaccugcgacggggacaacgacugcggcgacuacagcgacgagacgcacgccaacugcaccaaccaggccacccgcccgcccgggggcugccacaccgacgaguuccagugccggcuggacgggcugugcaucccccuccgcuggcggugcgacggcgacacggacugcauggacuccagcgacgagaaguccugcgagggcgugacccacgugugcgacccgagcgucaaguucgggugcaaggacuccgcccgcugcaucagcaaggccugggugugcgacggcgacaacgacugcgaggacaacuccgacgaggagaacugcgagagccuggcgugccggccgcccucccaccccugcgccaacaacaccagcgugugccugccgcccgacaagcucugcgacgggaacgacgacugcggcgacggguccgacgagggcgagcugugcgaccagugcagccugaacaacggcgggugcucccacaacugcagcgucgcccccggcgaggggaucgugugcuccugcccccucggcauggagcuggggccggacaaccacacgugccagauccagagcuacugcgccaagcaccugaagugcagccagaagugcgaccagaacaaguucuccgugaagugcagcugcuacgagggcuggguccucgagcccgacggcgaguccugccggagccuggaccccuucaagcccuucaucaucuucuccaaccgccacgagauccggcgcaucgaccugcacaagggggacuacagcgugcucgugccgggccugcggaacacgaucgcccuggacuuccaccucucccagagcgcgcuguacuggaccgacgucguggaggacaagaucuaccgcgggaagcugcucgacaacggcgcccugaccuccuucgagguggucauccaguacggccuggccacccccgaggggcucgccguggacuggaucgcgggcaacaucuacuggguggagagcaaccuggaccagaucgaggucgccaagcuggacgggacgcuccggaccacccugcuggccggcgacaucgagcacccccgcgccaucgcccucgacccccgggacgggauccuguucuggaccgacugggacgcgucccugccgcgcaucgaggccgccagcauguccggcgccggccggcgcacggugcaccgggagaccgggagcggcggguggcccaacggccucaccguggacuaccuggagaagcgcauccuguggaucgacgcccgguccgacgcgaucuacagcgcccgcuacgacggguccggccacauggagguccuccggggccacgaguuccugagccaccccuucgccgugacccuguacgggggcgagguguacuggaccgacuggcgcacgaacacccucgccaaggccaacaaguggaccgggcacaacgucaccguggugcagcggacgaacacccagcccuucgaccugcaggucuaccacccgucccgccagcccauggcgcccaaccccugcgaggccaacggcgggcagggcccgugcagccaccugugccucaucaacuacaaccgcaccgugagcugcgccugcccccaccugaugaagcugcacaaggacaacaccacgugcuacgaguucaagaaguuccuccuguacgcccggcagauggagauccgcggcgucgaccuggacgcccccuacuacaacuacaucaucuccuucaccgugcccgacaucgacaacgugaccguccucgacuacgacgcgcgggagcagcgcguguacuggagcgacgugcggacccaggccaucaagcgcgccuucaucaacgggacgggcgucgagaccgugguguccgccgaccugccgaacgcgcacgggcuggccgucgacugggugagccggaaccucuucuggaccuccuacgacaccaacaagaagcagaucaacguggcccgccuggacggcagcuucaagaacgccgucgugcaggggcuggagcagccccacggccucgugguccacccccugcggggcaagcuguacuggacggacggggacaacaucuccauggccaacauggacggcagcaaccgcacccuccuguucuccgggcagaagggcccggugggccuggcgaucgacuuccccgagagcaagcucuacuggaucuccagcgggaaccacaccaucaaccggugcaaccuggacggcuccgggcuggaggugaucgacgccaugcgcagccagcucggcaaggccaccgcccuggccaucaugggggacaagcuguggugggcggaccaggucuccgagaagaugggcacgugcagcaaggccgacggcuccgggagcguggugcuccggaacuccaccacccuggucaugcacaugaagguguacgacgagagcauccagcuggaccacaagggcaccaaccccugcagcgugaacaacggggacugcucccagcucugccugcccacgagcgagaccacccgcuccugcaugugcaccgccggcuacagccugcgguccgggcagcaggccugcgagggcgucggcagcuuccugcucuacuccgugcacgaggggauccgcggcaucccgcuggaccccaacgacaagagcgacgcccuggugcccgucuccgggacgagccucgcggugggcaucgacuuccacgccgagaacgacaccaucuacuggguggacauggggcuguccaccaucagccgggccaagcgcgaccagaccuggcgggaggacgucgugacgaacggcaucggccgcguggaggggaucgccgucgacuggaucgcgggcaacaucuacuggaccgaccagggguucgacgugaucgagguggcccggcugaacggcuccuuccgcuacgucgugaucagccaggggcucgacaagccccgcgccaucaccgugcacccggagaagggcuaccuguucuggaccgaguggggccaguacccccggaucgagcgcucccggcuggacgggacggagcgcgucgugcucgugaacgucagcaucuccuggcccaacggcaucagcguggacuaccaggacgggaagcuguacuggugcgacgcccggaccgacaagaucgagcgcaucgaccuggagaccggcgagaaccgggaggugguccucuccagcaacaacauggacauguucagcguguccguguucgaggacuucaucuacuggagcgaccgcacccacgccaacggcuccaucaagcgggggagcaaggacaacgcgaccgacuccgucccccugcgcacgggcaucggggugcagcugaaggacaucaagguguucaaccgggaccgccagaagggcaccaacgucugcgccguggccaacgggggcugccagcagcucugccuguaccggggccgcgggcagcgggccugcgccugcgcgcacggcaugcuggccgaggacggggccagcugccgcgaguacgccggcuaccuccuguacuccgagcggaccauccucaaguccauccaccucuccgacgagcgcaaccugaacgccccgguccagcccuucgaggaccccgagcacaugaagaacgugaucgcgcuggccuucgacuaccgggccgggaccagccccggcacgccgaaccgcaucuucuucuccgacauccacuucggcaacauccagcagaucaacgacgacgggagccgccggaucaccaucguggagaacgucggcuccguggaggggcucgccuaccaccgcggcugggacacccuguacuggaccagcuacacgaccuccaccaucacccggcacacgguggaccagacccgccccggggcguucgagcgggagaccgucaucaccaugagcggcgacgaccacccccgcgccuucgugcuggacgagugccagaaccucauguucuggacgaacuggaacgagcagcaccccuccaucaugcgggccgcccugagcggcgccaacgugcugacccucaucgagaaggacauccgcaccccgaacgggcuggcgaucgaccaccgggccgagaagcuguacuucuccgacgccacccucgacaagaucgagcgcugcgaguacgacggcagccaccgguacgucauccucaagagcgagcccgugcaccccuucgggcuggccguguacggcgagcacaucuucuggacggacuggguccgccgggccgugcagcgcgcgaacaagcacgugggcuccaacaugaagcuccugcgggucgacaucccccagcagccgauggggaucaucgccguggccaacgacaccaacagcugcgagcugucccccugccgcaucaacaacggcgggugccaggaccucugccugcugacccaccagggccacgugaacugcagcugccgcggcggccgcauccuccaggacgaccugaccugccgggccgucaacuccagcugccgcgcccaggacgaguucgagugcgcgaacggcgagugcaucaacuucucccugacgugcgacggggugccccacugcaaggacaagagcgacgagaagcccuccuacugcaacagccggcgcugcaagaagaccuuccgccagugcuccaacggccggugcgugagcaacaugcucuggugcaacggggccgacgacugcggcgacggguccgacgagaucccgugcaacaagaccgccugcggcgucggcgaguuccgcugccgggacgggaccugcaucggcaacagcucccgcugcaaccaguucguggacugcgaggacgccagcgacgagaugaacugcuccgccacggacugcagcagcuacuuccggcugggggugaagggcguccuguuccagcccugcgagcgcaccucccucugcuacgcgcccagcugggugugcgacggggccaacgacugcggcgacuacuccgacgagcgggacugcccgggcgugaagcgcccccggugcccccugaacuacuucgccugccccagcgggcgcugcaucccgauguccuggaccugcgacaaggaggacgacugcgagcacggcgaggacgagacccacugcaacaaguucugcagcgaggcccaguucgagugccagaaccaccggugcaucuccaagcaguggcugugcgacgggagcgacgacugcggcgacggguccgacgaggcggcccacugcgagggcaagacgugcggccccagcuccuucagcugccccgggacccacgucugcgugcccgagcgcuggcucugcgacggcgacaaggacugcgccgacggggccgacgaguccaucgccgcgggcugccuguacaacuccacgugcgacgaccgggaguucaugugccagaaccgccagugcaucccgaagcacuucgugugcgaccacgaccgggacugcgccgacggcuccgacgagagccccgagugcgaguacccgaccugcgggcccuccgaguuccgcugcgccaacggccggugccugagcucccgccagugggagugcgacggggagaacgacugccacgaccagagcgacgaggccccgaagaacccccacugcaccagccaggagcacaagugcaacgccuccagccaguuccucugcuccagcggccggugcgucgcggaggcccugcugugcaacgggcaggacgacugcggcgacuccagcgacgagcgcggcugccacaucaacgagugccucucccgcaagcugagcgggugcucccaggacugcgaggaccugaagaucggcuucaagugccggugccgccccggguuccggcucaaggacgacggccggaccugcgccgacguggacgagugcagcaccaccuuccccugcucccagcggugcaucaacacgcacgggagcuacaagugccugugcguggagggcuacgccccgcgcggcggggacccccacuccugcaaggccgucaccgacgaggagcccuuccugaucuucgcgaaccgguacuaccuccgcaagcugaaccuggacggcagcaacuacacccuccugaagcaggggcugaacaacgccguggcccucgacuucgacuaccgggagcagaugaucuacuggaccgacgugaccacgcagggcuccaugauccgccggaugcaccugaacgggagcaacguccaggugcugcaccgcaccggccucuccaaccccgacggccuggccguggacugggucgggggcaaccuguacuggugcgacaaggggcgggacaccaucgaggugagcaagcucaacggcgcguaccgcaccgugcuggucuccagcggccugcgggagccgcgcgcccucgugguggacguccagaacggguaccuguacuggacggacuggggcgaccacagccugaucgggcggaucggcauggacggguccagccgcuccgugaucguggacaccaagaucaccuggcccaacggccucacccuggacuacgucacggagcggaucuacugggccgacgcccgcgaggacuacaucgaguucgccagccuggacggcuccaaccggcacguggugcucagccaggacaucccccacaucuucgcgcugacccuguucgaggacuacgucuacuggaccgacugggagaccaaguccaucaaccgcgcccacaagacgaccgggaccaacaagacccuccugaucagcacgcugcaccgccccauggaccuccacguguuccacgcccugcggcagccggacguccccaaccaccccugcaaggugaacaacggcgggugcuccaaccugugccuccugagcccgggcgggggccacaagugcgccugccccaccaacuucuaccugggcuccgacgggcggaccugcgugagcaacugcaccgccucccaguucgucugcaagaacgacaagugcauccccuucugguggaagugcgacacggaggacgacugcggcgaccacagcgacgagcccccggacugccccgaguucaagugccggcccgggcaguuccagugcuccaccggcaucugcaccaaccccgcguucaucugcgacggggacaacgacugccaggacaacagcgacgaggccaacugcgacauccacgugugccucccgucccaguucaagugcaccaacacgaaccgcugcauccccggcaucuuccggugcaacggccaggacaacugcggggacggcgaggacgagcgcgacugccccgaggugaccugcgcccccaaccaguuccagugcagcaucaccaagcggugcaucccgcgcgucugggugugcgaccgggacaacgacugcguggacggguccgacgagcccgccaacugcacccagaugacgugcggcgucgacgaguuccgcugcaaggacagcgggcggugcauccccgcccgcuggaagugcgacggcgaggacgacugcggcgacgggagcgacgagcccaaggaggagugcgacgagcggaccugcgagccguaccaguuccgcugcaagaacaaccggugcgugcccggccgcuggcagugcgacuacgacaacgacugcggggacaacuccgacgaggagagcugcacgccccgccccugcuccgagagcgaguucuccugcgcgaacggccgcugcaucgccggccgguggaagugcgacggggaccacgacugcgccgacggcagcgacgagaaggacugcaccccgcgcugcgacauggaccaguuccagugcaaguccgggcacugcaucccccugcgcuggcggugcgacgccgacgcggacugcauggacggcagcgacgaggaggccugcgggaccggcgugcggaccugcccccuggacgaguuccagugcaacaacacccucugcaagccccuggccuggaagugcgacggcgaggacgacugcggggacaacuccgacgagaacccggaggagugcgcccgcuucgucugcccgcccaaccgccccuuccggugcaagaacgaccgcgugugccuguggaucggccggcagugcgacgggaccgacaacugcggcgacgggacggacgaggaggacugcgagccgcccaccgcccacaccacccacugcaaggacaagaaggaguuccugugccgcaaccagcggugccucagcuccagccugcgcugcaacauguucgacgacugcggcgacggcuccgacgaggaggacugcagcaucgaccccaagcugaccuccugcgcgacgaacgccagcaucugcggggacgaggcccggugcgugcgcaccgagaaggccgccuacugcgcgugccgguccggcuuccacaccgucccggggcagcccggcugccaggacaucaacgagugccuccgcuucgggaccugcagccagcugugcaacaacacgaagggcggccaccugugcuccugcgcccggaacuucaugaagacccacaacacgugcaaggccgaggggagcgaguaccaggugcucuacaucgccgacgacaacgagauccgcagccuguuccccggccacccccacuccgccuacgagcaggcguuccagggggacgagagcgugcggaucgacgccauggacguccacgugaaggccggccgcguguacuggaccaacuggcacacgggcaccaucuccuaccggagccugccgcccgccgcgccgcccaccaccuccaaccgccaccggcgccagaucgaccgcggggucacgcaccucaacaucagcggccugaagaugccgcgggggaucgcgaucgacuggguggccggcaacguguacuggaccgacuccgggcgcgacgucaucgagguggcccagaugaagggcgagaaccggaagacccugaucagcggcaugaucgacgagccccacgccaucguggucgacccccuccgcgggaccauguacugguccgacuggggcaaccaccccaagaucgagacggcggccauggacgggacccugcgggagacccuggugcaggacaacauccaguggccgaccggccucgccguggacuaccacaacgagcgccuguacugggccgacgccaagcugagcgucaucggguccauccggcucaacggcacggaccccaucguggcggccgacagcaagcgcggccugucccaccccuucagcaucgacguguucgaggacuacaucuacggggucaccuacaucaacaaccggguguucaagauccacaaguucggccacagcccccuggugaaccucaccgggggccugagccacgccuccgacgucgugcuguaccaccagcacaagcagccggaggugaccaaccccugcgaccgcaagaagugcgaguggcucugccugcugagccccuccgggcccgucugcacgugcccgaacggcaagcggcucgacaacgggaccugcgugcccgugcccagccccaccccgccgcccgacgcgccccgcccggggaccugcaaccugcagugcuucaacggcgggagcugcuuccugaacgcccggcgccagcccaagugccggugccagccccgcuacacgggcgacaagugcgagcucgaccagugcugggagcacugccggaacggcgggaccugcgcggccuccccgagcgggaugccgaccugccgcugccccaccggguucacgggccccaagugcacccagcaggucugcgccggguacugcgccaacaacuccacgugcaccgugaaccagggcaaccagccgcagugccggugccugcccggcuuccugggggaccgcugccaguaccgccagugcagcggcuacugcgagaacuucgggaccugccagauggccgcggacggcagccggcagugccgcugcaccgccuacuucgaggggagccggugcgaggugaacaagugcucccgcugccucgagggcgccugcgucgugaacaagcagagcggcgacgugaccugcaacugcaccgacgggcgggucgcccccuccugccugaccugcgugggccacugcagcaacgggggcuccugcacgaugaacagcaagaugaugcccgagugccagugcccgccccacaugaccgggccccgcugcgaggagcacguguucucccagcagcagcccggccacaucgcgagcauccugaucccgcuccugcugcuccugcugcucguccugguggccggcgucguguucugguacaagcggcgcgugcagggggccaagggcuuccagcaccagcggaugaccaacggggccaugaacgucgagaucggcaaccccaccuacaagauguacgagggcggcgagcccgacgacgugggcgggcugcucgacgccgacuucgcgcuggaccccgacaagccgacgaacuucaccaaccccguguacgccacccuguacaugggcgggcacggcucccgccacagccucgccuccaccgacgagaagcgggagcugcuggggcgcggccccgaggacgagaucggcgacccccucgccuga

SEQ ID NO: 32445 - RNA, 1044 nt, Artificial Sequence
  derived and/or modified sequence opt1 from LRP2BP__Homo_sapiens__NP_060879
augaagcugaccagcgagaagcuccccaagaacccguucuacgccuccgugagccaguacgccgcgaagaaccagaaguucuuccaguggaagaaggagaagaccgacuacacgcacgccaaccuggucgacaaggcccugcagcuccugaaggagcgcauccugaagggcgacacccucgccuacuuccugcgggggcagcuguacuucgaggagggcugguacgaggaggcccucgagcaguucgaggagaucaaggagaaggaccaccaggcgaccuaccagcugggggugauguacuacgacggccuggggaccacgcucgacgccgagaagggcguggacuacaugaagaagauccuggacucccccugccccaaggcccgccaccugaaguucgccgcggccuacaaccucggccgggccuacuacgaggggaagggcgucaagcgcagcaacgaggaggccgagcggcuguggcugaucgccgcggacaacgggaaccccaaggccuccgugaaggcccagagcaugcucggccuguacuacuccaccaaggagccgaaggagcuggagaaggccuucuacuggcacagcgaggccugcgggaacggcaaccucgagucccagggcgcgcuggggcugauguaccucuacggccaggggauccgccaggacaccgaggccgcccugcagugccugcgggaggccgccgagcgcggcaacguguacgcgcagggcaaccucgucgaguacuacuacaagaugaaguucuucaccaagugcguggccuucagcaagcggaucgccgacuacgacgaggugcacgacauccccaugaucgcccaggucacggacugccugcccgaguucaucgggcgcggcauggccauggcguccuucuaccacgcccggugccugcagcucgggcugggcaucacccgcgacgagaccaccgccaagcacuacuacagcaaggccugccggcugaaccccgcgcucgccgacgagcugcacucccugcucauccgccagcggaucuga

SEQ ID NO: 32446 - RNA, 13968 nt, Artificial Sequence
  derived and/or modified sequence opt1 from LRP2__Homo_sapiens__NP_004516
auggaccgcggccccgccgccguggcgugcacccugcuccuggcccuggucgccugccucgccccggccagcgggcaggagugcgacuccgcgcacuuccggugcggcagcgggcacugcauccccgccgacuggcgcugcgacggcaccaaggacugcuccgacgacgccgacgagaucgggugcgccguggugacgugccagcagggcuacuucaagugccagagcgagggccagugcauccccaacuccugggucugcgaccaggaccaggacugcgacgacgggagcgacgagcggcaggacugcucccagagcaccugcuccagccaccagaucaccugcuccaacggccagugcauccccagcgaguaccgcugcgaccacgugcgggacugcccggacggggcggacgagaacgacugccaguaccccaccugcgagcagcugacgugcgacaacggcgccugcuacaacaccucccagaagugcgacuggaagguggacugccgcgacagcuccgacgagaucaacugcaccgagaucugccugcacaacgaguucagcugcgggaacggcgagugcaucccccgggccuacgucugcgaccacgacaacgacugccaggacggcuccgacgagcacgccugcaacuaccccaccugcgggggcuaccaguucacgugcccgagcgggcgcugcaucuaccagaacugggugugcgacggcgaggacgacugcaaggacaacggcgacgaggacgggugcgaguccggcccccacgacgugcacaagugcagcccccgggaguggagcugccccgaguccgggcgcugcaucagcaucuacaaggucugcgacggcauccucgacugcccggggcgggaggacgagaacaacaccuccaccggcaaguacugcagcaugacccugugcuccgcccugaacugccaguaccagugccacgagacgcccuacggcggggcgugcuucugcccccccggcuacaucaucaaccacaacgacagccgcaccugcguggaguucgacgacugccagaucugggggaucugcgaccagaagugcgagucccggccgggccgccaccucugccacugcgaggagggguacauccuggagcggggccaguacugcaaggccaacgacagcuucggcgaggccuccaucaucuucagcaacgggcgcgaccugcucaucggcgacauccacgggcgguccuuccgcauccugguggagagccagaaccggggcgucgccguggggguggccuuccacuaccaccugcagcgcgucuucuggaccgacaccgugcagaacaagguguucuccgucgacaucaacggccucaacauccaggaggugcugaacgugagcgucgagacgcccgagaaccuggcgguggacugggugaacaacaagaucuaccucgucgagaccaaggugaaccggaucgacauggucaaccuggacggcuccuaccgcgugacccugaucaccgagaaccucgggcacccccgcggcaucgccguggaccccacggucggguaccuguucuucagcgacugggagucccugagcggcgagccgaagcucgagcgggccuucauggacggcuccaaccgcaaggaccuggugaagaccaagcugggguggcccgccggcgugacccucgacaugaucagcaagcgggucuacuggguggacagccgcuucgacuacaucgagaccgugacguacgacgggauccagcggaagaccgucgugcacggcgggucccugaucccccaccccuucggcgugagccuguucgagggccaggucuucuucaccgacuggaccaagauggccgugcucaaggcgaacaaguucacggagaccaacccgcagguguacuaccaggccucccugcgccccuacggggucaccguguaccacagccugcggcagcccuacgccaccaaccccugcaaggacaacaacggcgggugcgagcaggugugcguccucucccaccgcacggacaacgacggccugggguuccggugcaagugcaccuucggcuuccagcuggacaccgacgagcgccacugcaucgccgugcagaacuuccucaucuucagcucccagguggccauccggggcaucccguucacccugagcacgcaggaggacgucauggugcccguguccgggaaccccagcuucuucgucggcaucgacuucgacgcgcaggacuccaccaucuucuucagcgacauguccaagcacaugaucuucaagcagaagaucgacgggaccggccgcgagauccuggccgccaaccggguggagaacguggagagccucgccuucgacuggaucuccaagaaccuguacuggaccgacagccacuacaaguccaucagcgucaugcgccuggcggacaagacccggcgcacgguggugcaguaccucaacaacccgcggagcgucguggugcaccccuucgccggguaccuguucuucaccgacugguuccgccccgccaagaucaugcgggccugguccgacggcagccaccugcuccccgucaucaacaccacccugggcuggccgaacgggcuggccaucgacugggcggccucccgccucuacuggguggacgccuacuucgacaagaucgagcacagcacguucgacggccuggaccgccggcgccuggggcacaucgagcagaugacccaccccuucggccuggccaucuucggggagcaccucuucuucaccgacuggcggcugggcgccaucauccgcgugcggaaggcggacggcggggagaugaccgucauccgcuccggcaucgccuacauccugcaccucaagagcuacgacgugaacauccagacgggguccaacgccugcaaccagcccacccaccccaacggcgacugcagccacuucugcuucccggugcccaacuuccagcgggucugcggcugccccuacgggaugcgccuggccuccaaccaccugaccugcgagggcgaccccaccaacgagccgcccacggagcagugcgggcucuucagcuuccccugcaagaacggccggugcgugcccaacuacuaccugugcgacgggguggacgacugccacgacaacuccgacgagcagcugugcggcacccucaacaacaccugcagcuccagcgccuucaccugcggccacggggagugcaucccggcgcacuggcgcugcgacaagcggaacgacugcgucgacggcuccgacgagcacaacugccccacgcacgcccccgccagcugccuggacacccaguacaccugcgacaaccaccagugcaucuccaagaacugggugugcgacaccgacaacgacugcggggacggcagcgacgagaagaacugcaacuccacggagaccugccagcccagccaguucaacugcccgaaccaccgcugcaucgaccugagcuucgugugcgacggggacaaggacugcgucgacggcuccgacgaggugggcugcgugcucaacugcaccgccagccaguucaagugcgcguccggggacaagugcaucggcgucaccaaccggugcgacgggguguucgacugcagcgacaacuccgacgaggccggcugccccacgcgcccccccgggaugugccacagcgacgaguuccagugccaggaggacggcaucugcaucccgaacuucugggagugcgacggccaccccgacugccuguacggguccgacgagcacaacgccugcgugcccaagaccugcccgagcuccuacuuccacugcgacaacggcaacugcauccaccgggccuggcugugcgaccgcgacaacgacugcggggacaugagcgacgagaaggacugccccacccagcccuuccggugccccuccuggcaguggcagugccucggccacaacaucugcgucaaccugagcguggucugcgacggcaucuucgacugcccgaacgggaccgacgaguccccccugugcaacggcaacagcugcuccgacuucaacgggggcugcacgcacgagugcgugcaggagcccuucggggccaagugccucugcccccugggcuuccugcucgcgaacgacagcaagaccugcgaggacaucgacgagugcgacauccugggcuccugcagccagcacugcuacaacaugcgcggguccuuccggugcagcugcgacaccggcuacaugcuggagagcgacgggcgcaccugcaaggugacggccuccgagagccuccugcugcucgucgccucccagaacaagaucaucgccgacagcgugaccucccaggugcacaacaucuacagccuggucgagaacggcuccuacaucguggccguggacuucgacagcaucuccgggcggaucuucuggagcgacgcgacccagggcaagaccugguccgccuuccagaacggcacggaccgccgcgucguguucgacagcuccaucauccugaccgagaccaucgccaucgacuggguggggcggaaccucuacuggaccgacuacgcccuggagaccaucgaggucagcaagaucgacggcucccaccgcacggugcugaucagcaagaaccucaccaacccgcgggggcuggcccuggacccccgcaugaacgagcaccuccuguucugguccgacuggggccaccacccccggaucgagcgcgcgagcauggacggguccaugcggaccgugaucguccaggacaagaucuucuggcccugcggccugaccaucgacuacccgaaccgccuccuguacuucauggacagcuaccuggacuacauggacuucugcgacuacaacggccaccaccggcgccaggugaucgccagcgaccucaucauccggcaccccuacgcccugacgcuguucgaggacuccguguacuggaccgaccgcgccacccggcgcgucaugcgggcgaacaaguggcacgggggcaaccagagcguggugauguacaacauccaguggccccucgggaucgucgccgugcaccccuccaagcagccgaacagcgugaaccccugcgccuucucccgcugcagccaccugugccugcucuccagccagggcccccacuucuacuccugcgucugccccagcggguggucccugagcccggaccugcucaacugccugcgggacgaccagcccuuccugaucaccgugcgccagcacaucaucuucggcaucucccucaaccccgaggugaagagcaacgacgccaugguccccaucgccggcauccagaacgggcuggacguggaguucgacgacgcggagcaguacaucuacuggguggagaacccgggcgagauccaccgggucaagacggacgggaccaaccgcaccguguucgccuccaucagcauggugggccccuccaugaaccuggcccucgacuggaucagccgcaaccuguacuccaccaacccccggacgcagagcaucgagguccugacccuccacggcgacauccgcuaccggaagacccugaucgccaacgacgggaccgcccugggcgugggguuccccaucggcaucacgguggacccggcgcgcgggaagcucuacuggagcgaccagggcaccgacuccggcguccccgccaagaucgccagcgccaacauggacgggaccuccgugaagacccuguucacgggcaaccuggagcaccucgagugcgugacccuggacaucgaggagcagaagcuguacugggccgucaccgggcggggcgugaucgagcgcgggaacguggacggcaccgaccggaugauccucguccaccagcugagccaccccuggggcaucgcggugcacgacuccuuccuguacuacacggacgagcaguacgaggugaucgagcgcgucgacaaggccaccggggccaacaagaucgugcuccgggacaacgugccgaaccugcgcggccugcaggucuaccaccggcgcaacgccgccgagagcuccaacgggugcagcaacaacaugaacgcgugccagcagaucugccuccccgugcccggcgggcuguucuccugcgccugcgccaccggcuucaagcugaaccccgacaaccggagcugcuccccguacaacagcuucaucguggucuccaugcucagcgccauccgcggcuucucccuggagcugagcgaccacuccgagaccauggugcccgucgcggggcagggccggaacgcccuccacguggacguggacgucagcuccggguucaucuacuggugcgacuucagcagcuccguggccagcgacaacgccauccgccggaucaagcccgacggcuccagccugaugaacaucgugacgcacgggaucggcgagaacggcguccgcgggaucgccguggacuggguggcgggcaaccuguacuucaccaacgccuucgucuccgagacccucaucgaggugcugcggaucaacaccacguaccgccgggugcugcucaaggucaccguggacaugccccgccacaucguggucgacccgaagaaccgcuaccuguucugggccgacuacgggcagcggcccaagaucgagcgcagcuuccuggacugcaccaaccggaccgugcucguguccgagggcaucgucacgccccgcggccuggccguggaccggagcgacggguacguguacugggucgacgacucccuggacaucaucgcccgcauccggaucaacggcgagaacagcgaggugauccgcuacgggucccgguaccccaccccguacggcaucaccguguucgagaacagcaucaucugggucgaccgcaaccucaagaagaucuuccaggcguccaaggagcccgagaacaccgagccccccaccgugauccgggacaacaucaacuggcugcgcgacgugacgaucuucgacaagcagguccagccgcggagccccgccgaggugaacaacaaccccugccuggagaacaacgggggcugcucccaccugugcuucgcccuccccggccugcacaccccgaagugcgacugcgccuucgggacccugcagagcgacggcaagaacugcgccaucuccaccgagaacuuccucaucuucgcgcugagcaacagccugcgcucccuccaccuggaccccgagaaccacagcccccccuuccagacgaucaacguggagcggaccgucaugucccuggacuacgacagcguguccgaccgcaucuacuucacccagaaccucgccagcggggugggccagaucuccuacgccacccugagcuccgggauccacacgccgaccgucaucgccagcggcaucggcaccgcggacgggaucgccuucgacuggaucacccggcgcaucuacuacuccgacuaccugaaccagaugaucaacagcauggccgaggacggcuccaaccggacggugaucgcccgcgugcccaagccccgcgccaucguccucgaccccugccagggguaccuguacugggcggacugggacacccacgccaagaucgagcgggccacccugggcgggaacuuccgcgugccgaucgugaacagcucccucgucaugcccagcggccugacccuggacuacgaggaggaccuccuguacuggguggacgccucccugcagcggaucgagcgcagcacgcucaccggcguggaccgggaggucaucgugaacgccgcggugcacgccuucgggcugacccuguacggccaguacaucuacuggaccgaccucuacacgcagcgcaucuaccgggccaacaaguacgacggguccggccagaucgccaugaccaccaaccugcugagccagccccgcggcaucaacaccgucgugaagaaccagaagcagcagugcaacaacccgugcgagcaguucaacgggggcugcagccacaucugcgcccccgggcccaacggcgcggagugccagugcccccacgaggggaacugguaccucgccaacaaccggaagcacugcaucguggacaacggcgagcgcugcggcgccuccagcuucacgugcuccaacgggcggugcaucagcgaggaguggaagugcgacaacgacaacgacugcggcgacggguccgacgagauggagagcgucugcgcccugcacaccugcuccccgaccgcguucaccugcgccaacggccgcugcgugcaguacagcuaccggugcgacuacuacaacgacugcggggacggcuccgacgaggccggcugccuguuccgcgacugcaacgccacgaccgaguucaugugcaacaaccggcgcugcaucccccgggaguucaucugcaacgggguggacaacugccacgacaacaacaccagcgacgagaagaacugccccgaccgcaccugccaguccggcuacacgaagugccacaacagcaacaucugcaucccccgggucuaccucugcgacggggacaacgacugcggcgacaacuccgacgagaacccgaccuacugcaccacccacacgugcagcuccagcgaguuccagugcgccuccgggcgcugcaucccccagcacugguacugcgaccaggagaccgacugcuucgacgcgagcgacgagcccgccuccugcggccacagcgagcggaccugccuggccgacgaguucaagugcgacggcgggcgcugcauccccagcgaguggaucugcgacggcgacaacgacugcggggacauguccgacgaggacaagcgccaccagugccagaaccagaacugcagcgacuccgaguuccugugcgugaacgaccggccgcccgaccgccggugcaucccccagagcugggucugcgacggcgacguggacugcaccgacggguacgacgagaaccagaacugcacgcgccggaccugcuccgagaacgaguucaccugcggcuacggccucugcauccccaagaucuuccgcugcgaccggcacaacgacugcggggacuacagcgacgagcgcggcugccuguaccagaccugccagcagaaccaguucaccugccagaacgggcggugcaucuccaagacguucgugugcgacgaggacaacgacugcggcgacggcagcgacgagcugaugcaccucugccacaccccggagcccaccugccccccccacgaguucaagugcgacaacgggcgcugcaucgagaugaugaagcugugcaaccaccuggacgacugccucgacaacuccgacgagaagggcugcgggaucaacgagugccacgacccgagcaucuccggcugcgaccacaacugcaccgacacgcugaccagcuucuacugcuccugccggcccggguacaagcugaugagcgacaagcgcaccugcgucgacaucgacgagugcaccgagaugcccuucgugugcucccagaagugcgagaacgugaucggcagcuacaucugcaagugcgcccccggcuaccuccgggagccggacgggaagacgugccgccagaacuccaacaucgagcccuaccugaucuucagcaaccgguacuaccugcgcaaccucaccaucgacggcuacuucuacucccugauccuggaggggcucgacaacgucguggcccuggacuucgaccggguggagaagcgccuguacuggaucgacacccagcggcaggucaucgagcgcauguuccucaacaagaccaacaaggagacgaucaucaaccaccgccugcccgcggccgagagccuggccguggacugggugagccggaagcucuacuggcuggacgcccgccuggacggccucuucgucuccgaccugaacgggggccaccggcgcaugcuggcccagcacugcguggacgcgaacaacaccuucugcuucgacaacccgcggggccucgcccugcacccccaguacggguaccuguacugggccgacuggggccaccgcgccuacaucgggcgggugggcauggacgggaccaacaagagcgucaucaucuccaccaagcucgaguggcccaacggcaucacgaucgacuacaccaacgaccugcuguacugggccgacgcgcaccucggcuacaucgaguacagcgaccuggaggggcaccaccgccacaccguguacgacggcgcccugccccacccguucgccaucaccaucuucgaggacacgaucuacuggaccgacuggaacacccggaccguggagaaggggaacaaguacgacggcuccaaccgccagacgcucgucaacaccacccaccggcccuucgacauccacguguaccaccccuaccgccagcccaucgugagcaacccgugcggcaccaacaacgggggcugcucccaccugugccugaucaagcccgggggcaagggguucacgugcgagugccccgacgacuuccggacccuccagcugagcggcuccaccuacugcaugcccaugugcagcuccacccaguuccugugcgccaacaacgagaagugcaucccgaucugguggaagugcgacggccagaaggacugcagcgacggguccgacgagcucgcgcugugcccccagcgcuucugccggcugggccaguuccagugcagcgacgggaacugcacguccccccagacccucugcaacgcccaccagaacugccccgacggcagcgacgaggaccgccugcugugcgagaaccaccacugcgacuccaacgaguggcagugcgccaacaagcggugcaucccggagagcuggcagugcgacaccuucaacgacugcgaggacaacuccgacgaggacagcagccacugcgccucccgcaccugccggcccgggcaguuccgcugcgccaacggccggugcaucccccaggcguggaagugcgacgucgacaacgacugcggcgaccacagcgacgagcccaucgaggagugcauguccagcgcccaccucugcgacaacuucacggaguucuccugcaagaccaacuaccgcugcaucccgaagugggccgugugcaacgggguggacgacugccgcgacaacagcgacgagcagggcugcgaggagcggaccugccaccccgucggggacuuccgcugcaagaaccaccacugcaucccccugcgguggcagugcgacggccagaacgacugcggggacaacuccgacgaggagaacugcgccccccgcgagugcaccgagagcgaguuccggugcgugaaccagcagugcaucccgucccgcuggaucugcgaccacuacaacgacugcggcgacaacagcgacgagcgggacugcgagaugcgcaccugccaccccgaguacuuccagugcacguccggccacugcgugcacagcgagcugaagugcgacggguccgccgacugccucgacgcgagcgacgaggccgacugccccacccgguuccccgacggcgccuacugccaggccaccauguucgagugcaagaaccacgucugcaucccgcccuacuggaagugcgacggggacgacgacugcggcgacggguccgacgaggagcugcaccugugccucgacgugcccugcaacagcccgaaccgcuuccggugcgacaacaaccgcugcaucuacucccacgaggugugcaacggcgucgacgacugcggcgacgggaccgacgagacggaggagcacugccggaagcccacccccaagcccugcaccgaguacgaguacaagugcggcaacgggcacugcaucccgcacgacaacgugugcgacgacgccgacgacugcggcgacuggagcgacgagcugggcugcaacaaggggaaggagcgcaccugcgcggagaacaucugcgagcagaacugcacgcagcugaacgagggcggguucaucugcuccugcaccgccggcuucgagaccaacguguucgaccggaccagcugccucgacaucaacgagugcgagcaguucgggacgugcccccagcacugccgcaacaccaagggcagcuacgagugcgucugcgccgacggcuucaccuccaugagcgaccggcccgggaagcgcugcgccgcggagggcuccagcccccugcugcuccugccggacaacgugcggauccgcaaguacaaccuguccagcgagcgcuucuccgaguaccuccaggacgaggaguacauccaggccguggacuacgacugggaccccaaggacaucgggcugagcgucguguacuacaccgugcggggcgaggggucccgcuucggcgccaucaagcgggccuacauccccaacuucgagagcggccgcaacaaccugguccaggagguggaccucaagcugaaguacgugaugcagcccgacgggaucgccgucgacugggugggccggcacaucuacugguccgacgugaagaacaagcgcaucgaggucgcgaagcuggacgggcgguaccgcaaguggcugaucagcacggaccucgaccagccggccgccaucgccgugaaccccaagcugggccugauguucuggaccgacugggggaaggagcccaagaucgaguccgccuggaugaacggcgaggaccggaacauccucguguucgaggaccugggcuggcccaccgggcugagcaucgacuaccucaacaacgaccgcaucuacugguccgacuucaaggaggacgucaucgagaccaucaaguacgacggcacggaccggcgcgugaucgcgaaggaggccaugaacccguacagccuggacaucuucgaggaccagcuguacuggaucuccaaggagaagggggagguguggaagcagaacaaguucggccagggcaagaaggagaagacccucgucgugaaccccuggcugacccagguccggaucuuccaccagcugcgcuacaacaagagcgugcccaaccucugcaagcagaucugcagccaccugugccugcuccggcccgggggcuacuccugcgccugcccgcaggggagcuccuucaucgagggcagcaccacggagugcgacgccgccaucgagcugcccaucaaccugccccccccgugccgcugcaugcacgggggcaacugcuacuucgacgagaccgaccuccccaagugcaagugccccuccggcuacaccgggaaguacugcgagauggcguucagcaagggcaucucccccgggaccacggccguggccguccugcugaccauccuccugaucguggugaucggcgcccuggcgaucgccggguucuuccacuaccggcgcaccggcagccuccugccggcccugcccaagcuccccucccugagcucccuggucaagccgagcgagaacggcaacggggugaccuuccgguccggcgccgaccucaacauggacaucggggugagcggcuucgggcccgagacggccaucgaccgcuccauggcgaugagcgaggacuucgucauggagaugggcaagcagcccaucaucuucgagaaccccauguacuccgcccgggacagcgccgugaaggugguccagccgauccaggugaccguguccgagaacgucgacaacaagaacuacggcagccccaucaaccccagcgagaucgugcccgagaccaacccgaccucccccgccgccgacgggacgcaggugaccaaguggaaccuguucaagcgcaagagcaagcagaccaccaacuucgagaaccccaucuacgcgcagauggagaacgagcagaaggaguccgucgccgccacccccccgcccagccccucccugcccgccaagccgaagccccccagccgccgggaccccacgccgaccuacuccgccaccgaggacaccuucaaggacacggcgaaccucgugaaggaggacagcgagguguga

SEQ ID NO: 32447 - RNA, 5718 nt, Artificial Sequence
  derived and/or modified sequence opt1 from LRP4__Homo_sapiens__NP_002325
augcggcggcaguggggcgcccugcuccugggggcccugcucugcgcccacggccuggccagcagccccgagugcgccugcgggcgcagccacuucacgugcgccguguccgcccugggcgagugcacgugcaucccggcgcaguggcagugcgacggggacaacgacugcggcgaccacagcgacgaggacggcugcauccucccgaccugcagcccccuggacuuccacugcgacaacgggaagugcauccggcgcagcugggucugcgacggcgacaacgacugcgaggacgacuccgacgagcaggacugcccgccccgggagugcgaggaggacgaguuccccugccagaacggguacugcauccgcagccuguggcacugcgacggcgacaacgacugcggggacaacuccgacgagcagugcgacaugcggaagugcagcgacaaggaguuccgcugcuccgacggcagcugcaucgccgagcacugguacugcgacggcgacaccgacugcaaggacggguccgacgaggagaacugccccagcgccgugcccgccccgcccugcaaccucgaggaguuccagugcgcguacggccggugcauccuggacaucuaccacugcgacggggacgacgacugcggcgacugguccgacgagagcgacugcuccagccaccagcccugccgcuccggcgaguucaugugcgacagcgggcugugcaucaacgccggcuggcggugcgacggggacgccgacugcgacgaccagagcgacgagcgcaacugcaccaccuccaugugcaccgccgagcaguuccggugccacagcggccgcugcgugcggcucuccuggcgcugcgacggggaggacgacugcgccgacaacagcgacgaggagaacugcgagaacaccggcagcccccagugcgcgcuggaccaguuccugugcuggaacggccggugcaucgggcagcgcaagcucugcaacggcgucaacgacugcggggacaacagcgacgaguccccgcagcagaacugccggccccgcaccggcgaggagaacugcaacgugaacaacgggggcugcgcccagaagugccagauggugcggggcgccguccagugcacgugccacaccggguaccgccugaccgaggacggccacacgugccaggacgugaacgagugcgccgaggagggguacugcagccagggcugcaccaacuccgagggggccuuccagugcuggugcgagaccggcuacgagcugcgccccgaccggcgcagcugcaaggcgcucggccccgagccggugcugcuguucgccaaccggaucgacauccgccagguccucccccaccgguccgaguacacccugcugcucaacaaccuggagaacgccaucgcccuggacuuccaccaccgccgggagcucguguucuggagcgacgugacccuggaccgcauccugcgggccaaccucaacggguccaacgucgaggagguggugagcaccggccuggagucccccgggggccuggcggucgacugggugcacgacaagcucuacuggaccgacagcggcaccucccgcaucgagguggccaaccuggacggggcccaccggaagguccugcucuggcagaaccuggagaagccccgcgccaucgcccugcacccgauggagggcaccaucuacuggaccgacugggggaacacgccccggaucgaggcgagcuccauggacggcagcgggcgccggaucaucgccgacacccaccucuucuggcccaacggccugaccaucgacuacgccggccgccggauguacuggguggacgccaagcaccacgugaucgagcgcgcgaaccuggacgggagccaccggaaggccgucaucucccagggccucccccaccccuucgccaucaccguguucgaggacucccuguacuggaccgacuggcacaccaaguccaucaacagcgccaacaaguucaccgggaagaaccaggagaucauccgcaacaagcugcacuuccccauggacauccacacccuccacccccagcgccagcccgccggcaagaaccggugcggggacaacaacggcggcugcacgcaccugugccugccguccgggcagaacuacacgugcgcgugccccaccggcuuccgcaagaucagcucccacgccugcgcccagagccucgacaaguuccugcuguucgcccggcgcauggacauccggcgcaucuccuucgacaccgaggaccugagcgacgacgugaucccccucgccgacguccgguccgcgguggcccuggacugggacagccgcgacgaccacgucuacuggacggacguguccaccgacaccaucagccgggccaagugggacgggaccggccaggagguggucguggacacgucccuggagagcccggccgggcucgccaucgacugggugaccaacaagcuguacuggaccgacgcgggcaccgaccgcaucgaggucgccaacaccgacggcuccaugcggacggugcugaucugggagaaccucgaccgcccccgggacaucguggucgagcccaugggcggguacauguacuggaccgacuggggcgccagccccaagaucgagcgcgccggcauggacgcgagcgggcgccaggugaucaucuccagcaaccugaccuggccgaacggccuggccaucgacuacggcucccagcgccucuacugggccgacgccgggaugaagaccaucgaguucgccggccuggacgggagcaagcggaaggugcugaucggcucccagcucccccaccccuucggccugacgcuguacggggagcgcaucuacuggaccgacuggcagaccaagagcauccaguccgcggaccggcucaccggccuggaccgcgagacgcugcaggagaaccucgagaaccugauggacauccacgucuuccaccggcgccggccgcccgugagcacccccugcgccauggagaacgggggcugcucccaccugugccuccggagccccaaccccuccggguucagcugcacgugccccaccggcaucaaccugcuguccgacggcaagacgugcagccccgggaugaacuccuuccucaucuucgcccgccggaucgacauccgcauggugagccuggacauccccuacuucgccgacgucguggugcccaucaacaucaccaugaagaacaccaucgccaucggcgucgacccgcaggaggggaagguguacugguccgacagcacccugcaccggaucucccgcgcgaaccucgacggcagccagcacgaggacaucaucacgaccgggcugcagaccaccgacggccuggccguggacgccaucggccggaaggucuacuggacggacaccgggaccaaccgcaucgaggugggcaaccucgacgggagcaugcggaaggugcuggucuggcagaaccuggacagcccccgcgccaucgugcucuaccacgagaugggcuucauguacuggaccgacuggggcgagaacgccaagcuggagcgguccggcauggacggcuccgaccgcgcggugcugaucaacaacaaccucggguggcccaacggccugacggucgacaaggccagcucccagcugcucugggccgacgcccacaccgagcggaucgaggcggccgaccugaacggggccaaccgccacacccuggugagccccgugcagcacccguacggccucacccugcuggacuccuacaucuacuggacggacuggcagacccggagcauccaccgcgccgacaagggcaccggguccaacgucauccucgugcggagcaaccugcccggccugauggacaugcaggccguggaccgcgcgcagccccucggguucaacaagugcggcucccggaacgggggcugcagccaccugugccugccccgcccguccggcuucagcugcgccugccccaccgggauccagcucaagggcgacgggaagacgugcgaccccuccccggagaccuaccugcuguucagcucccgcggcagcauccggcgcaucucccucgacaccagcgaccacaccgacguccacgugcccgugcccgagcugaacaacgucaucagccuggacuacgacuccguggacgggaagguguacuacacggacgucuuccucgacgugauccggcgcgccgaccugaacggcagcaacauggagaccgugaucggccgggggcugaagaccaccgacggccucgccgucgacuggguggcccgcaaccuguacuggaccgacacggggcggaacaccaucgaggcgucccgccuggacggcagcugccggaaggugcucaucaacaacucccuggacgagccccgcgccaucgccgucuucccgcggaagggguaccuguucuggaccgacuggggccacaucgccaagaucgagcgcgccaaccucgacggcagcgagcggaaggugcugaucaacaccgaccugggguggcccaacggccucacgcuggacuacgacacccgccggaucuacuggguggacgcgcaccuggaccgcaucgaguccgccgaccucaacgggaagcugcggcagguccuggugagccacgugucccaccccuucgcccucacccagcaggaccgcuggaucuacuggaccgacuggcagaccaaguccauccagcgggucgacaaguacuccggccgcaacaaggagaccgugcuggccaacgucgaggggcugauggacaucaucguggugagcccccagcggcagaccggcaccaacgccugcggcgucaacaacgggggcugcacgcaccucugcuucgcgcgcgccuccgacuucgugugcgccugcccggacgagcccgacagccgccccugcucccuggugcccgggcuggucccgcccgcgccccgggcgaccggcaugagcgagaagucccccgugcucccgaacacgccgcccaccacgcuguacagcuccaccacccgcacccggacgagccuggaggagguggagggccgcugcagcgagcgggacgcccgccucgggcugugcgcccgguccaacgacgccguccccgccgcgccgggcgaggggcugcacaucagcuacgccaucggcgggcuccuguccauccugcucauccugguggugaucgccgcccugaugcucuaccgccacaagaaguccaaguucaccgaccccggcaugggcaaccugaccuacuccaaccccagcuaccggaccuccacgcaggaggucaagaucgaggccauccccaagccggcgauguacaaccagcugugcuacaagaaggagggcgggcccgaccacaacuacaccaaggagaagaucaagaucguggaggggaucugccugcucagcggggacgacgccgagugggacgaccugaagcagcugcgcuccagccgcggcgggcuccugcgcgaccacgugugcaugaagaccgacaccgucuccauccaggccagcuccgggagccuggacgacacggagaccgagcagcuccugcaggaggagcaguccgagugcagcuccgugcacaccgccgccacccccgagcggcgcgggagccugcccgacacgggcuggaagcacgagcggaagcucuccagcgagagccagguguga

SEQ ID NO: 32448 - RNA, 4848 nt, Artificial Sequence
  derived and/or modified sequence opt1 from LRP5__Homo_sapiens__NP_002326
auggaggccgcccccccgggcccccccuggccccugcuccugcugcuccugcugcuccuggcgcugugcgggugcccggcccccgccgccgccagcccccuccugcuguucgcgaaccgccgggacgugcgccucgucgacgccggcggggugaagcuggaguccaccaucguggucagcggccuggaggacgccgccgcgguggacuuccaguucuccaagggggccguguacuggaccgacgucagcgaggaggccaucaagcagacguaccucaaccagaccggcgccgccgugcagaacguggucaucuccggccuggugagccccgacgggcuggcgugcgacugggugggcaagaagcucuacuggaccgacuccgagaccaaccggaucgaggucgccaaccugaacgggacgagccgcaaggugcuguucuggcaggaccucgaccagccgcgggccaucgcccuggaccccgcccacggcuacauguacuggaccgacuggggggagaccccccgcaucgagcgggcgggcauggacggcuccacccgcaagaucaucguggacagcgacaucuacuggcccaacgggcugacgaucgaccucgaggagcagaagcuguacugggccgacgccaagcuguccuucauccaccgggccaaccucgacggcagcuuccgccagaaggucguggaggggucccugacccacccguucgcccugacccucagcggcgacacccuguacuggacggacuggcagacccgguccauccacgcgugcaacaagcgcaccggcgggaagcggaaggagauccugagcgcccucuacucccccauggacauccaggugcugagccaggagcgccagcccuucuuccacacccggugcgaggaggacaacggcgggugcucccaccugugccuccugagccccagcgagccguucuacacgugcgccugccccaccggcguccagcugcaggacaacgggcgcaccugcaaggccggcgccgaggaggugcuccugcuggcgcggcgcaccgaccuccggcgcaucucccuggacacgcccgacuucaccgacaucgugcugcaggucgacgacauccggcacgccaucgccaucgacuacgacccccucgagggcuacguguacuggaccgacgacgaggugcgcgccauccgccgggcguaccuggacgggagcggcgcccagacccuggucaacacggagaucaacgacccggacgggaucgccguggacugggucgcccgcaaccucuacuggaccgacaccggcaccgaccggaucgaggugacgcgccugaacgggaccucccggaagauccuggugagcgaggaccuggacgagccccgcgccaucgcgcuccaccccgucaugggccugauguacuggaccgacuggggcgagaaccccaagaucgagugcgccaaccuggacgggcaggagcggcgcgugcucgugaacgccucccugggcuggccgaacgggcuggcccucgaccugcaggagggcaagcuguacuggggggacgccaagaccgacaagaucgaggucaucaacguggacggcacgaagcggcgcacccuccuggaggacaagcugccccacaucuucggcuucacccuccugggggacuucaucuacuggaccgacuggcagcggcgcagcaucgagcgggugcacaaggucaaggcgucccgcgacgugaucaucgaccagcugcccgaccucaugggccugaaggccgugaacgucgccaaggugguggggacgaaccccugcgccgaccggaacggcggcugcagccaccugugcuucuucaccccgcacgccacccgcugcgggugccccaucggccucgagcugcuguccgacaugaagaccugcaucguccccgaggcguuccucguguucaccagccgggccgccauccaccgcaucucccuggagacgaacaacaacgacguggccaucccgcugaccggggucaaggaggcgagcgcccucgacuucgacguguccaacaaccacaucuacuggaccgacgugagccugaagaccaucucccgggccuucaugaacggcagcuccgucgagcacgugguggaguucgggcuggacuaccccgagggcauggccgucgacuggaugggcaagaaccucuacugggccgacacggggaccaaccgcaucgagguggcgcgccuggacggccaguuccggcaggugcuggucuggcgcgaccucgacaacccccggagccuggcccuggaccccaccaagggguacaucuacuggaccgaguggggcgggaagccgcgcaucgugcgggccuucauggacggcacgaacugcaugacccucguggacaaggucggccgcgccaacgaccugaccaucgacuacgccgaccagcggcuguacuggaccgaccucgacacgaacaugaucgaguccagcaacaugcuggggcaggagcgcguggugaucgcggacgaccugccccaccccuucggccucacccaguacagcgacuacaucuacuggaccgacuggaaccugcacuccaucgagcgggccgacaagaccagcgggcgcaaccggacgcugauccagggccaccucgacuucgucauggacauccugguguuccacuccagccgccaggacgggcugaacgacugcaugcacaacaacggccagugcggccagcucugccuggccauccccgggggccaccggugcgggugcgccucccacuacacccuggacccgagcucccgcaacugcagcccccccaccaccuuccuccuguucucccagaagagcgccaucucccggaugauccccgacgaccagcacagcccggaccugauccucccccugcacggccugcgcaacgugaaggcgaucgacuacgacccccucgacaaguucaucuacugggucgacgggcggcagaacaucaagcgcgccaaggacgacggcacgcagcccuucgugcugaccucccugagccagggccagaacccggaccggcagccccacgaccucuccaucgacaucuacagccgcacccuguucuggaccugcgaggccacgaacaccaucaacgugcaccggcuguccggggaggccaugggcgucgugcuccgcggggaccgcgacaagccccgggcgaucguggucaacgccgagcgcggcuaccuguacuucaccaacaugcaggaccgggccgccaagaucgagcgcgccgcgcuggacggcaccgagcgggaggugcucuucacgaccgggcugauccgccccguggcccuggucguggacaacacccucggcaagcuguucuggguggacgccgaccugaagcggaucgagagcugcgaccucagcggggccaaccgccugacccuggaggacgccaacaucguccagccgcucggccugacgauccuggggaagcaccucuacuggaucgaccggcagcagcagaugaucgagcgcguggagaagaccaccggcgacaagcggacccgcauccagggccggguggcgcaccugacggggauccacgccgucgaggaggugucccuggaggaguucagcgcccaccccugcgcccgcgacaacggcgggugcucccacaucugcaucgccaagggcgacgggaccccccggugcagcugccccguccaccucgugcugcugcagaaccuccugaccugcggcgagccgcccaccugcucccccgaccaguucgcgugcgccaccggcgagaucgacugcaucccgggggccuggcgcugcgacggcuuccccgagugcgacgaccagagcgacgaggaggggugccccgugugcuccgccgcccaguuccccugcgcgcggggccagugcgucgaccugcgccuccggugcgacggggaggccgacugccaggaccgcagcgacgaggccgacugcgacgccaucugccugccgaaccaguuccgcugcgcguccggccagugcgugcugaucaagcagcagugcgacagcuuccccgacugcaucgacggcuccgacgagcucaugugcgagaucacgaagccccccagcgacgacuccccggcccacagcuccgccaucgggcccgugaucggcaucauccugagccuguucgucauggggggcguguacuucgugugccagcgggucgugugccagcgcuacgccggcgccaacgggcccuucccccacgaguacguguccggcaccccgcacgucccccucaacuucaucgcgcccgggggcagccagcacgggcccuucaccggcaucgccugcggcaaguccaugaugagcagcgugucccugauggggggccgggggggcgugccgcuguacgaccgcaaccacgucaccggggccagcuccagcuccagcuccagcacgaaggccacccucuacccccccauccugaaccccccgcccucccccgccaccgaccccagccuguacaacauggacauguucuacuccagcaacaucccggcgaccgcccggcccuaccgccccuacaucauccggggcauggcccccccgacgacccccugcuccaccgacgugugcgacagcgacuacuccgccagccgcuggaaggccuccaaguacuaccuggaccucaacagcgacuccgaccccuacccgcccccccccaccccgcacagccaguaccugagcgcggaggacuccugcccccccagccccgccacggagcgguccuacuuccaccuguucccgcccccccccagcccgugcaccgacuccagcuga

SEQ ID NO: 32449 - RNA, 4842 nt, Artificial Sequence
  derived and/or modified sequence opt1 from LRP6__Homo_sapiens__NP_002327
augggcgccgugcugcgcagccuccuggccugcuccuucugcguccugcuccgggcggccccccugcugcucuacgccaaccgccgggaccugcgccugguggacgccaccaacgggaaggagaacgccaccaucguggucggcgggcucgaggacgcggccgccguggacuucguguucagccacggccugaucuacugguccgacgucagcgaggaggccaucaagcggacggaguucaacaagaccgaguccgugcagaacguggucgugagcgggcugcucuccccggacggccuggcgugcgacuggcugggcgagaagcucuacuggaccgacagcgagaccaaccgcaucgagguguccaaccuggacgggagccugcggaagguccucuucuggcaggagcuggaccagccccgcgccaucgcccuggaccccuccagcggcuucauguacuggacggacuggggggaggugcccaagaucgagcgggccggcauggacggguccagccgcuucaucaucaucaacuccgagaucuacuggccgaacggccucacccuggacuacgaggagcagaagcuguacugggccgacgcgaagcucaacuucauccacaagagcaaccuggacggcaccaaccggcaggccguggucaaggggucccugccccaccccuucgcccucacccuguucgaggacauccuguacuggacggacuggagcacccacuccauccucgccugcaacaaguacaccggcgaggggcugcgcgagauccacagcgacaucuucagccccauggacauccacgccuucucccagcagcggcagccgaacgcgaccaaccccugcggcaucgacaacggcgggugcagccaccugugccucaugucccccgugaagcccuucuaccagugcgccugcccgacgggcgugaagcugcuggagaacgggaagaccugcaaggacggcgccaccgagcuccugcugcucgcccgccggaccgaccugcgccggaucagccuggacacgcccgacuucaccgacaucguccuccagcuggaggacauccgccacgccaucgcgaucgacuacgaccccguggagggguacaucuacuggaccgacgacgaggugcgggccauccgccgguccuucaucgacggcagcggcucccaguucgucgugaccgcccagaucgcccaccccgacgggaucgccguggacugggucgcgcgcaaccuguacuggacggacaccggcaccgaccgcaucgaggugacccggcucaacgggacgaugcgcaagauccugaucagcgaggaccuggaggagccgcgggccaucguccucgaccccauggugggcuacauguacuggaccgacuggggggagauccccaagaucgagcgcgccgcccuggacggcuccgaccgggugguccuggugaacaccagccugggcuggcccaacgggcucgcgcuggacuacgacgagggcaagaucuacuggggggacgccaagaccgacaagaucgaggugaugaacacggacggcaccgggcgccggguccugguggaggacaagaucccgcacaucuucggcuucacccuccugggcgacuacguguacuggaccgacuggcagcgccgguccaucgagcgcguccacaagcggagcgccgagcgcgaggugaucaucgaccagcugcccgaccucauggggcugaaggccacgaacgugcaccgggucaucggcuccaaccccugcgccgaggagaacgggggcugcagccaccugugccucuaccgcccccagggccugcggugcgcgugcccgaucggguucgagcugaucuccgacaugaagaccugcaucgugcccgaggccuuccuccuguucagccgccgggccgacauccgccggaucucccuggagaccaacaacaacaacguggccaucccccucaccggcgucaaggaggccagcgcgcuggacuucgacgugacggacaaccgcaucuacuggaccgacaucucccugaagaccaucagccgcgccuucaugaacgggagcgcccucgagcacguggucgaguucggccuggacuaccccgaggggauggccguggacuggcugggcaagaaccucuacugggccgacaccggcaccaaccggaucgagguguccaagcuggacgggcagcaccgccagguccugguguggaaggaccucgacagcccgcgggcgcuggcccuggaccccgccgagggcuucauguacuggacggagugggggggcaagcccaagaucgaccgcgccgcgauggacggguccgagcggaccacccucgugccgaacgucggccgcgccaacggccugaccaucgacuacgccaagcggcgccuguacuggacggaccucgacaccaaccugaucgagagcuccaacaugcuggggcucaaccgggaggugaucgccgacgaccugccccaccccuucggccugacccaguaccaggacuacaucuacuggaccgacuggagccgccgguccaucgagcgcgccaacaagacgagcgggcagaaccggaccaucauccagggccaccucgacuacgugauggacauccuggucuuccacuccagccgccaguccggguggaacgagugcgcgagcuccaacggccacugcagccaccugugccucgccgugcccgugggcggguucgucugcggcugcccggcccacuacucccugaacgccgacaaccggaccugcagcgcccccaccacguuccugcucuucucccagaagagcgcgaucaaccgcauggugaucgacgagcagcagagccccgacaucauccugcccauccacucccugcggaacgugcgcgccaucgacuacgacccgcucgacaagcagcuguacuggaucgacagccggcagaacaugauccgcaaggcccaggaggacgggucccagggcuucaccgucguggugagcuccguccccagccagaaccuggagauccagcccuacgaccucuccaucgacaucuacagccgguacaucuacuggaccugcgaggccaccaacgugaucaacgugacgcgccuggacgggcgcuccgucggcguggugcugaagggcgagcaggaccggccccgcgccgucguggugaacccggagaagggguacauguacuucaccaaccuccaggagcggagccccaagaucgagcgcgcggcccuggacggcaccgagcgggagguccuguucuucuccgggcucagcaagcccaucgcccuggcccuggacucccgccucggcaagcuguucugggcggacagcgaccugcggcgcaucgaguccagcgaccucuccggcgccaaccggaucgugcuggaggacagcaacauccugcagcccguggggcucaccgucuucgagaacuggcuguacuggaucgacaagcagcagcagaugaucgagaagaucgacaugacgggccgcgaggggcggaccaaggugcaggcccgcaucgcccagcuguccgacauccacgccgugaaggagcucaaccugcaggaguaccggcagcacccgugcgcgcaggacaacggcgggugcagccacaucugccuggucaagggcgacggcaccacccgcugcagcugccccaugcaccucgugcugcugcaggacgagcucuccugcggggagccccccacgugcagcccgcagcaguucaccugcuucaccggcgagaucgacugcauccccgucgccuggcggugcgacggguucaccgagugcgaggaccacuccgacgagcugaacugccccgugugcagcgagucccaguuccagugcgccagcggccagugcaucgacggggcccugcgcugcaacggcgacgccaacugccaggacaaguccgacgagaagaacugcgaggugcucugccugaucgaccaguuccggugcgcgaacggccagugcaucgggaagcacaagaagugcgaccacaacgucgacugcagcgacaaguccgacgagcuggacugcuaccccacggaggagccggccccccaggccaccaacaccgugggcagcgugaucggggucaucgugaccaucuucguguccggcacggucuacuucaucugccagcgcaugcucugcccccggaugaagggggacggcgagaccaugaccaacgacuacguggugcacggcccggccagcgucccccugggguacgugccccaccccuccagccuguccggcagccucccggggaugucccgcggcaagagcaugaucuccagccugagcaucaugggcggguccagcggcccccccuacgaccgcgcccacgugaccggggcguccagcuccagcuccagcuccacgaagggcaccuacuuccccgccauccugaacccgccccccagccccgccaccgagcggucccacuacaccauggaguucggguacagcuccaacagcccguccacccaccgcagcuacuccuaccggcccuacagcuaccgccacuucgccccccccacgaccccgugcuccaccgacgucugcgacagcgacuacgcccccagccggcgcaugaccuccguggcgacggccaagggcuacaccagcgaccucaacuacgacuccgagcccgugcccccgccccccaccccccggagccaguaccuguccgccgaggagaacuacgagagcugcccgcccucccccuacaccgagcgcagcuacucccaccaccuguaccccccgccccccagcccgugcacggacuccagcuga

SEQ ID NO: 32450 - RNA, 1074 nt, Artificial Sequence
  derived and/or modified sequence opt1 from LRPAP1__Homo_sapiens__NP_002328
auggcgccccgccgggugcgcagcuuccugcggggccugccggcccugcugcuccugcugcuguuccuggggcccuggcccgccgccucccacggcgggaaguacagccgcgagaagaaccagcccaagccgucccccaagcgggagagcggcgaggaguuccgcauggagaagcugaaccagcucugggagaaggcccagcggcugcaccucccgcccguccgccucgccgagcugcacgccgaccugaagauccaggagcgggacgagcucgcguggaagaagcugaagcuggacgggcucgacgaggacggcgagaaggaggcccgccugauccggaaccugaacgugauccucgccaaguacggccuggacgggaagaaggacgcccgccaggugaccuccaacagccuguccggcacccaggaggacgggcucgacgacccccggcuggagaagcuguggcacaaggcgaagacgagcggcaaguucuccggggaggagcucgacaagcuguggcgcgaguuccugcaccacaaggagaagguccacgaguacaacgugcuccuggagacccugagccggaccgaggagauccacgagaacgugaucucccccagcgaccucuccgacaucaagggcagcguccugcacucccgccacaccgagcugaaggagaagcuccggagcaucaaccagggccuggaccgccugcggcgcgugucccaccagggguacagcacggaggccgaguucgaggagccccgggugaucgaccucugggaccuggcccaguccgccaaccugaccgacaaggagcucgaggccuuccgcgaggagcugaagcacuucgaggcgaagaucgagaagcacaaccacuaccagaagcagcuggagaucgcccacgagaagcuccgccacgccgagagcgucggcgacggggagcgggugagccgcucccgggagaagcacgcccugcuggagggccgcaccaaggagcucggcuacaccgugaagaagcaccuccaggaccugagcgggcggaucucccgcgcccggcacaacgagcuguga

SEQ ID NO: 32451 - RNA, 4185 nt, Artificial Sequence
  derived and/or modified sequence opt1 from LRPPRC__Homo_sapiens__NP_573566
auggccgcccugcuccgcagcgcgcgguggcugcugcgcgccggcgccgcgccccggcucccgcugucccugcgccuccugcccgggggccccgggcggcugcacgccgcgagcuaccuccccgccgcccgcgccggcccgguggccgggggccugcugucccccgcccggcucuacgccaucgccgccaaggagaaggacauccaggaggagagcaccuucuccagccgcaagaucuccaaccaguucgacugggcgcugaugcggcuggaccucagcguccgccggaccggccgcauccccaagaagcugcugcagaagguguucaacgacacgugccgguccgggggccucgggggcagccacgcccugcugcuccugcgcuccugcgggagccugcuccccgagcugaagcuggaggagcggaccgaguucgcccaccgcaucugggacacccuccagaagcugggcgccguguacgacgucucccacuacaacgcccugcucaagguguaccugcagaacgaguacaaguucagcccgaccgacuuccuggcgaagauggaggaggccaacauccagcccaaccgggugacguaccagcgccucaucgccuccuacugcaacgucggcgacaucgagggggccagcaagauccugggcuucaugaagaccaaggaccugcccgugaccgaggccguguucuccgcgcucgucaccgggcacgcccgggccggcgacauggagaacgccgagaacauccugacggugaugcgcgacgccggcaucgagcccgggccggacaccuaccuggcgcuccugaacgccuacgccgagaagggcgacaucgaccacgugaagcagacccuggagaaggucgagaaguccgagcuccaccugauggaccgggaccugcuccagaucaucuucagcuucagcaaggccggguacccccaguacgugagcgagauccuggagaaggugaccugcgagcgccgcuacauccccgacgcgaugaaccugauccuccugcuggucacggagaagcuggaggacguggcccuccagauccugcuggccugccccguguccaaggaggacggcccgagcgucuucggguccuucuuccuccagcacugcgugaccaugaacacccccguggagaagcugaccgacuacugcaagaagcugaaggagguccagaugcacagcuucccccuccaguucacgcugcacugcgcccugcucgccaacaagaccgaccuggcgaaggcccugaugaaggccgugaaggaggagggcuuccccauccggccgcacuacuucuggccccuccuggugggccgccggaaggagaagaacguccaggggaucaucgagauccugaagggcaugcaggagcucggggugcaccccgaccaggagaccuacaccgacuacgucauccccugcuucgacuccgugaacagcgcccgcgccauccugcaggagaacggcugccuguccgacagcgacauguucucccaggcggggcuccggagcgaggccgccaacggcaaccuggacuucgugcuguccuuccucaagagcaacacgcugccgaucucccugcagagcauccgcuccagccuccugcugggcuuccggcgcuccaugaacaucaaccucuggagcgagaucaccgagcugcuguacaaggacgggcgguacugccaggagccccgcggccccaccgaggccgucggguacuuccucuacaaccugaucgacuccaugagcgacagcgaggugcaggccaaggaggagcaccuccggcaguacuuccaccagcuggagaagaugaacgugaagauccccgagaacaucuaccgcggcauccggaaccugcuggaguccuaccacgucccggagcucaucaaggacgcgcaccuccugguggagagcaagaaccuggacuuccagaagaccgugcagcugacguccagcgagcuggaguccacccucgagacccugaaggccgagaaccagcccauccgcgacguccugaagcagcucauccuggugcugugcagcgaggagaacaugcagaaggcccucgagcugaaggccaaguacgaguccgacauggugaccgggggcuacgcggcccugaucaaccucugcugccggcacgacaaggucgaggacgcccugaaccugaaggaggaguucgaccgccucgacagcuccgccgugcuggacacgggcaaguacguggggcugguccgggugcucgccaagcacggcaagcugcaggacgcgaucaacauccugaaggagaugaaggagaaggacgugcucaucaaggacaccaccgcccugagcuucuuccacaugcugaacggggccgcccuccgcggcgagaucgagaccgucaagcagcugcacgaggccaucgugacgcugggccucgcggagcccuccaccaacaucagcuucccgcuggugaccguccaccuggagaagggggaccucuccaccgcccuggagguggccaucgacugcuacgagaaguacaaggugcugccccggauccacgacguccucugcaagcugguggagaagggcgagacggaccugauccagaaggccauggacuucgugagccaggagcagggggagauggucaugcucuacgaccuguucuucgccuuccugcagaccggcaacuacaaggaggcgaagaagaucaucgagacccccgggauccgcgcccgcuccgcccggcuccagugguucugcgaccgcugcguggccaacaaccagguggagacccuggagaagcuggucgagcucacccagaagcuguucgagugcgaccgggaccagauguacuacaaccugcucaagcuguacaagaucaacggcgacuggcagcgcgcggacgccguguggaacaagauccaggaggagaacgugaucccccgggagaagacgcugcgccuccuggccgagauccugcgggagggcaaccaggaggucccguucgacgugcccgagcucugguacgaggacgagaagcacagccugaacuccagcagcgccuccaccaccgagcccgacuuccagaaggacauccugaucgccugccgccucaaccagaagaagggggcguacgacaucuuccugaacgccaaggagcagaacaucguguucaacgccgagaccuacagcaaccugaucaagcugcucauguccgaggacuacuucacgcaggccauggaggucaaggccuucgcggagacccacaucaagggcuucacccugaacgacgccgccaacagccggcugaucaucacccaggugcgccgggacuaccucaaggaggccgugacgacccugaagaccguccuggaccagcagcagacccccucccgccucgccgugacgcgggugauccaggcgcuggccaugaagggggacgucgagaacaucgagguggugcagaagaugcugaacggccucgaggacagcaucgggcuguccaagauggucuucaucaacaacaucgcccuggcccagaucaagaacaacaacaucgacgccgcgaucgagaacaucgagaacaugcucaccagcgagaacaaggugaucgagccgcaguacuucggccuggccuaccuguuccgcaaggugaucgaggagcagcucgagcccgccgucgagaagaucuccaucauggccgagcggcuggcgaaccaguucgccaucuacaagcccgugaccgacuucuuccugcagcucguggacgccggcaaggucgacgacgcccgcgcccugcugcagcggugcggggcgaucgccgagcagacccccauccuccugcuguuccuccugcgcaacagccggaagcagggcaaggccuccacggucaagagcgugcuggagcucaucccggagcugaacgagaaggaggaggccuacaacucccugaugaaguccuacgugagcgagaaggacgugaccagcgccaaggcgcucuacgagcaccugaccgccaagaacaccaagcuggacgaccucuuccugaagcgcuacgccucccugcucaaguacgccggggagcccguccccuucaucgagcccccggagagcuucgaguucuacgcccagcagcugcggaagcugcgcgagaacuccagcuga

SEQ ID NO: 32452 - RNA, 1245 nt, Artificial Sequence
  derived and/or modified sequence opt1 from LRR1__Homo_sapiens__NP_689542
augaagcugcacugcgagguggaggucaucagccgccaccuccccgcccugggccugcggaaccgcgggaagggcgugcgggccgugcucucccugugccagcagaccagccgcucccagccgcccguccgggcguuccugcucaucagcacccugaaggacaagcgcgggacgcgguacgagcugcgcgagaacaucgagcaguucuucaccaaguucguggacgagggcaaggccaccgugcggcucaaggagccgcccgucgacaucugccuguccaaggccaucagcuccagccugaagggguuccucuccgccaugcgccuggcccaccggggcugcaacguggacacccccgugagcacgcugacccccgucaagaccuccgaguucgagaacuucaagaccaagauggugaucacgagcaagaaggacuacccccucuccaagaacuuccccuacagccuggagcaccuccagaccuccuacugcggccuggugcgcgucgacaugcggaugcugugccucaagagccugcgcaagcuggaccugucccacaaccacaucaagaagcucccggcgaccaucggggaccugauccaccuccaggagcugaaccugaacgacaaccaccuggagagcuucuccguggcccucugccacagcacccugcagaagucccugcggagccucgaccugagcaagaacaagaucaaggcccugcccgugcaguucugccagcuccaggagcugaagaaccugaagcucgacgacaacgagcugauccaguuccccugcaagaucggccagcugaucaaccuccgcuuccuguccgccgcgcggaacaagcugcccuuccucccgagcgaguuccgcaaccugucccuggaguaccucgaccuguucgggaacacguucgagcagcccaagguccugcccgugaucaagcugcaggcgccccucacccugcuggagagcuccgcccggaccauccuccacaaccgcaucccguacggcagccacaucauccccuuccaccugugccaggaccuggacaccgccaagaucugcgugugcgggcgguucugccucaacuccuucauccagggcacgaccaccaugaaccugcacagcgucgcccacaccguggugcuggucgacaaccucggcgggacggaggcccccaucaucuccuacuucugcagccugggcugcuacgugaacuccagcgacaugcugaaguga

SEQ ID NO: 32453 - RNA, 1764 nt, Artificial Sequence
  derived and/or modified sequence opt1 from LRRC15__Homo_sapiens__NP_001128529
augccccuggacaaggccaugccgcucaagcacuaccugcugcuccuggugggcugccaggccuggggcgcggggcuggccuaccacgggugccccagcgagugcacgugcucccgcgccagccaggucgagugcaccggcgcccggaucguggccgugcccacgccccucccguggaacgcgaugucccugcagauccugaacacccacaucaccgagcucaacgagagccccuuccugaacaucuccgcccugaucgcccuccgcaucgagaagaacgagcugagccggaucacccccggggccuuccgcaaccugggcucccuccgguaccugagccuggcgaacaacaagcuccagguccugcccaucggccuguuccaggggcucgacucccuggagagccugcuccuguccagcaaccagcugcuccagauccagccggcccacuucucccagugcagcaaccugaaggagcugcagcuccacggcaaccaccuggaguacauccccgacggggccuucgaccaccuggugggccucaccaagcugaaccuggggaagaacucccucacccacaucagcccccgcguguuccagcaccugggcaaccugcagguccuccggcuguacgagaaccgccugaccgacauccccaugggcaccuucgacgggcucgugaaccugcaggagcuggcccuccagcagaaccagaucggccugcuguccccgggccucuuccacaacaaccacaaccugcagcggcuguaccugagcaacaaccacaucucccagcucccgcccagcguguucaugcagcugccccagcugaaccgccucacgcuguucgggaacagccugaaggagcucucccccggcaucuucgggcccaugcccaaccugcgggagcuguggcucuacgacaaccacaucagcucccugcccgacaacgucuucagcaaccugcgccagcuccaggugcugauccugucccggaaccagaucagcuucaucuccccgggcgccuucaacgggcucaccgagcugcgcgagcugagccuccacaccaacgcgcugcaggaccuggacggcaacguguuccggaugcucgccaaccugcagaacaucucccugcagaacaaccgccuccggcagcugcccgggaacaucuucgccaacgucaacggccugauggccauccagcuccagaacaaccagcuggagaaccugccccucggcaucuucgaccaccuggggaagcugugcgagcuccgccuguacgacaaccccuggcggugcgacagcgacauccugccgcuccgcaacuggcugcugcucaaccagccccggcugggcaccgacacggugcccgugugcuucucccccgccaacguccgcgggcagagccugaucaucaucaacgugaacguggcggucccguccgugcacgugcccgagguccccagcuacccggagacccccugguaccccgacacccccuccuacccggacaccacgagcguguccagcaccaccgagcucaccucccccguggaggacuacacggaccugaccaccauccaggucaccgacgaccgcagcguguggggcaugacgcaggcccagagcgggcuggccaucgccgccaucgucaucggcaucguggcgcucgccugcucccuggccgccugcgugggcugcugcugcugcaagaagcggagccaggccguccugaugcagaugaaggcgcccaacgagugcuga

SEQ ID NO: 32454 - RNA, 4098 nt, Artificial Sequence
  derived and/or modified sequence opt1 from LRRC16A__Homo_sapiens__NP_001167448
augaccgaggagagcuccgacgugccccgcgagcugaucgagagcaucaaggacgucaucggccggaagaucaagaucuccgugaagaagaaggugaagcucgaggucaagggggacaagguggagaacaaggugcugguccugaccagcugccgcgccuuccucgugacggcccggaucccgaccaagcuggagcugaccuucuccuaccucgagauccacggcguggucugcagcaaguccgcgcagaugaucguggagaccgagaagugcagcaucuccaugaagauggccagccccgaggacguguccgagguccuggcccacaucgggacgugccugcgcaagaucuuccccggccucagccccgugcggaucaugaagaagguguccauggagccgagcgagcgccuggccucccugcaggcccucugggacagccagaccgucgcggagcaggggcccugcggcggcuucucccagauguacgccugcgugugcgacuggcugggguucagcuaccgggaggaggugcagugggacgucgacaccaucuaccugacccaggacacgcgcgagcucaaccugcaggacuucucccaccuggaccaccgggaccucauccccaucaucgccgcccuggaguacaaccagugguucaccaagcugagcagcaaggaccucaagcuguccaccgacgugugcgagcagauccugcgcguggucagccgguccaaccgccucgaggagcuggugcuggagaacgcgggccuccggaccgacuucgcccagaagcuggccagcgcccuggcccacaaccccaacuccgggcuccacacgaucaaccuggcgggcaacccgcuggaggaccgcggggugagcucccucagcauccaguucgccaagcugcccaagggccugaagcaccucaaccuguccaagaccagccugucccccaagggcgucaacagccucucccagagccuguccgccaacccccugaccgccagcacccucgugcaccuggaccuguccgggaacguccuccggggcgacgaccugagccacauguacaacuuccuggcccagccgaacgcgaucgugcaccucgaccuguccaacacggagugcagccuggacauggugugcggggcccugcuccgcggcugccugcaguaccuggccguccucaaccugagccggaccguguucucccaccgcaagggcaaggaggugccgcccagcuucaagcaguucuucuccagcucccuggcccucaugcacaucaaccugagcgggaccaagcugucccccgagccgcucaaggcccugcugcucggccuggcgugcaaccacaaccugaagggggucagccucgaccuguccaacugcgagcugcggagcggcggggcccaggugcucgagggcugcaucgccgagauccacaacaucaccucccuggacaucagcgacaacggccuggaguccgaccucagcacgcugaucguguggcuguccaagaaccgcagcauccagcaccucgcccuggggaagaacuucaacaacaugaaguccaagaaccugacccccguccucgacaaccuggugcagaugauccaggacgaggagagcccccugcagagccucucccuggccgacagcaagcugaagaccgaggugaccaucaucaucaacgcgcucggcuccaacacgagccugaccaaggucgacaucuccgggaacggcaugggggacaugggcgccaagaugcuggccaaggcccuccagaucaacaccaagcugcggaccgugaucugggacaagaacaacaucacggcgcagggcuuccaggacaucgccguggccauggagaagaacuacacccugcgcuucaugcccaucccgauguacgacgccagccaggcccucaagaccaaccccgagaagaccgaggacgcgcugcagaagaucgagaacuaccugcuccgcaaccacgagacgcggaaguaccugcaggagcaggccuaccgccugcagcaggggaucgucaccuccaccacccagcagaugaucgaccggaucugcgugaaggugcaggaccaccucaacagccugcgcaacugcggcggggacgccauccaggaggaccugaaguccgccgagcggcucaugcgcgacgccaagaacagcaagacgcugcugcccaaccucuaccacgucggcggggcguccugggccggcgccagcggccugcuguccagccccauccaggagacccucgaguccauggccggggaggugacccggguggucgacgagcagcugaaggcccugcucgagagcaugguggacgcggccgagaaccugugcccgaacgugaugaagaaggcccacauccgccaggaccugauccacgccuccaccgagaagaucagcaucccccggaccuucgucaagaacgugcuccuggagcaguccggcaucgacauccugaacaagaucagcgaggugaagcucacggucgcgagcuuccuguccgaccgcaucguggacgagauccuggacgcccucagccacugccaccacaagcuggccgaccacuucucccggcgcgggaagacccugccccagcaggagagccucgagaucgagcuggccgaggagaagcccgugaagcgguccaucaucaccgucgaggagcugaccgagaucgagcgccucgaggaccuggacacgugcaugaugacccccaagagcaagcggaaguccauccacagccgcaugcugcggcccgugucccgcgccuucgagauggaguucgaccucgacaaggcgcuggaggaggugcccauccacaucgaggacccgcccuuccccagccugcggcaggagaagcgcuccagcggcuucaucuccgagcuccccagcgaggagggcaagaagcuggagcacuucaccaagcugcgcccgaagcggaacaagaagcagcagcccacccaggccgccgucugcgccgccaacaucgugucccaggacggggagcagaacggccucauggggcgcguggacgagggcgucgacgaguucuucacgaagaaggugaccaagauggacagcaagaagugguccacccgggggagcgagucccacgagcugaacgagggcggcgacgagaagaagaagcgcgacagccggaaguccuccggguuccugaaccucaucaagagccgcuccaagagcgagcggccgcccaccauccugaugacggaggagcccuccagccccaagggcgcggugcgcuccccgcccgucgacugcccccggaaggacaccaaggccgccgagcacaacgggaacagcgagcgcaucgaggagaucaagacccccgacuccuucgaggagagccagggcgaggagaucgggaagguggagcgguccgacagcaaguccagcccccaggccggccgccgguacggcgugcaggucaugggguccggccugcucgccgagaugaaggcgaagcaggagaagcgcgccgccugcgcccagaagaagcuggggaacgacgcggugagccaggacuccagcucccccgcccugagcggcguggagcggagcgacgggggcggcgccgggcucccggagaaccgcuucggccuggggacccccgagaagaacacgaaggccgagcccaaggccgaggcgggcucccggagccgcuccagcuccagcacccccaccuccccgaagccccugcuccagagccccaagcccucccuggccgcccggccggucaucccccagaagccccgcaccgccagccggccggacgacauccccgacucccccagcucccccaagguggcccugcugccgcccgugcucaagaagguccccagcgacaaggagcgcgacgggcaguccagcccccagccgagcccccgcacguucagccaggaggugucccggcgcagcuggggccagcaggcgcaggaguaccaggagcagaagcagcggagcuccagcaaggacggccaccagggguccaagagcaacgacuccggcgaggaggccgagaaggaguucaucuucguguga

SEQ ID NO: 32455 - RNA, 4119 nt, Artificial Sequence
  derived and/or modified sequence opt1 from LRRC16B__Homo_sapiens__NP_612369
auggccaagcccagcguggagcugacccgcgagcuccaggacuccauccggcgcugccugagccagggcgccguccugcagcagcaccacgugaagcucgagaccaagccgaagaaguucgaggaccgggugcuggcgcugacguccuggcgccuccaccuguuccugcucaagguccccgccaagguggagagcuccuucaacgugcuggagauccgggccuucaacacccugagccagaaccagauccucgucgagaccgagcgcgggaugguguccaugcggcugcccagcgccgaguccguggaccaggucacccgccacgugagcuccgcccugagcaaggugugccccggcccggggugccucauccggcgcggcaacgcggacacgcccgaggggccccgggacaccucccccaacagcgagaccuccaccagcacgacccacuccgucugcggcggcuucagcgagaccuacgccgcccugugcgacuacaacgggcugcacugccgcgaggaggugcagugggacguggacaccaucuaccacgccgaggacaaccgggaguucaaccuccuggacuucucccaccuggagagccgcgaccucgcgcugauggucgccgcccuggccuacaaccagugguucacgaagcucuacugcaaggaccugcggcugggcagcgaggugcucgagcaggugcugcacacccuguccaagagcgggucccucgaggagcugguccuggacaacgccggccucaagaccgacuucgugcagaagcuggcggggguguucggcgagaacggcagcugcguccugcacgcccucacccugucccacaacccgaucgaggacaagggguuccugagccucucccagcagcugcugugcuuccccagcggccucacgaagcugugccuggccaagaccgccaucuccccccgcgggcuccaggcccugggccagaccuucggcgcgaaccccgccuucgccagcucccugcgguaccucgaccugagcaagaacccggggcugcuggccaccgacgaggccaacgcgcucuacuccuuccuggcccagcccaacgcccuggugcaccucgaccugagcggcacggacugcgugaucgaccugcuccugggggcccugcuccacggcugcugcucccaccugaccuaccugaaccucgcccgcaacagcugcucccaccggaaggggcgcgaggcgccccccgccuucaagcaguucuucagcuccgccuacacccugagccacgucaaccugagcgccaccaagcucccgcuggaggcgcugcgggcccuccugcagggccugucccucaacagccaccuguccgaccugcaccucgaccugagcuccugcgagcugcgcagcgccggcgcccaggcccuccaggagcagcugggggcggugacgugcgucggcucccuggaccucagcgacaacggguucgacuccgaccugcugacccucgugcccgcccugggcaagaacaagagccugaagcaccucuuccuggggaagaacuucaacgugaaggccaagacccuggaggagauccuccacaagcugguccagcugauccaggaggaggacugcucccuccagagccuguccguggccgacagccgccugaagcuccggaccuccauccugaucaacgcccugggcagcaacacgugccucgcgaagguggaccuguccggcaacgggauggaggacaucggcgccaagaugcugagcaaggcccuccagaucaacagcucccugcgcaccauccugugggaccggaacaacaccagcgcccucggguuccuggacaucgcccgcgcgcuggaguccaaccacacccuccgguucaugagcuuccccgucuccgacaucagccaggccuaccgcuccgcccccgagcggacggaggacguguggcagaagauccaguggugccuggugcgcaacaaccacagccagaccugcccgcaggagcaggccuuccggcugcagcagggccucgucaccuccagcgcggagcagaugcugcagcgccugugcgggcgggugcaggaggaggugcgcgcccuccggcugugcccccuggagcccguccaggacgagcuccuguacgcccgcgaccugaucaaggacgccaagaacucccgggcccucuuccccagccuguacgagcugggccacgugcucgcgaacgacggcccggugcgccagcggcuggaguccgucgccagcgagguguccaaggccguggacaaggagcugcaggucauccucgagagcauggugucccugacccaggagcugugccccguggccaugcgcgucgccgaggggcacaacaagaugcucagcaacguggcggagcgggugacggucccccgcaacuucauccgcggcgcccugcuggagcaggccgggcaggacauccagaacaagcucgacgaggugaagcuguccguggucaccuaccugaccagcagcaucguggacgagauccuccaggagcuguaccacucccacaagagccuggcccggcaccucacccagcugcgcacccuguccgaccccccgggcugccccggccaggggcaggaccucagcucccggggccgcgggcggaaccacgaccacgaggagacgaccgacgacgagcugggcaccaacaucgacaccauggccaucaagaagcagaagcgcugccggaagauccgccccgugagcgcguucaucuccgggagcccgcaggacauggagucccagcugggcaaccucggcaucccccccgggugguucagcggccuggggggcucccagcccacggccagcggguccugggagggccugagcgagcugccgacccacggcuacaagcuccggcaccagacccaggggcgcccccggcccccccgcaccacgccgcccggccccgggcggcccuccaugccggcccccggcacccgccaggagaacgggauggccacccggcuggacgagggccuggaggacuucuucagccgccggguccucgaggaguccagcuccuacccccgcacccugcggacggugcgccccggccugagcgaggcgccgcuccccccccugcagaagaagcggcgccgcgggcuguuccacuuccggcgcccccggagcuucaagggcgaccgcgggccgggcucccccaccaccgggcuccugcugccccccccgccccccccgccccccacccaggagagccccccgucccccgacccccccagccucggcaacaacuccagcccgugcuggucccccgaggaggagagcucccugcugcccggcuucgggggcgggcggggccccagcuuccgccggaagaugggcacggagggguccgagccgggcgaggggggccccgcccccgggaccgcccagcagccccgcgugcacggcgucgcccucccgggccuggagcgggccaagggguggagcuucgacggcaagcgcgaggggcccggccccgaccaggagggguccacccaggcguggcagaagcggcgcagcuccgacgacgccggccccggcagcuggaagccgcccccccccccgcaguccaccaagcccagcuucuccgccaugcggcgcgccgaggccacguggcacaucgcggaggagagcgcccccaaccacagcugccagucccccagcccggccucccaggacggggaggaggagaaggagggcacccuguuccccgagcggacccuccccgcccgcaacgccaagcugcaggacccggcgcuggcccccuggccccccaagccgguggccgugccccgggggcgccagcccccccaggagccgggcguccgggaggaggccgaggccggggacgcggcccccggcgugaacaagccccgccuccgccugagcucccagcaggaccaggaggagcccgaggugcagggcccgcccgaccccgggcggcgcaccgccccccugaagccgaagcggacgcgccgggcccagagcugcgacaagcucgagcccgaccgccggcgcccccccgacccgaccggcaccuccgagcccgggaccgacuga

SEQ ID NO: 32456 - RNA, 942 nt, Artificial Sequence
  derived and/or modified sequence opt1 from LRRC17__Homo_sapiens__NP_005815
augcgcguggucaccaucgugauccugcucugcuucugcaaggccgccgagcugcggaaggcgagccccggcuccgugcgcagccgggucaaccacgggcgcgccggcgggggccggcgcggguccaacccggugaagcgguacgcccccggccugcccugcgacguguacaccuaccuccacgagaaguaccuggacugccaggagcgcaagcuggucuacgugcuccccggcuggccgcaggaccugcugcacaugcuccuggcccggaacaagauccgcacgcugaagaacaacauguucagcaaguucaagaagcucaagucccuggaccugcagcagaacgagaucagcaagaucgaguccgaggccuucuucgggcucaacaagcugaccacccugcuccugcagcacaaccagaucaaggugcugaccgaggaggucuucaucuacacgccccuccugagcuaccugcggcucuacgacaaccccuggcacugcacgugcgagaucgagacccugaucuccaugcugcagaucccccgcaaccggaaccucggcaacuacgcgaagugcgagagcccgcaggagcagaagaacaagaagcugcgccagaucaaguccgagcagcugugcaacgaggaggagaaggagcagcucgaccccaagccccaggugagcgggcggcccccggugaucaagcccgaggucgacuccaccuucugccacaacuacguguuccccauccagacccuggacugcaagcgcaaggagcugaagaaggugcccaacaacaucccgcccgacaucgucaagcucgaccugagcuacaacaagaucaaccagcugcggcccaaggaguucgaggacgugcacgagcucaagaagcugaaccuguccagcaacggcaucgaguucaucgaccccgggucccuccgcuga

SEQ ID NO: 32457 - RNA, 786 nt, Artificial Sequence
  derived and/or modified sequence opt1 from LRRC18__Homo_sapiens__XP_011538131
auggugaagggcgagaaggggcccaagggcaagaagaucacccugaaggucgcccgcaacugcaucaagaucaccuucgacgggaagaagcggcucgaccugagcaagaugggcaucacgaccuucccgaagugcauccugcgccucuccgacauggacgagcuggaccugagccggaaccucauccgcaagauccccgacuccaucagcaaguuccagaaccugcgguggcuggaccuccacuccaacuacaucgacaagcugcccgagagcaucgggcagaugaccucccugcucuaccugaacgugagcaacaaccgccugaccuccaacggccuccccguggagcugaagcagcugaagaacauccgggccgucaaccucggccugaaccaccuggacagcgugccgacgacccucggggcgcugaaggagcugcacgaggugggccuccacgacaaccugcugaacaacauccccgucuccaucagcaagcuccccaagcugaagaagcugaacaucaagcgcaaccccuucccgaagcccggggaguccgagaucuucaucgacagcauccggcgccucgagaaccuguacgugguggaggagaaggaccugugcgccgccugccuccggaagugccagaacgcccgcgacaaccugaaccggaucaagaacauggccaccaccacgccccgcaagaccaucuuccccaaccugaucuccccgaacagcauggcgaaggacuccugggaggacuggcggauccgccucaccagcuccuga

SEQ ID NO: 32458 - RNA, 1575 nt, Artificial Sequence
  derived and/or modified sequence opt1 from LRRC1__Homo_sapiens__NP_060684
auguuccacugcaucccccuguggcgcugcaaccggcacguggagagcaucgacaagcgccacugcucccucgucuacgugccggaggagaucuaccgguacgcccgcagccuggaggagcugcuccuggacgccaaccagcugcgggagcuccccgagcaguucuuccagcuggugaagcugcgcaagcucggccuguccgacaacgagauccagcggcugccgcccgagaucgcgaacuucaugcagcucgucgagcuggacgugagccgcaacgagauccccgagauccccgaguccaucagcuucugcaaggcccuccagguggccgacuucuccgggaacccccucacccggcugcccgagagcuucccggagcugcagaaccugaccugccuguccgucaacgacaucagccugcagucccuccccgagaacaucggcaaccuguacaaccuggccagccucgagcugcgcgagaaccugcucacguaccugcccgacucccugacccagcuccggcgccuggaggagcuggaccucgggaacaacgagaucuacaaccugcccgagagcaucggcgcccugcuccaccugaaggaccuguggcucgacgggaaccagcuguccgagcugccgcaggagaucggcaaccucaagaaccugcugugccucgacgugagcgagaaccggcuggagcgccugcccgaggagaucuccggccucaccagccugaccgaccuggugaucucccagaaccugcucgagacgauccccgacgggaucggcaagcugaagaagcugagcauccucaaggucgaccagaaccggcugacccagcugcccgaggcggugggggagugcgagagccucaccgagcuggugcugaccgagaaccagcuccugacgcugccgaaguccaucggcaagcucaagaagcugagcaaccugaacgccgaccgcaacaagcucgucucccugcccaaggagaucgggggcugcugcagccugaccguguucugcgugcgggacaaccgccucacccggauccccgccgaggucucccaggccaccgagcugcacgugcuggacguggcgggcaaccgccuccugcaccucccccugagccugacggcccugaagcucaaggcccuguggcuguccgacaaccagagccagccgcuccugaccuuccagaccgacaccgacuacacgaccggggagaagauccugaccugcguccuccugccccagcugcccuccgagccgaccugccaggagaaccucccccggugcggcgcccuggagaaccuggugaacgacgugagcgacgaggccuggaacgagcgcgcggucaaccgcguguccgccauccgguucguggaggacgagaaggacgaggaggacaacgagacgcgcacccuccugcggcgcgccacgccccaccccggggagcugaagcacaugaagaagaccgucgagaaccuccggaacgacaugaacgccgccaagggccuggacagcaacaagaacgaggugaaccacgcgaucgaccgcgucaccaccuccguguga

SEQ ID NO: 32459 - RNA, 555 nt, Artificial Sequence
  derived and/or modified sequence opt1 from LRRC20__Homo_sapiens__NP_001265141
augcugaagaagaugggcgaggccguggcccgcgucgcccggaaggugaacgagaccguggagagcggguccgacacccucgaccuggccgagugcaagcuggucagcuuccccaucggcaucuacaaggugcuccgcaacguguccgggcagauccaccugaucacgcuggccaacaacgagcucaagagccugaccuccaaguucaugaccaccuucagccagcugcgggagcuccaccuggagggcaacuuccugcaccgccucccguccgaggucagcgcccugcagcaccugaaggccaucgaccucucccggaaccaguuccaggacuuccccgagcagcugacggcgcugcccgcccucgagaccaucaaccuggaggagaacgagaucguggacgugcccgucgagaagcuggccgccaugccggcgcuccgcagcaucaaccugcgguucaacccccugaacgccgaggugcgcgugaucgccccgccccucaucaaguucgacaugcugaugucccccgagggggcccgggcgccccugcccuga

SEQ ID NO: 32460 - RNA, 1005 nt, Artificial Sequence
  derived and/or modified sequence opt1 from LRRC26__Homo_sapiens__NP_001013675
augcgcggccccagcuggucccggccgcgcccccugcuccugcugcuccugcugcucagccccuggcccgugugggcccaggucuccgccaccgcgagcccguccgggagccugggcgcccccgacugccccgaggugugcacgugcgugcccgggggccuggccuccugcagcgcccucucccugccggccgucccgcccgggcugagccuccggcugcgcgcgcugcuccuggaccacaaccgggugcgcgcccugccgcccggcgccuucgccggcgcgggggcccuccagcggcuggaccugcgcgagaacggccuccacuccgugcacguccgggccuucugggggcugggcgcccugcagcuccuggaccugagcgccaaccagcucgaggcgcuggcccccgggaccuucgcgccccugcgcgcccuccggaaccugucccuggccggcaaccgccucgcccggcuggagcccgccgcccugggcgcccucccccugcugcgcagccucucccugcaggacaacgagcuggccgcgcucgcccccgggcugcugggccggcuccccgcccuggacgcccugcaccuccgcgggaaccccuggggcugcggcugcgcccugcggccgcugugcgcguggcugcgccggcacccccuccccgccagcgaggccgagaccgugcugugcguguggcccgggcgccugacccucuccccgcugaccgccuucagcgacgcggccuucucccacugcgcccagccccuggcccuccgggaccuggccgucguguacacgcugggccccgcgagcuuccucgugagccuggccuccugccuggcccucgggagcggccugaccgccugccgcgcccgccggcgccggcugcgcaccgcggcccuccggcccccgcgcccgcccgaccccaaccccgaccccgacccccacgggugcgccuccccggccgaccccggcagccccgccgcggccgcccaggccuga

SEQ ID NO: 32461 - RNA, 906 nt, Artificial Sequence
  derived and/or modified sequence opt1 from LRRC30__Homo_sapiens__NP_001099051
augggcgcccgccagagccgggccuccagcaaggacaaggggcccaagcgcaugcuguucaccggccggcgccagaaguucuccccgugggacgacgcgcuccugagcgggcgggacccccgcucccugcucaagcggggcaugcaccacgugagcuucucccuggucacccgcgggaugacggacauccccgacuuccuguggggccucagcgaggugcagaagcugaaccugucccacaaccagcuccgggugcugcccccggaggucggcaagcugacccgcaucguggugcucaaccugugcgggaaccggcucaagagccugccccgcgaggucucccugcugcagugccucaaggugcuguucgugaacaugaacugccugaccgagguccccgccgagcucagccugugccggaagcuggaggugcucucccugagccacaacugccugucccagcuccccgccugcuucgccgaccugagccgccugcggaagcucaaccuguccaacaacuucuucgcccacaucccgaugugcguguucagccugaaggagcucaucuuccugcacgucggcuccaaccgccuggagaacaucgcggagagcauccagcaccucgccagccugcagaucuucaucgccgaggggaacaacauccacuccuucccccggagccugugccucgugaccucccuggagcugcucaaccugaacaacaacgacauccagacgcugcccagcgagcuccaccuccugugccgccuggugcggaucgccuggaaccccauggacaagggccugcacaucucccacaacccgcugagcaagccccugcccgagcucgucgagggcgggcuggagaugcuguucggcuaccucaaggacaagaagcacaccuga

SEQ ID NO: 32462 - RNA, 1989 nt, Artificial Sequence
  derived and/or modified sequence opt1 from LRRC32__Homo_sapiens__XP_005273959
augcgcccccagauccugcuccugcuggcccuccugacccugggccucgccgcgcagcaccaggacaaggugccgugcaagauggucgacaagaaggugagcugccaggugcuggggcugcuccagguccccuccgugcugccgcccgacaccgagacgcuggaccucagcggcaaccagcugcgguccauccuggccagcccccucggguucuacaccgcccugcgccaccuggaccucuccaccaacgagaucagcuuccugcagcccggcgccuuccaggcccugacccaccucgagcaccugucccuggcgcacaaccggcucgccauggccacggcccugagcgccgggggccugggcccccucccccgcgugaccucccuggaccugagcgggaacucccucuacagcggccugcuggagcggcuccugggggaggcgccgucccugcacacccucagccuggccgagaacucccugacccgccucacgcggcacaccuuccgcgacaugcccgcccuggagcagcuggaccuccacagcaacguccugauggacaucgaggacggcgccuucgaggggcugccccggcucacccaccugaaccugucccgcaacagccugaccugcaucuccgacuucagccuccagcagcugcgggugcuggaccucagcugcaacuccaucgaggcguuccagacggccagccagccccaggccgaguuccagcugaccuggcuggaccuccgcgagaacaagcugcugcacuucccggaccucgccgcccugccccggcugaucuaccucaaccuguccaacaaccugauccgccuccccaccgggcccccgcaggacagcaagggcauccacgcgcccuccgagggguggagcgcccugccccuguccgcccccagcggcaacgccuccgggcggccgcucagccagcugcugaaccucgaccuguccuacaacgagaucgagcugauccccgacagcuuccucgagcaccugaccucccugugcuuccucaaccugagccgcaacugccugcggacguucgaggcccgccggcucggcucccugcccugccugaugcuccuggaccugagccacaacgcgcucgagacccuggagcugggcgcccgcgcccucgggucccugcggacccugcuccugcagggcaacgcccugcgcgaccugcccccguacaccuucgccaaccucgcgagccugcagcgccucaaccugcaggggaaccgggugucccccugcggcgggcccgacgagcccggcccgagcggcugcgucgccuucagcgggaucacgucccugcgcagccucucccugguggacaacgagaucgagcugcuccgggccggcgccuuccugcacacgccccugaccgagcucgaccugagcuccaaccccgggcuggagguggcgaccggcgcccucgggggccuggaggccagccuggagguccucgcccugcagggcaacgggcugauggugcuccagguggaccugccgugcuucaucugccugaagcgccucaaccuggccgagaaccggcugucccaccuccccgcguggacccaggccgucagccuggaggugcuggaccuccgcaacaacuccuucagccugcugcccggcuccgccaugggcggccucgagaccagccugcggcgccuguaccuccaggggaacccccuguccugcugcggcaacggcuggcuggccgcccagcuccaccaggggcggguggacgucgacgcgacccaggaccugaucugccgcuucagcucccaggaggaggugagccugucccacgugcggccggaggacugcgagaagggcgggcucaagaacaucaaccugaucaucauccugaccuucauccucgucagcgccauccugcugacgacccucgccgccugcugcugcgugcgccggcagaaguucaaccagcaguacaaggccuga

SEQ ID NO: 32463 - RNA, 5103 nt, Artificial Sequence
  derived and/or modified sequence opt1 from LRRC37A__Homo_sapiens__NP_055649
augagcagcgcccagugccccgcccucgugugcgugaugagccgccuccgguucuggggccccuggccccugcugauguggcagcuccuguggcugcucgugaaggaggcccagccccuggagugggugaaggacccccugcagcucaccuccaacccccugggcccgcccgagagcugguccagccacuccagccacuucccccgcgagagcccccacgcccccacccugcccgccgaccccugggacuucgaccaccucggccccuccgccuccagcgagaugcccgcgccgccccaggaguccaccgagaaccugguccccuuccuggacaccugggacagcgccggggagcagccccucgagcccgagcaguuccuggccucccagcaggaccugaaggacaagcucagcccccaggagcggcugcccgugucccccaagaagcugaagaaggaccccgcccagcgcuggagccucgccgagaucaucggcaucacccggcagcuguccaccccgcagagccagaagcagacgcugcagaacgaguacagcuccaccgacacccccuaccccgggagccugccgcccgagcugcgcgugaaguccgacgagccgcccggccccagcgagcaggucggccccucccaguuccaccuggagcccgagacccagaaccccgagacgcucgaggacauccagagcuccagccugcagcaggaggcgcccgcccagcugccccagcuccuggaggaggagcccuccagcaugcagcaggaggcccccgcccugccgcccgaguccagcauggagucccucacccugcccaaccacgaggugagcgugcagccgcccggggaggaccaggccuacuaccaccuccccaacaucaccgucaagcccgcggacguggaggugaccaucacguccgagcccaccaacgagaccgagagcucccaggcccagcaggagacccccauccaguuccccgaggaggucgagcccagcgccacgcagcaggaggcccccaucgagccgcccgugccgcccauggagcacgagcuguccaucagcgagcagcagcagcccgugcagcccagcgagagcccccgggaggucgagagcucccccacccagcaggagacccccggccagccgcccgagcaccacgaggugaccguguccccgcccgggcaccaccagacgcaccaccuggccucccccagcgucuccgugaagccgcccgacgugcagcugaccaucgcggccgagcccagcgccgaggucggcaccucccucgugcaccaggaggccaccacgcgccugagcggguccggcaacgacguggagccgcccgccauccagcacggcgggcccccgcugcuccccgagagcuccgaggaggcgggcccccuggccguccagcaggagaccagcuuccagucccccgagccgaucaacaacgagaaccccagccccacccagcaggaggccgccgccgagcacccccagaccgcggaggagggggaguccagccugacgcaccaggaggccccggcccagacccccgaguuccccaacguggucguggcccagcccccggagcacagccaccucacccaggcgaccgugcagccccuggaccugggcuucacgaucacccccgaguccaagaccgaggucgagcucagccccaccaugaaggagacgccgacccagccgcccaagaagguggugccgcagcugcgggucuaccagggcgugaccaaccccacccccgggcaggaccaggcccagcaccccguguccccgagcgucaccgugcagcugcuggaccucggccugacgaucacccccgagcccaccaccgagguggggcacuccacgcccccgaagcgcaccaucgucagccccaagcaccccgaggugacccugccccacccggaccaggugcagacccagcacucccaccucacgcgggccaccguccagccccuggaccugggcuucaccaucacccccaagagcaugacggagguggagcccuccaccgcccucaugaccaccgccccgccgcccgggcaccccgaggugacgcugccgcccagcgacaagggccaggcgcagcacucccaccugacccaggccaccguccagccccucgaccuggagcugaccaucacgaccaagcccaccaccgaggugaagccgagccccacgaccgaggagaccuccacccagccgcccgaccucggccuggccaucaucccggagcccacgaccgagaccgggcacagcaccgcccuggagaagacgaccgcgccccgcccggaccgggugcagacccuccaccgcucccugaccgaggucacggggccgcccaccgagcuggagcccgcgcaggacagccucgugcaguccgagagcuacacccagaacaaggcccugaccgccccggaggagcacaaggccuccaccagcacgaacaucugcgagcugugcacgugcggggacgagaugcucagcugcaucgaccugaaccccgagcagcggcugcgccaggugcccguccccgagccgaacacccacaacggcaccuucacgauccucaacuuccaggggaacuacaucuccuacaucgacggcaacguguggaaggccuacagcuggaccgagaagcugauccugcgggagaacaaccucaccgagcugcacaaggacuccuucgagggccugcucagccugcaguaccuggaccucuccugcaacaagauccagagcaucgagcgccacaccuucgagccccugcccuuccugaaguucaucaaccucuccugcaacgugaucacggagcugagcuucgggaccuuccaggcguggcacggcaugcaguuccugcacaagcucauccugaaccacaacccccugaccaccgucgaggacccguaccucuucaagcugcccgcccugaaguaccucgacauggggacgacccuggugccccugaccacccucaagaacauccugaugaugacgguggagcuggagaagcucauccugcccucccacauggccugcugccugugccaguucaagaacagcaucgaggccgucugcaagaccgugaagcuccacugcaacuccgcgugccugaccaacaccacgcacugcccggaggaggccagcgugggcaaccccgagggggccuucaugaagguccugcaggcccggaagaacuacaccuccaccgagcucaucguggagcccgaggagcccagcgacuccagcggcaucaaccuguccggcuucgggagcgagcagcuggacaccaacgacgaguccgacuucaucagcacgcucagcuacauccugccguacuucuccgccgugaaccuggacgucaagagccuccugcugcccuucaucaagcuccccaccaccggcaacucccuggcgaagauccagaccguggggcagaaccgccagcgggugaagcgcguccugaugggcccccgcagcauccagaagcggcacuucaaggaggugggccgccaguccauccggcgcgagcagggggcccaggccagcguggagaacgccgccgaggagaagcggcucacguccccggcgccccgcgaggucgagcagccccacacccagcagggcccggagaagcuggccgggaacgccguguacaccaagcccagcuucacccaggagcacaaggccgccguguccguccugaagcccuucagcaagggcacgcccuccaccagcuccccggcgaaggcccucccccaggugcgggaccgcagcaaggaccugacccacgccaucuccauccuggagagcgccaaggcgcgggugaccaacacgaagaccuccaagcccaucguccacgcccgcaagaaguaccgguuccacaagacccgcagccacgugacccaccggaccacgaaggugaagaagucccccaagguccgcaagaaguccuaccucagccggcugaugcuggccaaccgccucccguucuccgccgccaagagccugaucaacucccccagccagggggcguucuccagccugggcgaccucagcccccaggagaaccccuuccuggaggugagcgcccuguccgagcacuucaucgagaagaacaacaccaagcacaccaccgcccggaacgccuucgaggagaacgacuucauggagaacacgaacaugccggagggcaccaucagcgagaacaccaacuacaaccacccgcccgaggccgacuccgcggggaccgccuucaaccucggccccacggucaagcagaccgagaccaagugggaguacaacaacguggggaccgaccugagcccggagcccaaguccuucaacuacccccugcucagcucccccggcgaccaguucgagauccagcugacgcagcagcugcagagccucaucccgaacaacaacgugcgccggcugaucgcccacgucauccgcacccugaagauggacugcuccggggcccacguccaggugaccugcgccaagcucaucagccgcaccggccaccugaugaagcugcuguccggccagcaggaggucaaggcgagcaagaucgagugggacacggaccaguggaagaucgagaacuacaucaacgagagcaccgaggcccaguccgagcagaaggagaagucccucgagcugaagaaggaggugcccggguacggcuacaccgacaagcugauccucgcccugaucgugaccgggauccugacgauccucaucauccuguucugccugaucgucaucugcugccaccggcgcucccuccaggaggacgaggagggcuucagccgggggaucuuccgcuuccugcccuggcggggcugcuccagccgccgggagucccaggacggccugagcuccuucgggcagccccucugguucaaggaccuguacaagccgcugagcgccacccgcaucaacaaccacgccuggaagcuccacaagaaguccagcaacgaggacaagauccugaaccgggaccccggcgacuccgaggcgcccaccgaggaggaggagagcgaggcccugcccuga

SEQ ID NO: 32464 - RNA, 2844 nt, Artificial Sequence
  derived and/or modified sequence opt1 from LRRC37B__Homo_sapiens__NP_443120
augagcuggcugcgcuucuggggccccuggccgcuccugaccuggcagcugcucucccugcuggugaaggaggcccagccccucgucugggugaaggacccccugcagcugaccagcaacccccucgggccgcccgagcccugguccagccgguccagccaccuccccugggaguccccgcacgcccccgcgccgcccgccgcccccggcgacuucgacuaccuggggcccagcgccuccagccagauguccgcccugccccaggagcccacggagaaccuggcgccguuccugaaggagcucgacagcgccggcgagcugccccuggggcccgagcccuuccucgccgcccaccaggaccugaacgacaagcgcaccccggaggagcggcugcccgagguggucccccuccugaaccgcgaccagaaccaggcgcuggugcagcucccccggcugaagugggugcagaccaccgaccuggaccgcgccgccggccaccaggccgacgagauccucgucccgcuggacuccaaggugagccggcccacgaaguucguggucucccccaagaaccugaagaaggaccucgccgagcgcuggagccugcccgagaucgugggcaucccgcaccagcuguccaagccccagcggcagaagcagacccuccccgacgacuaccugagcauggacacccuguacccggggucccucccgcccgagcugcgcgugaacgcggacgagccgcccggcccgcccgagcaggucgggcugagccaguuccaccucgagcccaagagccagaaccccgagacccuggaggacauccaguccagcucccugcaggaggaggcccccgcccagcuccugcagcugccccaggagguggagcccagcacgcagcaggaggcccccgcccucccgcccgaguccagcauggagucccuggcgcagacgccccugaaccacgaggugaccguccagccgcccggcgaggaccaggcccacuacaaccuccccaaguucaccgugaagcccgccgacguggaggucaccaugaccagcgagcccaagaacgagaccgaguccacccaggcccagcaggaggcccccauccagccgcccgaggaggcggagcccagcuccacggcccugcggaccaccgacccgccgcccgagcaccccgaggugacccugccgcccagcgacaaggggcaggcccagcacucccaccugacggaggccaccgugcagccccucgaccuggagcugagcaucaccaccgagcccacgaccgaggucaagcccucccccaccaccgaggagacgagcgcccagccgcccgaccccggccucgcgaucacccccgagcccaccaccgagaucggccacuccacggcccuggagaagacccgcgcgccccaccccgaccaggugcagacccugcaccggagccucaccgaggugacggggcccccgaccaagcuggaguccagccaggacagccugguccaguccgagaccgcccccgaggagcagaaggccagcaccuccaccaacaucugcgagcucugcacgugcggcgacgagacccugagcugcguggggcugucccccaagcagcgccuccggcagguccccgugccggagcccgacaccuacaacggcaucuucaccacgcugaacuuccagggcaacuacaucagcuaccuggacgggaacguguggaaggccuacuccuggaccgagaagcucauccugagcgagaacuaccugaccgagcuccccaaggacuccuucgagggccugcuguaccuccaguaccuggaccugagcugcaacaagauccgcuacaucgagcggcagaccuucgagucccuccccuuccugcaguacaucaaccuggggugcaaccucaucacgaagcugagccugggcaccuuccaggccuggcacgggaugcaguuccuccacaaccugauccugaaccgcaacccgcucaccaccgucgaggaccccuaccuguucgagcugcccgcccucaaguaccuggacaugggcacgacccacaucacccugaccacgcucaagaacauccugaccaugaccguggagcuggagaagcucauccugcccucccacauggccugcugccugugccaguucaagaacagcaucgaggcggugugcaagaccgucaagcuccacugcaacacggccugccugaccaacuccauccacugcccggaggaggccagcgugggcaaccccgagggggccuucaugaagaugcugcaggcccggaagcagcacauguccacccagcucaccaucgagagcgaggcgcccagcgacuccagcggcaucaaccuguccggguucggcggggaccagcuggagauccagcucacggagcagcugcgcagccugaucccgaacgaggacgugcggaaguucaugucccacgucauccgcacccucaagauggagugcagcgagacccacgugcagggcuccugcgccaagcugaugcugcgcaccggccuccugaugaagcugcucagcgagcagcaggaggccaaggcccugaacguggagugggacacggaccagcagaagaccaacuacaucaacgagaacauggagcagaacgagcagaaggagcagaaguccagcgagcugaugaaggagguccccggggacgacuacaagaacaagcucaucuucgccaucuccgugaccgugauccugaucauccugaucaucaucuucugccucaucgaggucaacagccacaagcgggcguccgagaaguacaaggacaaccccagcaucuccggcgccuga

SEQ ID NO: 32465 - RNA, 1008 nt, Artificial Sequence
  derived and/or modified sequence opt1 from LRRC39__Homo_sapiens__XP_011538980
augaccgagaacguggucugcaccggcgccgugaacgccgugaaggaggucugggagaagcgcaucaagaagcugaacgaggaccucaagcgggagaaggaguuccagcacaagcuggugcgcaucugggaggagcgggugagccugacgaagcuccgcgagaaggucacccgggaggacgggcgcgugauccugaagaucgagaaggaggaguggaagacccugcccuccagccuccugaagcugaaccagcuccaggaguggcagcugcaccggaccggccugcucaagaucccggaguucaucgggcgcuuccagaaccugaucgugcuggaccucucccggaacacgaucagcgagaucccgcccggcaucgggcugcugacccgccuccaggagcugauccuguccuacaacaagaucaagaccguccccaaggagcucagcaacugcgcgucccuggagaagcuggagcucgccgugaaccgggacaucugcgaccugccccaggagcugagcaaccuccugaagcugacccaccucgaccuguccaugaacgacuucacgaccaucccccuggccgugcucaacaugcccgcccuggaguggcuggacaugggcagcaacaagcucgagcagcugcccgacaccaucgagcgcaugcagaaccugcacacccucuggcugcagcggaacgagaucacgugccugccgcagaccaucuccaacaugaagaaccucggcacccugguccugagcaacaacaagcuccaggacauccccgugugcauggaggagauggccaaccugcgcuucgugaacuuccgggacaacccccugaagcucaaggucucccugcccccgagcgaggggaccgacgaggaggaggagcgcgagcuguucggccugcaguucaugcacacguacauccaggagucccggcgccgggcggaccaccaggugaacgggagcaccacccuccccaucuccaucaacaccgacggcuga

SEQ ID NO: 32466 - RNA, 2061 nt, Artificial Sequence
  derived and/or modified sequence opt1 from LRRC49__Homo_sapiens__NP_060161
augauccccggcaaguaccgcagcguguccgggcgggccgccaacaacgucaacugcggccugcaccucgugauccagaccagcucccugccggagaagaacaagguggaguucaagcugaacaaggacaccagcuccuuccccgggcgccuccugcagcacgaccuggagcggaacuacagcucccgccagggcgaccacaucaaccucgucagcuccagccuguccagcuuccccauccugcagcgguccagcgaggagaagauccucuacuccgaccgccugagccuggagcggcagaagcucacggugugccccaucaucaacggggaggaccaccuccgccugcugaacuuccagcacaacuucaucacccggauccagaacaucuccaaccugcagaagcugaucagccucgaccuguacgacaaccagaucgaggagaucuccggccugagcacccuccgcugccugcgggugcugcuccugggcaagaaccgcaucaagaagaucagcaaccuggagaaccucaagucccuggacguccuggaccuccacgggaaccagaucaccaagaucgagaacaucaaccaccugugcgagcugcgggugcucaaccuggcgcgcaacuuccugagccacguggacaaccucaacggccuggacucccugacggagcucaaccugcggcacaaccagaucaccuucguccgcgacguggacaaccugccgugccuccagcaccuguuccugagcuucaacaacaucuccagcuucgacuccgugagcugccucgccgacuccagcucccugagcgacaucaccuucgacgggaaccccaucgcccaggaguccugguacaagcacaccguccugcagaacaugaugcagcuccggcagcuggacaugaagcgcaucacggaggaggagcggcgcauggccagcgugcuggccaagaaggaggaggagaagaagcgggagucccacaagcagagccugcucaaggagaagaagcgccugaccaucaacaacguggcgcgccagugggaccugcagcagcagcgggucgccaacaucgccaccaacgaggaccgcaaggacuccgacagcccccaggaccccugccagaucgacggcuccacccucagcgccuucccggaggagacggggccccuggacagcggccugaacaacgcgcuccagggccuguccgugaucgacaccuaccugguggaggucgacggggacacccucagccuguacggcuccggggcccuggagagccucgaccggaacugguccgugcagaccgccggcaugaucacgaccgugagcuucaccuucaucgaguucgacgagaucguccaggugcugcccaagcugaagaucaaguuccccaacucccuccaccugaaguucaaggagaccaaccuggugaugcuccagcaguucaacgcccuggcccagcugcgccggaucgaccagcucacgaucgacccgcagggcaaccccgucgugaacuucacccuguggaaguacuacguccuguuccgccucagccacuucuccaugcagaagaucaacgggaccgaggugacccagaacgacaugaucauggcggagcggcuguucggcauccuggcccacguggccagcuccgagcucccccaguaccgccugaucagcauccugggggacgcccggaagaagcaguuccgcuaccuccuggaguccaagggcaagaagcccgggaucaucaacgaggagaacaacgacagcaagcggcuggucggcgagaacacgaaccgcgccacccucaacuacaccacccgggacuucuacaacgagaagcuggaggagaucaaggagaagaagaaguucugcaagacguacaucgaggaccuggugaaggaggcgaccgagaucaacaugaagaacgaggcccuccagaagcuguggccgcagauguucaucgagcuggugcgcgacgccgucaucgagauccggaacaagaacuccuacaugaagcucugccugcagcagaucaccgaccagaaguga

SEQ ID NO: 32467 - RNA, 2142 nt, Artificial Sequence
  derived and/or modified sequence opt1 from LRRC4B__Homo_sapiens__XP_011525822
auggcccgcgcccggggcagccccugcccgccccugccccccgggcgcauguccuggccgcacggcgcgcuccuguuccuguggcucuucagccccccccugggggccggcgggggcggcguggccgucaccuccgccgccgggggcgggagccccccggcgaccuccugccccguggccugcagcugcuccaaccaggccagccgggugaucugcacgcgccgggaccuggccgagguccccgcguccauccccgugaacacccgcuaccucaaccugcaggagaacggcauccaggugauccggaccgacaccuucaagcaccugcgccaccucgagauccugcagcugagcaagaaccucguccggaagaucgaggugggggccuucaacggccugccgucccugaacacgcucgagcuguucgacaaccgccugaccaccgugcccacccaggccuucgaguaccucagcaagcugcgggagcuguggcuccgcaacaaccccaucgaguccauccccagcuacgccuucaaccgggucccgucccugcgccggcuggaccucggcgagcugaagcgccuggaguacaucagcgaggccgcguucgaggggcucgugaaccugcgguaccugaaccucggcaugugcaaccugaaggacauccccaaccugacggcccucgugcgccuggaggagcuggagcucuccgggaaccggcuggaccugauccgccccggcagcuuccagggccucaccucccugcggaagcuguggcucaugcacgcccaggucgccaccaucgagcgcaacgccuucgacgaccugaagagccuggaggagcucaaccugagccacaacaaccugaugucccucccccacgaccuguucaccccgcugcaccgccuggagcgggugcaccucaaccacaaccccuggcacugcaacugcgacgugcuguggcugagcugguggcucaaggagacgguccccuccaacaccaccugcugcgcgcgcugccacgcccccgccgggcugaagggccgguacaucggggagcuggaccagagccacuucaccugcuacgccccggugaucguggagccccccacggaccucaacgucaccgagggcauggccgcggagcugaagugccgcaccgggaccuccaugacgagcgugaacuggcugacccccaacggcacccucaugacccacggcuccuaccgggugcgcaucagcguccugcacgacgggacgcugaacuucaccaacgugaccgugcaggacaccggccaguacacgugcauggucaccaacuccgccgggaacaccaccgccagcgccacgcucaacguguccgccgucgacccgguggcggccggcgggaccggcagcggcgggggcgggcccggcggguccggcggcguggggggcgggagcggcggcuacaccuacuucaccacggucaccguggagacccuggagacccagcccggggaggaggcccugcagccgcggggcaccgagaaggagccccccgggcccacgaccgacggcgugugggggggcggccgcccgggggacgccgcgggccccgccuccagcuccaccaccgcccccgccccccggagcucccgcccgacggagaaggccuucaccguccccaucaccgacgugaccgagaacgcgcucaaggaccuggacgacgugaugaagacgaccaagaucaucaucgggugcuucgucgccaucaccuucauggccgccgugaugcugguggccuucuacaagcuccggaagcagcaccagcugcacaagcaccacggccccacccgcacggucgagaucaucaacguggaggacgagcugcccgcggccagcgccgugagcgucgccgccgcggccgccguggccuccgggggcggcguggggggcgacagccaccucgcgcugccggcccuggagcgggaccaccucaaccaccaccacuacgucgccgccgccuucaaggcgcacuacuccagcaaccccuccgggggcgggugcggcggcaaggggccccccggccugaacagcauccacgagccgcugcucuucaaguccgggagcaaggagaacgugcaggagacccagaucuga

SEQ ID NO: 32468 - RNA, 1923 nt, Artificial Sequence
  derived and/or modified sequence opt1 from LRRC4C__Homo_sapiens__NP_001245348
augcugaacaagaugacccuccacccccagcagaucaugaucggcccgcgcuucaaccgggcccuguucgacccccugcucgugguccugcuggcccuccagcugcuggugguggcggggcucguccgcgcccagaccugccccagcgugugcuccugcagcaaccaguucuccaaggugaucugcguccggaagaaccugcgcgaggugcccgacggcaucagcacgaacacccggcugcucaaccugcacgagaaccagauccagaucaucaaggugaacuccuucaagcaccuccgccaccucgagauccugcagcugagccggaaccacauccgcaccaucgagaucggggccuucaacggccucgccaaccugaacacccuggagcuguucgacaaccggcugacgaccaucccgaacggggccuucgucuaccuguccaagcucaaggagcuguggcugcgcaacaaccccaucgagagcauccccuccuacgcguucaaccggauccccagccuccgccggcuggaccugggcgagcucaagcgccuguccuacaucagcgagggcgccuucgaggggcuguccaaccuccgguaccugaaccuggccaugugcaaccuccgcgagaucccgaaccugacgccccugaucaagcucgacgagcuggaccugagcggcaaccaccucuccgccauccggcccgggagcuuccagggccugaugcaccuccagaagcuguggaugauccagucccagauccaggugaucgagcgcaacgcguucgacaaccugcagagccugguggagaucaaccucgcccacaacaaccugacccugcugccccacgaccucuucaccccgcugcaccaccuggagcggauccaccuccaccacaaccccuggaacugcaacugcgacauccuguggcuguccugguggaucaaggacauggcccccagcaacaccgccugcugcgcccgcugcaacacgcccccgaaccucaaggggcgguacaucggcgagcuggaccagaacuacuucacgugcuacgcgcccgucaucguggagccgcccgccgaccugaacgugaccgagggcauggccgccgagcucaagugccgcgccagcaccucccugaccagcgucuccuggaucacccccaacgggaccgugaugacccacggcgcguacaaggugcgcaucgccguccugagcgacgggacccucaacuucaccaacgugacggugcaggacaccggcauguacacgugcauggucuccaacagcgugggcaacaccaccgccuccgccacccugaacgugaccgccgcgaccacgacccccuucagcuacuucuccaccgucaccguggagacgauggagcccagccaggacgaggcccggaccaccgacaacaacgucgggcccaccccggugguggacugggagacgaccaacgucaccaccucccugacgccccagagcacccgcuccaccgagaagaccuucaccauccccgugacggacaucaacagcggcauccccgggaucgacgaggugaugaagaccaccaagaucaucaucggcugcuucgucgccaucacccucauggccgccgugaugcuggugaucuucuacaagaugcggaagcagcaccaccgccagaaccaccacgcgccgacgcggaccgucgagaucaucaacguggacgacgagaucaccggggacacccccauggagucccaccuccccaugccggccaucgagcacgagcaccugaaccacuacaacagcuacaagucccccuucaaccacacgaccaccgugaacaccaucaacagcauccacuccagcguccacgagccccugcugauccgcaugaacagcaaggacaacgugcaggagacgcagaucuga

SEQ ID NO: 32469 - RNA, 1962 nt, Artificial Sequence
  derived and/or modified sequence opt1 from LRRC4__Homo_sapiens__XP_011514763
augaagcugcucuggcaggucaccgugcaccaccacaccuggaacgccauccugcugcccuucguguaccucacggcccagguguggauccugugcgcggccaucgccgccgccgcgagcgccggcccgcagaacugccccuccgucugcagcugcuccaaccaguucagcaagguggugugcacccgccgggggcuguccgaggucccccagggcauccccagcaacacccgcuaccucaaccugauggagaacaacauccagaugauccaggccgacaccuuccggcaccuccaccaccucgaggugcugcagcuggggcgcaacuccauccggcagaucgaggugggcgccuucaacgggcucgcgagccugaacacgcuggagcuguucgacaacuggcugaccgucaucccguccggcgccuucgaguaccugagcaagcuccgcgagcuguggcugcggaacaaccccaucgaguccauccccagcuacgccuucaaccgcgugcccucccucaugcggcuggaccugggcgagcucaagaagcuggaguacaucagcgagggggccuucgagggccuguucaaccucaaguaccugaaccuggggaugugcaacaucaaggacaugccgaaccucacgccccuggugggccuggaggagcucgagauguccgggaaccacuuccccgagauccgccccggcagcuuccacggccuguccagccugaagaagcucugggucaugaacucccaggugagccugaucgagcggaacgccuucgacgggcuggcgagccucguggagcugaaccuggcccacaacaaccucuccagccugccgcacgaccuguucacgccccuccgcuaccuggucgagcugcaccuccaccacaaccccuggaacugcgacugcgacauccuguggcuggccugguggcugcgggaguacauccccaccaacuccacgugcugcggccgcugccacgccccgaugcacaugcgggggcgcuaccucguggagguggaccaggccagcuuccagugcuccgcgcccuucaucauggacgcgccccgggaccugaacaucagcgagggccgcauggccgagcugaagugccggacgcccccgauguccagcgucaaguggcuccugcccaacggcaccgugcugucccacgccagccgccacccccggaucuccgugcucaacgacgggacccugaacuucagccacguccugcucuccgacaccggcguguacacgugcauggugaccaacgucgccgggaacagcaacgccuccgccuaccugaacgugagcaccgccgagcugaacaccuccaacuacagcuucuucaccaccgucaccguggagaccaccgagaucucccccgaggacaccacccgcaaguacaagccggugcccaccaccagcaccggcuaccagcccgccuacacgaccagcaccaccguccucauccagacgacccgcgugcccaagcaggucgccgugccggcgaccgacaccacggacaagaugcagaccucccuggacgaggugaugaagaccaccaagaucaucaucgggugcuucguggccgucacccugcucgccgccgcgaugcugaucguguucuacaagcugcggaagcgccaccagcagcggagcacggugaccgccgcccgcaccgucgagaucauccagguggacgaggacauccccgccgccaccuccgcggccgccacggccgcccccagcggcguguccggcgagggggcggucgugcucccgaccauccacgaccacaucaacuacaacaccuacaagcccgcccacggcgcccacuggaccgagaacagccuggggaacucccugcaccccacggugaccaccaucagcgagcccuacaucauccagacccacacgaaggacaagguccaggagacccagaucuga

SEQ ID NO: 32470 - RNA, 942 nt, Artificial Sequence
  derived and/or modified sequence opt1 from LRRC52__Homo_sapiens__NP_001005214
augagccuggccuccggccccgggccgggcuggcuccuguucagcuucgggaugggccugguguccgggagcaagugccccaacaacugccucugccaggcccaggaggucaucugcaccggcaagcagcugaccgaguacccccuggacaucccccucaacacgcgccggcuguuccugaacgagaaccgcaucaccucccucccggcgaugcaccugggccugcucagcgaccugguguaccuggacugccagaacaaccggauccgcgaggugauggacuacaccuucaucggggucuucaagcucaucuaccuggaccuguccagcaacaaccucaccuccaucagccccuucacguucuccgugcugagcaaccuggugcagcucaacaucgccaacaacccccaccuccugucccuccacaaguucaccuucgccaacaccaccagccugcgguaccuggaccuccgcaacacgggccugcagacccuggacuccgccgcccucuaccaccugaccacccuggagacgcuguuccugagcgggaaccccuggaagugcaacugcuccuuccuggacuucgcgaucuuccucaucgucuuccacauggacccgagcgacgaccugaacgcgaccugcguggagcccaccgagcugaccggcuggcccaucacgcggguggggaacccccuccgcuacaugugcaucacccaccuggaccacaaggacuacaucuuccugcuccugaucggcuucugcaucuucgccgccggcaccgucgccgccuggcugaccggggugugcgccgugcucuaccagaacacgcggcacaaguccagcgaggaggacgaggacgaggccggcacccgcgucgaggugagccggcgcaucuuccagacccagaccuccagcgugcaggaguucccgcagcugaucuga

SEQ ID NO: 32471 - RNA, 924 nt, Artificial Sequence
  derived and/or modified sequence opt1 from LRRC59__Homo_sapiens__NP_060979
augaccaaggccggcagcaagggcgggaaccugcgcgacaagcucgacgggaacgagcuggaccugucccucagcgaccugaacgaggugcccgucaaggagcuggccgcgcucccgaaggccaccauccuggaccuguccugcaacaagcucacgacccugcccagcgacuucugcggccugacccaccucgugaagcuggaccuguccaagaacaagcuccagcagcugcccgccgacuucgggcggcuggugaaccuccagcaccuggaccugcucaacaacaagcuggucacccugcccgugagcuucgcccagcucaagaaccugaaguggcuggaccucaaggacaacccgcuggaccccgugcuggccaaggucgcgggcgacugccucgacgagaagcagugcaagcagugcgccaacaaggugcugcagcacaugaaggccgugcaggccgaccaggagcgcgagcggcagcgccggcuggaggucgagcgcgaggcggagaagaagcgggaggccaagcagcgcgccaaggaggcccaggagcgggagcuccgcaagcgggagaaggccgaggagaaggagcgccggcgcaaggaguacgacgcgcugaaggccgccaagcgggagcaggagaagaagcccaagaaggaggccaaccaggcccccaaguccaagagcggcucccgcccgcggaagcccccgccccgcaagcacacgcggagcugggcggugcugaagcuccugcugcuccugcuccuguucgggguggccggcgggcuggucgccugccgcgugaccgagcugcagcagcagccccucugcaccuccgugaacaccaucuacgacaacgccguccagggccugcggcgccacgagauccugcagugggugcuccagacggacagccagcaguga

SEQ ID NO: 32472 - RNA, 780 nt, Artificial Sequence
  derived and/or modified sequence opt1 from LRRC61__Homo_sapiens__XP_011514822
auggacccgcccgccgagaagcccggcgaggccgggggccugcagaucacgccccagcuccucaagagccgcaccggggaguucucccuggagagcauccugcugcugaagcuccggggccuggggcuggcggaccucggcugccugggcgagugccuggggcucgaguggcuggaccuguccggcaacgcccucacccaccuggggccccuggccagccuccgccagcuggccgugcugaacgucuccaacaaccggcucaccggccuggagccgcuggcgaccugcgagaaccuccagagccugaacgccgccgggaaccugcucgccacccccggccagcugcagugccuggccggccuccccugccuggaguaccugcgccuccgggacccccuggcgcgccuguccaacccgcucugcgccaaccccagcuacugggccgccgugcgggagcugcugcccgggcucaaggugaucgacggcgagcgcgucaucgggcggggcuccgaguucuaccagcugugccgcgaccuggacagcucccuccggcccagcuccagcccgggcccccgcgccacggaggcgcagcccuggguggagcccggguacugggaguccuggccgagccgguccagcuccauccuggaggaggccugccgccaguuccaggacacccugcaggagugcugggaccucgaccggcaggccagcgacagccuggcccaggccgagcagguccuguccagcgcgggccccaccuccagcuucguguucuga

SEQ ID NO: 32473 - RNA, 1764 nt, Artificial Sequence
  derived and/or modified sequence opt1 from LRRC63__Homo_sapiens__NP_001269389
augcagaagcccccgcugcuccugcgccggccccugccgcccaaguucaccaagcucagccugcacgagaagaagacccacacggccaagaccggcaagaucgagucccugcacguggccuucaccgaggacgagaccacgagcaucaagauggaccgcacccgguuccccgacguccuccgcaaccagucccugacccccaucaacauccagaacaucuuccuggaccacugcgugcaggagcgggugaccgcgaucagcagcccccagaaguccacgaagcacguccgcgagcagauccccgacaccgccaccggguccaucuucuucccgcacugcaacagcgccuccacccggaucuucggcaagcagacgaacaagauggagagcucccgcaaguucaagaccaugaaggacguguacaccgagaagcggcucgagaacauccugauccugagcuccaaguucagcaagcccaaguccacccccgggagcgugaucgcccagaagcucgagaagaugcaccccaagcaccagccgcugcccgagucccccggcuacacguaccagcacaucagccgcgaccuguccgccaccguccccagcccgccgcccaugaccgugagcaugaagcccgaggggcaguggcccgagcacuucaaguccaccgcgacgcucacccugcgggugaccgaguuccccggcuucgucagccugcccacccccgugcucccgcgcaagccccaccggcaguccgugaucgagacgcuggucaccgagaacggcaacaucgagagcgugcccaagcagaucccgccccgcccgcccgaggggcugaccaagaccgagaagaucgaguccgagauccacgugguccggggcgagggguucaagacgguggccgccacccgcuacgagaccaucaccgccaugacgaaccucgcgaucgugaacugccaggucuacggccggaacgcccugaaccugaagggguucuucauccucaacugccccgaccugacgccccuggccuuccagcucaucuaccugaaccugagcuucaacgaccuccacuacuuccccaccgagauccugugccugaagaaccuccagauccugaagcugcgcaacaaccccaucaaggagaucccguccgagauccagcagcucgaguuccugcggaucuucaccaucgccuucaaccugaucaccgugcuccccaucggccuguucagccuguccuaccucgaggagcuggacgugagcuacaacgagcugaccuucauccccaacgagauccagaagcuccgcucccuggagaagcugaccgucgacggcaacgagcucagcuucuucccccacgggauccugaagcugaaccugaccaagauccaguucgagaacaacuucacccacccgugcuucuggcgggacaacuaccucaacaacccccagcagcugacgcagaucaucucccuguucaucgugcagaacaagcuccacaaguucuacgacaagauccccguggagguccagaagcugcugaagugcaccagccgcugcgaguggugccacggccccaaguucggggagggcuuccgcgugauccgguccugcgacaucuucggcgccagccagcucccggucauguucuacgugugcucccccagcugcuaccgccggaucaaggaguccagcuucgugcuggacgggagccccucccgccggaucgcgcuggacgucgagcucagcaaggagcuguga

SEQ ID NO: 32474 - RNA, 1044 nt, Artificial Sequence
  derived and/or modified sequence opt1 from LRRC69__Homo_sapiens__NP_001123362
augaccgagcgccugcucaucaaggcccugagcggcgggaagaacaccaagaucaucacgcugaacggcaagaagaugaccaagaugcccuccgcccucgggaagcugccgggccugaagacccucgugcugcagaacaaccugauccccaaggucugccccgagcucugcaaccugacccagcugacgacccucaaccuggggaacaaccugcucgaggaggugcccgaggagaugaaguaccugaccagccugaagaaccuccaccuguccggcaaccggaucugccgcuucgcgccgggcgccugcgacgggcugcagaaccucauccugcugaaccucaacaacaaccaccugacccagcugccccaggaggugagccggcucaagucccugacguacaugagcaucaacuacaaccagcuggccuccaucccccgcgagcucugcuuccuggagaaccuggucgagcuccagcugaacuacaaccagcugaucugcauccccgaggagaucaaguuccucaagaagcugcagaagcugcuccuggcccggaacaacaucggcgugcugccggaggagcucugcgaccugaagaagcugcgcauccucgacaucgccgggaacaucauccagaucuuccccagcggcuuccaggaccugaagcugcgggaguucuacugcgaggggaacccccucuuccugcagcagcccgugaucuccacccagcaggagaacgucuggagccugcaggagaucaccucccgcuucgugaugaaccagcuggcggagaacaacccguuccucauggacgacaucgagcgguacccccaggugcgcagcaugaucucccagggcaagaccugcgccaucugcggccaguacuucaucacggucuggcuggagugcgugcgguucgugcccccgcccaaggacuggaagaucagcaagaaccugaagcucgucccccuccaggugcugaucugcuccuacaagugcuucacccagcgcgaccccaaccuguucgggaucgcccagguguga

SEQ ID NO: 32475 - RNA, 1401 nt, Artificial Sequence
  derived and/or modified sequence opt1 from LRRC6__Homo_sapiens__NP_036604
augggcuggaucaccgaggaccugauccgccggaacgccgagcacaacgacugcgugaucuucagccucgaggagcugucccugcaccagcaggagaucgagcgccucgagcacaucgacaaguggugccgggaccugaagauccuguaccuccagaacaaccugaucgggaagaucgagaacgucagcaagcugaagaagcucgaguaccugaaccuggcccucaacaacaucgagaagaucgagaaccuggagggcugcgaggagcuggcgaagcucgaccugaccgugaacuucaucggggagcuguccagcaucaagaaccuccagcacaacauccaccugaaggagcuguuccucaugggcaaccccugcgccuccuucgaccacuaccgcgaguucguggucgccacgcugccccagcugaaguggcucgacgggaaggagaucgagcccagcgagcggaucaaggcccugcaggacuacuccgugaucgagccccagauccgcgagcaggagaaggaccacugccugaagcgggccaagcucaaggaggaggcgcagcgcaagcaccaggaggaggacaagaacgaggacaagcggagcaacgccggcuucgacggccgcugguacaccgacaucaacgccacccuguccagccuggaguccaaggaccaccuccaggcccccgacaccgaggagcacaacacgaagaagcuggacaacagcgaggacgaccuggaguucuggaacaagccgugccucuucacccccgagucccggcuggagacccugcgccacauggagaagcagcggaagaagcaggagaagcucagcgagaagaagaagaaggugaagccgccccgcacccugaucacggaggacgggaaggcgcugaacgucaacgagcccaagaucgacuucucccucaaggacaacgagaagcagaucauccuggaccuggccguguaccgguacauggacaccagccucaucgacguggacguccagcccaccuacgugcgcgugaugaucaagggcaagcccuuccagcugguccugcccgccgaggugaagccggacuccagcuccgccaagcggagccagaccacggggcaccucgugaucugcaugcccaaggucggcgaggugaucaccgggggccagcgcgccuucaagagcaugaagaccaccuccgaccggagccgcgagcagacgaacacccgguccaagcacauggagaagcuggagguggaccccagcaagcacuccuuccccgacgucaccaacaucgugcaggagaagaagcacaccccgcgccgccggcccgagcccaagaucauccccagcgaggaggacccgacguucgaggacaaccccgaggugccgccccugaucuga

SEQ ID NO: 32476 - RNA, 1467 nt, Artificial Sequence
  derived and/or modified sequence opt1 from LRRC74A__Homo_sapiens__NP_919263
augcacauccaguuccccagcaagccgacccugccccgcgccugcugggagggccggaucaccgccgggucccccggcaugcccccggacgagaucgagaucgagcccgugcgccagagcuccgacaagaugcucuacugcgaggcggagagcccgcccacggucgagaaggugaagcccgcccgggagaacuccgagaccgaccuggagaucgaggacgacgagaaguucuucaccaccgggcagaaggagcuguaccucgaggccugcaagcugaugggcgugguccccgugagcuacuucauccgcaacauggaggaguccuacgugaaccugaaccaccacgggcucggcccccggggcacgaaggccaucgccaucgcgcuggucagcaacauggccgugaccaagcuggagcucgaggacaacugcaucauggaggagggggugcugucccuggucgagaugcuccaggagaacuacuaccugcaggagaugaacaucagcaacaaccaccugggccucgagggggcccgcaucaucuccgacuucuucgagcggaacagcuccagcaucuggucccuggagcugagcggcaacgacuucaaggaggacuccgccgcgcuccugugccaggcccugagcaccaacuaccagaucaagaagcucgaccugucccacaaccaguucagcgacgucgggggcgagcaccugggccagaugcucgccaucaacguggggcugaccagccuggaccucuccuggaacaacuuccacacgcgcggcgccguggcccugugcaacgggcugcggggcaacgugacccucaccaagcuggaccugagcaugaacggcuucgggaacgagguggcgcucgcccugggcgagguccugcgccucaaccggugccugguguaccuggacaucgggggcaacgacaucgggaacgagggcgccuccaagaucagcaagggccucgaguccaacgagagccugcgcgugcugaagcuguuccucaaccccaucaacauggacggggccauccugcucauccuggccaucaagcggaacccgaagucccgcauggaggagcuggacaucagcaacguccucguguccgagcaguucaugaagacccuggacggcguguacgcgguccacccccagcuggacgugguguucaaggccguccaggggcugagccccaagaagacgaucuuccuccugaccaaccccaugaagcugauccaguccuacgccgaccagcacaagaucaccaucguggacuucuucaagagccucaacccgaccggcacgaugaagauguccgucgacgaguuccagaaggugaugaucgagcagaacaaggugccccugaaccaguaccagguccgggaggugaucaagaagcuggacgagaagaccgggauggugaacuucagcuuccucaacaccaugaagcccuga

SEQ ID NO: 32477 - RNA, 4944 nt, Artificial Sequence
  derived and/or modified sequence opt1 from LRRC7__Homo_sapiens__XP_011540138
auguggauggagaaccugauccgcggccggaacccgccccaguaccagcgcagccccugcaaggaggugcgggccgcccuccgcaagcggcccgaggaggagcugcagugccuggagaugaccaccaagcgcaagaucaucgggcggcucguccccugccgcugcuuccggggcgaggaggagaucaucuccgugcuggacuacagccacugcucccugcagcaggucccgaaggaggucuucaacuucgagcgcacgcucgaggagcuguaccuggacgcgaaccagaucgaggagcuccccaagcagcuguucaacugccaggcccugcggaagcucagcauccccgacaacgaccuguccaaccugcccaccaccaucgccagccucgugaaccugaaggagcuggacaucuccaagaacggggugcaggaguucccggagaacaucaagugcugcaagugccucaccaucaucgaggccagcgucaaccccaucuccaagcugcccgacggcuucacgcagcugcucaaccugacccagcuguaccucaacgacgccuuccuggaguuccugcccgcgaacuucgggcgccucgugaagcugcggauccuggagcuccgcgagaaccaccugaagacccugcccaagagcaugcacaagcucgcccagcuggagcggcuggaccucggcaacaacgaguucggcgagcugcccgaggugcuggaccagauccagaaccuccgcgagcuguggauggacaacaacgcccugcagguccuccccggguccaucggcaagcugaagaugcugguguaccucgacaugagcaagaaccggaucgagaccguggacauggacaucuccgggugcgaggcccuggaggaccugcuccugagcuccaacaugcugcagcagcugcccgacagcaucggccuccugaagaagcugacgacccucaaggucgacgacaaccagcugaccaugcugccgaacaccaucgggaaccucucccugcuggaggaguucgacugcagcugcaacgagcucgagucccugcccagcacgaucggcuaccugcacagccuccgcacccuggcgguggacgagaacuuccugcccgagcucccccgggagaucggcuccugcaagaacgugaccgucaugagccugcgcuccaacaagcuggaguuccucccggaggagaucgggcagaugcagaagcugcgggugcugaaccucagcgacaaccgccugaagaaccugcccuucuccuucaccaagcucaaggagcuggccgcccuguggcucagcgacaaccaguccaaggcccugaucccccugcagacggaggcccaccccgagaccaagcagcgcgugcucaccaacuacauguucccgcagcagccccggggcgacgaggacuuccagagcgacuccgacagcuucaaccccacccugugggaggagcagcgccagcagcggaugacggucgcguucgaguucgaggacaagaaggaggacgacgagaacgccgggaaggugaaggaccuguccugccaggcccccugggagcgcggccagcggggcaucacccuccagccggcccgccugagcggggacugcugcacccccugggcccggugcgaccagcagauccaggacaugccggugccgcagaacgacccccagcuggcguggggcugcaucuccgggcuccagcaggagcgcagcaugugcacgccccugcccguggccgcccaguccaccacccugccgagccucuccggccgccagguggagaucaaccugaagcgguaccccacccccuaccccgaggaccugaagaacauggucaagagcgugcagaaccucguggggaagccgucccacggcguccggguggagaacagcaaccccaccgccaacacggagcagaccgugaaggagaaguacgagcacaaguggcccgucgcccccaaggagaucaccguggaggacagcuucgugcacccggcgaacgagaugcgcaucggcgagcugcaccccucccuggccgagacgccccucuacccgcccaagcugguccugcucgggaaggacaagaaggagagcaccgacgaguccgagguggacaagacccacugccugaacaacagcguguccagcggcaccuacuccgacuacagccccucccaggccagcuccgggagcuccaacacccgggucaaggugggcagccugcagacgaccgccaaggacgccgugcacaacucccucugggggaaccgcaucgcgcccagcuucccccagccgcuggacuccaagccccugcucagccagcgggaggccgucccgcccggcaacaucccccagcgccccgaccggcugcccaugagcgacaccuucaccgacaacuggaccgacggcucccacuacgacaacacgggguucguggccgaggagaccaccgccgagaacgcgaacagcaacccgcugcucuccagcaagucccgcagcaccuccagccacggccggcgcccccugauccgccaggaccggaucgugggggucccccuggagcucgagcaguccacgcaccgccacacccccgagaccgaggugccgcccagcaaccccuggcagaacuggacccggacgcccuccccguucgaggaccgcaccgccuuccccagcaagcuggagaccacccccacgaccagcccccugccggagcggaaggagcacaucaaggaguccaccgagauccccucccccuucagccccggcgugccgugggaguaccacgacuccaaccccaaccgcagccucuccaacgucuucagccagauccacugccggcccgagagcuccaagggggugaucagcaucuccaagagcaccgagcgccugagcccccugaugaaggacaucaaguccaacaaguucaagaagucccagagcaucgacgagaucgacaucggcacguacaagguguacaacaucccgcucgagaacuacgccuccggcagcgaccaccuggggucccacgagcggcccgacaagaugcugggccccgagcacgggaugagcuccaugagccgcucccagagcguccccaugcucgacgacgagaugcugaccuacggcuccagcaagggcccgcagcagcagaaggccuccaugaccaagaagguguaccaguucgaccagagcuucaacccccaggggagcguggaggucaaggccgagaagcggaucccgccgcccuuccagcacaaccccgaguacgugcagcaggcguccaagaacaucgccaaggaccugaucagcccccgcgccuaccggggcuacccgcccauggagcagauguucuccuucagccagcccuccgugaacgaggacgccgucgugaacgcccaguucgcgagccagggggcccgcgccggcuuccuccggcgcgccgacucccuggugagcgccaccgagauggcgauguuccggcgcgucaacgagccccacgagcugccgcccacggaccgguacgggcgcccgcccuaccggggcggccucgaccgccaguccagcgugaccgugaccgagucccaguuccugaagcgcaacgggcgguacgaggacgagcaccccagcuaccaggaggucaaggcccaggccggcuccuuccccgugaagaaccugacccagcgccggccccucagcgcccgcuccuacagcacggaguccuacggggcgagccagacccggcccguguccgcccgccccaccauggccgcccugcuggagaagauccccagcgacuacaaccucggcaacuacggggacaagcccagcgacaacuccgaccugaagacccggcccacgccggucaagggcgaggagagcugcggcaagaugcccgccgacuggcgccagcagcugcuccggcacaucgaggcgcgccggcuggaccgcaacgccgccuacaagcacaacaccgugaaccuggggaugcuccccuacggcgggaucuccgccaugcacgccggccggagcaugacccugaaccugcagaccaaguccaaguucgaccaccaggagcucccccugcagaagacgccgagccagcaguccaacauccuggacaacgggcaggaggacgugagccccuccggccaguggaaccccuacccccucggccgccgggacgucccgcccgacaccaucaccaagaaggcggggagccacauccagacccugaugggcucccagagccugcagcaccgcucccgggagcagcagcccuacgaggggaacaucaacaaggugacgauccagcaguuccagagcccccugccgauccagauccccuccagccaggccacccgcggcccccagccggggcggugccucauccagaccaagggccagcgcuccauggacggcuaccccgagcaguucugcgugcgcaucgagaagaaccccgggcugggcuucagcaucuccgggggcaucagcggccaggggaaccccuucaagccgagcgacaagggcaucuucgucacccgggugcagcccgacgggcccgccuccaaccugcuccagcccggcgacaagauccugcaggccaacgggcacagcuucgugcacauggagcacgagaaggccguccugcuccugaaguccuuccagaacaccguggaccuggugauccagcuguucccgcugcgcggccuccucuucggccugaacgucgagaaggcgagcggguccgagaagaagcugaucacgguggacccccacuacagcugggugcucuaccugcagaccugccugcucaccaaggucuacacccccaaguccaugugcggcacgagcgaggugauccacaagcaggcccagcgguccaagaagcuggagagcccccacgggcacgucccgcgcuga

SEQ ID NO: 32478 - RNA, 2433 nt, Artificial Sequence
  derived and/or modified sequence opt1 from LRRC8A__Homo_sapiens__NP_062540
augauccccgugaccgagcugcgcuacuucgccgacacccagccggccuaccggauccucaagcccuggugggacgucuucacggacuacaucagcaucgugaugcugaugaucgcgguguucggcgggacccugcaggucacccaggacaagaugaucugccuccccugcaagugggugaccaaggacuccugcaacgacagcuuccgcggcugggccgcccccgggccggagcccacguaccccaacuccaccauccugcccaccccggacaccggccccacggggaucaaguacgaccuggaccggcaccaguacaacuacguggacgccgucugcuacgagaaccgccuccacugguucgccaaguacuuccccuaccuggugcugcuccacacccugaucuuccuggcgugcagcaacuucugguucaaguucccccggaccuccagcaagcucgagcacuucguguccauccugcugaagugcuucgacagcccguggaccacgcgcgcccucuccgagaccgucguggaggagagcgaccccaagcccgccuucuccaagaugaacggcagcauggacaagaaguccagcaccguguccgaggacgucgaggccaccgugcccaugcugcagcggaccaagagccgcaucgagcagggcaucguggaccgguccgagacggggguccuggacaagaaggagggcgagcaggcgaaggcccucuucgagaaggugaagaaguuccgcacccacguggaggagggggacaucgucuaccggcuguacaugcgccagaccaucaucaaggugaucaaguucauccugaucaucugcuacacgguguacuacguccacaacaucaaguucgacguggacugcaccguggacaucgagagccucaccggcuaccggaccuaccgcugcgcccacccgcuggccacgcuguucaagauccucgccuccuucuacaucagccuggucaucuucuacgggcugaucugcauguacacccucugguggaugcugcggcgcagccugaagaaguacuccuucgagagcauccgggaggaguccagcuacuccgacauccccgacgugaagaacgacuucgcguucaugcuccaccugaucgaccaguacgacccccuguacagcaagcgcuucgccgucuuccucuccgaggugagcgagaacaagcugcggcagcugaaccucaacaacgaguggacccuggacaagcugcgccagcggcucaccaagaacgcccaggacaagcuggagcugcaccucuucaugcuguccggcauccccgacacgguguucgaccuggucgagcucgaggugcugaagcuggagcucaucccggacgugaccaucccgcccagcaucgcccagcugaccggccugaaggagcuguggcucuaccacaccgccgcgaagaucgaggcccccgcccuggccuuccugcgcgagaaccuccgcgcccugcacaucaaguucacggacaucaaggagaucccccuguggaucuacucccucaagacccuggaggagcugcaccucaccgggaaccugagcgcggagaacaaccgguacaucgucaucgacggccugcgcgagcucaagcggcugaaggugcugcgccucaaguccaaccugagcaagcugccccagguggucaccgacgugggggugcaccuccagaagcuguccaucaacaacgagggcacgaagcugaucguccucaacagccugaagaagauggccaaccugaccgagcucgagcugauccggugcgaccuggagcgcaucccccacuccaucuucagccuccacaaccugcaggagaucgaccugaaggacaacaaccucaagaccaucgaggagaucaucuccuuccagcaccuccaccggcugaccugccucaagcugugguacaaccacaucgccuacauccccauccagaucggcaaccugaccaaccucgagcgccuguaccugaaccggaacaagaucgagaagaucccgacgcagcuguucuacugccgcaagcugcgguaccuggaccucagccacaacaaccugaccuuccugcccgccgacaucgggcuccugcagaaccugcagaaccucgccaucaccgcgaaccgcaucgagacccugcccccggagcuguuccagugccggaagcuccgcgcccugcaccugggcaacaacgugcuccagagccugcccucccgggugggggagcugacgaaccucacccagaucgagcugcgcggcaaccggcuggagugccuccccgucgagcugggggagugcccccugcucaagcgcagcggccuggugguggaggaggaccuguucaacacccucccgcccgaggucaaggagcggcuguggcgcgccgacaaggagcaggccuga

SEQ ID NO: 32479 - RNA, 2412 nt, Artificial Sequence
  derived and/or modified sequence opt1 from LRRC8C__Homo_sapiens__XP_011540584
augauccccgugaccgaguuccgccaguucagcgagcagcagcccgccuuccggguccugaagcccuggugggacguguucaccgacuaccucuccguggccaugcugaugaucggcgucuucgggugcacgcuccaggugaugcaggacaagaucaucugccuccccaagcgcgugcagcccgcgcagaaccacagcucccugagcaacgucucccaggccguggccagcaccaccccgcugcccccgcccaagcccucccccgccaaccccaucaccguggagaugaagggccucaagacggaccuggaccugcagcaguacagcuucaucaaccagaugugcuacgagcgggcccuccacugguacgcgaaguacuuccccuaccugguccugauccacacccucguguucaugcugugcuccaacuucugguucaaguucccggggagcuccagcaagaucgagcacuucaucuccauccugggcaagugcuucgacagccccuggaccacccgcgcccucuccgaggugagcggggaggacuccgaggagaaggacaaccggaagaacaacaugaaccgcagcaacacgauccaguccggccccgaggacagccuggucaacagccagucccucaagagcauccccgagaaguucgugguggacaaguccaccgccggcgcccuggacaagaaggagggggagcaggcgaaggcccuguucgagaaggucaagaaguuccggcugcacguggaggagggcgacauccucuacgccauguacgugcgccagaccguccugaaggugaucaaguuccugaucaucaucgccuacaacagcgcccucguguccaagguccaguucaccguggacugcaacguggacauccaggacaugacgggguacaagaacuucagcugcaaccacaccauggcgcaccuguucuccaagcugagcuucugcuaccucugcuucgucuccaucuacggccugaccugccuguacacccucuacuggcuguucuaccggagccugcgcgaguacuccuucgaguacgugcggcaggagacggggaucgacgacaucccggacgucaagaacgacuucgccuucaugcuccacaugaucgaccaguacgacccccuguacagcaagcgcuucgccguguuccuguccgaggugagcgagaacaagcucaagcagcugaaccugaacaacgaguggacccccgacaagcuccggcagaagcugcagaccaacgcccacaaccgccuggagcucccccugaucaugcuguccggccucccggacaccgucuucgagaucacggagcugcagagccugaagcucgagaucaucaagaacgugaugauccccgccaccaucgcgcagcuggacaaccugcaggagcugucccuccaccagugcagcgugaagauccacuccgccgcccugagcuuccugaaggagaaccucaagguccugagcgugaaguucgacgacaugcgggagcugccgcccuggauguacggccuccgcaaccuggaggagcuguaccucguggggucccugagccacgacaucucccggaacgucacccuggagagccuccgcgaccugaagucccugaagauccucagcaucaaguccaacgugagcaagaucccccaggccguggucgacguguccagccaccuccagaagaugugcauccacaacgacggcaccaagcuggugaugcugaacaaccugaagaagaugacgaaccugaccgagcucgagcugguccacugcgaccuggagcggaucccccacgccguguucucccuccugagccugcaggagcucgaccugaaggagaacaaccugaaguccaucgaggagaucgugagcuuccagcaccuccgcaagcugaccguccugaagcucuggcacaacuccaucaccuacauccccgagcacaucaagaagcugacgagccuggagcggcucuccuucagccacaacaagaucgaggugcugcccagccaccuguuccucugcaacaagauccgcuaccuggaccuguccuacaacgacauccgcuucaucccgcccgagaucggggugcuccagagccugcaguacuucuccaucacgugcaacaaggucgagagccugcccgacgagcucuacuucugcaagaagcugaagacccugaagaucggcaagaacucccucagcgugcuguccccgaagaucggcaaccugcuguuccugagcuaccuggacgugaaggggaaccacuucgagauccucccgcccgagcugggcgacugccgggcgcugaagcgcgccgggcucgucguggaggacgcccuguucgagacccugcccuccgacgugcgggagcagaugaagaccgaguga

SEQ ID NO: 32480 - RNA, 3099 nt, Artificial Sequence
  derived and/or modified sequence opt1 from LRRCC1__Homo_sapiens__NP_208325
auggaggccgccgcggccguggucgccgccgaggccgagguggagaacgaggacggcgacagcuccugcggggacgugugcuucauggacaagggccugcagagcaucuccgagcucagccuggacuccacccugcacgcggucaaccuccacugcaacaacaucagcaagaucgaggccaucgaccacaucuggaaccugcagcaccuggaccucuccagcaaccagaucucccgcaucgaggggcugaacacccugacgaagcucugcacccugaaccugagcugcaaccucaucaccaagguggagggccuggaggagcugaucaaccucacccggcugaacguguccuacaaccacaucgacgaccugagcgggcucaucccccugcacggcaucaagcacaagcugcgcuacaucgaccuccacuccaaccggaucgacagcauccaccaccuccugcagugcauggucggccugcacuuccugacgaaccugauccucgagaaggacggggacgacaacccggugugccgccugcccggcuaccgggccgugauccugcagacccucccccagcugcgcauccuggacugcaagaacaucuucggggagcccgucaaccucaccgagaucaacuccagccagcugcagugccuggagggccuccuggacaaccugguguccagcgacuccccgcucaacaucagcgaggacgagaucaucgaccggaugcccgugaucaccgcccccaucgacgagcuggucccccuggagcaguucgcgagcacgccguccgacgccgugcucaccagcuucauguccgugugccagagcuccgagcccgagaagaacaaccacgagaacgaccugcagaacgagaucaagcugcagaagcucgacgaccagauccugcagcugcucaacgagaccagcaacuccaucgacaacguccuggagaaggacccccgccccaagcgggacaccgacaucacgagcgaguccgacuacgggaaccgcaaggagugcaaccggaaggugccgcgccggagcaagauccccuacgacgccaagaccauccagaccaucaagcaccacaacaagaacuacaacuccuucgugagcugcaaccgcaagaugaagccgcccuaccugaaggagcuguacgucuccagcucccucgccaacugccccaugcugcaggagagcgagaagcccaagaccgagaucaucaagguggaccagucccacagcgaggacaacacguaccagucccugguggagcagcucgaccaggagcgggagaagcgcuggcgggccgagcaggcggagaacaagcugauggacuacaucgacgagcugcacaagcacgccaacgagaaggaggacauccacagccucgcccugcugaccaccgaccgccucaaggagaucaucuuccgggagcgcaacagcaagggccagcuggaggucauggugcacaagcugcagaacgagaucaagaagcucaccguggagcugaugaaggccaaggaccagcaggaggaccaccugaagcaccuccggacgcuggagaagacccuggagaagauggagcgccagaagcgccagcagcaggccgcgcagauccggcucauccaggaggucgagcugaaggccuccgccgccgaccgcgagaucuaccugcuccggaccagccugcaccgcgagcgggagcaggcccagcagcugcaccagcuccuggcgcugaaggagcaggagcaccgcaaggagcucgagacccgggaguucuucacggacgccgacuuccaggacgcccuggccaaggagaucgccaaggaggagaagaagcacgagcagaugaucaaggaguaccaggagaagaucgacgugcugucccagcaguacauggaccucgagaacgaguuccgcaucgcgcugaccgucgaggcccggcgcuuccaggacgugaaggacggcuucgagaacguggccaccgagcuggccaagagcaagcacgcgcucaucugggcccagcggaaggagaacgaguccagcucccugaucaaggaccugaccugcauggucaaggagcagaagacgaagcucgccgaggugagcaagcugaagcaggagaccgccgccaaccugcagaaccagaucaacacccucgagauccugaucgaggacgacaagcagaaguccauccagaucgagcugcucaagcacgagaaggugcagcugaucagcgagcuggcggccaaggagucccucaucuucgggcugcgcaccgagcggaaggucuggggccacgagcuggcccagcaggggagcucccucgcccagaaccgcggcaagcuggaggcccagaucgagagccugucccgggagaacgagugccuccgcaagacgaacgagagcgacuccgacgcgcugcggaucaagugcaagaucaucgacgaccagaccgagaccauccgcaagcugaaggacugccuccaggagaaggacgagcacaucaagcggcugcaggagaagaucaccgagaucgagaagugcacgcaggagcagcuggacgagaaguccagccagcucgacgaggugcuggagaagcuggagcgccacaacgagcgcaaggagaagcucaagcagcagcugaagggcaaggagguggagcuggaggagauccggaaggccuacagcacccucaaccgcaaguggcacgacaagggggagcugcugugccaccucgagacccaggucaaggaggugaaggagaaguucgagaacaaggagaagaagcugaaggccgagcgggacaagagcaucgagcugcagaagaacgccauggagaagcuccacuccauggacgacgccuucaagcgccagguggacgcgaucgucgaggcccaccaggccgagaucgcccagcuggcgaacgagaagcagaagugcaucgacagcgccaaccugaaggugcaccagaucgagaaggagaugcgggagcuccuggaggagaccugcaagaacaagaagaccauggaggccaagaucaagcagcuggccuucgcccucaacgagauccagcaggacauguga

SEQ ID NO: 32481 - RNA, 1923 nt, Artificial Sequence
  derived and/or modified sequence opt1 from LRRFIP1__Homo_sapiens__NP_001131022
auggacaugggcacccaggggagcggccgcaagcggcugcccaaccgcgagcggcucaccgccgaggacgacgcccugaaccagaucgcgcgcgaggccgaggcccggcuggccgccaagcgcgcggcccgggccgaggcccgcgagauccggaugaaggagcucgagcgccagcagaaggagaucuaccaggugcagaagaaguacuacgggcuggacacgaaguggggcgacaucgagcaguggauggaggacuccgagcgguacagccgccggucccgccggaacaccagcgcguccgacgaggacgagcgcaugagcgucgggucccggggcagccugcgcucccagccggaccucgaguacggcgggcccuacgccuggaccaacggcuacgacggggagcuguacggcagccagucccugaaccggcgcagcgggcggcccuccugccucuacagcgccgcccgccccuccggcagcuaccgcgccuccgugcuggacgagggcagcuucgggggcacccggcgcggguccacgagcggcagccgggcgccguccgaguacagcggccaccugaacuccagcucccgcgccagcucccgggccagcuccgcccgcgccagccccguggucgaggagcggcccgagaaggacuucaccgagaaggggucccgcaacaugcccggccucagcgcggccacccuggccucccucgggggcaccagcucccggcgcgggagcggcgacacguccaucagcaucgacaccgaggccuccauccgggagaucaaggagcugaacgagcugaaggaccagauccaggacguggagggcaaguacaugcaggggcugaaggagaugaaggacagccucgccgagguggaggagaaguacaagaaggcgauggucagcaacgcccagcuggacaacgagaagaccaacuucauguaccagguggacacccugaaggacaugcuccuggagcuggaggagcagcucgccgagucccgccggcaguacgaggagaagaacaaggaguucgagcgcgagaagcacgcccacagcauccugcaguuccaguucgccgaggugaaggaggcgcugaagcagcgggaggagaugcucgaggagauccgccagcugcagcagaagcaggccuccagcauccgggagaucuccgaccugcaggagacgaucgaguggaaggacaagaagaucggcgcccucgagcgccagaaggaguucuucgacagcguccgguccgagcgcgacgaccugcgcgaggagguggugaugcugaaggaggagcucaagaagcacgggaucauccugaacagcgagaucgccaccaacggcgagaccuccgacacccugaacaacgucggguaccagggcccgacgaagaugaccaaggaggagcucaacgcgcucaagagcaccggcgacgggacccuggacauccggcugaagaagcugguggacgagcgcgagugccugcucgagcagaucaagaagcugaagggccagcuggaggagcggcagaagaucgggaagcucgacaaccugcgcuccgaggacgacgugcuggagaacggcacggacaugcacgucauggaccuccagcgggacgccaaccgccagaucagcgaccugaaguucaagcuggccaaguccgagcaggagaucaccgcccuggagcagaacgugauccggcucgagagccaggugucccgcuacaagagcgccgcggagaacgccgagaagaucgaggacgagcugaaggccgagaagcggaagcugcagcgcgagcuccgguccgcccuggacaagaccgaggagcuggaggucagcaacgggcaccucgugaagcgccuggagaagaugaaggccaaccggagcgcgcugcucucccagcaguga

SEQ ID NO: 32482 - RNA, 1275 nt, Artificial Sequence
  derived and/or modified sequence opt1 from LRRFIP2__Homo_sapiens__NP_001127841
augggcacccccgccagcgggcgcaagcggaccccggugaaggaccgcuucuccgccgaggacgaggcgcugagcaacaucgcccgggaggccgaggcccgccucgccgcgaagcgggccgcccgcgccgaggcgcgggacauccgcaugcgggagcuggagcgccagcagaaggagcuggacgagaaguccgacaagcaguacgccgagaacuacacgcggcccagcucccgcaacagcgccuccgccaccacgccccucagcggcaacuccagccggcgcggguccggcgacaccagcucccugaucgaccccgacaccagccuguccgagcuccgggacaucuacgaccugaaggaccagauccaggacgucgaggggcgcuacaugcagggccugaaggagcucaaggagagccuguccgagguggaggagaaguacaagaaggccauggugagcaacgcgcagcuggacaacgagaagaacaaccucaucuaccaggucgacacccugaaggacgugaucgaggagcaggaggagcagauggccgaguucuaccgggagaacgaggagaaguccaaggagcuggagcgccagaagcacaugugcagcgugcuccagcacaagauggaggagcugaaggagggccugcggcagcgcgacgagcucaucgagaagcacgggcuggucaucaucccggacggcacccccaacggggacgugagccacgagcccguggccggcgccaucaccgucgugucccaggaggccgcccaggugcuggagagcgcgggggagggcccccucgacguccggcugcgcaagcuggccggcgagaaggaggagcuccugucccagauccgcaagcugaagcuccagcuggaggaggagcggcagaagugcagccgcaacgacgggacggugggcgaccuggccgggcuccagaacggcuccgaccugcaguucaucgagaugcagcgggacgccaaccgccagaucagcgaguacaaguucaagcuguccaaggcggagcaggacaucaccacccucgagcagagcaucucccggcuggagggccaggugcugcgcuacaagaccgccgccgagaacgccgagaaggucgaggacgagcucaaggccgagaagcggaagcugcagcgcgagcugcggacggcgcucgacaagaucgaggagauggagaugaccaacagccaccuggccaagcgccuggagaagaugaaggccaaccggaccgcccuccuggcgcagcaguga

SEQ ID NO: 32483 - RNA, 6048 nt, Artificial Sequence
  derived and/or modified sequence opt1 from LRRK1__Homo_sapiens__XP_011520315
auggccggcaugagccagcggccgcccuccauguacuggugcguggggcccgaggagagcgccgucugccccgagcgggcgauggagacccugaacggcgccggggacaccggcgggaagcccuccacccgcggcggcgaccccgccgcccggucccgccggaccgaggggauccgcgccgccuaccggcgcggcgaccgcgggggcgcccgcgaccuccuggaggaggccugcgaccagugcgccucccagcuggagaaggggcagcuccugagcauccccgccgccuacggcgaccuggagauggugcgguaccuccuguccaagcgccugguggagcuccccaccgagcccaccgacgacaaccccgccgucguggccgccuacuucggccacaccgcggugguccaggagcugcuggagagccuccccgggcccugcagcccccagcggcugcugaacuggaugcucgcccuggccugccagcgcggccaccuggggguggugaagcuccugguccugacccacggcgccgaccccgagagcuacgccgugcggaagaacgaguuccccgugaucguccgccucccccuguacgcggccaucaaguccggcaacgaggacaucgccaucuuccugcuccggcacggggccuacuucugcagcuacauccugcuggacucccccgacccgagcaagcaccuccugcgcaaguacuucaucgaggccagcccccuccccagcuccuaccccggcaagaccgcgcuccgggugaaguggagccaccuccggcugccguggguggaccuggacuggcugaucgacaucuccugccagaucaccgagcuggaccucagcgccaacugccuggccacccugcccagcgucauccccugggggcucaucaaccugcggaagcugaaccucuccgacaaccaccugggcgagcugcccggggugcagagcuccgacgagaucaucugcagccgccuccuggagaucgacaucuccagcaacaagcugucccaccucccgcccggcuuccugcaccugagcaagcugcagaagcucaccgccuccaagaacugccuggagaagcuguucgaggaggagaacgccaccaacuggaucggccuccgcaagcugcaggagcuggacaucagcgacaacaagcucaccgagcugcccgcgcuguuccuccacuccuucaagagccugaacucccugaacgugagccggaacaaccucaaggucuuccccgacccgugggccugcccccugaagugcugcaaggccucccgcaacgcccuggagugccuccccgacaagauggcgguguucuggaagaaccaccugaaggacguggacuucagcgagaacgcccugaaggaggucccgcucgggcuguuccagcuggacgcccucauguuccugcggcugcagggcaaccagcucgccgcccugccgccccaggagaaguggacgugccgccagcugaagacccucgaccugucccggaaccagcuggggaagaacgaggacggccucaagaccaagcgcaucgcguucuucaccacgcgggggcgccagcggagcggcaccgaggccgccuccgugcuggaguuccccgccuuccugagcgagagccucgaggugcugugccugaacgacaaccaccucgacaccgucccgcccuccgugugccugcugaagucccucuccgagcuguaccugggcaacaaccccgggcuccgcgagcugcccccggagcugggccagcucgggaaccuguggcagcuggacaccgaggaccucacgaucagcaacguccccgccgagauccagaaggagggccccaaggcgaugcuguccuaccugcgggcccagcuccgcaaggccgagaagugcaagcugaugaagaugaucaucguggggcccccgcggcagggcaagagcacccugcucgagauccugcagaccggccgcgcgccccaggugguccacggggaggccaccauccggacgaccaagugggagcugcagcgccccgcgggcucccgggccaagguggagagcguggaguucaacgucugggacaucgggggccccgccuccauggccaccgugaaccagugcuucuucaccgacaaggcgcucuacguggucguguggaaccuggcccugggcgaggaggccguggccaaccuccaguucuggcugcugaacaucgaggccaaggcgccgaacgccgucgugcucguggucgggacgcaccuggaccugaucgaggccaaguuccgcguggagcggaucgccacccuccgcgccuacgugcuggcgcugugccgcagccccuccggcagccgggccaccggguuccccgacaucaccuucaagcaccuccacgagaucuccugcaagagccuggagggccaggaggggcugcgccagcucaucuuccacgucacgugcuccaugaaggacgugggcagcaccaucggcugccagcggcuggccgggcgccugaucccccgguccuaccucagccugcaggaggccgugcuggccgagcagcagcgccggagccgcgacgacgacguccaguaccucaccgaccggcagcuggagcagcugguggagcagaccccggacaacgacaucaaggacuacgaggaccuccaguccgcgaucagcuuccugaucgagacgggcacccugcuccacuuccccgacaccucccacgggcugcgcaaccuguacuuccucgaccccaucuggcugagcgagugccugcagcggaucuucaacaucaagggcucccgcagcguggccaagaacggggucauccgggccgaggaccuccgcaugcugcuggugggcaccggcuucacccagcagacggaggagcaguacuuccaguuccucgccaaguucgagaucgcgcugcccguggccaacgacuccuaccugcugccgcaccuccugcccagcaagcccgggcuggacacccacggcaugcggcacccgaccgccaacaccauccagcgcgucuucaagauguccuucgugcccgugggguucuggcagcgguucaucgcccgcaugcucaucagccuggccgagauggaccugcagcuguucgagaacaagaagaacacgaagucccggaaccgcaaggucaccaucuacagcuucaccggcaaccagcggaaccgcugcuccaccuuccgcgugaagcggaaccagacgaucuacuggcaggaggggcugcuggugaccuucgacggcggcuaccucagcgucgaguccagcgacgugaacuggaagaagaagaaguccgggggcaugaagaucgugugccagagcgagguccgcgacuucuccgcgauggccuucaucaccgaccacgugaacagccugaucgaccagugguuccccgcccugaccgccacggagagcgacgggacgccccugauggagcaguacgugccgugccccgucugcgagaccgccugggcgcagcacaccgaccccuccgagaaguccgaggacgugcaguacuucgacauggaggacugcgugcugacggccaucgagcgggacuucaucuccugcccccgccacccggaccugcccgucccccuccaggagcuggugcccgagcuguucaugaccgacuucccggcccgccucuuccuggagaacagcaagcuggagcacuccgaggacgagggcagcgugcucgggcagggcggcuccgggaccgucaucuaccgcgcccgguaccagggccagcccguggccgugaagcgcuuccacaucaagaaguucaagaacuucgcgaacguccccgccgacaccaugcugcggcaccuccgggccacggacgccaugaagaacuucagcgaguuccggcaggaggccuccaugcugcacgcgcugcagcaccccugcaucguggcccugaucgggaucagcauccacccgcucugcuucgcccuggagcuggcgccccucuccagccugaacaccgugcuguccgagaacgcgcgcgacagcuccuucaucccccucggccacaugcugacccagaagaucgccuaccagaucgccagcggccuggccuaccuccacaagaagaacaucaucuucugcgaccugaaguccgacaacauccuggucuggagccucgacgugaaggagcacaucaacaucaagcuguccgacuacgggaucagccggcagagcuuccacgagggcgcccugggggucgagggcacccccggguaccaggcgccggagauccgcccccggaucguguacgacgagaagguggacauguucuccuacggcaugguccucuacgagcugcugagcggccagcgccccgcccucgggcaccaccagcugcagaucgccaagaagcuguccaagggcauccggcccgugcucgggcagccggaggaggugcaguuccgccggcugcaggcccugaugauggagugcugggacacgaagcccgagaagcgcccccucgcccugagcgucgugucccagaugaaggaccccaccuucgcgaccuucauguacgagcugugcugcggcaagcagaccgccuucuucagcucccaggggcaggaguacacgguggucuucugggacggcaaggaggagagccgcaacuacaccguggugaacaccgagaagggccucauggagguccagcggaugugcugcccggggaugaagguguccugccagcuccaggugcagcgcagccuguggaccgccacggaggaccagaagaucuacaucuacacccucaagggcaugugcccccugaacacgccccagcaggcccuggacaccccggccgucgugacgugcuuccucgcggugcccgucaucaagaagaacuccuaccuggugcuggccgggcucgccgacggccugguggccgucuuccccguggugcgggggacccccaaggacagcugcuccuaccugugcagccacaccgcgaaccgcuccaaguucagcaucgccgacgaggacgcccggcagaacccguaccccgucaaggccauggagguggugaacuccggcagcgaggucugguacuccaacggccccgggcuccuggugaucgacugcgccagccuggagaucugccgccggcucgagcccuacauggcgccgagcauggugaccuccgucgugugcagcuccgagggccgcggggaggagguggucuggugccuggacgacaaggccaacagccuggugauguaccacuccaccacguaccagcucugcgcccgguacuucugcggcgugcccagcccccugcgcgacauguuccccguccggccgcuggacaccgagccgcccgccgccucccacaccgcgaaccccaaggugccggagggcgacagcaucgccgacguguccaucauguacagcgaggagcucgggacccagauccugauccaccaggagucccugacggacuacugcagcauguccagcuacuccagcagcccgccccgccaggccgcccggagccccuccagccucccgagcucccccgccagcuccagcuccguccccuucagcaccgacugcgaggacuccgacaugcugcacacccccggcgcggccagcgaccgcuccgagcacgaccugaccccgauggacggggagacguucagccagcaccuccaggccgugaagauccuggccgugcgggaccugaucugggucccccgccggggcggggacgugaucgugaucggccucgagaaggacuccggcgcgcagcgcgggcgggucaucgccgugcugaaggcccgcgagcugacgccccacggcgugcucgucgacgccgccgugguggcgaaggacaccgucgugugcaccuucgagaacgagaacacggaguggugccuggccgucuggcggggguggggcgcccgcgaguucgacaucuucuaccagagcuacgaggagcuggggcgccucgaggccugcacccggaagcgccgguga

SEQ ID NO: 32484 - RNA, 7584 nt, Artificial Sequence
  derived and/or modified sequence opt1 from LRRK2__Homo_sapiens__NP_940980
auggccagcggcuccugccaggggugcgaggaggacgaggagacccugaagaagcucaucgugcgccugaacaacguccaggagggcaagcagaucgagacccuggugcagauccucgaggaccugcugguguucacguacagcgagcacgccuccaagcucuuccaggggaagaacauccacgucccccugcugaucgugcucgacagcuacaugcggguggcguccguccagcaggugggcuggagccugcugugcaagcucaucgaggugugcccggggaccaugcagucccugaugggcccccaggacgucggcaacgacugggaggugcugggggugcaccagcucauccugaagaugcugaccguccacaacgccagcgugaaccucuccgugaucggccugaagacccuggaccuccugcugacgagcgggaagaucacccuccugauccuggacgaggaguccgacaucuucaugcucaucuucgacgccaugcacagcuuccccgccaacgacgagguccagaagcugggcugcaaggcccugcacgugcucuucgagcgcguguccgaggagcagcugaccgaguucgucgagaacaaggacuacaugauccugcucagcgcgcugaccaacuucaaggacgaggaggagaucgugcugcacgugcuccacugccugcacucccuggccauccccugcaacaacgucgaggugcucaugagcgggaacgugcggugcuacaacaucgucguggaggccaugaaggccuucccgauguccgagcgcauccaggaggucagcugcugccugcugcaccggcucacgcugggcaacuucuucaacauccuggugcucaacgaggugcacgaguucgucgugaaggcggugcagcaguaccccgagaacgccgcccugcagaucuccgcccugagcugccucgcccugcugaccgagaccaucuuccugaaccaggaccucgaggagaagaacgagaaccaggagaacgacgacgagggcgaggaggacaagcuguucuggcuggaggcgugcuacaaggcccucaccuggcaccgcaagaacaagcacguccaggaggccgccugcugggcccugaacaaccugcucauguaccagaacagccugcacgagaagaucggggacgaggacggccacuuccccgcgcaccgggaggugaugcuguccaugcucaugcacagcuccagcaaggagguguuccaggccuccgccaacgcccugagcacgcugcucgagcagaacgucaacuuccgcaagauccugcuguccaaggggauccaccucaacgugcuggagcugaugcagaagcacauccacagccccgagguggccgaguccggcugcaagaugcucaaccaccuguucgagggcagcaacaccucccuggacaucauggcggccgucgugccgaagauccucaccgugaugaagcggcacgagaccagccugcccguccagcuggaggcccuccgcgccauccugcacuucaucgugcccgggaugcccgaggagucccgggaggacacggaguuccaccacaagcugaacauggugaagaagcagugcuucaagaacgacauccacaagcucguccuggccgcgcugaaccgcuucaucggcaacccggggauccagaagugcggccucaaggugaucagcuccaucgugcacuuccccgacgcccuggagaugcugagccucgagggggccauggacuccguccugcacacccugcagauguaccccgacgaccaggagauccagugccucggccugagccugaucggcuaccucaucaccaagaagaacguguucaucgggaccggccaccugcuggccaagauccucguguccagccuguaccgguucaaggacgucgcggagauccagacgaagggguuccagaccauccuggccauccucaagcugagcgccuccuucagcaagcugcucgugcaccacuccuucgaccuggugaucuuccaccagaugagcuccaacaucauggagcagaaggaccagcaguuccugaaccucugcugcaagugcuucgccaaggucgccauggacgacuaccugaagaacgugaugcuggagcgcgcgugcgaccagaacaacagcaucaugguggagugccuccugcugcucggcgccgacgccaaccaggccaaggagggguccagccugaucugccaggucugcgagaaggaguccagccccaagcugguggagcuccugcugaacuccggcagccgggagcaggacgugcgcaaggcccucaccaucuccaucggcaagggggacagccagaucaucucccugcugcuccggcgccuggcgcuggacgucgccaacaacagcaucugccucggcggguucugcaucggcaagguggagccguccuggcuggggccccuguuccccgacaagaccagcaaccuccggaagcagacgaacaucgccagcacccuggcccgcauggugauccgguaccagaugaaguccgccgucgaggagggcaccgcgagcggcuccgacgggaacuucagcgaggacgugcuguccaaguucgacgaguggaccuucauccccgacagcuccauggacagcguguucgcccaguccgacgaccucgacagcgagggcuccgaggggagcuuccuggucaagaagaaguccaacagcaucuccgugggcgaguucuaccgcgacgccgugcugcagcgcugcagcccgaaccuccagcggcacuccaacagccugggccccaucuucgaccacgaggaccugcucaagcgcaagcggaagauccuguccagcgacgacagccugcgcuccagcaagcuccagucccacaugcggcacagcgacuccaucagcucccuggccagcgagcgcgaguacaucacgucccuggaccucagcgcgaacgagcugcgggacaucgacgcccugucccagaagugcugcaucagcguccaccucgagcaccuggagaagcuggagcuccaccagaacgcccugaccuccuucccccagcagcugugcgagacccugaagagccucacccaccuggaccugcacuccaacaaguucacgagcuuccccuccuaccuccugaagaugagcugcaucgccaaccuggacgugucccgcaacgacaucgggccgagcgugguccucgaccccaccgugaagugccccacccugaagcaguucaaccugagcuacaaccagcucuccuucgugcccgagaaccugaccgacgucguggagaagcuggagcagcucauccuggagggcaacaagaucagcgggaucugcuccccgcugcggcucaaggagcugaagauccugaaccucagcaagaaccacaucuccagccuguccgagaacuuccuggaggccugccccaagguggagagcuucuccgcgcgcaugaacuuccucgccgccaugcccuuccugccgcccagcaugacgauccugaagcucucccagaacaaguucagcugcauccccgaggccauccugaaccugccccaccuccggucccuggacaugagcuccaacgacauccaguaccugccgggccccgcccacuggaagagccucaaccugcgcgagcugcucuucucccacaaccagaucagcauccuggaccuguccgagaaggcguaccucuggagccgggucgagaagcugcaccugagccacaacaagcucaaggagaucccccccgagaucgggugccuggagaaccugaccucccucgacgugagcuacaaccuggagcugcgcuccuucccgaacgagaugggcaagcucagcaagaucugggaccugccccuggacgagcuccaccugaacuucgacuucaagcacaucggcugcaaggccaaggacaucauccgguuccugcagcagcgccucaagaaggccguccccuacaaccggaugaagcugaugaucguggggaacaccggcuccgggaagaccacccugcuccagcagcugaugaagacgaagaagagcgaccugggcaugcaguccgccaccguggggaucgacgucaaggacuggcccauccagauccgcgacaagcggaagcgcgaccucgugcugaacgugugggacuucgccggccgcgaggaguucuacagcacccacccgcacuucaugacccagcgggcgcuguaccucgccgucuacgaccuguccaagggccaggccgagguggacgccaugaagcccuggcuguucaacaucaaggcgcgcgccagcuccagccccgugauccucgucgggacgcaccuggacguguccgacgagaagcagcggaaggccugcaugagcaagaucaccaaggagcugcucaacaagcgcggcuuccccgccauccgggacuaccacuucgugaacgccaccgaggaguccgacgcgcuggccaagcugcgcaagaccaucaucaacgagagccucaacuucaagauccgggaccagcuggucguggggcagcugaucccggacugcuacguggagcucgagaagaucauccuguccgagcgcaagaacguccccaucgaguuccccgugaucgaccggaagcgccugcuccagcuggugcgggagaaccagcugcagcucgacgagaacgagcugccccacgccguccacuuccugaacgagagcggcgugcuccugcacuuccaggacccggcccugcagcucuccgaccuguacuucguggagcccaaguggcugugcaagaucauggcccagauccucacggucaagguggaggggugccccaagcaccccaagggcaucaucagccgccgggacguggagaaguuccugagcaagaagcgcaaguucccgaagaacuacaugucccaguacuucaagcugcucgagaaguuccagaucgcgcugcccaucggcgaggaguaccugcucguccccagcucccugagcgaccaccggccggugaucgagcugccccacugcgagaacuccgagaucaucauccgccucuacgagaugcccuacuuccccaugggguucuggagccggcugaucaaccgccugcucgagaucuccccguacaugcugagcggccgggagcgcgcccugcggcccaaccgcauguacuggcgccaggggaucuaccugaacuggucccccgaggccuacugccucgugggcagcgagguccuggacaaccaccccgaguccuuccugaagaucaccgugccgagcugccggaaggggugcauccuccugggccagguggucgaccacaucgacucccugauggaggagugguuccccggccuccuggagaucgacaucugcggggagggcgagacccugcucaagaagugggcccuguacagcuucaacgacggggaggagcaccagaagauccugcucgacgaccugaugaagaaggccgaggagggcgaccugcucgugaaccccgaccagccccgccugaccaucccgaucucccagaucgcgcccgaccugauccucgccgaccugccccggaacaucaugcugaacaacgacgagcucgaguucgagcaggcccccgaguuccugcugggcgacgggagcuucggcuccguguaccgcgccgccuacgagggggaggaggucgcggugaagaucuucaacaagcacacgagccuccggcugcugcgccaggagcucgugguccugugccaccugcaccacccgucccucaucagccugcuggccgccggcauccggccccgcaugcucgugauggagcuggccagcaaggggucccuggaccggcuccugcagcaggacaaggcgagccugacccgcacccuccagcaccggaucgcccugcacguggccgacggccugcgcuaccuccacuccgccaugaucaucuaccgggaccugaagccccacaacguccugcucuucacccuguaccccaacgccgcgaucaucgccaagaucgccgacuacggcaucgcccaguacugcugccgcauggggaucaagacgagcgagggcaccccgggguuccgggcccccgagguggcgcgcggcaacgugaucuacaaccagcaggccgacgucuacuccuucgggcugcuccuguacgacauccugaccaccggcggccggaucguggaggggcucaaguuccccaacgaguucgacgagcuggagauccagggcaagcugcccgacccggugaaggaguacgggugcgcccccuggcccauggucgagaagcucaucaagcagugccugaaggagaacccccaggagcgcccgacgagcgcccagguguucgacauccugaacuccgccgagcucgugugccugacccggcgcauccugcuccccaagaacgucaucguggagugcaugguggcgacccaccacaacagccgcaacgccuccaucuggcugggcugcgggcacaccgaccggggccagcugagcuuccucgaccugaacacggagggcuacaccuccgaggaggucgccgacagccgcauccugugccucgcccuggugcaccugcccgucgagaaggaguccuggaucgugagcgggacccaguccggcacccuccuggugaucaacacggaggacgggaagaagcggcacacccuggagaagaugaccgacagcgucaccugccucuacugcaacuccuucagcaagcagagcaagcagaagaacuuccugcuggugggcacggcggacggcaagcucgccaucuucgaggacaagaccgugaagcugaagggggccgccccgcugaagauccucaacaucggcaacgucuccaccccccugaugugccugagcgaguccaccaacagcacggagcgcaacgugaugugggggggcugcgggaccaagaucuucuccuucagcaacgacuucaccauccagaagcucaucgagacccggaccucccagcuguucagcuacgccgcguucuccgacagcaacaucaucacgguggucguggacaccgcccuguacaucgccaagcagaacucccccguggucgaggugugggacaagaagaccgagaagcucugcggccugaucgacugcgugcacuuccugcgcgaggucauggugaaggagaacaaggagagcaagcacaagauguccuacagcggccgggugaagacccucugccugcagaagaacacggcccuguggaucgggaccggcgggggccacauccuccugcuggaccucuccacccgccggcugauccgcgucaucuacaacuucugcaacagcgugcgggugaugaugaccgcccagcuggggucccucaagaacgucaugcuggugcugggcuacaaccgcaagaacacggagggcacccagaagcagaaggagauccagagcugccugaccgugugggacaucaaccucccccacgagguccagaaccuggagaagcacaucgaggugcggaaggagcuggcggagaagaugcgccggaccuccguggaguga

SEQ ID NO: 32485 - RNA, 2151 nt, Artificial Sequence
  derived and/or modified sequence opt1 from LRRN1__Homo_sapiens__NP_065924
auggcccgcaugagcuucgugaucgccgcgugccagcugguccucggccugcugaugaccucccucaccgagagcuccauccagaacagcgagugcccccagcugugcgugugcgagauccggccgugguucacgccccaguccaccuaccgcgaggccaccaccguggacugcaacgaccugcggcucacgcgcauccccagcaaccuguccagcgacacccagguccugcuccugcaguccaacaacaucgccaagaccguggacgagcugcagcagcuguucaaccucaccgagcuggacuucagccagaacaacuucacgaacaucaaggagguggggcucgccaaccugacccagcugaccacccuccaccuggaggagaaccagaucacggagaugaccgacuacugccugcaggaccucuccaaccugcaggagcuguacaucaaccacaaccagaucagcaccaucuccgcccacgcguucgccggccucaagaaccugcugcggcuccaccugaacagcaacaagcugaaggucaucgacucccgcugguucgacagcacccccaaccucgagauccugaugaucggggagaacccggugaucggcauccuggacaugaacuucaagccccucgccaaccugcggucccuggugcucgccgggauguaccugacggacauccccggcaacgcgcuggucggccucgacagccuggagucccugagcuucuacgacaacaagcucgugaaggugccccagcuggcccugcagaaggucccgaaccucaaguuccuggaccugaacaagaaccccauccacaagauccaggagggggacuucaagaacaugcuccgccugaaggagcugggcaucaacaacaugggggagcuggugagcguggaccgguacgcccucgacaaccugcccgagcugaccaagcucgaggccaccaacaaccccaagcuguccuacauccaccgccuggccuuccggagcgucccggcgcucgagucccugaugcugaacaacaacgcccucaacgccaucuaccagaagaccguggagagccugcccaaccugcgcgagaucuccauccacagcaacccccuccggugcgacugcgugauccacuggaucaacuccaacaagacgaacauccgcuucauggagccccugagcauguucugcgccaugccgcccgaguacaagggccaccaggucaaggaggugcugauccaggacuccagcgagcagugccuccccaugaucucccacgacagcuuccccaaccggcugaacguggacaucgggaccaccgucuuccuggacugccgcgccauggcggagccggagcccgagaucuacugggugacccccaucggcaacaagaucacgguggagacccucuccgacaaguacaagcugagcuccgagggcacccuggagaucagcaacauccagaucgaggacuccgggcgguacacgugcgucgcccagaacgugcagggcgccgacacccgcgucgccaccaucaaggugaacgggacccuccuggacggcacccaggugcugaagaucuacgucaagcagacggagagccacuccauccucgugagcuggaaggugaacagcaacgucaugaccuccaaccugaaguggagcuccgccaccaugaagaucgacaacccccacaucaccuacacggcgcgggugccgguggacguccacgaguacaaccugacccaccuccagcccagcaccgacuacgaggugugccugaccguguccaacauccaccagcagacccagaaguccugcgucaacgugacgaccaagaacgccgccuucgccguggacaucagcgaccaggagaccagcaccgcccuggcggccgucaugggcuccauguucgccgugaucagccucgccuccaucgcgguguacuucgccaagcgcuucaagcggaagaacuaccaccacagccugaagaaguacaugcagaagacguccagcaucccccugaacgagcucuacccgccccugaucaaccugugggagggggacuccgagaaggacaaggacggcagcgccgacaccaagcccacccaggucgacaccucccgcagcuacuacaugugguga

SEQ ID NO: 32486 - RNA, 2142 nt, Artificial Sequence
  derived and/or modified sequence opt1 from LRRN2__Homo_sapiens__NP_006329
augcgccugcucguggcgccccugcugcucgccugggucgccggcgccaccgccgccgugcccgugguccccuggcacgugcccugcccgccccagugcgccugccagauccggcccugguacacgccccgcagcuccuaccgggaggccaccaccguggacugcaacgaccuguuccugaccgccgugcccccggcccuccccgccgggacccagacgcugcugcuccagagcaacuccaucguccgcguggaccagagcgagcugggcuaccuggcgaaccucaccgagcuggaccugucccagaacagcuucuccgacgcccgggacugcgacuuccacgcccucccccagcugcugagccuccaccuggaggagaaccagcugacccgccucgaggaccacuccuucgccgggcuggccagccugcaggagcucuaccugaaccacaaccagcuguaccggaucgcgccccgcgccuucuccggccucagcaaccugcugcggcuccaccugaacuccaaccugcuccgcgccaucgacagccggugguucgagaugcugccgaaccuggagauccucaugaucgggggcaacaaggucgacgccauccuggacaugaacuuccgcccccuggccaaccuccggucccuggugcuggcgggcaugaaccuccgcgagaucagcgacuacgcccuggaggggcugcagucccucgagagccuguccuucuacgacaaccagcuggcccgggugccccgccgggcccucgagcagguccccggccugaaguuccuggaccugaacaagaacccgcuccagcgcguggggcccggcgacuucgccaacaugcugcaccugaaggagcucgggcugaacaacauggaggagcuggugagcaucgacaaguucgcgcucgucaaccugcccgagcugaccaagcucgacaucacgaacaacccccggcugagcuucauccacccgcgcgccuuccaccaccucccccagauggagacccugaugcugaacaacaacgcccuguccgcccuccaccagcagaccguggagagccugcccaaccugcaggaggugggccuccacggcaaccccauccggugcgacugcgucauccgcugggccaacgcgaccgggacgcgcgugcgguucaucgagccgcaguccacccugugcgccgagccgcccgaccugcagcgccuccccgugcgggagguccccuuccgcgagaugaccgaccacugccugccccugaucagcccccgguccuucccgcccagccuccagguggccuccggcgagagcauggugcugcacugccgcgcccuggcggagcccgagcccgagaucuacugggucaccccggccgggcuccggcugacgcccgcccacgccggccgccgguaccgcguguaccccgagggcacccuggagcuccggcgcgucaccgccgaggaggcggggcuguacacgugcguggcccagaaccuggugggcgccgacaccaagaccgucuccgugguggucgggcgggcccuccugcagcccggccgcgacgaggggcagggccuggagcuccgggugcaggagacccacccguaccacauccugcugagcugggugaccccgcccaacacggucuccaccaaccucaccuggagcuccgccagcucccugcgcggccagggggcgaccgcccuggcccggcucccccgcggcacgcacagcuacaacaucacccggcugcugcaggccaccgaguacugggccugccuccagguggcguucgccgacgcccacacccagcuggccugcgugugggcgcgcacgaaggaggccaccuccugccaccgcgcccugggggaccggcccggccucaucgccauccuggcccuggcgguccuccugcuggccgccgggcucgccgcccaccugggcaccggccagccccgcaagggggugggcgggcggcgcccccugcccccggcgugggccuucuggggcuggagcgcccccuccgugcgggucgugagcgcgccccucgugcugcccuggaacccggggcgcaagcugccccggagcuccgagggcgagacccuccugccgccccugagccagaacuccuga

SEQ ID NO: 32487 - RNA, 2127 nt, Artificial Sequence
  derived and/or modified sequence opt1 from LRRN3__Homo_sapiens__NP_001093128
augaaggacaugccccugcgcauccacgugcuccugggccuggccaucaccacccucguccaggccguggacaagaagguggacugcccccggcugugcacgugcgagauccgccccugguucacgccccggagcaucuacauggaggcguccaccgucgacugcaacgaccuggggcuccugaccuuccccgcccgccugccggccaacacccagauccuccugcugcagaccaacaacaucgccaagaucgaguacagcaccgacuuccccgugaaccucaccggccuggaccugucccagaacaaccucagcuccgugacgaacaucaacgucaagaagaugccccagcugcugagcguguaccucgaggagaacaagcugaccgagcugcccgagaagugccucuccgagcugagcaaccugcaggagcucuacaucaaccacaaccugcuguccaccaucagcccgggggccuucaucggccuccacaaccugcugcggcuccaccugaacuccaaccgccugcagaugaucaacagcaagugguucgacgcgcuccccaaccuggagauccugaugaucggggagaaccccaucauccggaucaaggacaugaacuucaagccccucaucaaccugcgcucccuggugaucgccggcaucaaccucaccgagaucccggacaacgcccuggucggccuggagaaccucgagagcaucuccuucuacgacaaccggcugaucaaggugccccacguggcccugcagaaggucgugaaccucaaguuccuggaccugaacaagaaccccaucaaccgcauccggcgcggggacuucagcaacaugcuccaccugaaggagcugggcaucaacaacaugcccgagcugaucuccaucgacagccucgcgguggacaaccugccggaccugcggaagaucgaggccacgaacaacccccgccucuccuacauccaccccaacgccuucuuccggcugcccaagcuggagagccucaugcugaacagcaacgcccuguccgcccucuaccacgggaccaucgagagccugccgaaccugaaggagaucuccauccacagcaaccccauccgcugcgacugcgucauccgguggaugaacaugaacaagaccaacauccgcuucauggagcccgacucccucuucugcguggacccgcccgaguuccagggccagaacgugcggcagguccacuuccgcgacaugauggagaucugccugccccugaucgcgcccgagagcuuccccuccaaccucaacguggaggccgggagcuacguguccuuccacugccgggccaccgccgagccgcagcccgagaucuacuggaucacgcccagcggccagaagcugcugccgaacacccucaccgacaaguucuacguccacuccgagggcacccuggacaucaacggggugacgcccaaggagggcgggcuguacacgugcaucgccaccaaccucgugggcgcggaccucaagagcgucaugaucaagguggacggcuccuucccccaggacaacaacgggagccugaacaucaagauccgcgacauccaggccaacuccguccuggugagcuggaaggccuccagcaagauccugaaguccagcgugaaguggaccgccuucgucaagaccgagaacagccacgccgcgcaguccgcccgcauccccagcgacgugaagguguacaaccugacccaccucaacccguccaccgaguacaagaucugcaucgacauccccaccaucuaccagaagaaccggaagaagugcgucaacgugacgaccaagggccugcaccccgaccagaaggaguacgagaagaacaacaccaccacgcugauggccugccucgggggccugcuggggaucaucggcgugaucugccucaucagcugccugucccccgagaugaacugcgacggcgggcacagcuacguccgcaacuaccugcagaagccgaccuucgcccucggcgagcuguacccgccccugaucaaccucugggaggccgggaaggagaaguccaccagccugaaggugaaggcgaccgugaucggccugcccacgaacauguccuga

SEQ ID NO: 32488 - RNA, 2223 nt, Artificial Sequence
  derived and/or modified sequence opt1 from LRRN4__Homo_sapiens__NP_689824
augcgccagacccugccccuccugcugcucaccgugcugcggccgagcugggccgacccgccccaggagaaggucccccuguuccgcgugacgcagcagggccccuggggguccagcggcuccaacgccaccgacagccccugcgaggggcuccccgcggccgacgccaccgcccugacccuggccaaccggaaccucgagcgccugcccggcugccugccgcggacgcuccgcucccuggacgcgagccacaaccugcuccgggcccuguccaccagcgagcuggggcaccucgagcagcuccaggugcugacccuccgccacaaccggaucgccgcccugcgcuggggccccggcgggcccgcgggccugcacacccucgaccuguccuacaaccagcuggccgcccugcccccgugcacggggcccgcccugagcucccugcgggcccucgcgcuggccggcaacccccugcgcgcccuccagccccgggccuucgccugcuucccggcgcugcagcugcucaaccugagcugcaccgcccuggggcgcggcgcccagggcgggaucgccgaggccgcguucgccggcgaggacggggcgccccucgucacccuggaggugcuggaccucuccggcaccuuccuggagcggguggagagcggcuggauccgcgaccugcccaagcucacgucccuguaccugcggaagaugccccgccucaccacccuggagggggacaucuucaagaugaccccgaaccugcagcagcuggacugccaggacagccccgcccucgccuccgucgccacgcacaucuuccaggacacgccccaccuccaggugcugcuguuccagaacugcaaccugagcuccuucccgcccuggacccuggacagcagccaggugcucuccaucaaccuguucggcaacccccugaccugcagcugcgaccucuccuggcugcugaccgacgccaagcggaccguccucagccgcgccgccgacaccaugugcgcgcccgccgccggguccagcggccccuucuccgccagccugucccugagccagcucccgggggugugccaguccgaccagagcaccacgcugggcgccucccacccgcccugcuucaaccggagcaccuacgcgcagggcaccaccguggcccccuccgccgcccccgccacgcgccccgcgggggaccagcagagcgucuccaaggcccccaacgugggcagccgcaccaucgccgccuggccgcacuccgacgcccgggaggggaccgcgcccagcaccacgaacagcguggccggccacuccaacagcuccgucuucccccgcgccgccagcaccacccggacccagcaccgcggggagcacgcgcccgagcuggugcucgagccggacaucuccgccgccagcacgccccuggccuccaagcugcucggccccuuccccaccagcugggaccgguccaucagcuccccgcagcccggccagcgcacccacgccacgccccaggcgcccaacccgagccuguccgagggggagauccccgugcugcuccuggacgacuacagcgaggaggaggagggccggaaggaggaggucgggacgccccaccaggacgugcccugcgacuaccacccgugcaagcaccuccagacccccugcgccgagcugcagcgccgguggcgcugccggugccccggccuguccggggaggacaccauccccgacccgccccgccugcagggcgugaccgagaccaccgacaccagcgcccucguccacuggugcgcccccaacuccguggugcacggcuaccagauccgguacagcgccgaggggugggcgggcaaccagagcgucgugggggucaucuacgccaccgcccgccagcacccgcuguacggccugucccccggcaccacguaccgggugugcgugcucgccgccaaccgcgcggggcugagccagccccgguccagcggcuggcgcucccccugcgccgccuucaccaccaagccgagcuucgcccugcuccuguccgggcugugcgcggccagcggccuccugcuggccuccaccgucgugcucagcgccugccugugccggcgcgggcagacgcugggccuccagcgcugcgacacccaccugguggccuacaagaaccccgcguucgacgacuacccccugggccuccagaccgucuccuga

SEQ ID NO: 32489 - RNA, 1569 nt, Artificial Sequence
  derived and/or modified sequence opt1 from LRRTM1__Homo_sapiens__NP_849161
auggacuuccugcuccugggccugugccucuacuggcugcugcgccggcccagcggggugguccucugccugcugggcgccugcuuccagaugcucccggccgcgcccuccgggugcccccagcugugccgcugcgagggccggcugcucuacugcgaggcccugaaccugaccgaggcgccccacaaccucagcgggcugcugggccucucccugcgcuacaacagccuguccgagcuccgggccggccaguucaccgggcugaugcagcugaccuggcucuaccuggaccacaaccacaucugcagcgugcagggcgacgccuuccagaagcugcgccgggugaaggagcucacccuguccagcaaccagaucacccagcugccgaacaccacguuccgccccaugcccaaccuccgguccgucgaccugagcuacaacaagcugcaggcccucgcccccgaccuguuccacgggcugcgcaagcucaccacccugcacaugcgggccaacgccauccaguucgugccggugcgcaucuuccaggacugccggucccugaaguuccucgacaucggcuacaaccagcucaagagccuggcgcgcaacuccuucgccggccuguucaagcugaccgagcugcaccucgagcacaacgaccuggucaaggugaacuucgcccacuucccccggcugaucagccuccacucccugugccugcgccggaacaagguggccaucgucgugagcucccuggacuggguguggaaccucgagaagauggaccugagcggcaacgagaucgaguacauggagccccacgucuucgagacggugccccaccuccagucccugcagcuggacagcaaccgccugaccuacaucgagccgcggauccucaacagcuggaagucccugaccagcaucacccuggccggcaaccucugggacugcgggcgcaacgugugcgcgcuggccuccuggcugaacaacuuccagggccgguacgacgggaaccuccagugcgccagccccgaguacgcccagggcgaggacguccuggacgccguguacgcguuccaccugugcgaggacggcgccgagcccacguccgggcaccuccugagcgccgugaccaaccgcuccgaccuggggcccccggccagcuccgccaccacccucgcggacgggggcgaggggcagcacgacggcacguucgagcccgccaccgucgcccugcccggcggggagcacgccgagaacgccgugcagauccacaagguggucaccggcaccauggcgcugaucuucagcuuccucaucguggugcugguccuguacguguccuggaagugcuuccccgccagccuccgccagcugcggcagugcuucgucacgcagcgccggaagcagaagcagaagcagaccaugcaccagauggccgccauguccgcgcaggaguacuacguggacuacaagccgaaccacaucgagggggcccuggugaucaucaacgaguacggcagcugcacgugccaccagcagcccgcccgcgagugcgaggucuga

SEQ ID NO: 32490 - RNA, 1551 nt, Artificial Sequence
  derived and/or modified sequence opt1 from LRRTM2__Homo_sapiens__NP_056379
augggccugcacuucaaguggccccucggggccccgaugcuggccgcgaucuacgccaugagcauggugcugaagaugcuccccgcccugggcauggccugcccgcccaagugccgcugcgagaagcugcuguucuacugcgacucccagggguuccacagcguccccaacgccaccgacaagggcucccuggggcugagccuccggcacaaccacaucaccgagcuggagcgcgaccaguucgcguccuucagccagcugacguggcuccaccuggaccacaaccagaucuccaccgugaaggaggacgccuuccagggccuguacaagcucaaggagcugauccugagcuccaacaagaucuucuaccuccccaacaccaccuucacgcagcugaucaaccugcagaaccucgaccugagcuucaaccagcuguccagccuccaccccgagcuguucuacggccugcggaagcuccagacccugcaccuccgcuccaacagccuccggaccauccccgugcgccuguucugggacugccggucccuggaguuccucgaccugagcaccaaccgccugcggucccucgcccgcaacggguucgccggccugaucaagcugcgggagcuccaccuggagcacaaccagcugacgaagaucaacuucgcgcacuuccuccgccugagcucccugcacacccucuuccugcaguggaacaagaucagcaaccugaccugcgggauggaguggaccuggggcacgcucgagaagcuggaccugaccgggaacgagaucaaggccaucgaccugaccgucuucgagaccaugccgaaccucaagauccugcugauggacaacaacaagcucaacagccuggacuccaagauccugaacagccuccggucccugacgaccgugggccugagcggcaaccucugggagugcuccgcccgcaucugcgcccuggccagcuggcugggguccuuccagggccggugggagcacagcauccucugccacucccccgaccacacccagggggaggacauccuggacgcggugcacggcuuccagcugugcuggaaccucagcaccacggucaccgugauggccaccaccuaccgcgaccccacgaccgaguacaccaagcggaucuccagcuccagcuaccacgugggcgacaaggagauccccaccacggccgggaucgccgucaccaccgaggagcacuucccggagcccgacaacgccaucuucacccagcgcgugaucacgggcaccauggcgcugcuguucuccuucuucuucaucaucuucaucguguucaucagccggaagugcugcccgcccacccuccgccggauccgccagugcuccaugguccagaaccaccgccagcugcggagccagacccgccugcacauguccaacaugagcgaccaggggcccuacaacgaguacgagcccacgcacgagggccccuucaucaucaucaacggguacggccagugcaagugccagcagcuccccuacaaggagugcgagguguga

SEQ ID NO: 32491 - RNA, 1746 nt, Artificial Sequence
  derived and/or modified sequence opt1 from LRRTM3__Homo_sapiens__NP_821079
augggcuucaacgugauccgccugcucagcggguccgccgucgcccuggugaucgcgcccaccgugcugcucaccaugcugagcuccgccgagcggggcugcccgaaggggugccgcugcgagggcaagauggucuacugcgagagccagaagcugcaggagauccccuccagcaucuccgccgggugccucggccugagccugcgguacaacucccuccagaagcugaaguacaaccaguucaagggccugaaccagcucacguggcuguaccuggaccacaaccacaucagcaacaucgacgagaacgccuucaacgggauccgccggcucaaggagcugauccuguccagcaaccgcaucuccuacuuccucaacaacaccuuccggcccgugaccaaccugcgcaaccuggaccucagcuacaaccagcugcacucccugggcagcgagcaguuccgggggcuccgcaagcugcugucccuccaccuccggagcaacucccugcgcaccauccccgugcggaucuuccaggacugccgcaaccuggagcugcuggaccucggcuacaaccggauccgcagccuggcccggaacgucuucgcggggaugauccgccugaaggagcuccaccuggagcacaaccaguucagcaagcugaaccucgcccuguucccgcggcuggugucccuccagaaccuguaccugcaguggaacaagaucagcgugaucggccagacgauguccuggaccuggagcucccuccagcgccuggaccugagcggcaacgagaucgaggccuucuccgggcccagcgucuuccagugcgugcccaaccuccagcggcugaaccuggacuccaacaagcugaccuucaucggccaggagauccucgacagcuggaucucccugaacgacaucagccuggccgggaacaucugggagugcucccgcaacaucugcagccucgugaacuggcugaaguccuucaagggccugcgcgagaacaccaucaucugcgcgagccccaaggagcuccagggcgucaacgugaucgacgccgugaagaacuacuccaucugcggcaagagcacgaccgagcgguucgaccuggcccgcgcccugccgaagcccaccuucaagcccaagcucccccggccgaagcacgaguccaagccgccccugccgcccaccgucggggccacggagcccgggcccgagaccgacgcggacgccgagcacaucagcuuccacaagaucaucgccggcagcguggcccuguuccucuccgugcuggucauccugcucgugaucuacgugagcuggaagcgcuaccccgccuccaugaagcagcugcagcagcggagccugaugcgccggcaccgcaagaagaagcggcagucccucaagcagaugacccccagcacccaggaguucuacgucgacuacaagcccacgaacaccgagaccuccgagaugcugcugaacgggaccggccccugcacguacaacaagagcggcucccgcgagugcgagaucccccucagcaugaacguguccaccuuccuggcguacgaccagccgaccaucagcuacugcggggugcaccacgagcugcucucccacaagagcuucgagaccaacgcccaggaggacacgauggagacccaccuggagaccgagcuggaccucuccaccaucacgaccgccggccggaucagcgaccacaagcagcagcuggccuga

SEQ ID NO: 32492 - RNA, 1773 nt, Artificial Sequence
  derived and/or modified sequence opt1 from LRRTM4__Homo_sapiens__NP_001128217
augggcuuccaccugaucacccagcucaaggggaugagcgugguccuggugcugcuccccacccugcugcucgugaugcugacgggcgcccagcgcgccugcccgaagaacugccggugcgacgggaagaucgucuacugcgagucccacgcguucgccgacauccccgagaacaucagcggcgggucccagggccugagccuccgcuucaacuccauccagaagcucaagagcaaccaguucgccggccugaaccagcucaucuggcuguaccuggaccacaacuacaucuccagcguggacgaggacgccuuccaggggauccggcgccucaaggagcugauccuguccagcaacaagaucaccuaccuccacaacaagaccuuccaccccgugcccaaccugcggaaccuggaccucuccuacaacaagcugcagacccugcagagcgagcaguucaagggccuccgcaagcugaucauccugcaccuccgguccaacagccugaagacggucccgauccgcguguuccaggacugccggaaccuggacuuccucgaccugggguacaaccgccugcggucccucagccgcaacgccuucgcgggccugcugaagcucaaggagcugcaccuggagcacaaccaguucuccaagaucaacuucgcccacuucccccggcuguucaaccugcgcagcaucuaccugcaguggaaccggauccgcuccaucagccaggggcucaccuggaccuggagcucccugcacaaccuggaccucagcggcaacgacauccagggcaucgagcccgggaccuucaagugccugcccaaccugcagaagcucaaccuggacuccaacaagcugacgaacaucagccaggagaccgugaacgccuggaucucccugaucagcaucacccucuccggcaacaugugggagugcagccgguccaucugcccgcuguucuacuggcugaagaacuucaaggggaacaaggagagcaccaugaucugcgccggccccaagcacauccagggcgagaaggucuccgacgcgguggagacguacaacaucugcagcgaggugcaggucgugaacaccgagcgcucccaccucgugccccagacgccccagaagccgcugaucaucccccggcccaccaucuucaagcccgacgucacccagagcaccuucgagaccccgucccccagccccggguuccagauccccggcgccgagcaggaguacgagcacguguccuuccacaagaucaucgccgggagcguggcccuguuccucuccgucgccaugauccugcuggugaucuacgugagcuggaagcgcuacccggcgagcaugaagcagcuccagcagcacucccugaugaagcggcgccgcaagaaggcccgggagagcgagcgccagaugaacagcccccugcaggaguacuacgucgacuacaagcccaccaacuccgagacgauggacaucuccgugaacggcagcgggcccugcaccuacaccaucuccggcagccgggagugcgagaugccgcaccacaugaagccccuccccuacuacuccuacgaccagcccgugaucggcuacugccaggcccaccagccgcugcacgucaccaagggguacgagacggugagccccgagcaggacgagucccccggccuggagcucgggcgcgaccacagcuucaucgccaccaucgcccgguccgcggccccggccaucuaccuggagcgcaucgccaacuga

SEQ ID NO: 32493 - RNA, 2091 nt, Artificial Sequence
  derived and/or modified sequence opt1 from LRSAM1__Homo_sapiens__NP_001177652
augccccuguucuuccgcaagcggaagccgagcgaggaggcccgcaagcggcucgaguaccagaugugccuggccaaggaggcgggcgccgacgacauccuggacaucuccaagugcgagcucagcgagauccccuucggggccuucgcgaccugcaaggugcugcagaagaagguccugaucgugcacaccaaccaccucacgucccugcugcccaagagcugcucccuccugagccuggccaccaucaaggugcucgaccugcacgacaaccagcugaccgcccuccccgacgaccugggccagcugaccgcccuccagguccugaacguggagcgcaaccagcugaugcagcucccgcgguccaucgggaaccugacgcagcugcagacccucaacgugaaggacaacaagcugaaggagcugcccgacaccgucggcgagcuccgcagccugcggacccugaacaucuccgggaacgagauccagcgccucccccagaugcuggcccacgugcggacgcuggagaugcucagccuggacgccuccgcgaugguguacccgccccgcgaggucugcggcgccggcaccgccgccauccugcaguuccucugcaaggagagcgggcuggaguacuacccgcccucccaguaccugcuccccauccuggagcaggacggcaucgagaacagccgggacucccccgacgggcccaccgaccgcuucagccgggaggagcuggaguggcagaaccgcuucuccgacuacgagaagcggaaggagcagaagaugcucgagaagcuggaguucgagcgccggcuggagcucggccagcgcgagcacacccagcugcugcagcagagcuccagccagaaggacgagauccuccagacggugaaggaggagcagagccggcuggagcaggggcuguccgagcaccagcgccaccugaacgccgagcggcagcgccuccaggagcagcugaagcagaccgagcagaacaucagcucccgcauccagaagcugcuccaggacaaccagcggcagaagaaguccagcgagauccucaagagccuggagaacgagcgcauccggauggagcagcugauguccaucacccaggaggagaccgagagccugcgccggcgcgacguggcguccgccaugcagcagaugcugacggagagcugcaagaaccggcucauccagauggccuacgagucccagcgccagaaccugguccagcaggccugcagcuccauggccgagauggacgagcgguuccagcagauccugagcuggcagcagauggaccagaacaaggcgaucucccagauccuccaggagagcgccaugcagaaggccgccuucgaggcccuccaggugaagaaggaccugaugcaccgccagauccggucccaggagaugaucagcgagcagcgcugggcgcuguccagccugcugcagcagcuccugaaggagaagcagcagcgggaggaggagcugcgcgagauccucaccgagcuggaggccaagagcgagacccggcaggagaacuacuggcugauccaguaccagcgccuccugaaccagaagccccugucccucaagcugcaggaggagggcauggagcggcagcugguggcccuccuggaggagcugagcgccgagcacuaccuccccaucuucgcccaccaccgccugucccuggaccuccugagccagauguccccgggcgaccuggcgaaggucggggugagcgaggccggccuccagcacgagauccugcggcgcgugcaggagcugcucgacgccgcccgcauccagcccgagcugaagccgcccaugggggaggucgugacccccacggcgccccaggagccgcccgaguccgugcggcccagcgccccgcccgccgagcuggagguccaggccuccgagugcguggugugccucgagcgcgaggcccagaugaucuuccugaacugcggccacgucugcugcugccagcagugcugccagccccugcggaccugcccccucugccgccaggacaucgcgcagcggcugcgcaucuaccacagcuccuga

SEQ ID NO: 32494 - RNA, 810 nt, Artificial Sequence
  derived and/or modified sequence opt1 from LRTM1__Homo_sapiens__NP_001291318
augacccugaaccucagcaacaacucccugagcaaccuggcccccggcgccuuccacgggcuccagcaccuccaggugcugaaccugacccagaacucccugcugagccucgagucccgccuguuccacagccugccgcagcuccgggagcuggaccuguccagcaacaacaucucccaccuccccacgagccugggcgagaccugggagaaccugaccauccucgcgguccagcagaaccagcugcagcagcuggaccgcgcccuccuggaguccaugcccagcgugcggcugcuccugcugaaggacaaccucuggaagugcaacugccaccuccuggggcugaagcuguggcuggagaaguucguguacaagggcgggcucaccgacggcaucaucugcgagucccccgacacguggaagggcaaggaccugcugcgcaucccgcacgagcucuaccagcccugcccccugcccgccccggaccccgucagcucccaggcccaguggcccgggagcgcccacggcguggugcugcggcccccggagaaccacaacgcgggggagcgcgagcuccuggagugcgagcugaagcccaagccccggcccgccaaccuccgccacgccaucgccaccgucaucaucaccggcguggugugcgggaucgucugccugaugaugcuggcggccgccaucuacggcugcaccuacgccgccaucacggcgcaguaccacggcgggccgcucgcccagaccaacgaccccggcaagguggaggagaaggagcgguucgacuccagccccgccuga

SEQ ID NO: 32495 - RNA, 477 nt, Artificial Sequence
  derived and/or modified sequence opt1 from LRTOMT__Homo_sapiens__NP_001138779
augaacaagcgcgacuacaugaacaccagcgugcaggagcccccgcuggacuacuccuuccggagcauccacgucauccaggaccucgugaacgaggagccccgcaccggccugcggccccugaagcgcuccaagagcgggaagucccucacgcagagccuguggcugaacaacaacgugcucaacgaccugcgggacuucaaccaggucgccucccagcugcucgagcaccccgagaaccuggccuggaucgaccugagcuucaacgaccucaccuccaucgaccccgugcugaccaccuucuucaaccugagcgugcucuaccugcacggcaacuccauccagcgccugggggaggucaacaagcucgcggugcugccccggcugcgcagccucacgcugcacggcaaccccauggaggaggagaagggguaccgggugcccggcuccgucgagaugccgcaccgcccgcccuga

SEQ ID NO: 32496 - RNA, 1017 nt, Artificial Sequence
  derived and/or modified sequence opt1 from LSAMP__Homo_sapiens__NP_002329
auggugcgccggguccagcccgaccgcaagcagcugccgcucgugcugcugcggcuccugugccugcuccccaccggccugcccgugcgcagcgucgacuucaaccgggggaccgacaacaucaccgugcgccagggcgacaccgccauccugcggugcguggucgaggacaagaacuccaagguggccuggcucaaccgcagcgggaucaucuucgcgggccacgacaaguggucccuggacccccggguggagcuggagaagcgccacagccucgaguacucccugcggauccagaaggucgacguguacgacgaggggagcuacacgugcuccgugcagacccagcacgagccgaagaccagccaggucuaccugaucguccaggugccgcccaagaucuccaacaucagcuccgacgugaccgugaacgagggcagcaacgugacccucgucugcauggccaacggccgccccgagcccgugaucaccuggcggcaccugacgcccaccgggcgcgaguucgagggcgaggaggaguaccuggagauccucgggaucacccgggagcaguccggcaaguacgagugcaaggccgccaacgaggugagcuccgccgacgucaagcaggucaaggugaccgugaacuacccgcccacgaucaccgagagcaaguccaacgaggcgaccaccgggcgccaggccagccugaagugcgaggccuccgccgugcccgcgcccgacuucgagugguaccgggacgacacgcgcaucaacagcgccaacggccuggagaucaagagcaccgagggccaguccagccucaccgucaccaacgugacggaggagcacuacgggaacuacacgugcguggccgccaacaagcugggcgucaccaacgccucccugguccucuuccggcccgggagcgugcgcggcaucaacggcuccaucagccuggcggugccccuguggcuccuggccgccucccugcucugccugcugagcaagugcuga

SEQ ID NO: 32497 - RNA, 1083 nt, Artificial Sequence
  derived and/or modified sequence opt1 from LSM11__Homo_sapiens__NP_775762
auggaggagcgcgagcggggcgcccgcagcgccggggcgggcucccccgcccggccgcccagcccccgccuggacguguccagcgacuccuucgacccccuccuggcccuguacgccccgcggcucccgcccauccccuaccccaacgcccccugcuucaacaacgucgcggaguacgagagcuuccugcgcaccggggugcggggcgggggccgcggccgggggcgcgcccggggcgccgccgcgggguccggcgugcccgccgcccccgggccgagcggccgcacccggcgccggcccgacgcccccgcccccgacccggagcgcauccagcggcugcgccggcucauggucgcgaaggaggagggcgacggggccgccggcgccgggcgccggggccccggccgcucccgcaaggcgccccggaacgugcugacgcgcaugccccugcacgaggggagcccgcucggcgagcugcaccggugcauccgcgagggggugaaggucaacgugcacauccggaccuucaagggccugcgcggggugugcaccggcuuccucgucgccuucgacaaguucuggaacauggcccugaccgacguggacgagacguaccggaagcccgugcugggcaaggccuacgagcgcgacuccagccucacccugacccggcuguucgaccgccucaagcugcaggacuccagcaagaaggaggccgacuccaagagcgccgucgaggacuccacccugagccgguacucccagacgagcaccuggaagcucgcgagcgugugggggcgcgccgacaccggccgggggucccacaagcgcagccgguccgugcccagcucccugcaggccagcgcccgcgaggagucccggagcgagcuguccggccgcaccacgcggaccgacgggagcuccgucggcggcaccuucagccgcgccaccacgcucucccgcgggcagagccggaagaagaagcgcaagcccaagguggacuaccagcaggucuucacccggcacaucaaccagaucuucauccgcggcgagaacgugcugcuggugcaccucgcgcaguga

SEQ ID NO: 32498 - RNA, 402 nt, Artificial Sequence
  derived and/or modified sequence opt1 from LSM1__Homo_sapiens__NP_055277
augaacuacaugcccggcaccgccagccugaucgaggacaucgacaagaagcaccucgugcugcugcgcgacgggcggacccucaucggcuuccugcgcuccaucgaccaguucgccaaccugguccuccaccagaccguggagcggauccacguggggaagaaguacggcgacaucccgcgcgggaucuucgucgugcggggcgagaacgugguccugcugggcgagaucgaccucgagaaggagagcgacacgccccugcagcaggucuccaucgaggagauccuggaggagcagcgcguggagcagcagaccaagcucgaggcggagaagcugaaggugcaggcccugaaggaccgggggcucagcaucccccgcgccgacacccuggacgaguacuga

SEQ ID NO: 32499 - RNA, 288 nt, Artificial Sequence
  derived and/or modified sequence opt1 from LSM2__Homo_sapiens__NP_067000
augcuguucuacagcuucuucaagucccucgugggcaaggacgucgugguggagcugaagaacgaccugagcaucugcgggacccuccacuccgucgaccaguaccugaacaucaagcugaccgacaucagcgugacggaccccgagaaguacccgcacaugcucuccgugaagaacugcuucauccgcggcagcgucgugcgguacgugcagcugcccgccgacgaggucgacacccagcugcuccaggacgccgcgcgcaaggaggcccugcagcagaagcaguga

SEQ ID NO: 32500 - RNA, 309 nt, Artificial Sequence
  derived and/or modified sequence opt1 from LSM3__Homo_sapiens__NP_055278
auggccgacgacguggaccagcagcagaccaccaacacggucgaggagccccuggaccucauccgccugagccuggacgagcggaucuacgugaagaugcgcaacgaccgggagcuccgcggccggcugcacgccuacgaccagcaccugaacaugauccucggggacguggaggagaccgucaccaccaucgagaucgacgaggagacguacgaggagaucuacaaguccaccaagcgcaacauccccaugcuguucgugcggggcgacggggugguccugguggcgccgccccuccgcgugggcuga

SEQ ID NO: 32501 - RNA, 420 nt, Artificial Sequence
  derived and/or modified sequence opt1 from LSM4__Homo_sapiens__NP_036453
augcugccccucagccugcugaagaccgcccagaaccacccgaugcucguggagcugaagaacggcgagaccuacaacgggcaccuggucuccugcgacaacuggaugaacaucaaccuccgcgaggugaucugcacgagccgggacggcgacaaguucuggcgcaugcccgagugcuacauccggggguccaccaucaaguaccugcgcauccccgacgagaucaucgacauggugaaggaggaggucguggccaagggccgggggcgcggcggccugcagcagcagaagcagcagaaggggcggggcaugggcggggcggggcgcggcguguucggcgggcggggccgcgggggcauccccggcaccgggcggggccagccggagaagaagcccgggcgccaggccggcaagcaguga

SEQ ID NO: 32502 - RNA, 276 nt, Artificial Sequence
  derived and/or modified sequence opt1 from LSM5__Homo_sapiens__NP_036454
auggccgccaacgcgaccaccaaccccagccagcugcucccgcuggagcugguggacaagugcaucggcagccgcauccacaucgucaugaaguccgacaaggagaucguggggacgcuccugggcuucgacgacuucgugaacaugguccuggaggacgugaccgaguucgagaucacccccgaggggcggcgcaucaccaagcucgaccagauccugcugaacggcaacaacaucacgaugcucgugcccgggggcgagggccccgaggucuga

SEQ ID NO: 32503 - RNA, 243 nt, Artificial Sequence
  derived and/or modified sequence opt1 from LSM6__Homo_sapiens__NP_009011
augagccugcgcaagcagacccccuccgacuuccucaagcagaucaucggccggccgguggucgugaagcugaacagcgggguggacuaccgcggcguccuggccugccucgacggguacaugaacaucgcccuggagcagaccgaggaguacgugaacggccagcugaagaacaaguacggggacgcguucauccggggcaacaacgugcucuacaucuccacgcagaagcgccggauguga

SEQ ID NO: 32504 - RNA, 312 nt, Artificial Sequence
  derived and/or modified sequence opt1 from LSM7__Homo_sapiens__NP_057283
auggccgacaaggagaagaagaagaaggagagcauccuggaccucuccaaguacaucgacaagaccauccgcgugaaguuccagggcgggcgggaggccagcggcauccugaagggguucgacccccugcucaaccugguccuggacggcaccaucgaguacaugcgcgacccggacgaccaguacaagcucacggaggacacccggcagcuggggcugguggugugccgcggcaccuccgucgugcucaucugcccccaggacggcauggaggcgauccccaaccccuucauccagcagcaggacgccuga

SEQ ID NO: 32505 - RNA, 834 nt, Artificial Sequence
  derived and/or modified sequence opt1 from LSP1__Homo_sapiens__NP_001013273
augcugcucagccugaagcccuccgaggccccggagcuggacgaggacgagggcuucggggacuggagccagcgccccgagcagcggcagcagcacgagggcgcccagggggcgcucgacuccggcgagccgccccagugccgcagccccgagggggagcaggaggaccggcccggccugcacgccuacgagaaggaggacuccgacgaggugcaccuggaggagcucagccuguccaaggagggccccgggcccgaggacaccguccaggacaaccugggcgccgccggggccgaggaggagcaggaggagcaccagaagugccagcagccgcgcacccccagcccccucgugcuggagggcacgaucgagcaguccagcccgccccugucccccaccaccaagcucaucgaccggaccgagagccugaaccgcuccaucgagaaguccaacagcgugaagaagucccagcccgaccugcccaucagcaagaucgaccaguggcucgagcaguacacgcaggcgaucgagaccgccgggcggaccccgaagcuggcccgccaggccagcaucgagcugcccuccauggcggucgccagcaccaagagccggugggagacgggcgaggugcaggcccaguccgccgccaagacccccagcugcaaggacaucguggcgggcgacauguccaagaagucccucugggagcagaagggcgggagcaagaccagcuccaccaucaagagcacgcccuccgggaagcgcuacaaguucgucgccaccggccacggcaaguacgagaaggugcugguggagggcgggccggcccccuga

SEQ ID NO: 32506 - RNA, 1890 nt, Artificial Sequence
  derived and/or modified sequence opt1 from LSR__Homo_sapiens__NP_001247418
augcagcaggacggccugggggugggcacccgcaacgggagcggcaaggggcgguccguccaccccagcuggcccuggugcgcgccccgcccccuccgguacuucggccgcgacgcccgggcgcgccgggcccagaccgccgccauggcccugcuggcgggcgggcucucccgcggccuggggagccaccccgccgccgccggccgggacgcggugguguucgucuggcugcuccuguccacguggugcaccgcccccgcccgcgccauccaggugaccgugagcaaccccuaccacgucgugauccuguuccagcccgugacccuccccugcacguaccagaugaccuccacccccacccagcccaucgucaucuggaaguacaagagcuucugccgggaccgcaucgccgacgcguucucccccgccagcguggacaaccagcugaacgcccagcuggccgccgggaaccccggcuacaacccguacguggagugccaggacuccguccggacggugcgcguggucgcgaccaagcagggcaacgccgugacccucggggacuacuaccagggccggcgcaucaccaucacggggaacgccgaccugaccuucgaccagaccgccuggggcgacagcggcguguacuacugcuccgucgugagcgcccaggaccugcaggggaacaacgaggcguacgccgagcucaucgugcuggacuggcuguucgucgugguggucugccucgccgccuuccugaucuuccugcuccugggcaucugcuggugccagugcugcccccacacgugcugcugcuacgugcggugccccugcugccccgacaagugcugcugcccggaggcccuguacgcggccgggaaggccgccaccuccggcguccccagcaucuacgcgcccuccaccuacgcccaccucagccccgccaagaccccgcccccgcccgccaugauccccauggggcccgccuacaacggcuaccccggcggguaccccggcgacguggaccgcuccagcagcgccgggggccagggguccuacgugccgcugcugcgggacaccgacagcuccgucgccagcgugcgcuccggcuaccggauccaggccagccagcaggacgacuccaugcgcgugcucuacuacauggagaaggagcuggccaacuucgaccccagccgccccggcccgcccuccgggcgggucgagcgcgccaugagcgaggugacgucccugcacgaggacgacuggcggagccgccccucccggggccccgcgcucaccccgauccgcgacgaggaguggggcgggcacagcccccggagcccccgcgggugggaccaggagcccgcccgggagcaggccggcggcggguggcgcgcccggcgcccgcgggcccgcuccguggacgcgcuggacgaccugaccccgcccuccaccgccgagagcggcucccggagccccacgagcaacgggggccgcucccgggccuacaugccgccccgcagccggucccgcgacgaccucuacgaccaggacgacagccgcgacuucccccggucccgcgacccccacuacgacgacuuccggagccgcgagcggccgcccgccgacccccgcucccaccaccaccggacccgcgacccccgggacaacggcagccgcuccggggaccugccguacgacggccggcugcucgaggaggcgguccgcaagaaggggagcgaggagcggcgccggccccacaaggaggaggaggaggaggccuacuacccgcccgccccgccgcccuacuccgagaccgacagccaggccucccgcgagcggcgccugaagaagaaccuggcccucagccgggagucccuggugguguga

SEQ ID NO: 32507 - RNA, 2199 nt, Artificial Sequence
  derived and/or modified sequence opt1 from LSS__Homo_sapiens__NP_001001438
augaccgaggggaccugccugcgccggcgcgggggccccuacaagaccgagccggccaccgaccucgggcgguggcgccugaacugcgagcggggccgccagaccuggaccuaccugcaggacgagcgggccgggcgcgagcagacgggccucgaggcguacgcccugggccuggacaccaagaacuacuucaaggaccuccccaaggcccacaccgccuucgagggggcccugaacggcaugaccuucuacguggggcugcaggcggaggacggccacuggacgggggacuacggcggcccccucuuccugcugcccgggcuccugaucacgugccacgucgcccggaucccgcugcccgccggcuaccgcgaggagaucgugcgguaccuccgcagcgugcagcugcccgacgggggcuggggccugcacaucgaggacaaguccaccgucuucgggaccgcccucaacuacgugagccugcggauccugggcguggggcccgacgacccggaccucguccgcgcgcggaacauccugcacaagaagggcggggccguggccauccccuccuggggcaaguucuggcuggccgugcucaacgucuacagcugggagggccugaacacccuguuccccgagauguggcuguuccccgacugggccccggcgcaccccuccacccuguggugccacugccgccagguguaccugcccaugagcuacugcuacgccgugcggcucuccgccgccgaggacccccugguccagagccugcgccaggagcucuacguggaggacuucgccuccaucgacuggcuggcgcagcggaacaacguggccccggacgagcuguacacgccccacagcuggcuccugcgcgucguguacgcccugcucaaccuguacgagcaccaccacuccgcccaccuccggcagcgcgccgugcagaagcucuacgagcacaucgucgcggacgaccgcuucaccaagagcaucuccaucgggcccaucagcaagaccaucaacaugcuggugcggugguacguggacggccccgccuccaccgccuuccaggagcacgucagccgcaucccggacuaccuguggauggggcucgacggcaugaagaugcaggggaccaacggcucccagaucugggacaccgccuucgccauccaggcgcugcuggaggccggcgggcaccaccggcccgaguucagcuccugccuccagaaggcccacgaguuccugcgccugagccaggugcccgacaacccgcccgacuaccagaaguacuaccggcagaugcgcaagggcggguucagcuucuccacgcuggacugcggcuggaucgugagcgacugcaccgccgaggcgcucaaggccguccugcugcuccaggagaagugcccccacgugaccgagcacaucccccgggagcgccugugcgacgccgucgccgugcugcucaacaugcggaaccccgacgggggcuucgccaccuacgagacgaagcgcggcgggcaccuccuggagcugcugaacccguccgagguguucggcgacaucaugaucgacuacaccuacgucgagugcaccagcgcggugaugcaggcccugaaguacuuccacaagcgguuccccgagcaccgcgccgccgagauccgggagacccucacgcaggggcuggaguucugccgccggcagcagcgcgccgacggcuccugggagggcagcuggggcgugugcuucaccuacggcaccugguucgggcuggaggcguucgccugcaugggccagaccuaccgggacgggacggccugcgccgaggucucccgcgccugcgacuuccuccugagccggcagauggcggacggcggcuggggcgaggacuucgaguccugcgaggagcgccgcuaccugcagagcgcccagucccagauccacaacacgugcugggccaugauggggcucauggccgugcggcaccccgacaucgaggcgcaggagcgcggggugcggugccugcuggagaagcagcucccgaacggcgacuggccccaggagaacaucgccggggucuucaacaagagcugcgccaucuccuacaccagcuaccgcaacaucuuccccaucugggcccugggccgguucucccagcuguaccccgagcgcgcccucgcgggccacccguga

SEQ ID NO: 32508 - RNA, 201 nt, Artificial Sequence
  derived and/or modified sequence opt1 from LST1__Homo_sapiens__NP_995309
augcugagccgcaacgacgacaucugcaucuacggcgggcucggccucgggggccugcugcugcuggccgugguccuccuguccgccugccugugcuggcuccaccggcgcgcgcccagcgugcuggugcccgggcccggccugcuccgggccggcaccccgcugugcaucuccgccgaggccgccagcgcgcagcaguga

SEQ ID NO: 32509 - RNA, 1836 nt, Artificial Sequence
  derived and/or modified sequence opt1 from LTA4H__Homo_sapiens__NP_000886
augcccgagaucguggacacgugcagccuggccuccccggccagcgucugccgcaccaagcaccuccaccuccggugcuccguggacuucacccgccggacccugaccggcaccgcggcccugacggugcagagccaggaggacaaccugcgcucccugguccucgacaccaaggaccugaccaucgagaagguggugaucaacgggcaggaggucaaguacgcccugggcgagcggcagagcuacaaggggucccccauggagaucagccuccccaucgcccuguccaagaaccaggagaucgugaucgagaucagcuucgagaccucccccaagagcuccgcccugcaguggcucacgccggagcagaccagcggcaaggagcaccccuaccuguucucccagugccaggcgauccacugccgcgccauccugcccugccaggacacccccagcgugaagcucaccuacacggccgaggucuccgugccgaaggagcugguggcccugaugagcgcgauccgggacggggagacccccgaccccgaggaccccucccgcaagaucuacaaguucauccagaaggucccgauccccugcuaccucaucgcccugguggugggcgcccuggagagccggcagaucggcccccgcacccucgucuggagcgagaaggagcaggucgagaaguccgccuacgaguucagcgagaccgaguccaugcugaagaucgccgaggaccucgggggccccuacgugugggggcaguacgaccugcuggugcugccgcccagcuuccccuacggcgggauggagaaccccugccucacguucgugaccccgacccugcuggcgggcgacaagucccucagcaacgugaucgcccacgagaucucccacagcuggaccggcaaccuggucacgaacaagaccugggaccacuucuggcugaacgaggggcacaccguguaccucgagcggcacaucugcggccgccuguucggggagaaguuccggcacuucaacgcccugggcggcuggggcgagcuccagaacuccgugaagaccuucggggagacgcaccccuucaccaagcuggucguggaccugaccgacaucgaccccgacgucgccuacagcuccgugcccuacgagaagggguucgcccuccuguucuaccuggagcagcuccugggcgggccggagaucuuccugggcuuccucaaggcguacguggagaaguucagcuacaaguccaucaccacggacgacuggaaggacuuccuguacagcuacuucaaggacaaggucgacgugcugaaccagguggacuggaacgccuggcucuacucccccggccugccgcccaucaagcccaacuacgacaugacccugaccaacgccugcaucgcccugagccagcgcuggaucaccgccaaggaggacgaccucaacuccuucaacgcgacggaccugaaggaccugagcucccaccagcucaacgaguuccuggcccagacccugcagcgggcgccccucccccuggggcacaucaagcgcaugcaggaggucuacaacuucaacgccaucaacaacagcgagauccgguuccgcuggcugcggcucugcauccagagcaagugggaggacgccaucccgcuggcccugaagauggccaccgagcagggccgcaugaaguucacccggccccucuucaaggaccuggccgccuucgacaagucccacgaccaggcggugcgcacguaccaggagcacaaggccagcaugcaccccgugaccgccaugcuggucgggaaggaccucaagguggacuga

SEQ ID NO: 32510 - RNA, 618 nt, Artificial Sequence
  derived and/or modified sequence opt1 from LTA__Homo_sapiens__XP_011512920
augacgcccccggagcgccuguuccucccccgggugugcggcaccacccugcaccuccuccugcuggggcuccugcugguccuccugcccggcgcccaggggcugcccggcguggggcucaccccgagcgccgcgcagaccgcccgccagcaccccaagaugcaccuggcccacuccacccugaagcccgccgcccaccucaucggcgaccccagcaagcagaacucccugcuguggcgggcgaacacggaccgcgccuuccuccaggacggcuucagccuguccaacaacagccugcucgugccgaccuccgggaucuacuucgucuacagccaggugguguucuccggcaaggccuacagccccaaggccaccuccagcccccuguaccuggcgcacgagguccagcuguucuccagccaguaccccuuccacgugccgcugcuguccagccagaagaugguguaccccgggcuccaggagcccuggcugcacuccauguaccacggcgccgccuuccagcugacccagggggaccagcucagcacgcacaccgacggcaucccccaccugguccuguccccgagcaccguguucuucggcgccuucgcccucuga

SEQ ID NO: 32511 - RNA, 1077 nt, Artificial Sequence
  derived and/or modified sequence opt1 from LTB4R2__Homo_sapiens__NP_062813
augagcgugugcuaccggcccccgggcaacgagacccugcucuccuggaagaccagccgcgccacggggaccgccuuccugcugcucgcggcccugcugggccuccccgggaacggcuucgucguguggucccuggccggguggcgccccgcccggggccgcccccuggccgcgacccucgugcugcaccuggcccucgccgacggcgccguccugcugcucaccccgcuguucguggcguuccugacgcggcaggccuggccccucgggcaggccggcugcaaggccguguacuacgucugcgcccugagcauguacgcguccgugcugcucaccgggcugcugagccuccagcgcugccuggccgugacccggcccuuccuggcgccccgccuccgguccccggcccuggcccgccggcugcuccuggccgucuggcuggccgcccuccugcuggccgugcccgccgcgguguaccgccaccucuggcgggaccgcgucugccagcugugccaccccagccccgugcacgccgccgcccaccugucccucgagacccugacggccuucgugcugccguucggccucaugcuggggugcuacagcgucacccuggcgcggcuccgcggcgcccgguggggcuccgggcgccacggcgcccggguggggcgccuggugagcgccaucguccuggcguucggccuccugugggcccccuaccacgccgugaaccugcugcaggccguggccgcgcucgccccgcccgagggcgcccuggccaagcucgggggcgccgggcaggcggcccgggccggcaccaccgcccuggccuucuucuccagcuccgucaacccggugcuguacguguucacggcgggggaccugcucccccgcgccggcccccgcuuccugacccggcuguucgagggcagcggggaggcccgcggcgggggccggucccgcgaggggaccauggagcuccggaccacgccccagcugaaggucgugggccagggccgcgggaacggcgaccccgggggcgggauggagaaggacggccccgagugggaccuguga

SEQ ID NO: 32512 - RNA, 1059 nt, Artificial Sequence
  derived and/or modified sequence opt1 from LTB4R__Homo_sapiens__NP_001137391
augaacaccaccagcuccgccgcgcccccgagccugggcguggaguucaucucccuccuggccaucauccugcucagcgucgcccuggccguggggcugcccggcaacuccuucguggucuggagcauccucaagcgcaugcagaagcgguccgugacggcccugauggugcugaaccucgcccuggcggaccuggccguccuccugaccgcccccuucuuccugcacuuccucgcccaggggaccuggagcuucggccuggcggggugccgccugugccacuacgugugcggcguguccauguacgccagcguccuccugaucaccgccaugucccuggaccggagccucgccguggcccgccccuucgugucccagaagcugcggacgaaggcgauggcccgccggguccuggccggcaucugggugcucagcuuccugcuggccaccccggugcucgccuaccgcaccgucgugcccuggaagaccaacaugucccugugcuucccccgguaccccagcgaggggcaccgcgcguuccaccugaucuucgaggccgugacgggcuuccuccugccguuccuggccgucguggccuccuacagcgacaucgggcggcgccuccaggcccggcgcuuccggcgcucccggcgcaccggccggcuggugguccugaucauccucaccuucgcggccuucuggcugcccuaccacguggugaaccuggccgaggccgggcgcgcccucgcgggccaggccgccggccuggggcuggucggcaagcggcucagccuggcccgcaacgugcugaucgcgcucgccuuccugagcuccagcgucaaccccgugcuguacgccugcgccgggggcggccuccugcgcuccgccggggugggcuucgucgcgaagcugcuggaggggaccggcagcgaggccuccagcacgcggcgcgggggcucccucggccagaccgcccggagcgggcccgccgcccuggagccgggccccuccgagagccugaccgcguccagcccccucaagcugaacgagcugaacuga

SEQ ID NO: 32513 - RNA, 735 nt, Artificial Sequence
  derived and/or modified sequence opt1 from LTB__Homo_sapiens__NP_002332
augggcgcccuggggcucgagggccgcgggggccggcugcaggggcgcggcagccugcuccuggccguggcgggcgccaccucccuggucacccuccugcuggccgugcccaucacggugcucgccguccuggcccuggugccgcaggaccagggcgggcucgugaccgagaccgcggaccccggggcccaggcccagcagggccugggguuccagaagcugcccgaggaggagcccgagaccgaccucagcccgggccugcccgccgcgcaccugaucggcgcgccccucaaggggcagggccuggggugggagacgaccaaggagcaggccuuccugaccuccggcacccaguucagcgacgccgagggccucgcccugccccaggacgggcuguacuaccucuacugccuggucggcuaccgggggcgcgccccgcccggcgggggcgacccccagggccgguccgugacgcugcgcagcucccucuaccgggccgggggcgccuacgggcccggcaccccggagcugcugcucgagggggccgagaccgugacccccguccuggaccccgcccgccggcagggcuacggcccccugugguacacgagcgugggguucggcgggcucgugcagcugcgccggggcgagcgcgucuacgugaacaucucccacccggacaugguggacuucgcgcgggggaagaccuucuucggcgccgucauggugggcuga

SEQ ID NO: 32514 - RNA, 4188 nt, Artificial Sequence
  derived and/or modified sequence opt1 from LTBP1__Homo_sapiens__NP_000618
auggacaccaagcugaugugccuccuguucuucuucagccugcccccgcuccugguguccaaccacaccggccgcaucaaggucguguucacgcccagcaucugcaaggugaccugcaccaagggguccugccagaacagcugcgagaagggcaacaccacgacccugaucuccgagaacgggcacgccgccgacacccucaccgcgacgaacuuccgggucgugaucugccaccuccccugcaugaacggcgggcagugcagcucccgcgacaagugccagugcccgcccaacuucaccggcaagcugugccagauccccgugcacggcgccagcguccccaagcucuaccagcacucccagcagcccgggaaggcccugggcacccacgugauccacagcacccacacgcugccgcucaccgugaccucccagcagggggucaaggugaaguucccgcccaacaucgugaacauccacgucaagcacccgcccgaggccagcgugcagauccaccaggugucccggaucgacggccccaccgggcagaagacgaaggaggcccagcccggccagagccaggucuccuaccagggccugcccgugcagaagacccagaccauccacagcaccuacucccaccagcaggucaucccccacgucuaccccguggcggccaagacgcagcuggggcgcugcuuccaggagaccaucggcagccagugcgggaaggcccuccccggccuguccaagcaggaggacugcugcggcaccguggggaccagcuggggcuucaacaagugccagaagugccccaagaagccgagcuaccacggguacaaccagaugauggagugccugcccggcuacaagcgggucaacaacacguucugccaggacaucaacgagugccagcuccagggggugugccccaacggcgagugccugaacaccaugggcuccuaccgcugcacgugcaagaucggguucggccccgacccgaccuucagcuccugcgugcccgacccgcccgucaucagcgaggagaaggggcccugcuaccggcugguguccagcggccgccagugcaugcacccccucuccguccaccugacgaagcagcugugcugcugcagcguggggaaggccuggggcccccacugcgagaagugcccgcuccccggcaccgcggccuucaaggagaucugccccgggggcaugggguacaccguguccggcguccaccggcgccggcccauccaccaccacguggggaagggcccgguguucgucaagcccaagaacacccagcccguggccaagagcacgcacccgccgccccugcccgccaaggaggagcccguggaggcccugaccuucucccgcgagcacggccccgggguggcggagcccgagguggccaccgccccgcccgagaaggagauccccagccuggaccaggagaagaccaagcuggagcccggccagccccagcugucccccgggaucagcaccauccaccuccacccgcaguuccccguggucaucgagaagaccuccccgcccgugcccguggaggucgcccccgaggccagcaccuccagcgcgucccaggugaucgcccccacccaggugaccgagaucaacgagugcacggucaacccggacaucugcggcgccggccacugcaucaaccugcccgugcgguacacgugcaucugcuacgagggguaccgcuucagcgagcagcagcggaagugcguggacaucgacgagugcacccagguccagcaccugugcagccagggccgcugcgagaacaccgagggguccuuccucugcaucugccccgccggcuucauggccagcgaggaggggaccaacugcaucgacguggacgagugccugcggcccgacgugugcggcgagggccacugcgucaacaccgugggggcguuccgcugcgaguacugcgacuccggcuaccggaugacccagcgcgggcggugcgaggacaucgacgagugccugaacccguccacgugccccgacgagcagugcgugaacagccccggcagcuaccagugcguccccugcaccgagggguuccgcggcuggaacggccagugccucgacguggacgagugccuggagccgaacgugugcgccaacggggacugcuccaaccuggagggcagcuacaugugcuccugccacaagggguacacccgcacccccgaccacaagcacugccgggacaucgacgagugccagcagggcaaccucugcgucaacgggcagugcaagaacaccgagggcagcuuccgcugcacgugcggccagggguaccagcuguccgccgccaaggaccagugcgaggacaucgacgagugccagcaccggcaccugugcgcccacggccagugccgcaacaccgaggggagcuuccagugcgugugcgaccagggcuaccgggcguccgggcucggcgaccacugcgaggacaucaacgagugccuggaggacaagagcgugugccagcgcggcgacugcaucaacaccgccggguccuacgacugcacgugccccgacggcuuccagcuggacgacaacaagaccugccaggacaucaacgagugcgagcaccccgggcucugcggcccgcagggcgagugccugaacaccgaggggagcuuccacugcgucugccagcagggcuucuccaucagcgccgacgggcggaccugcgaggacaucgacgagugcgugaacaacaccgugugcgacagccacggcuucugcgacaacacggccggguccuuccgcugccugugcuaccagggcuuccaggcgccccaggacggccaggggugcgucgacgugaacgagugcgagcuccugagcggcgugugcggggaggccuucugcgagaacgucgagggcuccuuccugugcgugugcgccgacgagaaccaggaguacagccccaugaccgggcagugccggucccgcaccagcaccgaccuggacguggacgucgaccagcccaaggaggagaagaaggagugcuacuacaaccucaacgacgccucccugugcgacaacgugcuggccccgaacgugacgaagcaggagugcugcugcaccagcggcgcgggcuggggcgacaacugcgagaucuuccccugccccguccucgggaccgccgaguucaccgagaugugccccaaggggaagggcuucgugccggccggggaguccagcuccgaggccggcggcgagaacuacaaggacgccgacgagugccugcuguucgggcaggagaucugcaagaacggcuucugccucaacacgcggcccggguacgagugcuacugcaagcagggcaccuacuacgaccccgugaagcugcagugcuucgacauggacgagugccaggaccccagcuccugcaucgacggccagugcgucaacaccgaggggagcuacaacugcuucugcacccacccgauggugcuggacgcguccgagaagcgcugcauccggcccgccgagagcaacgagcagaucgaggagacggacguguaccaggaccucugcugggagcaccuguccgacgaguacgucugcagccgcccccuggugggcaagcagaccaccuacaccgagugcugcugccucuacggggaggccuggggcaugcagugcgcccugugcccccugaaggacuccgacgacuacgcccagcucugcaacaucccggucacggggcggcgccagcccuacggccgggacgcgcugguggacuucagcgagcaguacacccccgaggccgacccguacuucauccaggaccgcuuccugaacagcuucgaggagcuccaggccgaggagugcggcauccugaacgggugcgagaacggccggugcgugcgcguccaggagggguacacgugcgacugcuucgacggcuaccaccuggacaccgccaagaugaccugcguggacgugaacgagugcgacgagcucaacaaccgcaugucccugugcaagaacgcgaagugcaucaacaccgacgggagcuacaagugccugugccuccccggcuacguccccuccgacaagcccaacuacugcaccccgcugaacaccgcccugaaccucgagaaggacagcgaccuggaguga

SEQ ID NO: 32515 - RNA, 5466 nt, Artificial Sequence
  derived and/or modified sequence opt1 from LTBP2__Homo_sapiens__NP_000419
augcgcccccggaccaaggcccgcucccccggccgggcccugcgcaaccccuggcggggcuuccucccccugacccuggcccucuucgugggcgccgggcacgcccagcgcgaccccgucggccgguacgagcccgccgggggcgacgccaaccgccugcggcgccccggcggguccuaccccgccgccgccgccgccaagguguacagccuguuccgggagcaggacgcccccguggccggccuccagccggucgagcgcgcccagcccggguggggcagcccccggcgccccaccgaggccgaggcccggcgccccagccgggcccagcagucccgccgggugcagccgcccgcccagacccgccggagcacgccccuggggcagcagcagcccgcgccccgcacccgcgccgcccccgcccugccccggcucggcacgccccagcgcuccggcgccgcgccgcccaccccgccccgggggcgccugaccggccggaacgugugcgggggccagugcugccccggcuggaccaccgccaacagcaccaaccacugcaucaagcccgucugcgagccgcccugccagaaccgcggguccugcagccggccccagcugugcgugugccgcuccggcuuccggggcgcccgcugcgaggaggugauccccgacgaggaguucgacccccagaacagccggcucgcgccccgccggugggccgagcgcucccccaaccugcggcgcagcuccgccgccggcgaggggacccuggcccgggcccagccgcccgcgccccaguccccgcccgcgccccaguccccgcccgcgggcacccucagcggccugucccagacgcaccccagccagcagcacgucgggcugagccgcaccgugcggcuccaccccaccgccaccgccuccagccagcuguccagcaacgcccugccgcccggccccgggcucgagcagcgcgacggcacgcagcaggccgugccgcuggagcaccccuccagccccugggggcugaaccucaccgagaagaucaagaagaucaagaucgucuucacccccaccaucugcaagcagacgugcgcgcgcggccacugcgccaacuccugcgagcggggcgacaccaccacccuguacagccagggcgggcacgggcacgacccgaaguccggcuuccgcaucuacuucugccagauccccugccugaacgggggccggugcaucggccgcgacgagugcuggugccccgccaacagcacggggaaguucugccaccuccccaucccgcagcccgaccgggagcccccgggccgcgggucccggccccgcgcccugcuggaggcgccccucaagcagagcaccuucacccugccccuguccaaccagcucgcgagcgugaacccgucccuggugaagguccacauccaccacccgcccgaggccagcgugcagauccaccagguggcccagguccggggcggcguggaggaggcccugguggagaacuccgucgagacccggcccccgcccuggcuccccgccagccccgggcacucccugugggacagcaacaacauccccgcgcgcagcggcgagccgccccgcccccugccgcccgccgcgccccggccccgcgggcuccugggccggugcuaccugaacacggugaacgggcagugcgccaacccgcuccuggagcugaccacccaggaggacugcugcggcuccgugggcgcguucuggggcgugacccucugcgcccccugcccgccccgcccggccagccccgugaucgagaacggccagcuggagugcccccagggguacaagcggcugaaccucacgcacugccaggacaucaacgagugccugacccugggccugugcaaggacgccgagugcgucaacacccgcggguccuaccucugcacgugccggcccggccugaugcuggaccccagccgcucccggugcgugagcgacaaggccaucuccaugcuccagggccugugcuaccgcagccuggggcccgggaccugcacccucccccuggcccagcgcaucaccaagcagaucugcugcugcucccgggugggcaaggccuggggcagcgagugcgagaagugcccgcugcccgggaccgaggccuuccgcgagaucugccccgccggccacggcuacaccuacgccuccagcgacauccggcucuccaugcgcaaggcggaggaggaggagcuggcccggcccccgcgcgagcaggggcagcggagcuccggcgcccugcccgggcccgccgagcgccagccccuccgggucgugacggacaccuggcuggaggccggcaccaucccggacaagggggacagccaggcgggccaggugaccacguccgucacccacgcccccgccugggugaccggcaacgccaccacgccgcccaugcccgagcaggggaucgcggagauccaggaggagcaggucacccccagcaccgacguccuggugacccucagcacgcccggcaucgaccgcugcgccgccggggccaccaacgugugcggccccgggaccugcgucaaccugccggacggguaccggugcgugugcucccccggcuaccagcugcaccccagccaggccuacugcaccgacgacaacgagugccuccgcgaccccugcaaggggaagggccggugcaucaaccgcgugggguccuacagcugcuucugcuacccgggcuacacgcuggcgaccuccggcgccacccaggagugccaggacaucaacgagugcgagcagcccggggucugcagcggcgggcagugcaccaacacggagggcuccuaccacugcgagugcgaccagggguacaucauggugcggaagggccacugccaggacaucaacgagugccgccaccccgggaccugccccgacgggcggugcgugaacagcccgggcuccuacacgugccuggccugcgaggagggguaccgcggccagagcggguccugcgucgacgugaacgagugccucacccccggcgugugcgcccacggcaagugcacgaaccuggaggggagcuuccggugcuccugcgagcagggcuacgaggucaccagcgacgagaaggggugccaggacguggacgagugcgccucccgcgcgagcugccccaccggccugugccucaacaccgagggcuccuucgccugcagcgccugcgagaacggguacugggugaacgaggacggcacggccugcgaggaccuggacgagugcgccuuccccggggucugcccguccggcgugugcaccaacaccgcggggagcuucagcugcaaggacugcgacggcggcuaccgccccagcccccugggggacagcugcgaggacguggacgagugcgaggacccgcaguccagcugccucggcggggagugcaagaacaccgucggcuccuaccagugccugugcccccagggguuccagcuggccaacggcacggugugcgaggacgugaacgagugcaugggcgaggagcacugcgcgccccacggggagugccucaacagccacggcuccuucuucugccugugcgcccccggguucgucagcgccgagggcgggaccuccugccaggacguggacgagugcgcgaccaccgacccgugcgugggcggccacugcgucaacacggaggggagcuucaacugccugugcgagaccggcuuccagcccucccccgagagcggggagugcguggacaucgacgagugcgaggacuacggcgaccccgugugcgggaccuggaagugcgagaacuccccgggcagcuaccggugcguccucggcugccagcccggguuccacauggcccccaacggcgacugcaucgacaucgacgagugcgccaacgacaccaugugcgggucccacggcuucugcgacaacaccgacggcagcuuccgcugccugugcgaccagggguucgagaucucccccagcggcugggacugcguggacgugaacgagugcgagcugaugcucgccgucugcggggcggcccugugcgagaacguggagggcuccuuccugugccucugcgccagcgaccuggaggaguacgacgcccaggaggggcacugccggccgcgcggcgccggcgggcagagcauguccgaggcgcccacgggcgaccacgcccccgcccccacccggauggacugcuacagcgggcagaagggccacgccccgugcuccagcgugcuggggcgcaacaccacccaggccgagugcugcugcacgcagggcgcguccuggggcgacgccugcgaccucugccccagcgaggacuccgccgaguucagcgagaucugccccuccgggaagggcuacauccccgucgagggggccuggaccuucggccagaccauguacaccgacgccgacgagugcgugaucuucgggccgggccugugccccaacggccggugccugaacacggugcccggguacgucugccucugcaaccccggcuuccacuacgacgcgagccacaagaagugcgaggaccacgacgagugccaggaccuggccugcgagaacggggagugcgugaacaccgagggcuccuuccacugcuucugcagcccgccccugacccucgaccugucccagcagcgcugcaugaacagcaccuccagcacggaggaccugcccgaccacgacauccacauggacaucugcuggaagaaggugaccaacgacgucugcuccgagccgcuccgggggcaccgcaccaccuacacggagugcugcugccaggacggcgaggccuggagccagcagugcgcccugugcccgccccgguccagcgagguguacgcgcagcugugcaacguggcccgcaucgaggccgagcgggaggccggcguccacuuccgccccggguacgaguacggccccgggcccgacgaccuccacuacagcaucuacggccccgacggcgcccccuucuacaacuaccuggggccggaggacaccgugcccgagcccgcguuccccaacaccgccggccacuccgccgaccggaccccgauccuggagagcccccuccagcccuccgagcugcagccccacuacgucgccagccacccggagccgcccgccggguucgagggccugcaggcggaggagugcgggauccucaacggcugcgagaacggccgcugcgugcgggugcgcgagggguacacgugcgacugcuucgagggcuuccagcuggacgccgcccacauggccugcgucgacgugaacgagugcgacgaccugaacgggcccgccgugcucugcguccacggcuacugcgagaacaccgagggguccuaccggugccacugcagcccgggcuacguggcggaggccgggccgccccacugcaccgccaaggaguga

SEQ ID NO: 32516 - RNA, 3912 nt, Artificial Sequence
  derived and/or modified sequence opt1 from LTBP3__Homo_sapiens__NP_001123616
augcccggcccgcgcggggccgccggcgggcuggcgcccgagaugcggggcgccggggccgccggccuccuggcccugcuccugcugcuccugcugcuccugcugggccucgggggccgcguggaggggggccccgcgggggagcggggcgccggcgggggcggggcccuggcccgcgagcgguucaaggucguguucgcgcccgugaucugcaagcgcaccugccugaagggccagugccgggacagcugccagcagggcuccaacaugacccucaucggggagaacggccacagcacggacacccugaccggguccggcuuccgcgucguggugugcccgcugcccugcaugaacgggggccagugcagcucccggaaccagugccucugcccccccgacuucaccggccgcuucugccaggucccggccgggggcgccgggggcgggacgggcggcagcgggcccggccugucccggaccggggcccugagcaccggcgcccuccccccccuggcgccggagggggacuccguggccagcaagcacgccaucuacgccgugcaggucaucgccgacccccccggccccggcgaggggccgcccgcgcagcacgccgccuuccuggugccccucggccccgggcagaucuccgccgaggugcaggccccgccccccgucgugaacgugcgcguccaccaccccccggaggcgagcgugcaggugcaccggaucgaguccagcaacgccgaguccgccgcccccagccagcaccugcugccccaccccaagccgucccacccccgccccccgacccagaagccccucggccggugcuuccaggacacgcugcccaagcagcccugcggcagcaacccgcugcccgggcucaccaagcaggaggacugcugcggcuccaucgggaccgccuggggccagagcaagugccacaagugcccccagcugcaguacaccgggguccagaagcccggcccggugcgcggcgaggugggggcggacugcccccagggcuacaagcggcugaacagcacgcacugccaggacaucaacgagugcgccaugcccggggucugccgccacggcgacugccucaacaaccccggguccuaccggugcgugugcccgcccggccacagccugggccccucccgcacccagugcaucgccgacaagcccgaggagaagagccugugcuuccggcucguguccccggagcaccagugccagcacccccugaccacccgccugacgcgccagcucugcugcugcagcgucgggaaggccuggggcgcgcggugccagcgcugccccaccgacgggaccgccgccuucaaggagaucugccccgccggcaagggguaccacauccugaccucccaccagacgcugaccauccagggcgagagcgacuucucccucuuccugcacccggacggcccccccaagccccagcagcugccggagagccccucccaggcccccccgcccgaggacaccgaggaggagcggggggugaccacggacagccccgucuccgaggagcgcagcgugcagcagucccaccccaccgcgaccaccacgccggcccggcccuaccccgagcucaucagccgccccuccccgcccaccaugcggugguuccugcccgaccugcccccgagccgcuccgccguggagaucgcccccacccaggucaccgagacggacgagugccggcucaaccagaacaucugcggccacggggagugcgugcccggccccccggacuacagcugccacugcaaccccggguaccgcagccacccccagcaccgguacugcguggacgucaacgagugcgaggccgagcccugcggcccgggccgcgggaucugcaugaacaccggcggguccuacaacugccacugcaaccggggcuaccgccugcacgugggcgcggggggccggagcugcguggaccugaacgagugcgccaagccccaccugugcggggacggcggguucugcaucaacuuccccggccacuacaagugcaacugcuaccccggcuaccgccucaaggccucccggccgcccgucugcgaggacaucgacgagugccgcgaccccagcuccugccccgacgggaagugcgagaacaagccgggcagcuucaagugcaucgccugccagcccggguaccggucccagggcgggggcgccugccgcgacgugaacgagugcgcggagggcagccccugcuccccgggguggugcgagaaccugcccggcagcuuccgcugcaccugcgcccagggguacgcccccgcccccgacggccgguccugccuggacguggacgagugcgaggcgggggacgucugcgacaacggcaucugcagcaacaccccgggcuccuuccagugccagugccucagcggguaccaccugucccgcgaccggagccacugcgaggacaucgacgagugcgacuuccccgccgccugcaucggcggggacugcaucaacacgaacggcuccuaccgcugccugugcccccagggccaccggcucguggggggccgcaagugccaggacaucgacgagugcagccaggaccccagccugugccugccgcacggggccugcaagaaccuccagggcuccuacgugugcgucugcgacgagggguucacccccacccaggaccagcacggcugcgaggagguggagcagccccaccacaagaaggagugcuaccugaacuucgacgacaccguguucugcgacagcguccuggccaccaacgugacgcagcaggagugcugcugcucccucggcgcgggguggggcgaccacugcgagaucuaccccugcccgguguacagcuccgccgaguuccacagccugugccccgacgggaagggcuacacccaggacaacaacaucgucaacuacgggauccccgcccaccgggacaucgacgagugcaugcuguucggcuccgagaucugcaaggagggcaagugcgugaacacccagcccggguacgagugcuacugcaagcagggcuucuacuacgacgggaaccuccuggagugcguggacgucgacgagugccuggacgagagcaacugccgcaacggcgugugcgagaacacccgggggggcuaccgcugcgccugcacgccgcccgccgaguacucccccgcgcagcggcagugccucagccccgaggagauggacguggacgagugccaggacccggccgccugccgccccggccggugcgucaaccugcccggguccuaccgcugcgagugccggcccccgugggugcccggccccagcgggcgcgacugccagcugcccgaguccccggccgagcgggcccccgagcgccgggacgugugcuggagccagcgcggcgaggacgggaugugcgcgggcccccucgccggcccggcccugaccuucgacgacugcugcugccggcaggggcgcggcuggggggcccagugccgccccugccccccccggggcgcgggcucccacugcccgaccagccaguccgagagcaacuccuucugggacaccagcccccugcuccuggggaagcccccccgcgacgaggacagcuccgaggaggacagcgacgagugccggugcgucuccggccgcugcgugccgcggcccgggggcgccgugugcgagugccccgggggcuuccagcuggacgccagccgcgcccggugcgucgacaucgacgagugccgcgagcucaaccagcggggccugcugugcaaguccgagcgcugcgugaacacgagcggguccuuccggugcgugugcaaggccggcuucgcgcgcagccggccccacggggccugcgucccgcagcgccggcgcuga

SEQ ID NO: 32517 - RNA, 4875 nt, Artificial Sequence
  derived and/or modified sequence opt1 from LTBP4__Homo_sapiens__NP_001036009
augccccgccccggcaccuccgggcggcgcccccugcuccuggugcugcuccugccccuguucgccgccgccaccuccgccgccagccccucccccucccccucccaggucguggaggugcccggcguccccagccggcccgccuccguggccgugugccgcugcugccccgggcagaccagccggcgcucccggugcauccgcgccuucugccggguccgcagcugccagcccaagaagugcgccggcccccagcggugccucaaccccgugcccgccgugcccucccccagccccuccguccgcaagcgccaggugagccugaacuggcagccccugacccuccaggaggcccgcgcccugcugaagcggcgccggccccgcgggcccggcggccgggggcuccugcgccggcgcccgccccagcgcgcccccgccggcaaggcccccgugcugugcccccucaucugccacaacgggggcgucugcgugaagcccgaccggugccugugcccgcccgacuucgccgggaaguucugccagcugcacuccagcggcgcgcgcccgcccgcccccgccgugccgggccucacccgguccgucuacaccaugccccuggccaaccaccgcgacgacgagcacgggguggccagcaugguguccguccacguggagcacccccaggaggccagcguggucgugcaccagguggagcgggucagcggccccugggaggaggccgacgccgaggccguggcccgcgcggaggccgccgcccgggccgaggcggccgccccguacaccguccuggcccaguccgcgccccgcgaggacggguacagcgacgccuccggcuucggcuacugcuuccgggagcuccgcgggggcgagugcgccagcccccugcccgggcugcggacccaggaggugugcugccgcggcgccgggcucgccuggggcgugcacgacugccagcugugcuccgagcggcugggcaacagcgagcgcgucuccgcgccggacgggcccugccccaccggcuucgagcgggugaacgggagcugcgaggacguggacgagugcgccaccggcgggcgcugccagcacggcgagugcgccaacacccggggcggguacacgugcgucugccccgacggcuuccuccuggacuccagccgcuccagcugcaucucccagcacgugaucagcgaggccaaggggccgugcuuccgggugcugcgcgacggcgggugcucccuccccauccugcgcaacaucaccaagcagaucugcugcugcagccgggucggcaaggccuggggccgcgggugccagcugugcccgcccuucggcuccgagggguuccgggagaucugcccggcgggccccggcuaccacuacagcgccuccgaccuccgcuacaacacccggccccuggggcaggagcccccgcgcgugagccugagccagccccggacccuccccgccaccucccgccccagcgccggcuuccugccgacccaccggcuggagccccgccccgagccgcggcccgacccccgccccgggccggagcucccccugcccuccauccccgccuggaccggcccggagauccccgagagcgggcccuccagcggcaugugccagcggaacccccaggugugcggcccggggcgcugcaucucccggcccagcggcuacacgugcgcgugcgacuccggguuccgccugagcccccagggcacccggugcaucgacgucgacgagugccgccgggugcccccgcccugcgcccccgggcgcugcgagaacucccccggcagcuuccggugcgugugcggcccgggguuccgcgccggcccccgcgccgcggagugccucgacgucgacgagugccaccgggugccgccgcccugcgaccuggggcgcugcgagaacacccccggcuccuuccugugcgugugccccgccggguaccaggccgcgccccacggcgccagcugccaggacgucgacgagugcacccagucccccggccucugcgggcggggcgcgugcaagaaccugcccgggagcuuccgcugcgugugccccgccggcuuccggggguccgccugcgaggaggacguggacgagugcgcccaggagccgccgcccugcggccccggccgcugcgacaacacggccgggagcuuccacugcgcgugcccggccggcuuccggagccgcgggcccggcgcccccugccaggacgucgacgagugcgcccggagcccgccgcccugcaccuacggccgcugcgagaacaccgaggggagcuuccagugcgugugccccaugggcuuccagcccaacaccgccggguccgagugcgaggacguggacgagugcgagaaccaccuggcgugccccggccaggagugcgucaacagccccggguccuuccagugccggacgugccccagcggccaccaccuccaccgcggccggugcaccgacguggacgagugcuccagcggggcgccgcccugcggcccccacgggcacugcaccaacaccgagggcuccuuccgcugcagcugcgcccccggguaccgggcccccuccggccgccccggccccugcgcggacgugaacgagugccuggagggggacuucugcuucccccacggcgagugccugaacacggacgggagcuucgccugcacgugcgcccccggcuaccggcccgggccccgcggcgccuccugccuggacgucgacgagugcagcgaggaggaccucugccaguccggcaucugcaccaacaccgacgggagcuucgagugcaucugcccgcccggccaccgggccgggccggaccuggcguccugccuggacguggacgagugccgcgagcgcggccccgcccucugcggcagccagcggugcgagaacucccccgggagcuaccgcugcgugcgggacugcgacccgggcuaccacgccgggcccgagggcacgugcgacgacgucgacgagugccaggaguacgggcccgagaucugcggcgcccagcgcugcgagaacacccccggcagcuaccggugcaccccggccugcgaccccggguaccagcccacccccggcgggggcugccaggacguggacgagugccgcaaccgguccuucugcggggcgcacgccgugugccagaaccugccgggcagcuuccagugccugugcgaccagggcuacgagggggcccgcgacggccggcacugcgucgacgugaacgagugcgagacgcuccagggggugugcggcgccgcccugugcgagaacgucgagggguccuuccugugcgugugccccaacagccccgaggaguucgaccccaugaccggccgcugcgugccgccccggaccuccgcgggcaccuuccccgggagccagccccaggccccggccucccccguccuccccgcccggcccccgcccccgccccugccgcggcgccccagcacgccccggcagggcccggugggguccggccgccgggagugcuacuucgacacggccgcgcccgacgccugcgacaacauccuggcccgcaacgugaccuggcaggagugcugcugcaccgucggggagggcuggggcagcgggugccggauccagcagugccccggcaccgagacggccgaguaccagucccucugcccccacgggcgcggcuaccuggcgccgagcggcgaccugucccuccggcgcgacguggacgagugccagcuguuccgcgaccaggugugcaagagcggggucugcgugaacaccgcccccggcuacuccugcuacugcagcaacggguacuacuaccacacccagcggcuggagugcaucgacaacgacgagugcgccgacgaggagcccgccugcgagggcgggcgcugcgugaacaccgucggcuccuaccacugcacgugcgagcccccgcucgugcuggacggcagccagcggcgcugcguguccaacgagagccagagccuggacgacaaccucggggucugcuggcaggaggugggcgccgaccuggucugcucccacccccggcuggaccgccaggcgaccuacaccgagugcugcugccucuacggggaggccuggggcauggacugcgcccugugccccgcccaggacagcgacgacuucgaggcccugugcaacgugcuccggcccccggcguacagcccgccccgccccgggggcuucggccugccguacgaguacgggcccgaccuggggccgcccuaccaggggcucccguacggccccgagcuguacccgccgcccgcccugcccuacgaccccuacccgccgccgcccgggcccuucgcccggcgcgaggcccccuacggcgcgccccgguucgacaugcccgacuucgaggacgacggcgggcccuacggcgagagcgaggcgcccgcgccgcccgggcccggcacccgcuggcccuaccggucccgcgacacgcggcgcagcuuccccgagcccgaggagccgcccgagggcggcuccuacgccggcagccucgccgagcccuacgaggagcuggaggcggaggagugcgggauccuggacggcugcaccaacgggcggugcgugcgcguccccgagggcuucacgugccggugcuucgacggcuaccgccucgacaugacccgcauggccugcguggacaucaacgagugcgacgaggccgaggccgccuccccgcugugcgugaacgcgcggugccugaacacggacgggagcuuccgcugcaucugccggcccggcuucgcccccacccaccagccccaccacugcgccccggcccgcccccgggccuga

SEQ ID NO: 32518 - RNA, 1251 nt, Artificial Sequence
  derived and/or modified sequence opt1 from LTBR__Homo_sapiens__NP_001257916
auggaggccaccggcaucagccuggccucccagcucaaggugcccccguacgcgagcgagaaccagaccugccgcgaccaggagaaggaguacuacgagccccagcaccggaucugcugcucccgcugcccgcccgggacguacgucagcgccaagugcucccggauccgcgacaccgugugcgcgaccugcgccgagaacagcuacaacgagcacuggaacuaccugaccaucugccagcugugccggcccugcgaccccgugaugggccucgaggagaucgcccccugcacguccaagcgcaagacccagugccggugccagcccgggauguucugcgccgccugggcccuggagugcacccacugcgagcugcucagcgacugcccgcccggcaccgaggccgagcugaaggacgaggucgggaagggcaacaaccacugcgugcccugcaaggcgggccacuuccagaacacguccagccccuccgcccgcugccagccgcacacccggugcgagaaccaggggcugguggaggccgcccccggcaccgcccagagcgacaccacgugcaagaacccccucgagccccugccgcccgagauguccgggaccaugcugaugcucgcgguccugcugccccucgccuucuuccugcugcucgccaccguguucagcugcaucuggaagucccaccccagccugugccgcaagcugggcucccuccugaagcggcgcccgcagggggagggccccaaccccguggccggcagcugggagcccccgaaggcccaccccuacuuccccgaccugguccagccccuccugccgaucuccggggacgugagccccgugagcaccggccugcccgcggccccgguccucgaggccggggugccccagcagcagagcccccuggaccugacgcgggagccccagcucgagccgggcgagcagucccagguggcccacggcaccaacgggauccacgucaccggcggguccaugaccaucacgggcaacaucuacaucuacaacgggcccgugcugggcggcccgcccgggcccggcgaccugcccgccacccccgagcccccguaccccauccccgaggagggggaccccggcccgcccgggcucagcacgccccaccaggaggacggcaaggcguggcaccuggccgagaccgagcacugcggcgccacccccuccaaccgcgggccgcggaaccaguucaucacccacgacuga

SEQ ID NO: 32519 - RNA, 453 nt, Artificial Sequence
  derived and/or modified sequence opt1 from LTC4S__Homo_sapiens__NP_665874
augaaggacgagguggcccugcucgccgcggucacccugcugggcgugcuccugcaggccuacuucagccuccaggugaucuccgcccgccgggccuuccgcgucagcccgccccugaccacggggccgcccgaguucgagcggguguaccgcgcccaggugaacugcuccgaguacuucccccuguuccuggcgacccucugggucgccggcaucuucuuccacgagggggccgccgcgcugugcggccugguguaccucuucgcccggcugcgcuacuuccagggguacgcccggagcgcccagcugcgccucgcgccccuguacgccuccgcccgggcccuguggcuccugguggcccuggccgcgcucggccugcuggcccacuuccuccccgccgcccugcgcgccgcgcugcucggccggcugcgcacccugcuccccugggccuga

SEQ ID NO: 32520 - RNA, 2001 nt, Artificial Sequence
  derived and/or modified sequence opt1 from LTF__Homo_sapiens__NP_001186078
augcgcaaggugcgggggcccccggucagcugcaucaagcgcgacucccccauccagugcauccaggccaucgccgagaaccgggcggacgccgugacccuggacgggggcuucaucuacgaggccgggcucgcccccuacaagcugcgccccguggccgcggaggucuacggcaccgagcggcagccgcgcacgcacuacuacgccguggccguggucaagaagggcggcagcuuccagcugaacgagcuccagggccugaaguccugccacaccgggcugcggcgcaccgccggcuggaacgugcccaucgggacccuccggcccuuccugaacuggacggggcccccggagcccaucgaggcggccguggcccgcuucuucagcgccuccugcguccccggcgccgacaagggccaguuccccaaccugugccggcucugcgcgggcaccggggagaacaagugcgccuucagcucccaggagccguacuucagcuacuccggcgccuucaagugccugcgcgacggggccggcgacguggccuucauccgggagagcaccguguucgaggaccuguccgacgaggcggagcgcgacgaguacgagcuccugugccccgacaacacccggaagcccgucgacaaguucaaggacugccaccuggcccgcgugcccagccacgccguggucgcccgguccgugaacggcaaggaggacgccaucuggaaccuccugcgccaggcgcaggagaaguucgggaaggacaagagcccgaaguuccagcuguucggcucccccagcgggcagaaggaccuccuguucaaggacuccgccaucggcuucagccgggugccgccccgcaucgacuccgggcuguaccucggcagcggcuacuucacggccauccagaaccugcgcaagagcgaggaggaggucgccgcccggcgcgcgcgggugguguggugcgccgucggggagcaggagcugcgcaagugcaaccagugguccggccucagcgagggguccgugaccugcagcuccgccagcaccaccgaggacugcaucgcccuggugcugaagggcgaggcggacgccaugucccucgacgggggcuacgucuacacggccggcaagugcgggcuggugcccguccuggccgagaacuacaagagccagcaguccagcgaccccgaccccaacugcguggaccggcccguggagggcuaccucgccgucgcgguggugcgccgguccgacaccagccugaccuggaacuccgucaaggggaagaaguccugccacaccgccguggaccgcacggccggcuggaacaucccgauggggcuccuguucaaccagaccggcuccugcaaguucgacgaguacuucagccaguccugcgcccccggcagcgacccccgguccaaccugugcgcccugugcaucggggacgagcagggcgagaacaagugcgugcccaacagcaacgagcgcuacuacggguacaccggcgcguuccggugccucgccgagaacgccggcgacgucgccuucgugaaggacgugaccguccugcagaacacggacgggaacaacaacgaggccugggcgaaggaccugaagcucgccgacuucgcccugcugugccucgacggcaagcgcaagccggugaccgaggcccggagcugccaccuggcgauggcccccaaccacgccguggucucccgcauggacaagguggagcggcugaagcagguccuccugcaccagcaggccaaguucgggcgcaacggcagcgacugccccgacaaguucugccuguuccaguccgagaccaagaaccuccuguucaacgacaacaccgagugccuggcccggcugcacgggaagacgaccuacgagaaguaccucggcccgcaguacguggcgggcaucaccaaccugaagaagugcagcaccagcccccugcucgaggccugcgaguuccugcgcaaguga

SEQ ID NO: 32521 - RNA, 2205 nt, Artificial Sequence
  derived and/or modified sequence opt1 from LTK__Homo_sapiens__NP_001129157
augggcugcugggggcagcugcucgugugguucggcgccgccggggcgauccugugcagcucccccggcagccaggagaccuuccugcgcuccagcccgcucccccuggccucccccagcccccgggacccgaaggucuccgccccgcccagcauccuggagcccgccagcccccucaacucccccgggaccgagggcuccuggcuguucagcacgugcggcgccuccgggcgccacggccccacccagacccagugcgacggggcguacgccggcaccagcgugguggucacggugggggccgccggccagcugcggggcgugcagcucuggcgcguccccgggccgggccaguaccugaucuccgcguacggggccgccggcggcaagggggccaagaaccaccugagccgggcccacggcguguucguguccgcgaucuucagccucgggcugggcgagucccuguacauccucgucgggcagcagggcgaggacgccugccccggcgggagccccgagagccagcuggugugccugggcgagucccgcgccguggaggagcacgccgccauggacgggagcgagggcguccccgggucccggcgcugggcgggcggcgggggcgggggcgggggcgccaccuacguguuccgggugcgcgccggcgagcucgagccgcugcuggucgccgccgggggcgggggccgggcguaccuccgcccccgggaccgcggccggacccaggccagccccgagaagcuggagaaccgcuccgaggcccccgggagcggcgggcggggcggggccgccggcggcgacgcguccgagaccgacaaccugugggccgacggggaggacggcgugagcuucauccacccguccagcgagcuguuccugcagccccuggccgugacggagaaccacggggaggucgagauccgccggcaccucaacugcucccacugcccccugcgcgacugccaguggcaggccgagcugcagcucgcggagugccugugccccgagggcauggagcuggccguggacaacgugaccugcauggaccuccacaagccgcccgggccccugguccugaugguggccguggucgccaccagcacccucucccugcugauggugugcggcguccucauccugggcggggccuggcccggcccggugcuggcgagcgccacgcggugccaccgcggguuccccucccagugcuacagcgcccagacccuccccgagcugugcuccccgcaggacgagcuggacuuccucauggaggcccugaucaucagcaaguuccgccaccagaacaucgugcggugcgucggccugucccuccgcgccacgccccggcugauccugcuggagcucaugagcgggggcgacaugaaguccuuccugcgccacucccggccccaccugggccagcccagcccgcucgugaugcgcgaccugcugcagcucgcgcaggacaucgcccaggggugccacuaccuggaggagaaccacuucauccaccgggacaucgccgcccgcaacugccugcucuccugcgccggccccagccggguggcgaagaucggggacuucggcauggcccgcgacaucuaccgggccuccuacuaccgccgcggggaccgggcccugcugcccgucaaguggaugcccccggaggcguuccucgagggcaucuucaccagcaagaccgacuccuggagcuucggcgugcugcugugggagaucuucucccucggguacaugcccuaccccggccggaccaaccaggaggugcuggacuucgucgucgggggcggccgcauggacccgccccgggggugccccggccccguguaccgcaucaugacccagugcuggcagcacgagcccgagcugcggccgagcuucgccuccauccucgagcgccugcaguacugcacccaggaccccgacgugcugaacagccuccugcccauggagcuggggcccacgccggaggaggagggcaccuccgggcucggcaaccgcagccuggagugccugcggccgccccagccccaggagcucucccccgagaagcucaagagcuggggcgggagcccccugggccccuggcucagcagcgggcugaagccgcugaagucccgcggccuccagccccagaaccuguggaaccccaccuaccggagcuga

SEQ ID NO: 32522 - RNA, 1299 nt, Artificial Sequence
  derived and/or modified sequence opt1 from LUC7L3__Homo_sapiens__NP_057508
augaucagcgccgcccagcugcucgacgagcugaugggccgcgaccggaaccuggcgcccgacgagaagcgcuccaacgugcggugggaccacgagagcgucugcaaguacuaccucugcggguucugcccggccgagcuguucaccaacacccgcuccgaccugggccccugcgagaagauccacgacgagaaccuccggaagcaguacgagaaguccagccgcuucaugaaggugggguacgagcgggacuuccugcgcuaccugcagagccuccuggccgagguggagcggcgcauccggcgcggccacgcccggcuggcccucucccagaaccagcagagcuccggggcggccggccccacgggcaagaacgaggagaagauccagguccugaccgacaagaucgacgugcugcuccagcagaucgaggagcuggggagcgagggcaagguggaggaggcccaggggaugaugaagcuggucgagcagcucaaggaggagcgcgagcugcugcgguccaccaccagcacgaucgaguccuucgccgcgcaggagaagcagauggaggugugcgaggugugcggcgccuuccucaucgucggggacgcccagagccgcguggacgaccaccugaugggcaagcagcacaugggcuacgccaagaucaaggccaccguggaggagcugaaggagaagcuccggaagcgcaccgaggagcccgaccgggacgagcgccugaagaaggagaagcaggagcgggaggagcgcgagaaggagcgcgagcgggagcgcgaggagcgggagcgcaagcggcgccgggaggaggaggagcgcgagaaggagcgggcgcgcgaccgggagcgccggaagcgcucccggagccgcucccggcacagcucccgcaccagcgaccggcgcugcagccgcucccgggaccacaagcgcagccggucccgcgagcggcgccggagccgcucccgggaccgccggcgcagccggucccacgaccgcagcgagcggaagcaccgcucccggagccgcgaccggcgccgguccaagagccgcgaccgcaaguccuacaagcaccggagcaagucccgcgaccgggagcaggaccgcaagagcaaggagaaggagaagcggggguccgacgacaagaaguccagcgucaagagcggcagccgcgagaagcaguccgaggacacgaacaccgagagcaaggaguccgacaccaagaacgaggugaacgggaccagcgaggacaucaaguccgagggcgacacgcagagcaacuga

SEQ ID NO: 32523 - RNA, 978 nt, Artificial Sequence
  derived and/or modified sequence opt1 from LUC7L__Homo_sapiens__NP_060502
augagcgcccaggcccagaugcgcgcgcugcucgaccagcugaugggcaccgcccgggacggggacgagacccgccagcgggugaaguucacggacgaccgcgucugcaagucccaccuccuggacugcugcccccacgacauccuggccggcacccggauggaccugggggagugcaccaagauccacgaccucgcccugcgcgccgacuacgagaucgcgagcaaggagcgggaccuguucuucgagcucgacgccauggaccaccuggaguccuucaucgccgagugcgaccgccggaccgagcuggccaagaagcgccucgcggagacgcaggaggagaucagcgccgagguguccgccaaggccgagaaggugcacgagcugaacgaggagaucggcaagcugcucgccaaggcggagcagcugggggccgagggcaacgucgacgagagccagaagauccugauggagguggagaaggugcgggccaagaagaaggaggccgaggaggaguaccgcaacuccaugccggccagcuccuuccagcagcagaagcuccgggucugcgaggugugcagcgcguaccugggccugcacgacaacgaccgccggcucgccgaccacuucgggggcaagcugcaccugggguucauccagauccgcgagaagcucgaccagcugcggaagaccguggccgagaagcaggagaagcgcaaccaggaccggcugcgccggcgcgaggagcgcgagcgggaggagcgccucucccggcgcagcggcucccggacccgcgaccggcgccggagccgcucccgggaccgccggcgccggcgcagccgguccaccagccgcgagcggcgcaagcugucccgcagccggagccgcgaccggcaccgccggcaccgcucccggagccgcucccacagccgggggcaccgccgggccucccgcgaccggagcgccaaguacaaguga

SEQ ID NO: 32524 - RNA, 1017 nt, Artificial Sequence
  derived and/or modified sequence opt1 from LUM__Homo_sapiens__NP_002336
augagccuguccgccuucacccucuuccuggcccugaucggcgggaccagcggccaguacuacgacuacgacuucccccucuccaucuacgggcagagcuccccgaacugcgcgcccgagugcaacugccccgagagcuaccccuccgccauguacugcgacgagcugaagcucaagagcgugccgauggucccgcccggcaucaaguaccuguaccugcgcaacaaccagaucgaccacaucgacgagaaggccuucgagaacgugacggaccugcaguggcucauccuggaccacaaccugcucgagaacuccaagaucaaggggcggguguucagcaagcugaagcagcugaagaagcuccacaucaaccacaacaaccugaccgaguccgucggcccccugcccaagagccucgaggaccugcagcugacccacaacaagaucaccaagcucggcuccuucgaggggcuggugaaccugacguucauccaccuccagcacaaccgccugaaggaggacgccgugagcgccgcguucaagggccugaagucccucgaguaccuggaccugagcuucaaccagaucgcccggcuccccuccgggcugcccgucagccugcucacccuguaccuggacaacaacaagaucuccaacauccccgacgaguacuucaagcgcuucaacgcccuccaguaccugcggcugagccacaacgagcucgccgacagcggcaucccggggaacuccuucaacgugagcucccugguggagcuggaccucagcuacaacaagcugaagaacauccccaccgucaacgagaaccuggagaacuacuaccucgaggugaaccagcuggagaaguucgacaucaaguccuucugcaagauccugggcccccucagcuacuccaagaucaagcaccuccgccuggacggcaaccggaucagcgagaccucccugcccccggacauguacgagugccugcgcguggcgaacgaggucacgcugaacuga

SEQ ID NO: 32525 - RNA, 687 nt, Artificial Sequence
  derived and/or modified sequence opt1 from LURAP1L__Homo_sapiens__NP_981948
auggaggacagcccccugccggaccuccgcgacaucgagcugaagcugggccggaaggugcccgagucccucguccgcagccugcgcggggaggagcccgugccccgggagcgggaccgcgacccgugcggcggguccggcgggggcggcgggggcgggggcgggugcagcuccagcuccagcuacugcuccuucccgcccagccuguccagcuccagcuccagcucccccaccagcggcagcccccggggcucccacagcuccgcccucgagcgccuggagaccaagcugcaccuccugcggcaggagauggugaaccugcgcgccacggacguccggcucaugcgccagcugcuggugaucaacgagagcaucgaguccaucaaguggaugaucgaggagaaggcgaccaucaccagccggggguccagccucuccggcagccugugcucccugcucgagagccaguccaccagccugcgcggguccuacaacagccugcacgacggcuccgacggccucgacgggaucagcgugggcuccuaccuggacacgcuggccgacgacguccccgggcaccagacccccagcgaccucgaccaguucuccgacagcagccugaucgaggacucccaggcccugcacaagcggcccaagcucgacagcgaguacuacugcuucggcuga

SEQ ID NO: 32526 - RNA, 942 nt, Artificial Sequence
  derived and/or modified sequence opt1 from LUZP4__Homo_sapiens__NP_057467
auggccagcuuccgcaagcugacccucuccgagaaggugcccccgaaccaccccagccggaagaaggucaacuuccuggacaugucccuggacgacaucaucaucuacaaggagcucgagggcaccaacgccgaggaggagaagaacaagcgccagaaccacagcaagaaggagucccccagccggcagcaguccaaggcgcaccgccaccggcaccgccggggguacagccgcugccgguccaacagcgaggagggcaaccacgacaagaagcccucccagaagccgagcggguucaaguccggccagcacccccugaacgggcagccccugaucgagcaggagaagugcagcgacaacuacgaggcccaggccgagaagaaccagggccaguccgagggcaaccagcaccagagcgaggggaaccccgacaaguccgaggagagccagggccagccggaggagaaccaccacuccgagcgcagccggaaccaccucgagcgcagccugucccagagcgaccggucccaggggcagcugaagcgccaccacccccaguacgagcggagccacggccaguacaagcgcucccacgggcagagcgagcggucccacggccacagcgagcgcucccacggccacagcgagcggucccacgggcacagcgagcgcucccacggccacagcaagcggucccgcagccagggggaccucguggacacgcaguccgaccugaucgccacccagcgcgaccugaucgccacccagaaggaccucaucgcgacccagcgggaccugaucgccacgcagcgcgaccugaucgugacccagcgggaccucgucgccaccgagcgcgaccugaucaaccagagcggccggucccacggccagagcgagcgccaccagcgguacagcaccgggaagaacacgaucaccaccuga

SEQ ID NO: 32527 - RNA, 177 nt, Artificial Sequence
  derived and/or modified sequence opt1 from LUZP6__Homo_sapiens__NP_001122091
augaaguccgugaucagcuacgcccuguaccagguccagaccggcagccuccccguguacuccagcgugcugaccaaguccccgcugcagcuccagacggucaucuaccgccugaucgugcagauccagcaccugaacauccccagcuccagcuccacccacagcucccccuucuga

SEQ ID NO: 32528 - RNA, 2973 nt, Artificial Sequence
  derived and/or modified sequence opt1 from LVRN__Homo_sapiens__NP_776161
augggcccgcccagcuccagcggguucuacgugucccgcgccgucgcccugcuccuggcgggccugguggccgcccuccugcuggcccucgccgugcuggcggcccuguacgggcacugcgagcgggucccgcccagcgagcuccccggccugcgcgaccuggaggccgaguccagcccgccccuccggcagaagcccacccccaccccgaagcccuccagcgcccgcgagcuggcggugacgaccacccccuccaacuggcggcccccggggcccugggaccagcugcgccucccgcccuggcuggugccccugcacuacgaccucgagcuguggccccagcugcggcccgacgagcuccccgccggcagccugccguucaccggccgcgucaacaucacggugcggugcaccguggccaccucccgccugcuccugcacagccuguuccaggacugcgagcgggccgagguccgcgggccccucucccccggcaccgggaacgccacggugggccgggugcccgucgacgacgugugguucgcgcuggacaccgaguacauggugcuggagcucagcgagccgcugaagcccggguccagcuacgagcugcagcucuccuucagcggccuggucaaggaggaccugcgcgagggccucuuccugaacguguacaccgaccagggggagcggcgcgcccugcucgccucccagcuggagcccaccuucgcccgguacguguuccccugcuucgacgagccggcccugaaggcgacguucaacaucaccaugauccaccaccccagcuacgucgcccucagcaacaugcccaagcugggccaguccgagaaggaggacgugaacgggagcaaguggaccgugaccacguucuccaccaccccgcacaugcccaccuaccuggucgccuucgugaucugcgacuacgaccacgugaaccgcacggagcggggcaaggagauccgcaucugggcccggaaggacgccaucgcgaacggcagcgccgacuucgcccucaacaucaccgggcccaucuucuccuuccuggaggaccuguucaacaucagcuacucccuccccaagaccgacaucaucgcccugcccagcuucgacaaccacgccauggagaacuggggccugaugaucuucgacgaguccgggcugcuccuggagcccaaggaccagcugaccgagaagaagacgcucaucagcuacgucgugucccacgagaucggccaccagugguucgggaaccuggucaccaugaacugguggaacaacaucuggcugaacgagggcuucgcgagcuacuucgaguucgaggugaucaacuacuucaaccccaagcucccccgcaacgagaucuucuucuccaacauccugcacaacauccugcgcgaggaccacgcccucgugacccgggccgucgccaugaagguggagaacuucaagaccagcgagauccaggagcuguucgacaucuucacguacuccaagggcgcgagcauggcccgcaugcuguccugcuuccucaacgagcaccuguucgugagcgcccugaaguccuaccucaagaccuucagcuacagcaacgccgagcaggacgaccuguggcggcacuuccagauggccaucgacgaccaguccaccgucauccugccggcgaccaucaagaacaucauggacagcuggacgcaccaguccggguuccccgugaucacccucaacgugagcaccggcgucaugaagcaggagcccuucuaccuggagaacaucaagaaccgcacccugcucacguccaacgacaccuggaucgugcccauccuguggaucaagaacgggaccacccagccgcugguguggcucgaccagagcuccaaggucuuccccgagaugcaggucagcgacuccgaccacgacugggugauccugaaccugaacaugaccggcuacuaccgggugaacuacgacaagcucggguggaagaagcugaaccagcagcuggagaaggaccccaaggccauccccgugauccaccgccuccagcugaucgacgacgccuucagccuguccaagaacaacuacaucgagaucgagacggcccucgagcugaccaaguaccuggccgaggaggacgagaucaucguguggcacaccguccucgugaaccuggugacccgggaccuggucagcgaggugaacaucuacgacaucuacucccuccugaagcgcuaccugcucaagcggcugaaccugaucuggaacaucuacagcacgaucauccgcgagaacgugcucgcgcugcaggacgacuaccuggcccucaucucccuggagaagcuguucgucaccgccugcuggcucggccuggaggacugccugcagcucagcaaggagcuguucgccaaguggguggaccacccggagaacgagauccccuaccccaucaaggacgugguccugugcuacggcaucgcccucggguccgacaaggagugggacauccugcugaacaccuacaccaacacgaccaacaaggaggagaagauccagcucgcguacgccaugagcugcagcaaggaccccuggauccugaaccgguacauggaguacgccaucuccaccagcccguucaccuccaacgagacgaacaucaucgaggugguggccagcuccgaggucggccgcuacguggcgaaggacuuccuggugaacaacuggcaggccgucagcaagcgguacgggacccagucccucaucaaccugaucuacaccaucggccgcaccgugacgaccgaccugcagaucguggagcuccagcaguucuucagcaacaugcuggaggagcaccagcggauccgcguccacgccaaccugcagaccaucaagaacgagaaccucaagaacaagaagcuguccgcccggaucgccgcguggcugcgccggaacaccuga

SEQ ID NO: 32529 - RNA, 669 nt, Artificial Sequence
  derived and/or modified sequence opt1 from LXN__Homo_sapiens__NP_064554
auggagaucccgcccaccaacuaccccgccagccgcgccgcgcugguggcccagaacuacaucaacuaccagcagggcacgccccaccggguguucgaggugcagaaggugaagcaggccuccauggaggacauccccgggcgcggccacaaguaccaccucaaguucgccgucgaggagaucauccagaagcaggucaaggugaacugcaccgccgaggugcuguacccgagcaccgggcaggagaccgcgcccgaggugaacuucaccuucgagggcgagacggggaagaaccccgacgaggaggacaacaccuucuaccagcggcugaaguccaugaaggagccccucgaggcccagaacaucccggacaacuucggcaacgugagccccgagaugacccugguccugcaccucgccuggguggccugcggcuacaucaucuggcagaacuccaccgaggacacgugguacaagauggugaagauccagaccgucaagcagguccagcgcaacgacgacuucaucgagcuggacuacaccauccugcuccacaacaucgcgagccaggagaucauccccuggcagaugcagguccuguggcacccccaguacgggaccaaggugaagcacaacucccggcugccgaaggaggugcagcucgaguga

SEQ ID NO: 32530 - RNA, 387 nt, Artificial Sequence
  derived and/or modified sequence opt1 from LY6D__Homo_sapiens__NP_003686
augcgcaccgcccugcuccugcuggccgcgcucgccguggccaccggccccgcccugacgcugcggugccacgucugcaccagcuccagcaacugcaagcacuccguggugugcccggccagcucccgcuucugcaagaccaccaacacggucgagccccuccgggggaaccuggugaagaaggacugcgcggagagcugcacccccuccuacacccugcagggccaggugagcuccgggaccagcuccacgcagugcugccaggaggaccucugcaacgagaagcugcacaacgccgcccccacccgcaccgcccuggcgcacagcgcccucucccugggccuggcccucagccugcuggccgucauccucgccccgucccuguga

SEQ ID NO: 32531 - RNA, 396 nt, Artificial Sequence
  derived and/or modified sequence opt1 from LY6E__Homo_sapiens__NP_001120685
augaagaucuuccugcccgugcuccuggccgcccugcucggcgucgagcgcgcgagcucccugaugugcuucagcugccugaaccagaaguccaaccucuacugccugaagccgaccaucugcagcgaccaggacaacuacugcgugaccguguccgccagcgccgggaucggcaaccuggucacguucgggcacucccucagcaagaccugcucccccgccugccccauccccgagggcgugaacgugggggucgccagcaugggcaucuccugcugccagagcuuccugugcaacuucuccgcggccgacggcgggcugcgggccagcgugacccuccugggcgccgggcugcuccugucccugcucccggcgcugcugcgcuucggccccuga

SEQ ID NO: 32532 - RNA, 606 nt, Artificial Sequence
  derived and/or modified sequence opt1 from LY6G5B__Homo_sapiens__NP_067044
augaaggugcacaugcuggucggcgugcucgugauggucggguucaccgugggcaaggugcccgucccggacauccggaccugccacuucugccugguggaggaccccagcguggggugcaucuccggcagcgagaagugcacgaucuccagcuccagccugugcauggucaucaccaucuacuacgacgugaaggugcgcuucaucguccgcgggugcggccaguacaucuccuaccggugccaggagaagcgcaacaccuacuucgccgaguacugguaccaggcccagugcugccaguacgacuacugcaacagcugguccagcccccagcuccaguccagccugcccgagccgcacgaccggccccuggcgcucccccuguccgacagccagauccagugguucuaccaggcccugaaccucucccugccccugccgaacuuccacgccggcaccgagcccgacgggcucgaccccauggugacgcugagccugaaccucggccuguccuucgccgagcugcgccggauguaccucuuccugaacagcuccgggcugcucgugcugccccaggccggccugcucaccccgcaccccagcuga

SEQ ID NO: 32533 - RNA, 453 nt, Artificial Sequence
  derived and/or modified sequence opt1 from LY6G5C__Homo_sapiens__NP_079538
augcgcuucauggccggccccgccgggagccagucccugggcccgcucugcuuccacagcagcccccaggcgcuguacaccgugcugcucaucguccuggugaugaugucccugguguucgggaaguucguccccgugaacugggagcccccgcagccccuccccuuccccaaguaccugcggugcuaccgcugccugcucgagaccaaggagcugggcugccugcucggguccgacaucugccugacgccggccggcagcuccugcaucacccugcacaagaagaacagcuccggcagcgacgugauggucuccgacugccggagcaaggagcagauguccgacugcagcaacacccgcaccucccccgugagcggguucuggaucuucucccaguacugcuuccucgacuucugcaacgacccccagaaccggggccuguacacgcccuga

SEQ ID NO: 32534 - RNA, 378 nt, Artificial Sequence
  derived and/or modified sequence opt1 from LY6G6C__Homo_sapiens__NP_079537
augaaggcccugaugcuccugacccugagcgugcuccugugcugggucuccgccgacauccgcugccacagcugcuacaaggugcccgugcugggcugcgucgaccggcaguccugccgccucgagccggggcagcagugccugaccacgcacgcguaccugggcaagauguggguguucagcaaccuccggugcgggacccccgaggagcccugccaggaggccuucaaccagaccaaccgcaagcugggccugaccuacaacacgaccugcugcaacaaggacaacugcaacuccgccgggccccggccgacccccgcccucggccugguguuccugaccagccucgccggccuggggcuguggcuccugcacuga

SEQ ID NO: 32535 - RNA, 894 nt, Artificial Sequence
  derived and/or modified sequence opt1 from LY6G6F__Homo_sapiens__NP_001003693
auggccgugcuguuccuccugcuguuccucugcggcacgccccaggccgcggacaacaugcaggccaucuacgucgcccugggggaggccguggagcugcccugccccagcccgcccacccuccacggcgacgagcaccuguccugguucugcagccccgccgcgggguccuucaccacccugguggcccagguccaggugggccgccccgcccccgaccccgggaagccgggccgggagagccgccuccggcugcugggcaacuacucccucuggcuggaggggagcaaggaggaggacgccggccgcuacuggugcgcggugcuggggcagcaccacaacuaccagaacuggcgggucuacgacgugcucgugcugaagggcucccagcugagcgcccgcgccgccgacgggucccccugcaacguccuccugugcagcguggugcccucccggcgcauggacagcgucaccuggcaggagggcaagggccccgugcgggggcgcgugcaguccuucuggggcagcgaggccgcgcugcuccuggucugcccgggggagggccuguccgagccccggagccgccggccccgcaucauccggugccucaugacccacaacaagggcguguccuucagccuggccgccuccaucgacgccagccccgcccugugcgcgccgagcacggggugggacaugcccuggauccucaugcugcugcucaccaugggccaggggguggucauccuggcccuguccaucgugcucuggcgccagcgggugcgcggcgcccccgggcgggacgccagcaucccccaguucaagccggagauccaggucuacgagaacauccaccuggcccgccugggcccgcccgcgcacaagccccgguga

SEQ ID NO: 32536 - RNA, 498 nt, Artificial Sequence
  derived and/or modified sequence opt1 from LY6K__Homo_sapiens__NP_059997
auggcccugcucgcccugcugcucguggucgcgcugccccgcguguggaccgacgccaaccugaccgcccggcagcgcgacccggaggacagccagcggacggacgagggcgacaaccgcguguggugccacgucugcgagcgggagaacaccuucgagugccagaacccccgccggugcaaguggaccgagcccuacugcgugaucgccgccgugaagaucuucccccgcuucuucauggucgcgaagcagugcuccgccgggugcgccgccauggagcggccgaagcccgaggagaagcgcuuccuccuggaggagcccaugcccuucuucuaccugaagugcugcaagauccgguacugcaaccucgagggcccgcccaucaacagcuccguguucaaggaguacgcggggagcaugggcgaguccugcgggggccuguggcuggccauccuccugcugcucgccagcaucgccgccggccugucccugagcuga

SEQ ID NO: 32537 - RNA, 5622 nt, Artificial Sequence
  derived and/or modified sequence opt1 from LY75-CD302__Homo_sapiens__NP_001185688
augcgcaccggcugggccaccccccggcgcccggccgggcugcucaugcugcuguucugguucuucgaccucgcggagcccagcggccgggccgccaacgaccccuucacgaucgugcacgggaacaccggcaagugcaucaagcccgucuacggguggaucguggccgacgacugcgacgagaccgaggacaagcuguggaagugggugucccagcaccgccuguuccaccuccacagccagaagugccugggccuggacaucaccaaguccgucaacgagcuccggauguucagcugcgacuccagcgccaugcugugguggaagugcgagcaccacucccuguacggcgcggcccgcuaccggcucgcccugaaggacgggcacggcacggccaucagcaacgcguccgacguguggaagaaggggggcagcgaggagucccugugcgaccagccguaccacgagaucuacacccgcgacgggaacagcuacggccggcccugcgaguuccccuuccucaucgacggcaccuggcaccacgacugcauccuggacgaggaccacuccgggcccuggugcgccaccacgcugaacuacgaguacgaccgcaaguggggcaucugccucaagccggagaacgggugcgaggacaacugggagaagaacgagcaguucggcagcugcuaccaguucaacacccagaccgcccuguccuggaaggaggccuacgugagcugccagaaccagggcgccgaccugcucuccaucaacagcgcggccgagcugaccuaccugaaggagaaggaggggaucgccaagaucuucuggaucggccucaaccagcuguacuccgcccgggggugggaguggagcgaccacaagccccugaacuuccucaacugggaccccgaccgccccagcgccccgacgaucggcggguccagcugcgcgcggauggacgccgaguccggccuguggcagagcuucuccugcgaggcccagcugcccuacgucugccgcaagccccucaacaacaccguggagcugaccgacguguggaccuacagcgacacgcggugcgacgccggcuggcugcccaacaacggguucugcuaccuccuggucaacgaguccaacagcugggacaaggcccacgcgaagugcaaggccuucuccagcgaccugaucuccauccacagccucgccgacguggagguggucgugaccaagcugcacaacgaggacaucaaggaggagguguggaucggccugaagaacaucaacaucccgacccucuuccagugguccgacgggaccgaggucacgcugaccuacugggacgagaacgagcccaacgugcccuacaacaagacccccaacugcgugagcuaccugggcgagcucgggcaguggaagguccaguccugcgaggagaagcugaaguacgugugcaagcgcaagggcgagaagcugaacgacgccagcuccgacaagaugugcccgcccgacgagggcuggaagcggcacggggagaccugcuacaagaucuacgaggacgaggugcccuucggcacgaacugcaaccucaccaucaccagccgcuucgagcaggaguaccugaacgaccugaugaagaaguacgacaagucccuccggaaguacuucuggaccgggcugcgcgacgucgacagcugcggcgaguacaacugggccacgguggggggccggcgccgcgcggugaccuucagcaacuggaacuuccuggagcccgccuccccgggcgggugcgucgccaugagcaccggcaaguccguggggaagugggaggucaaggacugccggagcuucaaggcccuguccaucugcaagaagaugagcggcccccucggccccgaggaggcgucccccaagccggacgaccccugccccgagggguggcagagcuucccggccucccugagcugcuacaagguguuccacgccgagcgcaucgugcggaagcgcaacugggaggaggccgagcgguucugccaggcccugggcgcgcaccucuccagcuucucccacgucgacgagaucaaggaguuccugcacuuccugaccgaccaguucagcgggcagcacuggcucuggaucggccugaacaagcgcucccccgaccugcaggggagcuggcagugguccgaccggacgcccgugagcaccaucaucaugcccaacgaguuccagcaggacuacgacauccgcgacugcgccgccgugaaggucuuccaccggccguggcgccggggcuggcacuucuacgacgaccgcgaguucaucuaccuccggcccuucgccugcgacaccaagcuggagugggugugccagauccccaagggccgcacccccaagacgccggacugguacaaccccgaccgggccgggauccacggccccccccugaucaucgaggggagcgaguacugguucguggcggaccuccaccugaacuacgaggaggccguccuguacugcgccuccaaccacagcuuccucgccaccaucaccuccuucgugggccugaaggccaucaagaacaagaucgcgaacaucagcggggacggccagaagugguggauccgcaucuccgaguggccgaucgacgaccacuucaccuacagccgguaccccuggcaccgcuuccccgugaccuucggcgaggagugccuguacauguccgccaagacguggcucaucgaccuggggaagcccaccgacugcagcaccaagcugccguucaucugcgagaaguacaacgucuccagccucgagaaguacucccccgacagcgccgccaaggugcagugcuccgagcaguggauccccuuccagaacaagugcuuccugaagaucaagcccgugagccugaccuucucccaggcgagcgacacgugccacuccuacggcgggacccucccgagcguccugucccagaucgagcaggacuucaucaccagccugcuccccgacauggaggccacccuguggaucggccugcgguggacggccuacgagaagaucaacaaguggaccgacaaccgcgagcucaccuacagcaacuuccacccccugcugguguccgggcgccuccggauccccgagaacuucuucgaggaggagagccgcuaccacugcgcccugauccugaaccuccagaaguccccguucaccggcacguggaacuucaccagcugcuccgagcggcacuucgugagccugugccagaaguacuccgaggucaagagccgccagacccugcagaacgccuccgagaccgugaaguaccucaacaaccuguacaagaucauccccaagacgcugaccuggcacagcgcgaagcgggagugccucaaguccaacaugcagcuggugagcaucaccgaccccuaccagcaggccuuccuguccguccaggcccuccugcacaacagcucccuguggaucggccucuucagccaggacgacgagcugaacuucgggugguccgacggcaagcgccugcacuucagccggugggccgagaccaacgggcagcucgaggacugcguggugcuggacacggacggcuucuggaagaccgucgacugcaacgacaaccagccgggggccaucugcuacuacuccggcaacgagaccgagaaggaggugaagcccguggacagcgucaagugccccagccccgugcugaacaccccguggauccccuuccagaacugcugcuacaacuucaucaucacgaagaaccgccacauggcgaccacccaggacgaggugcacaccaagugccagaagcucaaccccaagucccacauccugagcauccgggacgagaaggagaacaacuucguccuggagcagcuccuguacuucaacuacauggccuccugggugaugcugggcaucacguaccgcaacaagagccucaugugguucgacaagaccccccuguccuacacccacuggcgggccgggcgcccgaccaucaagaacgagaaguuccuggccggccucagcacggacggguucugggacauccagaccuucaaggugaucgaggaggccgucuacuuccaccagcacuccauccuggcgugcaagaucgagaugguggacuacaaggaggaguacaacaccacccugccccaguucaugcccuacgaggacggcaucuacagcgugauccagaagaaggucacgugguacgaggcccucaacaugugcucccagagcggcgggcaccuggccuccgugcacaaccagaacggccagcuguuccucgaggacaucgugaagcgggacggguucccccugugggucggccugagcucccacgacgggagcgaguccagcuucgagugguccgacggcagcaccuucgacuacaucccguggaagggccagaccucccccgggaacugcgugcuccuggaccccaagggcaccuggaagcacgagaagugcaacagcgugaaggacggggccaucugcuacaagcccaccaagagcaagaagcugucccgccucacguacagcucccggugcccggcggccaaggagaacggcagccgcuggauccaguacaaggggcacugcuacaaguccgaccaggcccugcacagcuucuccgaggccaagaagcugugcagcaagcacgaccacuccgccaccaucgucagcaucaaggacgaggacgagaacaaguucgugucccggcucaugcgcgagaacaacaacaucaccaugcggguguggcugggccugagccagcacuccgucgaccagagcugguccuggcucgacggcagcgaggugaccuucgugaagugggagaacaaguccaagagcggggucggccgcugcuccaugcugaucgcgagcaacgagacguggaagaagguggagugcgagcacggguucggccggguggucugcaaggugccccuggacugccccagcuccaccuggauccaguuccaggacagcugcuacaucuuccuccaggaggccaucaaggucgaguccaucgaggacgugcgcaaccagugcaccgaccacggggccgacaugaucagcauccacaacgaggaggagaacgccuucauccuggacacccugaagaagcaguggaagggccccgacgacauccuccugggcauguucuacgacacggacgacgccuccuucaagugguucgacaacagcaacaugaccuucgacaaguggaccgaccaggacgacgacgaggaccugguggacaccugcgcguuccuccacaucaagacgggggaguggaagaagggcaacugcgaggucuccagcguggaggggacccugugcaagaccgccaucccguacaagcgcaaguaccuguccgacaaccacauccucaucagcgcccuggugaucgccuccaccgucauccugacggugcugggcgccaucaucugguuccucuacaagaagcacagcgacucccgguucaccaccguguucagcaccgcgccccagucccccuacaacgaggacugcguccugguggugggcgaggagaacgaguaccccguccaguucgacuga

SEQ ID NO: 32538 - RNA, 5169 nt, Artificial Sequence
  derived and/or modified sequence opt1 from LY75__Homo_sapiens__NP_002340
augcgcaccggcugggccaccccccggcgcccggccgggcugcucaugcugcuguucugguucuucgaccucgcggagcccagcggccgggccgccaacgaccccuucacgaucgugcacgggaacaccggcaagugcaucaagcccgucuacggguggaucguggccgacgacugcgacgagaccgaggacaagcuguggaagugggugucccagcaccgccuguuccaccuccacagccagaagugccugggccuggacaucaccaaguccgucaacgagcuccggauguucagcugcgacuccagcgccaugcugugguggaagugcgagcaccacucccuguacggcgcggcccgcuaccggcucgcccugaaggacgggcacggcacggccaucagcaacgcguccgacguguggaagaaggggggcagcgaggagucccugugcgaccagccguaccacgagaucuacacccgcgacgggaacagcuacggccggcccugcgaguuccccuuccucaucgacggcaccuggcaccacgacugcauccuggacgaggaccacuccgggcccuggugcgccaccacgcugaacuacgaguacgaccgcaaguggggcaucugccucaagccggagaacgggugcgaggacaacugggagaagaacgagcaguucggcagcugcuaccaguucaacacccagaccgcccuguccuggaaggaggccuacgugagcugccagaaccagggcgccgaccugcucuccaucaacagcgcggccgagcugaccuaccugaaggagaaggaggggaucgccaagaucuucuggaucggccucaaccagcuguacuccgcccgggggugggaguggagcgaccacaagccccugaacuuccucaacugggaccccgaccgccccagcgccccgacgaucggcggguccagcugcgcgcggauggacgccgaguccggccuguggcagagcuucuccugcgaggcccagcugcccuacgucugccgcaagccccucaacaacaccguggagcugaccgacguguggaccuacagcgacacgcggugcgacgccggcuggcugcccaacaacggguucugcuaccuccuggucaacgaguccaacagcugggacaaggcccacgcgaagugcaaggccuucuccagcgaccugaucuccauccacagccucgccgacguggagguggucgugaccaagcugcacaacgaggacaucaaggaggagguguggaucggccugaagaacaucaacaucccgacccucuuccagugguccgacgggaccgaggucacgcugaccuacugggacgagaacgagcccaacgugcccuacaacaagacccccaacugcgugagcuaccugggcgagcucgggcaguggaagguccaguccugcgaggagaagcugaaguacgugugcaagcgcaagggcgagaagcugaacgacgccagcuccgacaagaugugcccgcccgacgagggcuggaagcggcacggggagaccugcuacaagaucuacgaggacgaggugcccuucggcacgaacugcaaccucaccaucaccagccgcuucgagcaggaguaccugaacgaccugaugaagaaguacgacaagucccuccggaaguacuucuggaccgggcugcgcgacgucgacagcugcggcgaguacaacugggccacgguggggggccggcgccgcgcggugaccuucagcaacuggaacuuccuggagcccgccuccccgggcgggugcgucgccaugagcaccggcaaguccguggggaagugggaggucaaggacugccggagcuucaaggcccuguccaucugcaagaagaugagcggcccccucggccccgaggaggcgucccccaagccggacgaccccugccccgagggguggcagagcuucccggccucccugagcugcuacaagguguuccacgccgagcgcaucgugcggaagcgcaacugggaggaggccgagcgguucugccaggcccugggcgcgcaccucuccagcuucucccacgucgacgagaucaaggaguuccugcacuuccugaccgaccaguucagcgggcagcacuggcucuggaucggccugaacaagcgcucccccgaccugcaggggagcuggcagugguccgaccggacgcccgugagcaccaucaucaugcccaacgaguuccagcaggacuacgacauccgcgacugcgccgccgugaaggucuuccaccggccguggcgccggggcuggcacuucuacgacgaccgcgaguucaucuaccuccggcccuucgccugcgacaccaagcuggagugggugugccagauccccaagggccgcacccccaagacgccggacugguacaaccccgaccgggccgggauccacggccccccccugaucaucgaggggagcgaguacugguucguggcggaccuccaccugaacuacgaggaggccguccuguacugcgccuccaaccacagcuuccucgccaccaucaccuccuucgugggccugaaggccaucaagaacaagaucgcgaacaucagcggggacggccagaagugguggauccgcaucuccgaguggccgaucgacgaccacuucaccuacagccgguaccccuggcaccgcuuccccgugaccuucggcgaggagugccuguacauguccgccaagacguggcucaucgaccuggggaagcccaccgacugcagcaccaagcugccguucaucugcgagaaguacaacgucuccagccucgagaaguacucccccgacagcgccgccaaggugcagugcuccgagcaguggauccccuuccagaacaagugcuuccugaagaucaagcccgugagccugaccuucucccaggcgagcgacacgugccacuccuacggcgggacccucccgagcguccugucccagaucgagcaggacuucaucaccagccugcuccccgacauggaggccacccuguggaucggccugcgguggacggccuacgagaagaucaacaaguggaccgacaaccgcgagcucaccuacagcaacuuccacccccugcugguguccgggcgccuccggauccccgagaacuucuucgaggaggagagccgcuaccacugcgcccugauccugaaccuccagaaguccccguucaccggcacguggaacuucaccagcugcuccgagcggcacuucgugagccugugccagaaguacuccgaggucaagagccgccagacccugcagaacgccuccgagaccgugaaguaccucaacaaccuguacaagaucauccccaagacgcugaccuggcacagcgcgaagcgggagugccucaaguccaacaugcagcuggugagcaucaccgaccccuaccagcaggccuuccuguccguccaggcccuccugcacaacagcucccuguggaucggccucuucagccaggacgacgagcugaacuucgggugguccgacggcaagcgccugcacuucagccggugggccgagaccaacgggcagcucgaggacugcguggugcuggacacggacggcuucuggaagaccgucgacugcaacgacaaccagccgggggccaucugcuacuacuccggcaacgagaccgagaaggaggugaagcccguggacagcgucaagugccccagccccgugcugaacaccccguggauccccuuccagaacugcugcuacaacuucaucaucacgaagaaccgccacauggcgaccacccaggacgaggugcacaccaagugccagaagcucaaccccaagucccacauccugagcauccgggacgagaaggagaacaacuucguccuggagcagcuccuguacuucaacuacauggccuccugggugaugcugggcaucacguaccgcaacaagagccucaugugguucgacaagaccccccuguccuacacccacuggcgggccgggcgcccgaccaucaagaacgagaaguuccuggccggccucagcacggacggguucugggacauccagaccuucaaggugaucgaggaggccgucuacuuccaccagcacuccauccuggcgugcaagaucgagaugguggacuacaaggaggaguacaacaccacccugccccaguucaugcccuacgaggacggcaucuacagcgugauccagaagaaggucacgugguacgaggcccucaacaugugcucccagagcggcgggcaccuggccuccgugcacaaccagaacggccagcuguuccucgaggacaucgugaagcgggacggguucccccugugggucggccugagcucccacgacgggagcgaguccagcuucgagugguccgacggcagcaccuucgacuacaucccguggaagggccagaccucccccgggaacugcgugcuccuggaccccaagggcaccuggaagcacgagaagugcaacagcgugaaggacggggccaucugcuacaagcccaccaagagcaagaagcugucccgccucacguacagcucccggugcccggcggccaaggagaacggcagccgcuggauccaguacaaggggcacugcuacaaguccgaccaggcccugcacagcuucuccgaggccaagaagcugugcagcaagcacgaccacuccgccaccaucgucagcaucaaggacgaggacgagaacaaguucgugucccggcucaugcgcgagaacaacaacaucaccaugcggguguggcugggccugagccagcacuccgucgaccagagcugguccuggcucgacggcagcgaggugaccuucgugaagugggagaacaaguccaagagcggggucggccgcugcuccaugcugaucgcgagcaacgagacguggaagaagguggagugcgagcacggguucggccggguggucugcaaggugccccuggggcccgacuacaccgccaucgccaucaucgucgccacccucagcauccuggugcugaugggcggccucaucugguuccuguuccagcgccaccgccugcaccucgccggguucuccagcgugcgguacgcgcagggcgucaacgaggacgagaucaugcugcccuccuuccacgacuga

SEQ ID NO: 32539 - RNA, 489 nt, Artificial Sequence
  derived and/or modified sequence opt1 from LY86__Homo_sapiens__NP_004262
augaagggcuucaccgccacccuguuccucuggacgcugaucuuccccagcugcuccgggggcgggggcgggaaggccuggccgacccacguggucugcagcgacuccggccuggaggugcucuaccagagcugcgacccccugcaggacuucggcuucuccguggagaagugcagcaagcagcugaaguccaacaucaacauccgcuucgggaucauccuccgggaggacaucaaggagcuguuccuggaccucgcgcugaugagccagggcuccagcguccugaacuucuccuaccccaucugcgaggccgcccuccccaaguucagcuucugcgggcgccggaagggcgagcagaucuacuacgccgggccggugaacaaccccgaguucaccaucccccagggcgaguaccaggugcugcuggagcucuacaccgagaagcgcuccacggucgccugcgcgaacgccaccaucaugugcagcuga

SEQ ID NO: 32540 - RNA, 393 nt, Artificial Sequence
  derived and/or modified sequence opt1 from LY96__Homo_sapiens__NP_001182726
augcugcccuuccucuucuucagcacccuguucuccagcaucuucaccgaggcccagaagcaguacugggugugcaacuccagcgacgccuccaucagcuacacguacugcggccgcgaccugaagcagcucuacuucaaccuguacaucaccgucaacaccaugaaccugccgaagcggaaggaggugaucugccgcggguccgacgacgacuacagcuucugccgggcgcucaagggcgagaccgugaacacgaccaucuccuucagcuucaaggggaucaaguucuccaagggcaaguacaagugcgucguggaggccaucagcgggucccccgaggagaugcuguucugccuggaguucgugauccuccaccagcccaacagcaacuga

SEQ ID NO: 32541 - RNA, 582 nt, Artificial Sequence
  derived and/or modified sequence opt1 from LY9__Homo_sapiens__NP_001028839
augguggcccccaagagccacaccgacgacugggccccgggccccuucuccagcaagccccagcgcucccagcugcagaucuucagcuccguccuccagaccagccugcuguuccuccugauggggcugcgggcguccggcaaggacagcgcccccacggugguguccgggauccucggcgggagcgucacccugccgcugaacaucuccguggacaccgagaucgagaacgugaucuggaucggccccaagaacgcccucgccuucgcccgccccaaggagaacgucaccaucauggucaagagcuaccugggccggcuggacaucacgaagugguccuacagccucugcaucuccaaccugacccugaacgacgcggggagcuacaaggcccagaucaaccagcgcaacuucgaggugaccaccgaggaggaguucacccucuucguguacgcccccuucaucgagaagcuguccgugcacgugaucgagggcgaccaccggacgcugcucgaggggagcggccuggaguccaucaucagcacccuggccgagccgcgcgucagcgugcgggagggguga

SEQ ID NO: 32542 - RNA, 1056 nt, Artificial Sequence
  derived and/or modified sequence opt1 from LYL1__Homo_sapiens__XP_006722815
augaccggccuggacugggccguggggagcgucuucggcgggcucggcuccgccuucgaggugaucgugagcgucguggggucccagggcugcuacggcgggugccugcagugggaguggggcagccugaagcagcucugguccaccuuccgcgacagcaacgggaagaaccggcgcgugauccuggaggucuccacgcccaccagcggcuccaugugcccgccccaggcgcaggccgagguggggcccaccaugaccgagaaggccgagauggugugcgcccccagcccggcccccgcgcccccgcccaagcccgccucccccgggcccccgcaggucgaggaggugggccaccgcggcggcagcuccccgccccggcugcccccgggggugcccgucaucagccucggccacucccggccgcccggcguggccaugcccacgaccgagcuggggacccugcgcccgccccuccugcagcugagcacccucggcacggccccgcccacccuggcgcugcacuaccacccccaccccuuccucaacuccguguacaucgggcccgccggccccuucagcaucuuccccuccagccggcugaagcgccggcccagccacugcgagcuggaccucgccgaggggcaccagccccagaaggucgcccgccggguguucaccaacucccgcgagcgguggcgccagcagaacgugaacggcgccuucgcggagcugcggaagcugcuccccacccacccgcccgaccgcaagcugagcaagaacgagguccugcggcucgccaugaaguacaucggcuuccuggugcgccugcuccgggaccaggccgccgcccuggcggccgggcccacgccgcccggcccccgcaagcggcccgugcaccgcguccccgacgacggggcccgccggggcuccgggcgccgggccgaggccgcggcccgcagccagcccgcgcccccggccgaccccgacggcucccccggcggggccgcccggcccaucaagauggagcagaccgcccugagcccggaggugcgcuga

SEQ ID NO: 32543 - RNA, 1476 nt, Artificial Sequence
  derived and/or modified sequence opt1 from LYN__Homo_sapiens__NP_001104567
augggcugcaucaagagcaaggggaaggacucccugagcgacgacggcguggaccucaagacccagcccgucccggagucccagcugcugcccgggcagcgcuuccagaccaaggaccccgaggagcagggcgacaucgugguggcccucuaccccuacgacgggauccacccggacgaccugagcuucaagaagggcgagaagaugaagguccuggaggagcacggcgagugguggaaggccaagucccuccugacgaagaaggagggguucauccccagcaacuacguggcgaagcugaacacccucgagaccgaggagugguucuucaaggacaucacccggaaggacgccgagcgccagcugcuggcccccggcaacuccgccggggccuuccucauccgggagagcgagacgcugaagggcuccuucagccuguccgugcgcgacuucgaccccguccacggggacgugaucaagcacuacaagauccggagccucgacaacggcggcuacuacaucuccccgcgcaucaccuuccccugcaucagcgacaugaucaagcacuaccagaagcaggcggacgggcugugccggcgccuggagaaggccugcaucucccccaagccccagaagccgugggacaaggacgccugggagaucccccgggagagcaucaagcucgugaagcgccugggcgccgggcaguucggcgaggucuggaugggcuacuacaacaacuccaccaagguggcggugaagacccugaagcccgggacgaugagcguccaggccuuccucgaggaggccaaccugaugaagacccugcagcacgacaagcucgugcggcuguacgccguggucacccgcgaggagcccaucuacaucaucaccgaguacauggccaagggcucccugcucgacuuccucaagagcgacgagggcgggaaggugcugcugccgaagcugaucgacuucagcgcgcagaucgccgaggggauggccuacaucgagcggaagaacuacauccaccgcgaccugcgggccgccaacgugcucgucuccgagagccugaugugcaagaucgcggacuucggccuggcccgcgugaucgaggacaacgaguacacggcccgggagggcgccaaguuccccaucaaguggaccgcccccgaggcgaucaacuucgggugcuucaccaucaaguccgacguguggagcuucggcauccuccuguacgagaucgucaccuacgggaagauccccuacccgggccgcacgaacgccgacgugaugaccgcccugucccagggguaccggaugccccgcguggagaacugccccgacgagcucuacgacaucaugaagaugugcuggaaggagaaggccgaggagcggcccaccuucgacuaccugcagagcguccuggacgacuucuacaccgccacggagggccaguaccagcagcagccguga

SEQ ID NO: 32544 - RNA, 294 nt, Artificial Sequence
  derived and/or modified sequence opt1 from LYNX1__Homo_sapiens__NP_803253
augcagcugggcaccgggcuccugcuggccgccgugcucagccugcagcuggcggccgccgaggccaucuggugccaccagugcaccggcuucgggggcugcucccacgggagccgcugccuccgggacuccacgcacugcgucaccaccgccacccgcgugcugagcaacacggaggaccugccccucgugaccaagaugugccacaucggcugcccggacauccccucccugggccuggggcccuacgucagcaucgcgugcugccagaccucccucugcaaccacgacuga

SEQ ID NO: 32545 - RNA, 426 nt, Artificial Sequence
  derived and/or modified sequence opt1 from LYPD1__Homo_sapiens__NP_653187
augugggugcugggcaucgccgccaccuucugcggccucuuccugcugcccggguucgcgcuccagauccagugcuaccagugcgaggaguuccagcugaacaacgacugcagcuccccggaguucaucgucaacugcaccgugaacgugcaggacaugugccagaaggaggucauggagcagagcgccgggaucauguaccgcaaguccugcgccagcuccgccgccugccugaucgcgagcgccggcuaccaguccuucugcagccccgggaagcucaacuccgugugcaucagcugcugcaacacgccccugugcaacggcccccggccgaagaagcgcggcuccagcgccuccgcccugcggcccgggcuccgcaccaccauccuguuccugaagcucgcgcuguucagcgcccacugcuga

SEQ ID NO: 32546 - RNA, 378 nt, Artificial Sequence
  derived and/or modified sequence opt1 from LYPD2__Homo_sapiens__NP_991108
augcgcggcacccggcuggcccuccuggcccuggugcucgcggccugcggggagcuggcccccgcccugcgcugcuacgucugcccggagcccaccggcgugagcgacugcgugacgaucgcgaccugcaccaccaacgagacgaugugcaagaccacccucuacucccgggagaucgucuaccccuuccagggggacagcaccgugacgaaguccugcgccagcaagugcaagcccuccgacguggacggcaucgggcagacccugccggucagcugcugcaacaccgagcugugcaacguggacggcgcccccgcccucaacucccugcacugcggcgcccugacccuccugccccugcucagccugcgccuguga

SEQ ID NO: 32547 - RNA, 1041 nt, Artificial Sequence
  derived and/or modified sequence opt1 from LYPD3__Homo_sapiens__NP_055215
auggaccccgcccgcaaggccggcgcgcaggccaugaucuggaccgccggguggcugcuccugcugcuccugcggggcggggcccaggcccuggagugcuacagcugcgugcagaaggcggacgacggcugcuccccgaacaagaugaagaccgucaagugcgcccccgggguggacgugugcacggaggccgucggcgccguggagaccauccacggccaguucagccucgcggugcgcgggugcggcuccgggcugcccggcaagaacgaccgggggcuggaccuccacggccugcuggccuucauccagcuccagcagugcgcccaggaccgcugcaacgccaagcugaaccugaccagccgggcccucgaccccgcgggcaacgaguccgccuacccgcccaacggggucgagugcuacagcugcgugggccugucccgcgaggccugccaggggaccagcccgcccguggucuccugcuacaacgccagcgaccacguguacaagggcugcuucgacggcaacgugacgcugaccgccgcgaacgucaccgugucccuccccgugcgggggugcguccaggacgaguucugcacccgcgacggcgugacggggcccggcuucacccugagcggguccugcugccagggcagccggugcaacuccgaccugcgcaacaagaccuacuucagcccccggaucccgccccucgugcgccugcccccgcccgagcccaccacggucgccuccaccaccagcgugaccacguccaccagcgcccccgugcggcccaccagcaccacgaagcccaugccggcccccaccucccagacgccccgccagggcgucgagcacgaggccagccgggacgaggagccccgccugaccgggggcgcggccgggcaccaggaccgguccaacagcggccaguacccggccaagggcgggccccagcagccccacaacaagggcugcguggcccccaccgccgggcucgcggcccugcugcucgccguggccgcgggcguccugcuguga

SEQ ID NO: 32548 - RNA, 636 nt, Artificial Sequence
  derived and/or modified sequence opt1 from LYPD4__Homo_sapiens__NP_001278348
augggcccccagcaccuccgccuggugcagcuguucugccugcucggggccaucagcacccugccgcggauguccugcggcgccgggugcuacaagacccagaagggcacggcgcgcggggucgugggcuucaagggcugcagcuccagcuccagcuaccccgcccagaucuccuaccuggugagcccgcccggggucuccaucgccagcuacucccgggugugccgcagcuaccucugcaacaaccugaccaaccuggagcccuucgugaagcucaaggccuccacccccaagagcaucaccuccgccagcugcuccugccccacgugcgucggcgagcacaugaaggacugccugcccaacuucgugaccaccaacagcugcccgcuggcggccuccacgugcuacagcagcacccucaaguuccaggccggguuccugaacaccaccuuccugcucaugggcugcgcccgggagcacaaccagcugcuggcggacuuccaccacaucggguccaucaaggugaccgagguccucaacauccuggagaagucccagaucgugggcgccgccagcagccgccaggaccccgccuggggcgugguccuggggcuccuguucgccuuccgggacuga

SEQ ID NO: 32549 - RNA, 756 nt, Artificial Sequence
  derived and/or modified sequence opt1 from LYPD5__Homo_sapiens__NP_001026919
auggccaugggcgugccccgcgucauccugcucugccuguucggggccgcgcugugccucaccggcagccaggcccugcagugcuacuccuucgagcacaccuacuucgggccguucgaccugcgggccaugaagcuccccagcaucuccugcccccacgagugcuucgaggccauccugagccuggacacgggcuaccgcgcccccgugacccucgugcggaaggggugcuggaccggcccgcccgcgggccagacccaguccaacgccgacgcccugccgcccgacuacagcgucgugcgcgggugcacgaccgacaagugcaacgcccaccugaugacccacgacgcgcuccccaaccugucccaggcccccgacccgcccacccugagcggcgccgagugcuacgccugcaucggggugcaccaggacgacugcgccaucggccggucccgccggguccagugccaccaggaccagacggcgugcuuccaggggaacggccgcaugaccgugggcaacuucagcgugcccgucuacauccggaccugccaccgccccuccugcaccacggaggggaccaccagccccuggaccgccaucgaccuccagggcuccugcugcgagggguaccugugcaaccgcaagagcaugacgcagcccuucaccuccgccagcgccaccaccccgccccgggcccuccaggugcuggcgcugcugcuccccgugcugcugcucgucggccuguccgccuga

SEQ ID NO: 32550 - RNA, 516 nt, Artificial Sequence
  derived and/or modified sequence opt1 from LYPD6__Homo_sapiens__NP_001182614
auggagcccggcccggcccuggccuggcuccugcugcucagccugcuggcggacugccucaaggccgcccagucccgcgacuucaccgugaaggacaucaucuaccugcaccccagcaccacgcccuaccccgggggcuucaagugcuucacgugcgagaaggccgccgacaacuacgagugcaaccggugggcgccggacaucuacugcccccgcgagacccgguacugcuacacccagcacaccauggaggucaccgggaacuccaucagcgugaccaagcgcugcgugccccuggaggagugccucuccaccggcugccgggacagcgagcacgaggggcacaaggucugcacguccugcugcgagggcaacaucugcaaccugccccugccgcgcaacgagaccgacgccaccuucgccaccacgagccccaucaaccagaccaacggccacccccggugcauguccgugaucgugagcugccucuggcuguggcuggggcucaugcuguga

SEQ ID NO: 32551 - RNA, 714 nt, Artificial Sequence
  derived and/or modified sequence opt1 from LYPD8__Homo_sapiens__NP_001078943
augaagggcauccugguggccgggaucaccgccguccucguggcggccguggagagccuguccugcguccagugcaacagcugggagaaguccugcgugaacagcaucgccuccgagugccccagccacgccaacaccuccugcaucagcuccagcgccuccagcucccuggagacgccggugcgccucuaccagaacauguucugcagcgcggagaacugcuccgaggagacccacaucaccgccuucaccguccacgugagcgccgaggagcacuuccacuucgugucccagugcugccagggcaaggagugcagcaacacguccgacgcccuggacccgccccugaagaacgucagcagcaacgcggagugccccgccugcuacgaguccaacgggaccagcugccggggcaagcccuggaagugcuacgaggaggagcagugcguguuccucguggccgagcugaagaacgacaucgaguccaagagccugguccucaaggggugcuccaacgugagcaacgcgaccugccaguuccuguccggcgagaacaagacccugggcggggugaucuuccgcaaguucgagugcgccaacgucaacagccucacgcccaccuccgcccccaccaccagccacaacgugggcuccaaggccagccuguaccugcucgcccuggccucccugcuccugcgggggcugcuccccuga

SEQ ID NO: 32552 - RNA, 645 nt, Artificial Sequence
  derived and/or modified sequence opt1 from LYPLA1__Homo_sapiens__NP_001266286
augugcggcaacaacaugagcacgccccugccggccaucgugcccgccgcgcgcaaggccaccgccgccgucaucuuccuccacgggcugggcgacaccgggcacggcugggccgaggcguucgccgggauccgguccagccacaucaaguacaucugcccccacgccuucgacaucaucggccugucccccgacagccaggaggacgaguccggcaucaagcaggccgcggagaacaucaaggcccucaucgaccaggaggugaagaacgggaucccgagcaaccgcaucauccugggcggguucucccagggcggggcccugagccucuacaccgcccugaccacccagcagaagcuggccggcgugacggcgcucuccugcuggcugccccugcgggccagcuucccccagggccccaucgggggcgccaaccgcgacaucuccauccuccagugccacggggacugcgacccgcuggucccccugauguucggcagccucaccguggagaagcugaagacccuggugaaccccgccaacgucaccuucaagacguacgagggcaugaugcacuccagcugccagcaggagaugauggacgugaagcaguucaucgacaagcuccugcccccgaucgacuga

SEQ ID NO: 32553 - RNA, 666 nt, Artificial Sequence
  derived and/or modified sequence opt1 from LYPLAL1__Homo_sapiens__NP_001287699
auggccgccgcgagcggcuccgugcugcagcgcugcaucgucagccccgccgggcggcacuccgccagccucaucuuccugcacggcuccggggacagcggccaggggcugcgcauguggaucaagcagguccucaaccaggaccugaccuuccagcacaucaagaucaucuacccgaccgccccgccccgguucaagaucacgaacgacugccccgagcaccuggaguccaucgacgugaugugccaggugcucaccgaccugaucgacgaggaggucaagagcggcaucaagaagaaccgcauccugaucggcggguucuccaugggcgggugcauggccauccaccucgcguaccggaaccaccaggacguggccggcguguucgcccugagcuccuuccugaacaaggccagcgcgguguaccaggcccuccagaaguccaacggggugcugcccgagcuguuccagugccacggcaccgccgacgagcucguccugcacagcugggccgaggagaccaacuccaugcucaagagccugggcgugacgaccaaguuccacuccuuccccaacguguaccacgagcugagcaagaccgagcuggacauccucaagcuguggauccugaccaagcuccccggggagauggagaagcagaaguga

SEQ ID NO: 32554 - RNA, 369 nt, Artificial Sequence
  derived and/or modified sequence opt1 from LYRM1__Homo_sapiens__NP_001289765
augaccaccgccacccgccaggaggugcugggccucuaccggagcaucuuccgccuggcccggaaguggcaggcgaccuccgggcagauggaggacaccaucaaggagaagcaguacauccugaacgaggcccgcacccucuuccggaagaacaagaaccugacggacaccgaccugaucaagcagugcaucgacgagugcaccgcccgcaucgagaucggccuccacuacaagauccccuacccgcggcccauccaccucccgcccauggggcugacgccccugcgcggccgggggcugcgcagccaggagaagcugcggaagcucuccaagcccgucuaccugcgcagccacgacgagguguccuga

SEQ ID NO: 32555 - RNA, 393 nt, Artificial Sequence
  derived and/or modified sequence opt1 from LYRM4__Homo_sapiens__NP_001158312
auggccgccagcucccgcgcccaggugcugagccucuaccgggcgaugcugcgcgaguccaagcgguucagcgccuacaacuaccgcaccuacgccguccggcgcauccgggacgccuuccgcgagaacaagaacgugaaggaccccguggagauccagacccuggucaacaaggcgaagcgggaccucggcgugauccgccggcagauggacucccacagcguggcccaggccgggguccacuggaacgaccuguccagccugcagccccucccgcccugguucaagcaguucuccugccugagccugcccuccagcugggacuaccgccggacgccgccccgccucgccaacuucugcauccugucccgggacgugaucagccuguacuga

SEQ ID NO: 32556 - RNA, 315 nt, Artificial Sequence
  derived and/or modified sequence opt1 from LYRM7__Homo_sapiens__NP_859056
augggccgcgccgugaagguccugcagcuguucaagacccuccaccggacccgccagcaggucuucaagaacgacgcccgggcgcuggaggccgcccgcaucaagaucaacgaggaguucaagaacaacaagagcgagacguccagcaagaagaucgaggagcucaugaagaucggguccgacguggagcugcugcuccggaccagcgugauccagggcauccacaccgaccacaacacccugaagcuggugccccgcaaggaccuccugguggagaacgucccguacugcgacgcccccacgcagaagcaguga

SEQ ID NO: 32557 - RNA, 237 nt, Artificial Sequence
  derived and/or modified sequence opt1 from LYRM9__Homo_sapiens__NP_001070148
auggcgccccugccgggcgccgagcucgugcgccggccccugcagcuguaccgcuaccuccugcggugcugccagcagcugcccaccaaggggauccagcagcacuacaagcacgccguccgccagagcuuccgggugcacuccgacgaggacaaccccgagcgcauccagcagaucaucaagcgggccaucgaggacgccgacuggaucaugaacaaguacaagaagcagaacuga

SEQ ID NO: 32558 - RNA, 11406 nt, Artificial Sequence
  derived and/or modified sequence opt1 from LYST__Homo_sapiens__NP_001288294
augagcaccgacuccaacagccuggcgcgggaguuccugaccgacgugaaccggcugugcaacgccgucgugcagcggguggaggcgcgggaggaggaggaggaggagacgcacauggccacccugggccaguaccugguccacgggcgcggcuuccugcugcucaccaagcugaacuccaucaucgaccaggcccugaccugccgggaggagcuccugacccugcuccugagccugcucccccugguguggaagaucccggugcaggaggagaaggccaccgacuucaaccugccccucuccgccgacaucauccugaccaaggagaagaacagcuccagccagcgcuccacccaggagaagcugcaccucgaggggagcgcgcuguccagccaggucuccgccaaggugaacguguuccggaagucccgccggcagcgcaagaucacgcaccgguacuccguccgcgacgcccggaagacccagcugagcaccuccgacagcgaggccaacuccgacgagaagggcaucgcgaugaacaagcaccgccggccccaccuccugcaccacuuccugaccagcuuccccaagcaggaccacccgaaggccaagcucgaccgccuggccacgaaggagcagacgccgcccgacgccauggcccuggagaacagccgggagaucaucccccgccagggguccaacaccgacauccucagcgagccggcggcccuguccgugaucagcaacaugaacaacucccccuucgaccugugccacgugcuccugagccugcucgagaaggucugcaaguucgacgugacccugaaccacaacagcccccucgccgccagcgugguccccacgcucaccgaguuccuggccggcuucggcgacugcugcucccugagcgacaaccucgagucccggguggugagcgcgggguggaccgaggagccggucgcccugauccagcgcaugcuguuccggaccgugcuccaccuccuguccguggacgucagcacggccgagaugaugcccgagaaccuccgcaagaaccugaccgagcugcugcgcgccgcccucaagauccggaucugccuggagaagcagcccgaccccuucgcgccgcgccagaagaagacccugcaggaggugcaggaggacuucguguucuccaaguaccggcaccgcgcccuccugcugcccgagcuccuggagggcguccugcagauccucaucugcugccugcagagcgccgccuccaaccccuucuacuucagccaggccauggaccuggugcaggaguucauccagcaccacggguucaaccucuucgagaccgcgguccugcagauggaguggcuggugcuccgggacggcgugcccccggaggccuccgagcaccugaaggcccugaucaacagcgucaugaagaucaugagcacggugaagaaggugaaguccgagcagcuccaccacagcaugugcacccgcaagcggcaccgccggugcgaguacucccacuucaugcaccaccaccgcgaccugagcgggcugcucgucuccgccuucaagaaccaggugagcaagaaccccuucgaggagaccgcggacggcgacguguacuaccccgagcggugcugcugcaucgccgucugcgcccaccagugccugcgccugcuccagcaggccucccugagcagcacgugcgugcagauccugagcggcgugcacaacaucgggaucugcugcugcauggaccccaaguccgucaucaucccgcuccugcacgccuucaagcugcccgcgcucaagaacuuccagcagcacauccugaacauccugaacaagcucauccuggaccagcugggcggggccgagaucagccccaagaucaagaaggccgccugcaacaucugcaccguggacuccgaccagcucgcccagcuggaggagacccugcagggcaaccucugcgacgcggagcugagcuccagccuguccagccccagcuaccgguuccagggcauccucccguccagcggguccgaggaccugcuguggaagugggacgcccucaaggccuaccagaacuucguguucgaggaggaccgccugcacagcauccagaucgccaaccacaucugcaaccugauccagaagggcaacaucgucgugcaguggaagcucuacaacuacaucuucaaccccgugcugcagcgcgggguggagcuggcccaccacugccagcaccucuccgugaccagcgcgcagucccacgugugcagccaccacaaccagugccugccccaggacguccugcagaucuacgugaagacccucccgauccugcugaagucccgcgugauccgggaccucuuccugagcugcaacggcgucucccagaucaucgagcugaacugccucaacgggauccgcagccacucccugaaggccuucgagacgcugaucaucagccucggcgagcagcagaaggacgccuccgugcccgacaucgacggcaucgacaucgagcagaaggagcugagcuccgugcacgucgggaccagcuuccaccaccagcaggccuacuccgacagcccccagagccuguccaaguucuacgcgggccucaaggaggccuaccccaagcggcgcaagaccgugaaccaggacgugcacaucaacaccaucaaccuguuccugugcgucgccuuccucugcgugagcaaggaggccgaguccgaccgcgagagcgccaacgacuccgaggacacgagcggguacgacuccaccgcgagcgagccgcugucccacaugcugcccugcaucagccucgagucccuggugcugcccagccccgagcacaugcaccaggccgccgacaucugguccaugugccgguggaucuacaugcucagcuccgucuuccagaagcaguucuaccgccugggcggguuccgggugugccacaagcugaucuucaugaucauccagaagcuguuccgcagccacaaggaggagcagggcaagaaggagggcgacaccuccgugaacgagaaccaggaccucaaccggaucagccagccgaagcgcaccaugaaggaggaccugcucucccuggccaucaagagcgaccccauccccagcgagcuggggucccucaagaaguccgccgacucccugggcaagcuggagcuccagcacaucagcuccaucaacgucgaggaggugagcgcgaccgaggccgcccccgaggaggccaagcuguucacgucccaggagagcgagaccucccugcagagcauccggcuccuggaggcccugcucgcgaucugccugcacggggcccgcaccucccagcagaagauggagcuggagcugccgaaccagaaccucagcguggaguccauccuguucgagaugcgggaccaccugagccaguccaaggucaucgagacccagcucgccaagccccuguucgacgcccugcuccgcguggcgcugggcaacuacagcgccgacuucgagcacaacgacgccaugacggagaagucccaccagagcgccgaggagcuguccagccagcccggggacuucagcgaggaggccgaggacucccagugcugcagcuucaagcuccugguggaggaggagggcuacgaggcggacuccgagagcaaccccgaggacggcgagacccaggacgacggggucgaccugaaguccgagaccgagggcuucagcgccuccagcuccccgaacgaccuccuggagaaccugacccagggggagaucaucuaccccgagaucugcaugcucgagcugaaccugcucagcgccuccaaggccaagcuggacgugcuggcccacguguucgagagcuuccucaagaucauccggcagaaggagaagaacgucuuccugcugaugcagcagggcacggugaagaaccuccugggcggguuccuguccauccucacccaggacgacagcgacuuccaggcgugccagcgcgugcuggucgaccugcucgugucccugaugagcucccggaccugcagcgaggagcugacccuccugcugcgcaucuuccucgagaagucccccugcacgaagauccugcugcucggcauccugaagaucaucgagagcgacaccaccaugagccccucccaguaccugaccuucccgcuccugcacgcccccaaccugagcaacgggguguccagccagaaguaccccggcauccucaacuccaaggccauggggcugcugcggcgcgcccgggucagccgcuccaagaaggaggccgaccgggagagcuucccccaccgccuccuguccagcuggcacaucgcgccggugcaccucccccuccugggccagaacugcuggccccaccuguccgagggcuucagcgucucccucugguucaacguggagugcauccacgaggccgagagcacgaccgagaaggggaagaagaucaagaagcggaacaagucccugauccugccggacagcuccuucgacggcaccgagagcgaccgccccgagggggccgaguacaucaaccccggcgagcgccucaucgaggaggggugcauccacaucaucucccugggcagcaaggcccugaugauccaggugugggccgacccccacaacgcgacccucaucuuccgggucugcauggacagcaacgacgacaugaaggccgugcugcuggcccagguggagucccaggagaacaucuuccucccgagcaaguggcagcaccugguccugacguaccuccagcagccccagggcaagcgccggauccacgggaagaucuccaucugggugagcggccagcgcaagcccgacgugacccuggacuucaugcugccccggaagaccucccucagcuccgacagcaacaagaccuucugcaugaucgggcacugccuguccagccaggaggaguuccugcagcucgccggcaagugggaccuggggaaccugcuccuguucaacggcgcgaaggucggcucccaggaggccuucuaccuguacgccugcgggccgaaccacacgagcgugaugcccugcaaguacggcaagcccgugaacgacuacuccaaguacaucaacaaggagauccuccgcugcgagcagauccgggagcuguucaugaccaagaaggacgucgacaucgggcugcucaucgagagccuguccgugguguacaccaccuacugccccgcccaguacacgaucuacgagccggucauccgccugaagggccagaugaagacccagcucagccagcggcccuucuccagcaaggaggugcagagcauccugcuggagccccaccaccucaagaaccugcagcccaccgaguacaagaccauccaggggauccugcacgagaucggcggcacggggaucuucguguuccucuucgcccgcgucguggagcuguccagcugcgaggagacccaggcgcuggcccuccgggugauccugucccugaucaaguacaaccagcagcgcguccacgagcucgagaacugcaacggccugagcaugauccaccaggugcugaucaagcagaagugcaucgugggguucuacauccucaagacccugcuggagggcugcugcggcgaggacaucaucuacaugaacgagaacggggaguucaagcuggacgucgacuccaacgccaucauccaggacgugaagcuccuggaggagcugcuccuggacuggaagaucuggagcaaggccgagcagggcgugugggagacccugcucgccgcgcuggagguccugauccgggccgaccaccaccagcagauguucaacaucaagcagcuccugaaggcccagguggugcaccacuuccugcucacgugccagguccugcaggaguacaaggaggggcagcugaccccgaugccccgcgaggugugccgguccuucgugaagaucaucgccgagguccucggcuccccgcccgaccuggagcugcucaccaucaucuucaacuuccugcuggccgugcacccgcccaccaacaccuacgugugccacaaccccacgaacuucuacuucucccuccacaucgacgggaagaucuuccaggagaagguccgcagcaucauguaccugcggcacuccagcuccggcggccgcagccugaugucccccggguucauggugaucagcccguccggcuucaccgcgagccccuacgagggggagaacuccagcaacaucaucccccagcagauggccgcccacaugcuccggagccgcucccugcccgccuucccgaccagcucccugcucacccagagccagaagcugacgggcucccuggggugcagcaucgaccgccuccagaacaucgcggacaccuacguggccacccaguccaagaagcagaacagccugggcuccagcgacacccugaagaagggcaaggaggacgccuucaucuccagcugcgaguccgccaagacggucugcgagauggaggccgugcucagcgcccagguguccgucagcgacgugcccaagggggugcugggcuuccccgucgugaaggccgaccacaagcagcugggggccgagccgcgguccgaggacgacagccccggcgacgaguccugcccccgccggcccgacuaccucaaggggcuggccagcuuccagcgcagccacuccaccaucgccagccugggccucgcguucccgucccagaacggcagcgccgccguggggcgguggcccucccuggucgaccgcaacaccgacgacugggagaacuucgccuacagccugggcuacgagcccaacuacaaccggaccgccuccgcgcacagcgugacggaggacugccucgugcccaucugcugcgggcuguacgagcugcucuccggcguccugcugauccucccggacgugcugcuggaggacgucauggacaagcucauccaggccgacacccugcuggugcucgugaaccaccccagccccgccauccagcagggcgucaucaagcugcuggacgccuacuucgcgcgcgccuccaaggagcagaaggacaaguuccucaagaaccggggguucagccugcuggccaaccagcucuaccugcaccgcggcacccaggagcugcucgagugcuucaucgagauguucuucgggcggcacaucggccuggacgaggaguucgaccuggaggacgugcgcaacaugggccuguuccagaagugguccgugauccccauccugggccugaucgagaccagccucuacgacaacauccugcugcacaacgcccuccugcugcuccugcagauccugaacuccugcagcaaggucgccgacaugcuccuggacaacggccugcucuacgugcugugcaacacgguggcggcccugaacgggcucgagaagaacaucccgauguccgaguacaagcugcuggccugcgacauccagcagcuguucaucgccgucaccauccacgccugcagcuccagcggcagccaguacuuccgggugaucgaggaccugaucgugaugcugggguaccuccagaacuccaagaacaagcgcacccagaacauggcggucgcccugcagcugcgggugcuccaggccgccauggaguucauccgcaccacggccaaccacgacagcgagaaccugaccgacucccugcagagccccuccgcgccccaccacgccgugguccagaagcgcaagagcaucgccggcccccgcaaguucccgcucgcccagaccgagucccugcugaugaagaugcggagcguggccaacgacgagcugcacgugaugaugcagcgccggaugucccaggagaaccccagccaggcgaccgagacggagcucgcccagcgccugcagcgccugaccguccucgccgugaaccggaucaucuaccaggaguucaacuccgacaucaucgacauccugcgcacccccgagaacgugacccagagcaagacguccgucuuccagaccgagaucagcgaggagaacauccaccacgagcaguccagcguguucaaccccuuccagaaggagaucuucaccuaccugguggagggguucaaggucuccaucggcagcuccaaggccagcggcagcaagcagcaguggaccaagauccucugguccugcaaggagacguuccggaugcagcuggggcgccugcucgugcacauccugagcccggcgcacgccgcccaggagcggaagcagaucuucgagaucgugcacgagcccaaccaccaggagauccugcgcgacugccucucccccagccugcagcacggcgccaagcugguccucuaccuguccgagcugauccacaaccaccagggggagcucaccgaggaggagcugggcaccgccgagcugcucaugaacgcgcugaagcugugcgggcacaagugcaucccgcccagcgccuccaccaaggccgaccucaucaagaugaucaaggaggagcagaagaaguacgagacggaggagggcgugaacaaggccgccuggcagaagaccgugaacaacaaccagcagagccuguuccagcggcuggacuccaagagcaaggacaucuccaagaucgcggccgacaucacccaggccgucagccucucccagggcaacgagcgcaagaaggugauccagcacauccgggggauguacaagguggaccugagcgccucccgccacuggcaggagcugauccagcagcucacccacgaccgggccgucugguacgaccccaucuacuaccccaccagcuggcagcuggaccccacggagggccccaaccgcgagcggcgccggcugcagcgcugcuaccucaccauccccaacaaguaccugcugcgggaccgccagaaguccgaggacguggugaagcccccgcucagcuaccuguucgaggacaagacccacuccagcuucagcuccaccgucaaggacaaggcggccagcgaguccauccgggugaaccgccgcugcaucagcguggcccccucccgggagacggccggggagcugcuccugggcaagugcgggauguacuucgucgaggacaacgcgagcgacaccguggaguccagcucccugcagggcgagcucgagcccgccagcuucuccuggaccuacgaggagaucaaggaggugcacaagcgcugguggcagcugcgggacaacgccgucgagaucuuccugaccaacggccgcacgcuccugcuggccuucgacaacaccaaggugcgggacgacguguaccacaacauccucaccaacaaccugcccaaccugcucgaguacgggaacaucaccgcccugacgaaccugugguacaccggccagaucaccaacuucgaguaccucacccaccugaacaagcacgcggggcgcagcuucaacgaccugaugcaguacccggucuuccccuucauccucgccgacuacguguccgagacgcuggaccugaacgaccuccugaucuaccggaaccugagcaagcccaucgccgugcaguacaaggagaaggaggaccgcuacgucgacaccuacaaguaccucgaggaggaguaccggaagggcgcccgcgaggacgaccccaugccgcccgugcagcccuaccacuacggcucccacuacagcaacuccgggaccgugcugcacuuccugguccggaugcccccguucaccaagauguuccucgccuaccaggaccagagcuucgacauccccgaccgcacguuccacagcaccaacaccaccuggcggcuguccagcuucgaguccaugacggacgugaaggagcugauccccgaguucuucuaccuccccgaguuccuggucaaccgcgagggcuucgacuucggggugcggcagaacggcgagcgcgugaaccacgucaaccugccgcccugggcgcggaacgacccccgccucuucauccugauccaccggcaggcccuggagagcgacuacgugucccagaacaucugccaguggaucgaccucguguucggguacaagcagaagggcaaggccagcguccaggccaucaacguguuccaccccgccaccuacuucggcauggacguguccgcggucgaggacccggugcagcgccgggcccuggagaccaugaucaagaccuacgggcagacgccccgccagcuguuccacauggcccacgugagccgccccggcgccaagcucaacaucgagggggagcugcccgcggccgucggccugcucgugcaguucgccuuccgggagacccgcgagcaggucaaggagaucaccuacccgagcccccugagcuggaucaaggggcugaaguggggcgaguacgucggcucccccagcgccccggugcccguggucugcuucucccagccccacggggagcgguucggcagccuccaggcccugcccacccgcgcgaucugcgggcugucccggaacuucugccuccugaugacguacagcaaggagcagggcgugcgcuccaugaacagcaccgacauccagugguccgccauccugagcuggggguacgccgacaacauccuccggcucaagagcaagcaguccgagccgcccgugaacuucauccagagcucccagcaguaccaggucaccagcugcgccugggugcccgacuccugccagcuguucaccggcagcaagugcggcgugaucacggccuacaccaaccgcuucaccuccagcacccccuccgagaucgagauggagacgcagauccaccucuacgggcacaccgaggagaucaccagccuguucgucugcaagccguacuccauccugaucagcgugucccgggacgggaccugcaucaucugggaccugaaccgccucugcuacgugcagagccuggcggggcacaagucccccgucaccgccgugagcgccuccgagacgagcggcgacaucgccaccgugugcgacuccgccgggggcggcagcgaccugcggcucuggaccgucaacggggaccuggugggccacgugcacugccgcgagaucaucugcagcgucgcguucuccaaccagcccgagggggugagcaucaacgugaucgccggcggccuggagaacgggaucguccggcucugguccaccugggaccugaagcccgugcgcgagaucacguuccccaagagcaacaagcccaucaucucccugaccuucagcugcgacggccaccaccucuacaccgccaacuccgacgggaccgugaucgccuggugccggaaggaccagcagcgccugaagcagcccauguucuacagcuuccuguccagcuacgccgcgggcuga

SEQ ID NO: 32559 - RNA, 969 nt, Artificial Sequence
  derived and/or modified sequence opt1 from LYVE1__Homo_sapiens__NP_006682
auggcccgcugcuucagccuggugcuccugcugaccuccaucuggaccacgcggcuccugguccagggcagccugcgcgccgaggagcucuccauccaggugagcugccggaucauggggaucacccugguguccaagaaggcgaaccagcagcugaacuucaccgaggccaaggaggccugccgccuccugggccugagccucgccgggaaggaccaggucgagaccgcccugaaggcguccuucgagacgugcagcuacggcugggugggggacggcuucguggucaucucccggaucagccccaacccgaagugcggcaagaacggggugggcgugcugaucuggaagguccccgugucccgccaguucgccgccuacugcuacaacagcuccgacaccuggaccaacagcugcauccccgagaucaucaccacgaaggaccccaucuucaacacccagaccgccacccagacgaccgaguucaucguguccgacagcaccuacuccgucgcgagcccguacuccaccauccccgcccccacgaccacgcccccggcccccgccagcaccagcaucccccggcgcaagaagcucaucugcgugaccgagguguucauggagaccuccaccaugagcaccgagacggagcccuucgucgagaacaaggccgcguucaagaacgaggccgccggguucggcggggugccgaccgcccugcuggugcucgcccugcuguucuucggcgcggccgccggccucggguucugcuacgucaagcgguacgugaaggccuuccccuucaccaacaagaaccagcagaaggagaugaucgagaccaagguggucaaggaggagaaggccaacgacuccaaccccaacgaggagagcaagaagacggacaagaaccccgaggaguccaagagcccguccaagaccaccgugcgcugccuggaggcggagguguga

SEQ ID NO: 32560 - RNA, 447 nt, Artificial Sequence
  derived and/or modified sequence opt1 from LYZ__Homo_sapiens__NP_000230
augaaggcccugaucgugcucggccugguccugcucagcgugaccgugcaggggaaggucuucgagcgcugcgagcuggcccggacccugaagcgccucggcauggacggguaccggggcaucucccuggcgaacuggaugugccuggccaagugggagagcggguacaacacgcgcgccaccaacuacaacgccggcgaccgguccaccgacuacggcaucuuccagaucaacagccgcuacuggugcaacgacgggaagacccccggcgccgugaacgcgugccaccucuccugcagcgcccugcugcaggacaacaucgccgacgccguggcgugcgccaagcgggucgugcgcgacccgcaggggauccgggccuggguggccuggcgcaaccggugccagaaccgcgacguccggcaguacgugcagggcugcgggguguga

SEQ ID NO: 32561 - RNA, 585 nt, Artificial Sequence
  derived and/or modified sequence opt1 from LYZL1__Homo_sapiens__NP_115906
augcaggacgcgccccugagcugccucuccccgaccaaguggagcuccgugagcuccgccgacagcaccgagaaguccgccagcggcgccgggacgcgcaaccugcccuuccaguucugccugcggcaggcccuccgcaugaaggccgccggcauccugacccugaucgggugccucgucaccggcgcggaguccaagaucuacacccggugcaagcuggccaagaucuucagccgcgccgggcuggacaacuacuggggcuucucccucggcaacuggaucugcauggccuacuacgagagcggguacaacacgaccgcgcagaccgugcuggacgacggcuccaucgacuacgggaucuuccagaucaacagcuucgccuggugccggcgcggcaagcugaaggagaacaaccacugccacguggccugcuccgcccucaucaccgacgaccugacggacgccaucaucugcgcgcggaagaucgucaaggagacccaggggaugaacuacuggcagggcuggaagaagcacugcgagggccgcgaccugagcgaguggaagaaggggugcgagguguccuga

SEQ ID NO: 32562 - RNA, 585 nt, Artificial Sequence
  derived and/or modified sequence opt1 from LYZL2__Homo_sapiens__NP_898881
augcaggacgcgccccugagcugccucuccccgaccaaguggagcuccgugagcuccgccgacagcaccgagaaguccgccagcgccgccggcacgcgcaaccugcccuuccaguucugccugcggcaggcccuccgcaugaaggccgcggggauccugacccugaucggcugccucgucaccggggccgaguccaagaucuacacccggugcaagcuggccaagaucuucagccgcgccggccuggacaacuacuggggguucucccucggcaacuggaucugcauggcguacuacgagagcggcuacaacacgaccgcccagaccgugcuggacgacggguccaucgacuacggcaucuuccagaucaacagcuucgccuggugccggcgcgggaagcugaaggagaacaaccacugccacguggccugcuccgcccucgucaccgacgaccugacggacgcgaucaucugcgccaagaagaucgugaaggagacccagggcaugaacuacuggcagggguggaagaagcacugcgagggccgggaccugagcgacuggaagaaggacugcgagguguccuga

SEQ ID NO: 32563 - RNA, 447 nt, Artificial Sequence
  derived and/or modified sequence opt1 from LYZL6__Homo_sapiens__NP_001186880
augaccaaggcccugcucaucuaccuggugagcuccuuccuggcccucaaccaggcgagccugaucucccgcugcgaccuggcccagguccuccagcuggaggaccuggacggcuucgagggguacagccucuccgacuggcugugccuggccuucguggagagcaaguucaacaucuccaagaucaacgagaacgccgacggcagcuucgacuacggccucuuccagaucaacucccacuacuggugcaacgacuacaagagcuacuccgagaaccugugccacguggacugccaggaccugcucaaccccaaccugcuggccgggauccacugcgcgaagcggaucgucagcggggcccgcggcaugaacaacuggguggaguggcggcuccacugcuccggccgcccgcuguucuacuggcugaccgggugccggcuccgcuga

SEQ ID NO: 32564 - RNA, 849 nt, Artificial Sequence
  derived and/or modified sequence opt1 from LZTFL1__Homo_sapiens__NP_001263307
augcgcuucgcccggagcaagcgcggccugcggcucaagaccguggacuccugcuuccaggaccugaaggagagccgccuggucgaggacaccuucacgaucgacgagguguccgaggugcucaacgggcugcaggccgucgugcacagcgagguggaguccgagcugaucaacaccgcguacaccaacguccuccugcugcggcagcuguucgcccaggccgagaagugguaccugaagcugcagaccgacaucagcgagcucgagaaccgcgagcugcuggagcaggucgccgaguucgagaaggccgagaucacguccagcaacaagaagcccauccucgacgugaccaagccgaagcuggcgccccugaacgagggcgggaccgccgagcuccugaacaaggagauccugcggcuccaggaggagaacgagaagcugaagucccgccugaagaccaucgagauccaggccacgaacgcccucgacgagaaguccaagcuggagaaggcgcugcaggaccuccagcuggaccagggcaaccagaaggacuucaucaaggcccaggaccugagcaaccucgagaacaccguggccgcccucaagagcgaguuccagaagacccugaacgacaagaccgagaaccagaagucccucgaggagaaccuggccacggcgaagcacgaccugcuccgggugcaggagcagcugcacauggccgagaaggagcuggagaagaaguuccagcagaccgccgccuaccgcaacaugaaggagauccucaccaagaagaacgaccagaucaaggaccugcggaagcgccuggcccaguacgagcccgaggacuga

SEQ ID NO: 32565 - RNA, 2523 nt, Artificial Sequence
  derived and/or modified sequence opt1 from LZTR1__Homo_sapiens__NP_006758
auggccggccccgggagcaccggcgggcagaucggcgccgcggcccuggccgggggcgcccgcuccaagguggccccgagcgucgacuucgaccacuccugcagcgacuccguggaguaccucacccugaacuucggccccuucgagacggugcaccgguggcgccggcugccgcccugcgacgaguucgucggggcgcgccggagcaagcacaccgugguggccuacaaggacgccaucuacgucuucggcggggacaacggcaagaccaugcucaacgaccugcugcgcuucgacgugaaggacugcuccuggugccgggccuucaccacggggaccccgcccgcgccccgcuaccaccacagcgccguggucuacggcuccagcauguucguguucggcggguacaccggcgacaucuacuccaacagcaaccucaagaacaagaacgaccuguucgaguacaaguucgccaccgggcaguggacggaguggaagaucgagggccggcugcccguggcccgcuccgcccacggcgcgaccgucuacagcgacaagcucuggaucuucgccggguacgacggcaacgcccggcugaacgacauguggaccaucgggcugcaggaccgcgagcugaccugcugggaggagguggcccaguccggcgagaucccgcccagcugcugcaacuuccccguggccgucugccgggacaagauguucguguucuccgggcagagcggcgcgaagaucacgaacaaccuguuccaguucgaguucaaggacaagaccuggacccgcauccccaccgagcaccuccuccggggcuccccgcccccgccccagcgccgguacgggcacacgaugguggccuucgaccgccaccuguacgucuucggcggggccgccgacaacacccugcccaacgagcuccacugcuacgacguggacuuccagaccugggaggugguccagcccagcagcgacuccgaggugggcggggccgaggugcccgagcgggcgugcgccagcgaggagguccccacccugacguacgaggagcgcgugggcuucaagaagucccgggacgucuucggccuggacuucgggaccaccagcgccaagcagcccacccagcccgccuccgagcuccccagcggccgccuguuccacgccgcggccgugaucuccgacgccauguacaucuucgggggcacgguggacaacaacauccgcagcggggagauguaccgguuccaguucuccugcuaccccaagugcacccugcacgaggacuacggccgccucugggagagccggcaguucugcgacgucgaguucgugcugggcgagaaggaggagugcgugcaggggcacgucgccaucgugaccgcgcgcucccgguggcugcgccggaagaucacccaggcccgcgagcggcucgcccagaagcuggagcaggaggccgccccggugccccgcgaggcgcccggcgucgccgccgggggcgcccggcccccgcugcuccacguggccauccgcgaggcggaggcccggcccuucgaggugcugaugcaguuccuguacacggacaagaucaaguacccccgcaagggccacgucgaggacgugcuccugaucauggacguguacaagcuggcccucagcuuccagcugugccggcuggagcagcucugccgccaguacaucgaggccuccgucgaccugcagaacgugcugguggucugcgagagcgccgcgcggcuccagcugucccagcugaaggagcacugccucaacuucguggugaaggagagccacuucaaccaggucaucaugaugaaggaguucgagcgccuguccagcccgcugaucguggagaucgugcggcgcaagcagcagcccccgccccgcacgccccucgaccagcccgucgacaucgggaccucccugauccaggacaugaaggccuaccuggagggcgccggggccgaguucugcgacaucacccugcuccuggacggccacccccggcccgcgcacaaggccauccuggccgcccgcagcagcuacuucgaggccauguuccgguccuucaugccggaggacggccaggugaacaucagcaucggggagauggugcccucccgccaggcguucgagagcaugcuccgguacaucuacuacggcgaggucaacaugccgcccgaggacucccuguaccuguucgccgcccccuacuacuacggguucuacaacaaccgccuccaggccuacugcaagcagaaccuggagaugaacgugaccgugcagaacguccugcagauccucgaggccgcggacaagacccaggcccuggacaugaagcggcacugccugcacaucaucgugcaccaguucaccaaggugagcaagcuccccacccugcgcucccugagccagcagcuccugcuggacaucaucgacucccucgccagccacaucuccgacaagcagugcgccgagcugggcgccgacaucuga

SEQ ID NO: 32566 - RNA, 1791 nt, Artificial Sequence
  derived and/or modified sequence opt1 from LZTS1__Homo_sapiens__XP_011542689
augggcagcguguccagccugaucuccgggcacagcuuccacuccaagcacugccgcgccagccaguacaagcuccggaaguccagccaccugaagaagcugaaccgcuacuccgacggccuccugcgguucggguucagccaggacuccggccacggcaagagcuccagcaagaugggcaaguccgaggacuucuucuacaucaaggucagccagaaggcccgcggcucccaccaccccgacuacaccgcgcugagcuccggggaccucggcgggcaggccggcguggacuucgacccgagcaccccgcccaagcugaugcccuucagcaaccagcuggagaugggguccgagaagggcgccgugcggcccacggccuucaagcccguccucccccgcagcggcgccauccugcacuccagccccgaguccgcgagccaccagcugcacccggccccgcccgacaagcccaaggagcaggagcucaagcccgggcugugcuccggcgcccugagcgacuccgggcggaacagcauguccagccuccccacccacuccaccagcuccagcuaccagcuggacccccuggugacccccgugggcccgacgucccgcuucggcgggagcgcccacaacaucacccagggcaucguccuccaggacuccaacaugaugagccugaaggcgcugagcuucuccgacgggggcagcaagcucgggcacuccaacaaggccgacaagggccccagcugcgugcggucccccaucagcaccgacgagugcuccauccaggagcuggagcagaagcugcucgagcgcgagggcgcccugcagaagcugcagcggagcuucgaggagaaggagcucgccuccagccuggccuacgaggagcgcccccggcgcugccgggacgagcuggaggggccggagcccaagggcgggaacaagcucaagcaggcgucccagaagucccagcgcgcccagcagguccugcaccuccaggugcugcagcugcagcaggagaagcggcagcugcgccaggagcucgagagccugaugaaggagcaggaccugcucgagaccaagcugcggagcuacgagcgcgagaagacguccuucggccccgcccuggaggagacccagugggaggugugccagaaguccggggagaucagccuccugaagcagcagcugaaggagagccagaccgaggugaacgccaaggccagcgagauccucggccugaaggcgcagcugaaggacacccggggcaagcucgaggggcuggagcugcgcacgcaggaccuggagggcgcccuccgcaccaaggggcuggagcuggaggucugcgagaacgagcuccagcggaagaagaacgaggccgagcugcugcgcgagaaggugaaccuccuggagcaggagcugcaggagcuccgggcccaggccgcgcuggcccgcgacauggggcccccgaccuuccccgaggacgugcccgcccugcagcgggagcucgagcgccugcgggccgagcugcgcgaggagcggcaggggcacgaccagauguccagcggcuuccagcacgagcgccucgucuggaaggaggagaaggagaaggugauccaguaccagaagcagcugcagcaguccuacguggccauguaccagcggaaccagcgccuggagaaggcgcuccagcagcuggcccggggcgacagcgccggggagccccuggaggucgaccucgagggcgccgacaucccguacgaggacaucaucgcgaccgagaucuga

SEQ ID NO: 32567 - RNA, 576 nt, Artificial Sequence
  derived and/or modified sequence opt1 from M6PR__Homo_sapiens__NP_001193953
auguuccccuucuacagcugcuggcgcaccggccugcuccugcugcuccuggccguggccguccgggaguccuggcagaccgaggagaagacgugcgaccuggugggggagaagggcaaggagagcgagaaggagcucgcgcuggugaagcgccugaagccccucuucaacaaguccuucgagagcaccgucgggcagggcuccgacaccuacaucuacaucuuccgggugugccgcgaggccgggaaccacaccagcggcgccggccuggugcagaucaacaaguccaacgggaaggagacggucgugggccggcugaacgagacccacaucuucaacgggagcaacuggaucaugcucaucuacaagggcggggacgaguacgacaaccacugcggcaaggagcagcgccgggccguggucaugaucuccugcaaccgccacacccuggccgacggcugcgacuucgugugccggagcaagccgcgcaacgugcccgcggccuaccgcggggucggcgacgaccagcugggggaggaguccgaggagcgggacgaccaccuccugcccauguga

SEQ ID NO: 32568 - RNA, 2304 nt, Artificial Sequence
  derived and/or modified sequence opt1 from MAATS1__Homo_sapiens__NP_203528
augagccacgccgugaccaucgaggagccccaggcccagccgcaggucucccagacccgcuaccgggagcgcagccgggcgggcucccacaucagcuccaaccgcgccuacgacuuccuguacgacccccucuucaucgugagcuccgagaaggaccacacgcaggccaacauccaggccacccugauccggagccgccugcggaaggugccccgcuucaagaccauguucuccaaccucauccacuacccccgguacagccuguacugguccaagagcgacccggucccgcccuucaucucccgcgaguggaaggggcacaaggagaagcaccgggaggcccugcgccagcucaccacgaccgacgcgagcuuccagaugcccaaggagguguacgaggaccccgaggugaccggcaagaaccgguacaaguacuucgagcgccccuuccugcccuucuuccagcagaugcccuucaacgucguguacgccguguccaaggccgagccguacaccuucccgcccacgagcaccaagcaccuguccauccccagcaaguccaccgucgggacccagacggacuaccgggacgccgacgugcagaccgaccccuacagccccgaguacguggucugccaggacagcauccccgagcuccugacccuggcgacccucacguggggccgcgggcugcccgccggccaggccgagguggagaugaucgagcgggcccgcgagaagcgggccugggaggcgucccugccggcccucagcgacaccucccaguucgagaagcgccggaagaugaugaacgagauggagcgcaaggagugggccuuccgcgagcaggagaucgagaagcugcaggagauccggcuggaggugcucaaggagcugcugcgcaagcgggaggagaaccagaacgaggucaacaugaagcaccucaacgcccgcuggagcaagcugcaggagggcaaggaggccaagauggcgaagauccagcggacccacguguccaccauccgcaagcugguggggaagcggaagaacaucgagggcaagcucgagcgccggaacaucaucaaggacuacagcgacuacgccucccaggucuacgggccccugagccgccugggcugcuuccccgacaacaacuccgaggacuucguggugaagaacuacuaccucaacacguacgaggggcuggucgagcuggagagcugccuccccgacuucgugacccagccgcagauccgggcccccaagcccaaggugaucaccaccaaggccggcuuccugaagcgcgccgcgcggcuggacuacgagcucgccgagguccacaaggcccugcuggacaagaagaacaaggugcucgaggucaagaagcccccgcgcuuccugcagcggaaccccaucccccagccgcgccugcccacgcccacccucgagaugaccuccaacgaggaggaggagauggagauggccgugaucuaccugcagaagcugcuccggggccgcgugguccagaacaugauguucgaggggaaggagaagcggcuggagcugauccaggagcuccggaccugccacgcccugcaggaggacgagaagcuggugaagaaggcggagaagcaggucacgcucgcccugcagcgccagcggaaccugcacgagcacaaggugagccugguggagaaccaccucgccggccuggaggggcgcgcccuggcggacauguucgacuuccucuccaaggagcuggugcggcugcaggaggagcgccggauccacgccuucgucaugcucgccgagcgccagcggcgcgugcgggaggccgaggagagcggccgccgccagguggagaagcagcgccugcgggaggaggacgagaucuucaaggaggucgugaaggugcaccacuccaccaucagcuccuaccuggaggacaucauccucaacaccgaggccaacaccgcggaggagcaggcccgcgccgagaucgagaagauggccgagaagaucaacgacaucgccuacgagauggagagccggcgcacguaccugcaguccgaggagaucgucgcggagcugguguacagcuuccucauccccgaggugcagaaguacuucgucaaggagaaggugcggaacgcccagcgcaagcacauccuggccgcccaccagaucauccacagcuacaccgaguccauggugcagaagaagcugaccgagggcgagcaggacgaggccagcaacgcggccaugcuccuggagaaggagacccagaacgagaacaacuccuga

SEQ ID NO: 32569 - RNA, 1080 nt, Artificial Sequence
  derived and/or modified sequence opt1 from MAB21L1__Homo_sapiens__NP_005575
augaucgccgcccaggcgaagcugguguaccaccucaacaaguacuacaacgagaagugccaggcccgcaaggccgccaucgccaagaccauccgggaggucugcaagguggugagcgacguccugaaggagguggaggugcaggagccccgcuucaucuccagccugaacgagauggacaaccgguacgagggccucgaggucaucuccccgaccgaguucgagguggugcuguaccugaaccagaugggggucuucaacuucguggacgacggcagccuccccgggugcgcggugcugaagcuguccgacggccgcaagcggagcaugucccucugggucgaguucaucacggccagcggguaccuguccgcccgcaagauccggagccgcuuccagacccugguggcccaggcgguggacaagugcuccuaccgggacgucgugaagaugguggccgacaccagcgaggucaagcuccgcauccgggaccgcuacguggugcagaucacccccgccuucaagugcacgggcaucuggccccgguccgccgcccacuggccgcugccccacauccccuggcccggcccgaaccgcgucgcggaggugaaggccgagggguucaaccugcucagcaaggagugccacucccuggccggcaagcagagcuccgccgagagcgacgccugggugcugcaguucgcggaggccgagaaccggcuccagaugggcgggugccgcaagaagugccuguccauccugaagacccuccgggaccgccaccuggagcugcccgggcagccccucaacaacuaccacaugaagacccuggucagcuacgagugcgagaagcacccccgggagagcgacugggacgaguccugccugggcgaccgccucaacggcauccugcugcagcucaucagcugccugcagugccggcgcugcccgcacuacuuccugcccaaccucgaccuguuccaggggaagccccacuccgcccuggagaacgccgccaagcagaccuggcgccucgcgcgggagauccugacgaaccccaagagccuggagaagcucuga

SEQ ID NO: 32570 - RNA, 1080 nt, Artificial Sequence
  derived and/or modified sequence opt1 from MAB21L2__Homo_sapiens__NP_006430
augaucgccgcccaggcgaagcugguguaccagcucaacaaguacuacaccgagcgcugccaggcccggaaggccgccaucgccaagaccauccgcgaggucugcaagguggugagcgacguccugaaggagguggaggugcaggagccccgguucaucuccagccuguccgagaucgacgcgcgcuacgagggccucgaggucaucagcccgacggaguucgagguggugcuguaccugaaccagaugggggucuucaacuucguggacgacggcucccuccccgggugcgccgugcugaagcugagcgacggccggaagcgcuccaugagccucugggucgaguucaucaccgccuccggguaccugagcgcccggaagauccgcucccgguuccagacccugguggcgcaggccguggacaagugcagcuaccgcgacgucgugaagaugaucgccgacaccuccgaggugaagcuccggauccgcgagcgguacgucgugcagaucacgcccgccuucaagugcaccggcaucuggccccgcagcgccgcgcaguggccgaugccccacauccccuggcccggcccgaaccggguggccgaggucaaggccgagggguucaaccugcuguccaaggagugcuacagccucaccggcaagcaguccagcgccgaguccgacgccugggugcugcaguucggggaggcggagaaccgccugcucaugggcgggugccggaacaagugccugagcgugcugaagacccuccgcgaccggcaccuggagcugcccggccagccccucaacaacuaccacaugaagacgcugcugcucuacgagugcgagaagcacccccgcgagaccgacugggacgagagcugccugggcgaccggcugaacgggauccuccugcagcugaucuccugccuccagugccgccgcugcccgcacuacuuccugcccaaccuggaccucuuccagggcaagccccacagcgcccuggaguccgccgccaagcagaccuggcggcuggcccgcgagauccucaccaaccccaagagccuggacaagcuguga

SEQ ID NO: 32571 - RNA, 1089 nt, Artificial Sequence
  derived and/or modified sequence opt1 from MAB21L3__Homo_sapiens__XP_011538928
augaaguaccugaccgugggcgaccucgaggacugccugcugaacaaggucgaccuccgccggcagcagaucagccaggccguggaggaggugcagaaggucgugcaccaccugaccacgaacaucuccaaccaggacauccgcuuccaggccgugcccuacagcgacaccuacaacgagaacaucaagguccuggcgccgucccaguuccucgugaccgugcccaucaaggggcuggccggcuaccgggaggcccgcgagcagcacuggcgguacuacacccugcaggggacgcgccuccccugcccccugcgggacccggagggccugcagcaguggcucgaggucgagcaguucaugaagucccuguggcaguggcacgagaccgacgugaacaucgacggggacaucgugcccgccaagguccugcucguguuccgcaagcugguggagaacgccguccggaccugccaccugagcggcaaggugagccuccugggcaaccgcuccgcggugugggucgccguggagaccagcgccuaccagguggagcuggagcucguccccgccguggagauccccacgaccugguccaagaaggcgcgguggccgcgcugccugcagcgguggcccagccaggagcgcguggagugcaucaaguccuucggguucaaccugcucgccugcagcaacuaccacuggcagcuguccuuccugcgggccgagcagguccuccuggagcagcuggacgaggacggcgggugccgccggaagugcuuccaggugaugcgccaccucaaggaggacaucuggugccccggcaaccggcccgucaucaccagccaccaccuccagaccgugcuguucuggacgugcgagaaguacccgcacuucaaggacuggcaggucuucuccaaggccuuccugcgccuggugcggaagcugcacaagugcgugagccagcacuuccucaagcacuacuucgugcgcaacuccaaccuguuccagugcaccaaccccaccgagcuggacaccgucgcccagaagcucgcgacguuccugaagaacccccagaucgggcccccguga

SEQ ID NO: 32572 - RNA, 2559 nt, Artificial Sequence
  derived and/or modified sequence opt1 from MACC1__Homo_sapiens__NP_877439
augcugaucaccgagcgcaagcacuuccggagcggccgcaucgcccaguccaugagcgaggccaaccucaucgacauggaggcggggaagcuguccaagagcugcaacaucaccgagugccaggaccccgaccugcuccacaacuggccggacgccuucacgcugcggggcaacaacgccuccaagguggccaaccccuucuggaaccagcugagcgccuccaaccccuuccucgacgacaucacccagcugcgcaacaaccggaagcgcaacaacaucagcauccugaaggaggaccccuuccucuucugccgggagaucgagaacgggaacuccuucgacagcuccggcgacgagcuggacguccaccagcugcuccgccagaccagcucccggaacagcgggcgcuccaagagcguguccgagcugcuggacauccucgacgacaccgcgcacgcccaccagagcauccacaacuccgaccagauccugcugcacgaccucgaguggcugaagaacgaccgggaggccuacaagauggccuggcugagccagcgccagcucgcgcggagcugccuggaccugaacacgaucucccagagcccgggcugggcccagacccagcucgccgaggugaccaucgccugcaaggucaaccaccagggcggguccgugcagcugcccgagagcgacaucaccgugcacgucccccagggccacguggccgugggggaguuccaggaggucucccugcgcgcguuccucgacccgccccacaugcugaaccacgaccugagcugcacggugagcccccuccuggagaucaugcugggcaaccucaacaccauggaggcccugcugcucgagaugaagaucggggccgaggugcggaaggaccccuucucccaggucaugaccgagauggugugccugcacucccugggcaaggagggccccuucaaggugcucagcaacugcuacaucuacaaggacaccauccaggucaagcugaucgaccugucccaggugauguaccucguggucgccgcccaggcgaaggcccugccgagccccgccgccacgaucugggacuacauccacaagaccaccuccaucgggaucuacggccccaaguacauccaccccagcuucaccguggugcugacggucugcgggcacaacuacaugccgggccagcucaccaucuccgacaucaagaagggcgggaagaacaucagccccgugguguuccagcuguggggcaagcaguccuuccugcucgacaagccccaggaccugagcaucuccaucuucagcugcgaccccgacuucgaggucaagaccgagggggagcgcaaggagaucaagcagaagcagcuggaggccggcgaggugguccaccagcaguuccuguucagccucguggagcaccgggagaugcaccuguucgacuucugcgugcaggucgagccgcccaacggggagcccguggcgcaguucuccaucaccacgcccgacccgacccccaaccugaagcgccucagcaaccugcccggcuaccugcagaagaaggaggagaucaaguccgcgccccucagcccgaagauccuggugaaguaccccaccuuccaggacaagacccugaacuucuccaacuacggcgucacgcucaaggccgugcugcggcagagcaagaucgacuacuuccuggaguacuucaagggggacaccaucgcccuccugggcgaggggaaggugaaggccaucggccaguccaaggucaaggagugguacgugggggugcugcgcggcaagaucggccucguccacugcaagaacgugaaggugaucagcaaggagcaggucauguucauguccgacagcguguucaccacccggaaccugcuggagcagaucgugcucccccugaagaagcugacguacaucuacuccgucgugcucacccuggugagcgagaaggucuacgacuggaaggugcuggccgacgugcucggguacucccaccugagccuggaggacuucgaccagauccaggccgacaaggaguccgagaaggucagcuacgugaucaagaagcucaaggaggacugccacaccgagcgcaacacccgcaaguuccuguacgagcugaucguggcccuccugaagauggacugccaggagcuggucgcccggcucauccaggaggcggccgugcugacguccgccgugaagcugggcaagggguggcgcgagcucgccgagaagcugguccggcugaccaagcagcagauggaggccuacgagaucccgcaccgcggcaacaccggggacguggcgguggagaugauguggaagcccgccuacgacuuccucuacaccuggagcgcccacuacggcaacaacuaccgggacguccugcaggaccugcagagcgcccucgaccgcaugaagaaccccgugacgaagcacuggcgggagcugaccggcgugcugauccucgucaacucccuggaggugcugcgcgugaccgccuucagcaccuccgaggaggucuga

SEQ ID NO: 32573 - RNA, 978 nt, Artificial Sequence
  derived and/or modified sequence opt1 from MACROD1__Homo_sapiens__NP_054786
augagccugcagucccgccucagcggccggcuggcccagcugcgcgccgcggggcagcuccuggugcccccgcggccccgccccggccaccuggccggggccacccggacccgcuccagcacgugcgggcccccggccuuccucggcgucuucggccggcgcgcccggaccuccgcgggcgugggggccuggggcgccgccgcgguggggcgcaccgccggcguccggaccugggcgccccuggccauggccgccaagguggaccugagcacguccaccgacuggaaggaggccaagagcuuccucaaggggcuguccgacaagcagcgcgaggagcacuacuucugcaaggacuucgugcggcugaagaagauccccaccuggaaggagauggccaagggcgucgccgugaagguggaggagccccgcuacaagaaggacaagcagcucaacgagaagaucagccugcugcgguccgacaucaccaagcucgaggucgacgccaucgugaacgcggccaacagcucccugcugggcgggggcgggguggacggcugcauccaccgcgccgccggcccgcuccugacggacgagugccggacccugcagagcugcaagaccgggaaggccaagaucaccggcggguaccgccuccccgcgaaguacgucauccacacggugggccccaucgccuacggggagcccuccgccagccaggccgccgagcugcgguccugcuaccugagcucccucgaccugcugcucgagcaccgccugcggagcguggcguucccgugcaucagcaccggcgucuucggcuaccccugcgaggccgccgccgagaucgugcuggcgacccuccgcgaguggcuggagcagcacaaggacaagguggaccgccugaucaucugcgucuuccucgagaaggacgaggacaucuaccggucccgccugccccacuacuuccccguggccuga

SEQ ID NO: 32574 - RNA, 642 nt, Artificial Sequence
  derived and/or modified sequence opt1 from MACROD2__Homo_sapiens__NP_001028259
augaacgaguucuucagcguggacgacaacaacgaggaggaggaggacgucgagaugaaggaggacuccgacgagaacggccccgaggagaagcagagcguggaggagauggaggagcagucccaggacgccgacggggugaacaccgucaccgugccgggccccgccagcgaggaggcgguggaggacugcaaggacgaggacuucgccaaggacgagaacaucacgaagggcggggaggucaccgaccacuccgugcgcgaccaggaccaccccgacgggcaggagaacgacagcaccaagaacgagaucaagaucgagaccgagucccagagcuccuacauggagacggaggagcugagcuccaaccaggaggacgccgugaucgucgagcagcccgaggugaucccgcucaccgaggaccaggaggagaaggagggcgagaaggcccccggcgaggacacgccccggaugcccggcaagagcgagggguccagcgaccuggagaacaccccggggcccgacguggagaugaacucccaggucgacaaggugaacgaccccaccgagagccagcaggaggaccagcugaucgccggcgcgcaggacgaggccaaggagcagcgcaacgggaccaaguga

SEQ ID NO: 32575 - RNA, 2157 nt, Artificial Sequence
  derived and/or modified sequence opt1 from MAD1L1__Homo_sapiens__NP_001291452
auggaggaccugggcgagaacaccauggugcucagcacccugcgcucccugaacaacuucaucagccagcgggucgagggcggguccgggcucgacaucagcacguccgcccccggcagccugcagaugcaguaccagcaguccaugcagcuggaggagcgcgccgagcagauccggagcaagucccaccucauccagguggagcgcgagaagaugcagauggagcugagccacaagcgggcgcgcguggagcuggagcgggccgccuccaccagcgcccgcaacuacgagcgggaggucgaccgcaaccaggagcuccugacccggauccgccagcugcaggagcgggaggccggggcggaggagaagaugcaggagcagcucgagcgcaaccggcagugccagcagaaccuggacgccgccuccaagcgccugcgggagaaggaggacagccucgcccaggcgggcgagaccaucaacgcccugaagggccgcaucuccgagcugcaguggagcgugauggaccaggagaugcgggugaagcgccucgaguccgagaagcaggagcugcaggagcagcuggaccuccagcacaagaagugccaggaggccaaccagaagauccaggagcugcaggccagccaggaggcccgggcggaccacgagcagcagaucaaggaccuggagcagaagcucucccugcaggagcaggacgccgccaucgucaagaacaugaaguccgagcuggugcgccucccgcgccuggagcgggagcugaagcagcuccgcgaggagagcgcccaccuccgggagaugcgcgagacgaacgggcugcugcaggaggagcuggagggccugcagcggaagcucgggcgccaggagaagaugcaggagacccuggugggccuggagcucgagaacgagcggcugcuggccaagcuccagagcugggagcgccuggaccagaccauggggcugagcauccggacccccgaggaccucucccgcuucgucguggagcugcagcagcgggagcuggcgcucaaggacaagaacagcgccgugacguccagcgcccgcggccuggagaaggcccggcagcagcugcaggaggagcugcgccaggucuccggccagcuccuggaggagcggaagaagcgcgagacccacgaggcccuggcgcggcgccuccagaagcgggugcugcugcucaccaaggagcgcgacgggaugcgcgccauccugggcagcuacgacuccgagcugacccccgccgaguacagcccccagcucacgcggcgcaugcgggaggccgaggacauggugcagaagguccacucccacagcgccgagauggaggcgcagcugucccaggcccuggaggagcucgggggccagaagcagcgcgccgacaugcuggagauggagcugaagaugcucaagagccaguccagcuccgccgagcagagcuuccuguucucccgggaggaggcggacacccugcgccucaagguggaggagcuggagggcgagcggagccgccuggaggaggagaagcggaugcucgaggcccagcuggagcgccgggcccugcagggggacuacgaccagagccgcaccaaggugcuccacaugucccugaacccgaccagcgucgcccggcagcgccugcgggaggaccacucccagcuccaggccgagugcgagcgccugcggggccugcuccgcgcgauggagcgcgggggcacggugcccgccgaccuggaggccgccgccgcgagccugcccuccagcaaggagguggccgagcucaagaagcaggucgaguccgccgagcugaagaaccagcggcugaaggagguguuccagaccaagauccaggaguuccggaaggccugcuacacccucaccggguaccagaucgacaucacgaccgagaaccaguaccgccugaccagccuguacgccgagcaccccggcgacugccucaucuucaaggcgaccuccccgagcggcuccaagaugcagcugcuggagacggaguucagccacaccgugggggagcucaucgagguccaccuccgccggcaggacuccauccccgccuuccugagcucccugacccuggagcuguucagccgccagaccguggccuga

SEQ ID NO: 32576 - RNA, 921 nt, Artificial Sequence
  derived and/or modified sequence opt1 from MAD2L1BP__Homo_sapiens__NP_001003690
auggcccgcgugccccugggccggagccucacccuguccccgcgccuggagcacaacgggaugaccagcgcccaccacaacuuccggcuccccggcucccgcgacagccccgcguccgccagccaggucgccgagaucaucgaccuggagugguacgagaaguccgaggagacgcacgccagccagaucgagcugcucgagaccuccagcacccaggagccccugaacgccuccgaggcguucugcccgcgggacugcauggugcccguggucuuccccgggcccgugagccaggagggcugcugccaguucacgugcgagcugcucaagcacaucauguaccagcgccagcagcugccgcugcccuacgagcagcucaagcacuucuaccggaagcccagcccccaggccgaggagaugcugaagaagaagccgcgcgccaccaccgagguguccucccggaagugccagcaggcccuggcggagcucgagagcguccugucccaccuggaggacuucuucgcccgcacccucgugccccgggugcugauccugcucgggggcaacgcccugagccccaaggaguucuacgagcuggaccucucccugcuggcccccuacagcgucgaccagagccucuccaccgccgcgugccugcgccggcuguuccgcgccaucuucauggccgacgccuucagcgagcuccaggccccgccccugaugggcacgguggugauggcgcaggggcaccggaacugcggcgaggacugguuccgccccaagcugaacuaccggguccccucccgcgggcacaagcucaccgugacccugagcugcggccggccguccauccgcaccacggccugggaggacuacaucugguuccaggcccccgugaccuucaagggguuccgggaguga

SEQ ID NO: 32577 - RNA, 618 nt, Artificial Sequence
  derived and/or modified sequence opt1 from MAD2L1__Homo_sapiens__NP_002349
auggcccugcagcucagccgcgagcagggcaucacccugcggggguccgccgagaucguggcggaguucuucagcuucggcaucaacuccauccuguaccagcgcgggaucuaccccagcgagaccuucacgcggguccagaaguacggccucacccugcuggugaccaccgaccucgagcugaucaaguaccugaacaacguggucgagcagcucaaggacuggcuguacaagugcuccgugcagaagcugguggucgugaucagcaacaucgaguccggggaggugcucgagcgcuggcaguucgacaucgagugcgacaagacggccaaggacgacagcgccccgcgggagaagucccagaaggccauccaggacgagauccgcagcgucauccggcagaucaccgccaccgugaccuuccugccccugcucgagguguccugcagcuucgaccugcugaucuacacggacaaggaccucgucgugcccgagaagugggaggaguccggcccccaguucaucaccaacagcgaggaggugcgccugcgguccuucaccaccacgauccacaaggucaacagcaugguggcguacaagaucccggugaacgacuga

SEQ ID NO: 32578 - RNA, 636 nt, Artificial Sequence
  derived and/or modified sequence opt1 from MAD2L2__Homo_sapiens__XP_011538809
augaccacccugacgcgccaggaccucaacuucggccagguggucgccgacgugcugugcgaguuccuggagguggccguccaccucauccuguacgugcgggagguguaccccgucgggaucuuccagaagcgcaagaaguacaacgugccggugcagaugagcugccaccccgagcugaaccaguacauccaggacacccuccacugcgucaagccccugcuggagaagaacgacguggagaagguggucguggugauccucgacaaggagcaccggcccgucgagaaguucguguucgagaucacccagccgccccugcuguccaucagcuccgacagccuccugucccacguggagcagcugcuccgcgcguucauccugaagaucagcgucugcgacgccgugcuggaccacaacccgcccggcugcaccuucacggugcucguccacacccgggaggccgccacccgcaacauggagaagauccaggugaucaaggacuuccccuggauccuggccgacgagcaggacgugcacaugcacgacccccggcugaucccccucaagaccaugacguccgacauccugaagaugcagcuguacgucgaggagcgcgcgcacaaggggagcuga

SEQ ID NO: 32579 - RNA, 1149 nt, Artificial Sequence
  derived and/or modified sequence opt1 from MADCAM1__Homo_sapiens__NP_570116
auggacuucggccuggcccuccugcuggccgggcuccugggccugcuccuggggcagagccuccaggugaagccccuccaggucgagccgcccgagcccgugguggcggucgcccugggcgccucccgccagcugaccugccggcucgccugcgccgaccgcggggcgagcgugcaguggcggggccuggacaccucccugggcgccgugcagagcgacacggggcgcuccguccucaccgugcggaacgccagccuguccgccgcgggcacccgcgugugcgucgggagcugcggcgggcggaccuuccagcacacggugcagcugcucguguacgccuuccccgaccagcugaccgucuccccggccgcccuggugcccggcgaccccgagguggccugcaccgcgcacaaggucacccccguggacccgaacgcccucagcuucucccugcuggugggcgggcaggagcucgagggcgcccaggcccuggggcccgagguccaggaggaggaggaggagccccagggcgacgaggacgugcuguuccgcgugacggagcgguggcgccugcccccgcugggcacccccgucccgcccgcccuguacugccaggcgaccaugcggcuccccgggcuggagcugagccaccgccaggccauccccgugcuccacucccccaccagccccgagccgcccgacacgaccucccccgagagccccgacaccaccuccccggagagccccgacacgaccucccaggagccgcccgacaccaccagccccgagccgcccgacaagacgagccccgagcccgcgccccagcagggcuccacccacacgccccggagcccgggguccacccgcacccggcgccccgagaucagccaggccggccccacccagggggaggugauccccaccggcuccagcaagccggccggcgaccagcugcccgccgcccuguggaccuccagcgccguccucgggcugcugcuccuggcccugcccacguaccaccucuggaagcggugccgccaccuggccgaggacgacacccacccgcccgcgucccugcggcuccugccccaggugagcgccugggccggccugcgcgggaccggccaggucgggaucucccccagcuga

SEQ ID NO: 32580 - RNA, 4746 nt, Artificial Sequence
  derived and/or modified sequence opt1 from MADD__Homo_sapiens__NP_569831
auggugcagaagaagaaguucugcccccgccugcucgacuaccuggucaucgugggcgcccggcacccgagcuccgacagcguggcccagacccccgagcugcuccgccgguacccccuggaggaccacaccgaguucccccugccgcccgacgucguguucuucugccagcccgaggggugccucuccgugcgccagcggcgcaugagccugcgggacgacacguccuucgucuucacccugaccgacaaggacaccggcgugacgcgcuacgggaucugcgugaacuucuaccggagcuuccagaagcgcaucuccaaggagaagggcgagggcggggcgggcagccgggggaaggagggcacccacgcgaccugcgccuccgaggagggcgggaccgagagcuccgagagcggguccagccuccagccccuguccgccgacagcacgccggacgucaaccagagcccccgcggcaagcggcgcgccaaggccggcagccggucccgcaacagcacccugaccagccucugcgugcugucccacuaccccuucuucagcaccuuccgggagugccuguacacgcucaagcgccugguggacugcugcuccgagcggcugcucgggaagaagcugggcaucccccgcgggguccagcgggacaccauguggcgcaucuucaccggcagccugcucguggaggagaaguccagcgcccugcugcacgaccuccgcgagaucgaggccuggaucuaccggcugcugcgcuccccggugcccgucagcggccagaagcggguggacaucgaggugcucccccaggagcugcagcccgcccugaccuucgcgcucccggaccccucccgcuucacgcuggucgacuucccccugcaccucccccuggagcugcucgggguggacgccugccuccaggugcugaccugcauccugcuggagcacaaggucgugcugcagagccgggacuacaacgcccucuccaugagcgugauggccuucgucgccaugaucuacccgcuggaguacauguuccccgugaucccccugcucccgaccugcauggcguccgccgagcagcugcugcucgcccccacccccuacaucaucggcguccccgccagcuucuuccuguacaagcuggacuucaagaugcccgacgacguguggcugguggaccucgacuccaaccgcgucaucgccccgacgaacgcggaggugcugcccauccugcccgagccggagagccucgagcugaagaagcaccugaagcaggcccucgccuccaugagccugaacacccagcccauccugaaccucgagaaguuccacgaggggcaggagaucccccugcugcucggccggcccuccaacgaccugcagagcaccccgagcaccgaguucaacccccugaucuacgggaacgacguggacuccgucgacguggccacgcgcguggccaugguccgguucuucaacagcgcgaacgugcuccagggcuuccagaugcacacccgcacccugcggcuguucccccgccccguggucgccuuccaggccggcuccuuccucgccagccggccgcgccagacccccuucgccgagaagcuggcgcggacgcaggccguggaguacuucggggaguggauccugaaccccaccaacuacgccuuccagcgcauccacaacaacauguucgaccccgcccucaucggcgacaagccgaagugguacgcgcaccagcugcagcccauccacuaccggguguacgacuccaacagccagcuggccgaggcccucuccgucccgcccgagcgcgacagcgacuccgagcccaccgacgacagcggguccgacagcauggacuacgacgacuccagcuccagcuacuccagccugggcgacuucgugagcgagaugaugaagugcgacaucaacggggacacccccaacguggacccccugacgcacgccgcccucggcgacgcguccgaggucgagaucgacgagcugcagaaccagaaggaggccgaggagcccggcccggacagcgagaacucccaggagaacccgccccugcggagcuccagcuccaccaccgccagcuccagccccuccaccgugauccacggggccaacagcgagcccgccgacuccacggagauggacgacaaggcggccgugggcgucagcaagccccuccccuccgugccgcccagcaucgggaaguccaacguggaccgccgccaggccgagaucggcgaggggagcguccggcgccggaucuacgacaaccccuacuucgagccccaguacggcuucccgcccgaggaggacgaggacgagcagggcgaguccuacacgccccgcuucagccagcacgugagcgggaaccgggcccagaagcugcugcgccccaacucccuccggcuggccagcgacuccgacgcggagagcgacucccgcgccagcuccccgaacagcaccguguccaacaccagcaccgagggcuucgggggcaucauguccuucgccagcucccuguaccggaaccacagcaccuccuucagccucuccaaccugacccugcccaccaagggcgcccgcgagaaggcgacccccuuccccagccucaaggucuucgggcugaacacgcugauggagaucgugaccgaggccggcccgggguccggcgaggggaaccggcgcgcccucguggaccagaaguccagcgucaucaagcacucccccaccgugaagcgggagccgcccagcccccagggccgcuccagcaacuccagcgagaaccagcaguuccugaaggaggugguccacuccgugcuggacggccagggggugggcuggcucaacaugaagaagguccggcgccugcuggagagcgagcagcuccggguguucgugcuguccaagcugaaccgcaugguccagagcgaggacgacgcccggcaggacaucauccccgacguggagaucucccgcaagguguacaaggggaugcucgaccugcugaagugcaccguccucagccuggagcaguccuacgcccacgcgggccucgggggcauggccagcaucuucggccugcuggagaucgcccagacgcacuacuacuccaaggagcccgacaagcggaagcgcagccccaccgaguccgugaacaccccgguggggaaggaccccggccuggccgggcgcggcgaccccaaggccauggcgcagcuccgggucccccagcuggggccgcgcgcccccagcgccaccggcaagggccccaaggagcuggacacgcggucccucaaggaggagaacuucaucgccagcaucgagcuguggaacaagcaccaggaggugaagaagcagaaggcccuggagaagcagcgccccgaggugaucaagccggucuucgaccucggggagaccgaggagaagaagucccagaucagcgcggacagcggcgugucccugaccagcuccagccagcggaccgaccaggacuccgugaucggggucagccccgccgugaugauccgcuccagcucccaggacagcgaggucuccacgguggugagcaacuccagcggcgagacccugggggccgacuccgaccucagcuccaacgccggcgacggccccgggggcgaggggagcguccaccuggcgagcucccggggcacccugagcgacuccgagaucgagaccaacagcgccacguccaccaucuucggcaaggcccacagccucaagccguccaucaaggagaagcuggccgggagccccauccgcaccuccgaggacgugagccagcggguguaccuguacgagggccuccuggggcgcgacaagggcuccaugugggaccagcuggaggacgccgcgauggagaccuucagcaucuccaaggagcggagcacgcucugggaccagaugcaguucugggaggacgccuuccuggacgccgucaugcuggagcgcgaggggaugggcauggaccagggcccccaggagaugaucgaccgguaccucucccugggggagcacgaccgcaagcggcuggaggacgacgaggaccgccuccuggccacccugcuccacaaccugaucagcuacaugcugcucaugaaggugaacaagaacgacauccggaagaaggugcgccggcugaugggcaagucccacaucgggcuggucuacagccagcagaucaacgaggugcucgaccagcuggccaaccugaacggccgcgaccuguccaucuggagcagcgggucccgccacaugaagaagcagaccuucgugguccacgcgggcaccgacacgaacggcgacaucuucuucauggaggugugcgacgacugcgugguccuccggagcaacaucgggaccguguacgagcgcuggugguacgagaagcugaucaacaugaccuacugccccaagaccaaggugcugugccucuggcggcgcaacggcuccgagacgcagcugaacaaguucuacaccaagaagugccgggagcuguacuacugcgucaaggacagcauggagcgcgccgccgcccggcagcaguccaucaagccggggcccgagcucggcggggaguuccccgugcaggaccugaagaccggcgagggcgggcugcuccaggugacccuggagggcaucaaccugaaguucaugcacaaccaguuccucaagcugaagaagugguga
